United States Patent 8,781,750 (CELL-TYPE-SPECIFIC PATTERNS OF GENE EXPRESSION) - sequence listing, part 59

SEQ ID NO: 38635 - DNA, 246604 bp, Homo sapiens
tcagacatggcggcggatctgaacctggagtggatctccctgccccggtcctggacttacgggatcaccaggggcggccgagtcttcttcatcaagtaaagagccggggacggcacgggggcccgcgggggcgggagggcaggaggcgggcggctggcgacacgggggagagcccgggtctgtgctcctgcagcccctcggctcgcccccgcgtcccctctcacgctccgtgtctgccccttctctcacccctgcagcgaggaggccaagagcaccacctggctgcaccccgtcaccggcgaggcggtggtcaccggacaccggcggcagagcacaggtaacgccgggcccaaacggagttgggctccgcctggaggaggcggcagagcccgggccgcccggctccccgcaacctgccccgcgccgcgggccccgggaggcggcgaggcggggcggaggccgggcgggagcggccgcaggtagaggggccacggggactccgccgccgggagttctctccagtctcggggcgcctctttctcctcagcctttcatcagcacttggagacggcgccctcttcctgcgccttctccccccatcccagcctagacgaccctcgcgaccctagagtggcgacgctcccctccctgaaacctggagtcctgagtttttcctccgcggccgctactcactccccggtgacccccagctgccgtcttgccccccagcaatcttcaggcagtccttacccactcccctccctgcagccccggaccccgatcgcccgccgggataacgtaaccacatcctccccctcctcccaggagcgctgcctcctgccgtgcagcttcctcctcctaggtgggacttgtgggtaggtggctgatgaaggaggaggaggaggaggagaggagttcgggggtgctgcgatcctctctgtgacagggaacggctcgggaaacgcttggcgcgttccctcctgccacgggaggagcagccggagccggaggaggcgttcgcagcctcagttgctggcgatccggatctaaagtccccgccagccgcacggaggttgcacagactgccaggaggcggtgggcgtgcgagggggtgtcccgtatgggggcacccgggccctgtttggagggagtccgtggggaagcggctctctcgggtggctttgggagcttgtttgaatgctaagtgtgagtggagctggaaaaggctcctcgtagtttctgtactggtctgggtttcttttatcattctttgtttacattcgtgacttgtttgtctttgaaatgtaacatgtgttctcttactggcctgcctctagtcctggtgattggaaaggcttgagagcagtttgggtcgaaggcgaggccagtttcagcagtcctcagagctggcctctggggtacattctctcggactctgacattccgtgaatctgttaaagttgccaggatattgaacaaacctgcctctctgtgaaatgctggagttcactgaagtgactaatgtctccaaatttgcaaaaaggtggaggaagaaaggaaaggctggtgtagcaagcatgatgagcttacatttttaaggcatttctgactaatacactatcatgtttctcaattccccggtgcaggcttttgcttcaatatacctttctggtgttttacacgcatattccaactttgatggcctctttgcttttatggataatgatagatttatttcatgaaagacgatatgacatttaaattatttagactaattatcctatggaattatgagtgatataaataagtgtcctagttaaccccacagatttggtaacattcacgccacagaaaaattttattcttttatgtgatttcacttttttttttttctggtttggttttactttgcttggactctggttttgtacacacatcggttgtttttacttccaagaggcattttgatgaaatccaaacaacttgtcattaataataatatgtagcacataatgaccattgttcacctgaatcatccccaactttactacttgaaacttcacgtctcttagtcaaatttttagaaacacacacggaagtattcggtgtcatttcttttccattaattaagtagttaggaagttctgccttctttttggtgacacttcctagatggattcatttgtgtagctgaaaaatacggtcttaaatagacacaatatacccaagaagaggcaggcgttgcctgttatacccagcttttttttttgctagtcattcatgagtgttccacctgggatgagaaggcttccctttgctttcttgggtgccagaacatagttcctctccaccctaatatattacagtgtgtgctcaggtcagataatctctaatattatggttacttttctggtggctctaaatttgaattgctgtttttcaaaaaatgatatctgttgtattgccagctcaacactttttttgttagtaatctacttaattaaaacagctaataaatgaaaatggataattaaaatggattgagacttattttgctatcattgaagtaatactaattgtaatatatgtattgttttagatttgcctactggctgggaagaagcatatacttttgaaggtgcaagatactatataaagtgagttttttgactttcatttttttccttcgtaattagaatgctgtgattactcctcagctgaatagttgtatgtccagtcttgatcatgattttctgaagtttatcatataatggtgactgtattctttattttgtatagtgtcagaattttgagagaagaaaatggcactcttacttttctaatgttatttgcctggaatattcatcgattcattgatttggaaattagatcatttatggccacttttaaaaataattttgtatcttcgtttttttcttttggaatcgtccagcttcatcagaatatgaccacaattacctttttttttttttttttttggtgcttctgtgtatattcctgggtaatagaggattattggtcattagctatgtggtacttaaagttttgatctttgattatctgtgctgagagataacaaacaaaaaaaaatctgagttacgtgaacatcttttttttttttttttttttagtgaaccttgttcatgtatattttgaccagggctgtttataggtagcaaaagtgatgtaaagctaggcacaatttgataaacaatgacggtcagggagtaaaaatagaaatagttactgaatatttcatgagcatatattggagcattgtttgtatttttgcctcagtttatttaaatatgtctaagtcaagatgttttattgatatgtttgtttaaaaaaggcttttagtagagcttgagagaaaagatgaccagtcagtcccaatcttaaaaccagttctttagaatattaaactaatttatgttcaaacttaataacttagtactacttggagacaaatacaaagctggaggtcaacatcatgtaggaaaaattttaatcccccaacgaaaaatatgggtggttttgtctttttatttttatattagaaactatttacctaagagtttgtttttattgtttaaccttatttgttctttaattttaataaactgagacatgaaagagaatgctgaaatgccaaactgggttaagacttcagtagtttataaacaataacagatacctagctaaagttacctttatttcattgagcctagaaagttatttttactgtgacatttttaagatcatgttatacttccagtaaattataattacctgtatggttctttaatcttttagaaagatacttagataaaacgtcaagggcttttttataagtattaggaatgcttgcttttggatgtagaaatagagaaagcagaagatacaggaatggaatagtttcatggtatggtctttctgtgaatatttttgggtgaaatcttttctttggagattatactatacattattagatggcctaaaaaaatacttgagtgaaatgcagtcatcaaatgtttttctattggttatttccatcctaaattaaagtgagttgatattgccacgaaaagggatacttcttttcttgtcaagctagtagtatggtatatgtgaagaaaaacagttttttcatttcaggtcatttattcaatgtaattttgactactgtacattaagcctagctcatcttataaaaacagaggtaacatttcaattttcaataacattttaatttctttgcgtgcattcttggatgaatgtttatttgatagtacaaaatcttattctgtgtgggctgagtatgtatgttttaatttagaactaagctgttaggaagacattgagtgagtttcttttgttttacgagccattttgattaggttttcttttatgtttacttaaacaaattagaattttatttgagtgccatgtctaatgcctaagtaggtttctctggaaaattaagacaatattaagaaagctataataattttactttaaagacatttttaaacttgtaggttttaatcattttggtattcatagccagtaattgtgtccaaaagtagcaataaataacttataatattatggaagtaatttctcctaaaattgagcatagtgttgcatatcactcattaaacttttaaaaaaactaaccattgataaatatatgatgtactgaatgttaggtgctactgctttatcttctgggtaatgtcagaagactaatttcttttaaggttagttaaatccctaatgtgcactgtaatttcctagaaactttttacttgtttgtattgttatttatcattctaataggataggggcactacttttatcttaaactttacaatttagagtaccttcacatacattattcattcatgaagtagtcagagttactactcccattgtcacacacataataaaacagcagaaacatgcctttggaacttacagtttgcaaagacagcaggatgagaaaccccaggaacataaactatatttagaatattcagagtggaggaaaagataggagtctgaagtaggaaagtgattcgtgttggtggctatagtttttcattgtcatttctttctcagatgaagaaaggtggttattgatcaaattgtatgtaaaggaggttacagggttatcggggtggattttgttcacatgggaagtggaaagataggaatgccaataaaagacatgtcagccctttgactattcctaatcctgtgttctggaaagttctcactgcaagaagggagacctaaagaatttcagttgtttctgcttccattgtgaagtgaaatatatataactcttaaattattcctctcctggacaaatgttggttggtgttaaaaatggcaggttaccagaaagaatttatctcttaattatattttggtattgacacttgcatctctgtaggtggtaagaggagaggattgtagtggggaagtcataggaactgaaatgtggtcttgaccttaatgactttggagctcagtcttcacgtctttaaattaggttacctggaaaaggcaacctctaaattccatttctaaatttctttgaattttgtactgttctgggatttataatattctggaaaacaaggaactcacaatgccaagcagagatgatgcgggaaatatggaaagctagcttttctatccttcttaactattttatcctccctctttaagctttggatagacaatcacagataagtatgatgtatgtagtgccagggttgtgtgtactttcttttgctgctttttgtgcttacgtttccttgtaaaatgtttgtatacatatcttcatgtaaacagatagtactgctaatgtaaacaaaggacctgatcagcgtaagagttgtataggtttgagttaatcagtttattttatacactttgaaattggttctttaatacaagtttgcagctagattaaaaaaatatgtaatatagagaatgtattttccttcacatccatttggccaaaaaacagtaaaatatgaaaaatcttactttgtttttttttttttttttgaggggggtttcactgtgtcacccaggctggagtgcagtggctctatcacaacacactgcagccttgacctcctgggcttaagcgatcctcccacctcagccttacgagtagctgggaccacaagtgtgtaccaccatgcctggctaatttgattgattgattgattgagagagacagggtcttcctatgttgcccagcctgatcttgaactcctaggctcacgcaatcctcctgccttggtccccgaaaatgggggattataggcatgagccatggtgcctggccaaaaatctttatctttaaagatatttaatactttttttctgaataatttttctatgtgccctaagctagccagcctcttaattatgttactatgtgtttgtgtgtgtaaatacattacacagagtttgagtttgattattgaattttcatattgtttttataacttaatttatgctgttatctttatgaagaatgctgaaaataagtgaattttataacttgtaaagtgtggctttaaatattccgtattcttatgagaacgcaaataacttagcccataaagcacagaagaaaatcttatacgtttgagttataaagctttctgcttgctccttgaaaatattgcttaatgattctgtaatgacaggccatggtaacttaaaatggatgtgtcatttactattcctttgtgcttcaaagctttaagatggttaacttagagtgccaagtaaatcttaaggctctctgaatagtgagaaactttattctgattatttaaaggtcattgcaggactgggtatcaaaacaatatttgcgggggtaaaatagtatgcaaattttttaaggttatgttttcatactgctttttttaacttaaaattctaagttctgaaaattgaactttttcttacataggcaaatagagtatgaggttttgtttcaatatctgcaatagctggatctaatgtatgctaattccaaacttaccaaaactagcgttgcaagtaaggagaaaaatctgtttcttcagattttcacaattcaaaatatgaatgaagatggggaatctaacaagtgccataaaaaacattagaatatattaactatgtatttgatatttaaagttgttttatactttactttttttttttctttgagacggagtttcactcttgttgcccaggctggcatgatctcagctcacgcaacgtccacctcccgggttcaagcagttctcctgcctcagtctcccaagtagttgagattacaggtgcccaccaccaccacgcctggctaattttttgtatttttagtagagaaggggtttcgccacgttggccaggctggtctcaaactcctgacctcaggtgatccgcccacctcggcgtcccaaagtgctgggattaccaccacccctggccaaaaactgttttatactttctataataatataaccaaattttgattactagagctatataattctttagaacactttgtgggcattatatttcttttccatatttataacaagagttttggactgttaatatgtgattccttacattgataaagcactttatgctaattcattagttacaaaacaactacgaactatgatctcagctttcaaggagtttgtagtgtagagataaatatgcagtatattaaaacagggagatggtttggggaacatagacttatttagtgctaggcacttcagcatagcattaaactcctataatcctcacaatagcctttttgttgttgttgtctctttcgttttcaagttggtgtgccaggactaccagcctcagtagactttgttgtggaattcttttatttttagccccaggaccactgcttagggccaggtttgctcaatatcctccttgtatttcctgtgatgcccagcatctagtcagcctctaaagaagtggtatctgtgatgatgatgatgctggctcctagttatttaaggagttaatcaagatggggaaagaatagtccccacaactcaagtggttgcattttaagaacactttctggatttgtcaagggactttttcttccctaatctggatagaccccttcgtttcttcttattctcaaagctggcctatatttaggaagggggaggaagtggtcaatacaaaaacacaaaaagtattggaagagttgaagagtcgatgacctggagacagggccttacataggacctgtctgtcctatacaggatggaatttctttgaatttgttagcagatgctcttttcttgtgactgtttcatttttttaaataacagataaatataagatgaaattaagggtgaaaagttatgtgtatatgtgtatgtgtaagttagagttaatggtgtaaaaaaatggcacggcatggtggctcatgcctgtaatcctagcaccttgggaggctgaggcaggcggatcacttgaagtcaggagtttgagaccaacctggctaacatggtaaaaccctgtctctactaaaaatacaaaaattagccgggtgtggtggcgggctcctgtagtcccagctactcgggaggctgaggcaggagaatcgcttgaacccaggagggagaggttgcagtgggccgagatcacgccactgcactccagcctgggtgacagagtaagactctgtctcaaaaaaaaaaaaaaaagaagatgctagtttgagtcataagaattcagaggaggaagaggcagcctaggctgggctgccctggaacgacttgaagaggtgggagttgagctaggcctgagggtatagatgggattcactttcagatgagttgataagactgggaggatacattcatggggctgggaacacgtataatatgtgaatatgtgtgatgagtaatactaactaggcttgttagtgatggttctgtagaaaatgctaggatgatgggaggtgagtctaggaatgctgtttggaaccatactgtgtccggtctttgaatgtcaggctgaggtttttattttccgggcaagcctttgcagatgttttttagtatagcgttaattatgcaacatgaaggttttagggagatttcaatacaggcagcatggattggacaggagcaaagtgggaatcaaggagaccatttctgagtctgttgccataattgggtagttacttgaactaagtttgtggcagcgggaatggaaaggaaaggccattgatcaaagatgttaaagacgagctgacaggccttaggagtcttgctgagcaaggaggttgacagaaaaaaagaggtcaaaagctcctcaaagcctttgtgtctgagtgtctacaagaatgatgatgagacccttgaccggaataaaggagtaggtgtgggagggggagccccaggtggacatattaatggtggtttggtttttgagctgcttgagaggacatagcatttcaggtggctaaaatccgactttcacaaaggactcctgacattatctttttactcccctcaaaaagcaaacacaacccactcccctatcctatctcagctacctaaatgactatctagctatttatagattcaggctgggaatttcatattcatccatctaattattcattcaacaaatgcttattgaatatttactgtgtgccaagtgctttaagctttatgaatgaaacagacatggacactactcttaagaactttatagttgaattagtgggggagccagtaataaaataatcatgcaaatatgtaagatagactgtgataaatgctatgaagaatatctaatgttttgactacgtatattgaaaggccttagcccgttgtgggggttgctgggagaggcatttctcacagttaagctccaaacccctgcagagtggatcagaatagagcagtgtaaagtcactggaaagatgaagaataaatagcctcctggtcttgagattggaccacaacctgagtgaaagcattgctatatataaagaaagacttgggggatggggttggtatggtatggcaatttatgaaaaggagaaagctgctgcagaagctgctctttatcatccaatagataacaatgtttagccaactgattttaatgattatctcagtcccagtggcaaggtcttccaattagtcactcactcatgtgttcttccaattctcttgaatacattttgaactcatagttgtgtgccttagtgattagtgtacatcagtaaatgaaataaaccaaaaaattctgcccgtctggggagtgggatgatgggggagagaatgtcaaagtaaacaataaataagtacattttatagtatgttagactacacataaatcctctaagcaaaaagtctactttttaagtctactttggtttcaagaaaacaaggaaatatattactgaagtctgtactatcgtgattagtatggaagaagtgaatgtagactaaattttaaaatactgaaatcagtgggtccagtagaaacccaaaagaaataaagaggtcctcatgaggtacagatgatagacatttcagagccactgggggaacatcttggccactaaggagtgtcctctgaactacttaggaattatgctctgaagtgaccagtaagccacccacaccaagagaatcttttggactattaggtctcagaaggcagagatagtcttatactgtagccacctttatgcttccagtgcctggcatgtaatagacaattaggtgtttgaaatgaagccctaaaacaaattgtaagaaaagcaagcctctttacctaaatctgaacatcccagggcatttttttcttctcatttgtcatctagtcacaacccttgttgttgtaaaagtcactggcccaaagccaactagtataagcaaaaaggaaactattttctttttggagacagagtctcgctctgttgcctaggctggagtacagtgactcagtctcggttcactgcaacctctgcctcctgggttcaagtgattctcctgcttcagcctcctgagtagctgggattacaggtggcccgccactacgcccggctaatttttttgtatttttagtagatatgggagtttcaccatgtttggccaggctggtttccaactcctgacctcaggtcatccacctgccttggccttccaaagtgctgggattataggcatgagccaccgtgcccagccaggaaacacttcacactgatttcaagagtgatgcaagtaaattcttcaaggctcttcctcacctgctttccacccctcccccccaacagaaagcttctctttaaccagaaaaaatggttacgtgcagccccaaattacacccgtttagctttttaacctaaaatgtaagttttcttctctagttgcaaattaaaaaaatctcggacaaggacttttgactaccttggatcacatgcctgttcctagagcagacattggcctgctagtcttcagtcattgtctgtccttagctagagccaaggcactaacattggcaagccatccagaaacatacagttagagaggaaggcccagttcatcattggaagtcaagatgtgaaagactagagatcagaggtcttcttataatatagtgcaaaatgcctaaaggccagggagacctgagcatctgtaaacttctgagaaaagaagtaatggtaccagtgatattcagggaagctttttgccttgtgttgcagaagtaatagttgaagttattcgggatggttcaggccaggaccagggaggatgaagagaaagtgctgaattttgaggaagaatgagtagaagccagtcctagattggctgtcctgagcaagtgagtttgaagaaactgatttagcacaagtggcagtagaacttcactgtggtggaaacctcaccctgctaggtgaggccagggattctcttcggtgcttctgaaattactggccacttgaagagtaattcccaaacagtgtcagtgcttgagtaatattgccaatgcttgcttgctatgatgctgtctacatggggagtggtttttgttccctatcccttccaaataacttggattatttacatatattgtttctttggatagacatgctctaaaaaagtttgcctctaaggtgaaaattccaactttcgctaaagtggttgaagttgcatattattaaatgttaaggccaggtgctgtggctcacgcctgtaatcccaacactttgggaggccgaggcaggaggattctttgaagccaggagttcaagaccagcctacacaacatagtgtgacccccaatctctacaaaaaaaaattgtttttttaattagctggtcatggtggtgtacccctatagtcctggttacccaggaggctgaggcagaaggattgcttgagcccaggaactcaaagctgaggtgagctatgatcatgccactgcacttcagcctgggcaactgagcgagaccccatctctaaaaaaatttttttaaaagctattcaacataaaatataaaactcagtaaaataggacatgatgacaaaattttgaaaagaaataactccttgcccaattttcacaatacaaagaaattatataacatggtaaaattagtgtgaattttttctctgtggaaaacacatctgtatttattttgaaaaatcaattctgttctatcacaatatagatgtagtctgataacaatagctttttagtgtataagtgtaaggtgtacatgtttgatgtacgtaatgaaatcgttacagtagtcaatcaaattcacatatccacctataatctacttgatcagcaaatttccagtatacaatacattatctcagtcctctactgtagtctctaaatttattcatcttctataagtgtaactctatactcactttgatctgcatattcccatccccccatttctattctatttttatgtattttactttacaaacttcttttagcttccacatttaagatcatgcagtatttttctttttgtctggtttatttcacttagcataatgtcctccagttctatctatgttgtcacaaaaggcaaggtctcattttttataagaatatgatgaataatattccatcatattttctttatccattcatctcttgatggacatgtgggttatttccttattttggctattgtcagtaatgctgcagtgaacatgggagcacagatgttcctatgaggtggcaattcatttcttttgggtatacacccagaggtgggattgtagatcatatatggtagttctatttttaatttcttgaggaacctccatactgttttccataatggctgcactaatttattttcctaccaacaatgtgcaaggatttccttttttctgcaccttgcaggcacttgcttgatggcatttttttaaagttagtaaagaaataccacagaatgattccaaatcaaataataaaagtgtacgtttagtgtatatgcttctttttaacctgttttataatgttaagtgtttttttcttatagaagcaattcatttttattgtagaacatttggaaaatactaaggagtataaagatggagaaaataaaaatcattcacagtcctgttgtgcagagagaatttctactaatataattattgtgtacaattatatgcatatattatgcatatataacacataattatatatgcagcatagatgcatgtattatatgtaattatatgtgcaattatgcacaattatgtatgcggcacatatgcatatattatgcatttataatgtttcacattgacagttaatatgtatatatatttttaaagatttgagtcttattgctattgataatactgtgtcaaatcctattttcattagctgtattagtatccttatatcgttatatatttattcagtagaaggtttttaataactatgatgttctgtcttatgaatatatggtatttattcctctacttccaggtaactttgttgtttgtgagtttttgctgtgagaaaaatgtttatatgaatactcttgtatgcatgtctgttttttgtagaattggaattgagaaaatacatgagctttttagatggttcatcacttaacatttgccaaattgccctttagaaaatttgtgcagatttatgttctcacttgagaacatataagaatgtatgaaagtgccttcatttctccataactgcaataagtgcttctgattgaatagatgaaatttgaaaggtaactgatagagagtctgtatggattattactagagattcagatggtttgaaacacagattagtccttcagttatgtatgtctacataaacaactaccccagaactcagtggcttaaaacgatgatttctaatttctcacttttctttaagttgactaggctcagctgtgctggtcttcagttccatgcggtataactgaggtcatgagtctggaacaaacaccagcgtctctcctcgtggcctctcatcagttagtctgtctcaagttttctttgtagcgtggcagttggcttctaagaggaattatcctaggagaacagaccacagttttagacacttataaaacttctgcttatatcatgctttcccatgtggtcctggttgatgtaagtcaaagtcagatgtgggaggagagctacataggagtgcaaatacaaggagtgtgggacgtaatgtaatggacagccagagatgataaataagtttcagccagcattgcaactctgtttagcgataactgtttgaagcaatgtattcaaaagaatttggagaccaacttctggatcagtgggaaagcatattgtgataagctagtgatgtacgcaaggatttaggtgaggaagtggatatactggtgtgtttaccagtactaattcaatatctgttaatttttatcataaagtcagagacttagaaaatcaaagtaagtcatgaacttgaatgtaagcccaaatattttaaaaacatttgaatacctgagtaaatttagtcttgatctttagtttattccagtttcacattgacagttaatacacttggtagtaaaagatataaataattggtatcttaaggctagattactttgcacaatacaattattttacaccagggctgctgtttcccactgataaatgacacagctgtagcagagttcaaacatgaggatcaaagtacctatgctagtaatcaagatagtagtgccttgggttatatgagtgtgtagacagatatctcacatatgtgtttgtgtgaggggagtgtgtgtgtgtgagagagagagagacagagattttatgtgcttgactgaactgtcgatttgacctttggactaactctatgatcgttagtagttattatcagtggcagtatttgaataggagtagcactatagccctctgccttccaagaggacttgtaggaagatgttcctactcctcctgatgcagtaaagtcctcttttatgatttttcccttctaccccatactctgctccccaagaagttataagtatcagtggtttagggtccatttttctactgttctttctttgcatgtacatacttatatatacataaatattttaacaaaaatgggattgtcctgtaggtactattctttaactttttatttaataaatatcttaggtcttttcatagtactggttaaaggtcaatatcgttctttcaataactgtaaaacatgtcttgatggttttgttatactcctgttgttggacatcgaggttttttcctatttcccccgccccctgcccaattgctagaagtatgatagtgaaccaatttaaacagaatctttgtggtcacatgcaaatatttttataaaacagttgttttataaaacaactatttagatgtggaattgctgaaataggctgtattcgtagttgagctttggtaagttgtagtaagatcctgctaaaccccgtaagtagagttcaaaaaattggaaatgcttaaatgtgcaatcataatattgaaaaataatactttttaataagtctgtggagctacaaaaaaacttacaaaagtaataatatgacacattgtgcaaaactgactgcataatgattcaaaaagccccaaatgataacaatacattcacttcttaaactcctctgagaattagggttggccaaatcattggagacatttgccaatcacattcagattaatttctggttttcctatttggtttactgttagacagctttcttccaaaaagtcttaattatttatccttacttatatccttgccagcacttggtgttactgtacttaagttttggctaggccaatgggcaaaaatggtatcttcttgtttgaatttacatgctcctgatttcagccatgcatggcatctttttcaatatttattgcccatttgaatctcttctgtaaatttcctgtttcacatattttctgtgtttttctattgagttatttttcttagtgatttatgttaggtatttatttgtatttttgatatctaggccagttagcttagtagacatctcgaaaatattttggttgtgcacccctacaaataaaaagtttttgagtatataccctcaagtacgaacattatacatgtatttatttaaaaagtatatacatgtaatgctgtcaatctgtgtcttacatattagtaaagctgttttttcttattatttaaaaataagtgtaaatagaggtactaaatattttctcctgcaacccagtggaaagcccagtgtgcacccacttaggcagttaggagttcagaacataatataccttagaccagttagagttgccaacaggaatatgctctctgttttgtgaccacagtgtgcatcttcataagcctgtgggcaccaagaattgtggtgaagtggaaagtagcaatgtgttagaccttgactctcttaccttagttagctgtattactttgataaaattgatactgttatataccagttttctctcatgtaaagtggagaggataattcttgtcttgcccattttaataggcttatgatgttgtgagttaatttatatgaacaaactttgaaaaactgtgaaacattacataaagagataaagtacgtgggtatatgttttccaagtttatgccattggggttctaagagaatatgcctcaatatcatttatgctgaaaaacaacttaaaatgcatggcctgctcagagtggtttagaaatgtgatcatttagtcttcctcttatatagattttacacctcttgaaagtaggaactgttacacataagtcaatgagtatttgttgatagtgtagtgttcacttaataatatacgtatttcttttttctatttaagaaagccttgtgacttaggaattagaaatcagtttctttgtgaaatgcctagacagtggtactaaggagagctttccttaaagagaaagtttagggctgcacataaaaggcaggacttagcttgaatatattctacaggaatgaagaattcaaggtgttgtaacgttagggacacttacataggtgagtggaactgaagtgtgaggaggcaatactaaaggcagtatgtggtataggatacccaggagtgactatgaaaagacaactttgaatgaaggtgttgctgctgtttgaaaaagatattttgtagtttcttttttctttttttttttttttggcaaatgaatgaatttaactgcagaatgaattattaccagtaaagggggatggtggagagagaagtaaaagaaacttatgcctcaaattgggattgcaactgtataattaaacaggtttgaaatattgtattttatttttagagacagggtctcactctgttgcccaaggctggagtgcagtggcatgatcagagctcacctcagctttgaattcctggcttcaagtgatccttctgcctcagcctcccgagtagctgggaccaaggcgtgtgccaccacacctagctaatttatctatttttttttagagatggggtctcactatgttgcccaggttgatctcgaactcctgggcccacgccattctcttgccttggcctcccaaagtgttaagattataggcattgagcagctgcacctagcttttgaagtattttattttatttatttatttattttttgagacggagtctcgttctgttgcccgggctggagtgcagtggcaggatctcagctcactgcaacctccgcctcccaggttcaagcaattctcctgccttagcctcctgagtagctggcatttcaggcacctgccaccacgcctgactaatttttgtatttttagtagagacagggtttcactatgttggccaggctggtcttgaattcctgacctcaagtgatccacccgccttggcctcccaaagtgctgggattacaggtgtaagccaccatgtccgtgaagttattttaaatgtattaatactcaggctctgcaaaggtgctggagattaggcatgctcaggcacgtactgctggctgacacaggcagagcccctgaccagtagtagcccctgaacacactacgtgtgggcgacgggcctagcaggtcacattccttctgaaccctctcttcttctcatttgattctcaggacaaccccacagagtaggaaacaggacaggcctggttcgattcaagttagtaaactttttatgcttacccagatgaatgagaagaggaggtaacatgtatattatctactttcaaaaacttaattacttaaactcttgaagaaggtggaagacttcaaaaaagaaattcttttgagaatttggaaaagtagatgcatttctcagaaatagttcactgaaaaaattgtgtatcagaaaagaaggatgaaaataaaaggaaatcagctagttattttgttgttaacagaataatctcaggctctttcacacctagtcatctggatttttacaatatcaagtcagcccctcccctccattattcttatgaaagtctggctgctattcctttctcagcaggttctctaaaagaagctctagaaaggaaacaaacattattattggtagtagaagtaaagtcctttggggttgtgagtctttactgtatataacacttcctttctgacctgctatttaagcctcattacagaagatgaccctgaaattgaaatatttcacaattattggtttcagttcctcaaaaacattaatggagacaattaatatattatcagagttgaatagaggtaaatcattataatcttgctgtatcagttattgctctatgacaaaccattcaaaaactcagtggcttgcctgtaatcccagcactttggggaggccagcgtggacggatcacgaggtcgggagatcgagaccatcctggctagcacggtgaaaccccatctctactaaaaatgcaaaaaacattagctggatgtggtggtgggtgcctgaggtcccagctactcaggaggctgaggcaggagaatggcgtgaacccgggaggcggagcttgcagtgagccgagagagcgcctctgtactccagcctgggcgacagagcgagactccatctcaaaaaaaaaaaaaaaaaaaagaaaagaaaaaaaaactcagtggcttaaaacaataactatatattattgtgcatacttttcatgggtttgctgggcagtttctcccgtttgtttctttctctagtttctgtggggcctgctcttatctgagatcacctagtcaggtaagaggctttgctgatcttggcaggtctagcatggccttatccaggatgatgggaatgactcttcctctaataggttccggcttcatctgctaggcccaggcttgctgtgattgatgaagacaggcatccacccgagtgagcagaagcacctaagggtctcttgaggcctagattcagaactgggacagtgtcacttttactgctttctgttggctaaaggcagtcacaaggtcagttcagattcaaaaagtggagaaatggactccatctttggataggaggagttgcagactaacattgtacaaggttgtagatacaaggagaggtggaagatggaggcatttttgtaatccatgtaaggtacatgctgaaaaaattactgaacccagctaaagtttaggttcttcagtctgaaatatgggattacacttgatcctgaacacactgctgatcatatatgtactccttagattatatagaaatctatgtggacatgtgtgggatgaccctctttattaaaactgttaattcctaactcctgtagaatagagttattatgtttttttcttttgatgccctgtttagttggtttggtactttcactggggctgtgtcagtttaaggtccaaaatagatctgactgattctgttttgggggatggaggaaggtatcttaggtctcagtgtgcttctgagaagtctttcaagtagatgacctcccctgttctgcccacacccaaaacccactgaccaagcacttgctgtcatgttaccctgttttgttttccctgtggcacttatcactggttaaaattcttattcacttacgtgttttctttttctgccttgtgatatgagcctcacaagagtggggacctcctctgaccctctttgctgctaaattctcacagttaagaatagtgcctttctgttcttaggaaatgctcaataaatatctgttgaacatttgtaataaatattttgtaataaacaagtcagcagtttgttaaaatacagtgtgtttaaatgctatgtcactggtgcattgcagacacttgttgggtatttatggaatcttgagggagggccgtggtcagtaggagctcaaggagaatgaaagcttgaagccacaaagggtttttctagattaatccagtgaaagacagatgagcaggagagttagggtatgatagatttgttgaaatgttgaactgttagacttcaggctgggaaggagggaagtagagcaaaaagtgatctgatagattgggatagagattcttccaagaccagagaactcccacagggaagtagttaaacatgtatactgcaaggttggagatttggtgttgcagtgtgatcattgaagtcatgattttagatgtgccaggttatgggtatgacaaggttctgggattaagagaatggatggctcaggtagttgaaggaccttgggggaatggggaataaatatctgttctttgagagaatgcagtaggacagctgatgggagaaagtccttaacagccaaggtactgaggtaatgctttgaaaagaggttgagggtatagaggagtttgctaattatggagcaccatttccataggtagttaaatttgtaagatagaaggtggactgtagactaggtcagggatggaaaaaacaaagccttgtagggttaatgccaggtcagtagatggattgagagaggaattggagataaagttaatttgggcattgagaggtttgctgaatttagtttcagtagactcctagagaaaggtgaccctgggacttacagaggccgtgactcatttggccaagagtggtggtcagcccaggaatttgtgggttctgcctgtgctccttaaagggtatttgggtaggtagattgtgaactcttaatagcttacatactaagcagatacatagtcattagcagcttccatattttcactatggtttttcagaatattttaagtatttttttattagaaatgacattttccaaatgtaaactctttagagatggaaaacattaatgatatatgcaaatactaaaggacagtgatttaatttaagtaatactgttgtcaagtgtaaaattcaaagatctaagcctggaacctggacttaaaaaaaaaattcaaggatcaagattttcaggttagcattttctattttttggtcatacttttttttttttttttttttgagacagggtcttgcactgtcacccaggctggagtgtagtgacacgatctcggctcactgcaagctccacctccagagttcatgccattctcctgcctcagcctcccgagtagctgggactacaggcgcctgccaccacgcccggctaattttttgtacttttagtagagacagggtttcagcatgttagccaggatggtctcgatctcctgacgtcgtgatccaccctccttggcctcccaaagtgctgggattacaggcgtgagccaccgcgcccggccacattttttttacattggtattagcagtagatattttaatgtaaatatttaatcttttttgctgttagtcattttgaaagttcaaactgtgtgatgaaccagaccaaaacttcataatctttaaaccacaaagttgcctaataggcaacaaagtaagcaggacaacagtggaagattttacaaattctcagaaacacctggaaataatttaggaaaagcttttgactctaggctcatagatagagactgtacatgaagaataattaatagcaattactttcttgtctttagtctttcgtcagatttgtttctttgaaaagagcaaggcaggttaaaataatctgtataatataaattgcccatgcaatgcaggtcagtttgttttatgcaggtagcagtagtacgaacttggggtccaatgatattttttatatactacttatatatgatggtaataattaaaatctttgagtatgttttatttctttaattatgacaatttaattaaatgccaaatgaatataacatttgtcagacataagggaaaataagatgaataagcactgcacatgatactcagcttaaaataagaacattttttttatgtcaaagagcttctctaggatctgtaaataggagtgtaattgaagttgtaaagtacatgcatttgattttgggaatttctttattataatcttttatccataatatgtgtggcaaatttactctcctacattgtagcttaccttcacattccaagagatcttttgacgaacagagttcttaattttaataaaattatgtcagtcttctgtaaattaacacaggttttttgtttttttttttgttgtttttaattcctttccagtactttaatctttttccattccagtccttacatttctttatattgctggctagtattgccagtacagtgatagaagcaactacagctctgatgtaaaaatgaaggattctaatttttaccactaagaatgatatctgatgaagatttttggaaggtatcatttccaggtgaaggaaattctctatttctactttagtaagaacttttattatgagtttaagtattgaattttatcaactatttgttctgcattcattaagattttttttcttttagtttgcttattcagtgaattccatgaattgcattaatactcttgttaatgctaaaccattaatggtaaatcttacattgttgggatcaacccaacttggtcatgaagtactcttttttccaagttaataaagtttgtattttttagagcacttttaggttcatggcaaaatttagtagaaaatgtataaagttctctgttacgcgtacacacacacaaacctttaccccctcccccactgtggacatcttgcaccacagtgatacagttgttacaattgtacctacattgtcacatcattatcacccaaagttcatagtttaccttaggattcactcttggtgttgtgtgttcattgagttttgacaaatgtaaatgacatgtatccaccatcacagtatcatacagaatagtttcacccccctaaaatcatctgtacattgttctgttgggtttgttgatacttcatttaagactttgatatttatgataacaaagtgaaattgccctgtaattttcttctcttgtactgtcattgtctggctttgatagcaaggttggtctagcctcagaaaatgagttggaaggtgttccacttttttgtactctggaagagtttgtatgaggttagaatcagtcatggagaaagggatattatagttttcaaatgttgcagtgacttcttgttttctctgtgtactctgtccttttattttgagtttatattatcagatgcatttaagtatagaattgttatgttctgttaagtgtagaatatgccatcagaatgaagccaacatttttatcatgaggggacctccacctccggtagtacttgtgcctttatctgttttgtctgattttgatatataaactttcttttatttagcattacctactctaattttttttcacccttttaaaatatctgtttatccgtatatttgggtgtatctttttaaaatagtatataatgaatctttttccagttttataaacttttttttaacttatagtcaacttatgattgttggtatatttaggtttatttataccttattttgttctttcttctcttccttgttttcttgttggttatttaaaaggtatatagttttaaaattgtgtacaaccaagatactcagcaatggataatcaattttcctctcaatctttgactttcaagaaactggaatagatttcagtatgtactacaaattgagtgagaaattattcgggaaaatgcccaataaaaggccttcataattttggaagaagtaattggaataaaggtgactcatctcttattagtgagaatggttaaatatgctaattaaatgcctttcactttttgtgtttacttgtttgtattcattgatggaagcagaatgtttggtgtgtcttttagatttaaaaactggaatctactagtaacatatttatattggcctttttgtgatttaaaatataatgttatcttttataacggcatcagaccacactgagtgccttctaattacagtctgtgagtcttgtgagtacagagaaatgacaagctttgccctgaaggatttcatatgccccagcaatgtctaatgatgttaagttaaagccagataagattgagaaacctttctgtatgtgtcagtattaggtcaaacctctggatttacactggtggggctcaggcatcagaaagaaaatgaggaaaggggtgagaagctataagggagtcagaaacgtaggaaggaatactacaggagttgtgcatgtggagtagagtgccactcacaagttccttcagttgcctgtcttgaagcagattattcaaaaaacgtacataggaattcttagtcttcatcaggaaggtcattatcactaggaagacctcacaagctctatgtaaaataaatatgtttttataatatcaactgctttacctggcaagaagcaaattcagacaatcctaaacctgttttgaccatgaggttacatcaaaacactcctattatatgcttctgaatcatgaactcaagtccatttatttagtaagaaggagcctgctgggaatggaagaaagctagatttttctattaagtcccgaaaccttgttttttcttcacgtcctttttttgtatgtgtgcattttgcttagtctttagtcagccatttctagtgcagtttgaggacctgtgaatttttatataagcctaggaatcatcggtattagggctttaaatgtgacctattttgaatcaaatggaatctgttttcctctgcaattgaaggtaacagttttaaagtgttaaccatagtcttggacataaaatattattagtctttatcttgaatttgttactactttgcactaagattacaagggccttcacttaggtgacaaggttcttactatagatataatgtttttctcataatcctcataataaatcaaacacatggggaagaagagtgaccatttcaggattctgtggaacttgaatatgataataccttactgtcctgaatgtacgcatacccctagaaataacttatatcactgactctgaaaataactcatctgtggttgaacatctttttcttcagagacattcctgtaaagtatacgttgagtagcccctttctctgtgatagattaagcaggcaaacccagaagttcagagaaggtaatttttataattgctacatgttatttttgtttgctttttgagagaattatttgtgttaaaaagtagtttccgttttataatcttgctttttgagctttcctatatcagttatcgcgcaaagttcttattgcagggaccgccctggagtatgttcttgaattgttgggggtggtcaaaaggttaggagcacttccttgatttgttttttttcctttttttgtttttttttttctcctcagggagtgagcaagccagtcatttcttcttctgtgagacacaagaggaaataattaaagagttttttatggagcagtgtgaaaatttggttttttactttagaaaactgattttatggagtatttctcaggtgaaacccatgtattattggtaaaattatatacatatgagagactgatttttttttcatgttttatttttagtaagaaaggaggcaaaagttcagtatgccacttagactaaatgtttctaggatccaaaataacattgatgttagtccctttactgtgatcaccttactctgctgctgcttctacttgtcacatctgagactgtttcttaaaatagagctccccagcagcaatttttcattatatggcctcatcgtgcatgtatttggtatgaactctgataagagattatgatgttgatatcataagaatttccctcttttacagaacatgaaaaaatgcatgcatttaggttaagcattgactatatattggaaatgtagttaaaaaaaactgtacaggtccagcacggtggctcacgcctgtagtccctgcactttgggaggccagggcaggtgggtcacttgagatcaggagttagagaccagcctggccaacatggtaaaaacaaatctctactaacaaaaaataccaaaaaaaaaaaaaaaattagctgggcatggtggcactcctgtaatcccagctacttggggggctgaggcaggagaatcgcttgaacccgggagccagagtgcagtgacctgagattgagccactgcaccgtagcctggtgacagagtgagaatctgtctccaaaaaaaaccatatatatggtttttatatctatatgtacatacacacacacacacacacacacacacacacggagctgtatatgttatacagcttaccctcgtatatgttatagtgtaatcacaaaaccctcatgctgagtttaaaattacaaagaaaaagttttaaaaattcaaataaatgtactttttggttgagtgggaaaagatgaaattaaacaaatactttatgtcagataatctgccaggcactggggatacgaagaggaaataagcagtctacaaactcttcatgaacttcatgatttattttgttgatggtcattatttagtaatgcaacaaaatttctctaatatctaccattttgtaggtctggtgctagatggtagagataacatactgcatgctaataagtgggtttttttttttagattttaagaaaagttatttaaatccgaaactatttttactggttttaaatttttgtccacttgttttgtgtattatcttctgtttatggaacacttaactatatgttccaagcactctgctgggtcttttatatgcatatgtcatttattgcatacaccataccaatctacccgtcagttattgagcatttatgtacctgtcactgtgcaaccatttaatcttgcaaatgaggaccctaaaccttacagggctggcagagctgggattcaagtttgaatcaggtgggtcagcattctacccaaaaagattttttatcaattgtgctttatgataaaactgccatgtacaatataaacaataggtcatcagattattaaaaattcaccagattgaaaaagaggcaatggaagatttaagtgatgccgaactctggaataattagtcatcattttgtgtaacatatatggtatctattatgacagctttttaaaaaacctctactcatgtcaactaatacagctattgccataaacttggatcaagtttataatcaagttttaaaaatttaagtttggcgggtgctgggattacaggattactcatgcctgtaatgctagcactttgggaggccgaggtggatggatcacgaggtcaggagatcgagaccattctagctaacacagtgaaacccccatctctactgaaaatacaaaaaattagccgggcgtggtggcgggtgcctgtggtcccagctactcaggaggctgaggtaggagaatgacgtgaacccaggaggtggagcttgcagtgagccgagatcgcaccactgcactccagcctgggcgacagagtgagactccgactcaaaaaaaaaaatttaagtttataaacttagatttaaacttagactatgtcctacaatcaagcgtcctgtgtaaaggtggctgtggtatgctggtggcattgaaaactggtagcttgaagaatgtgtactttcagtacattccgtggatgtcctcttcttgatttttcttttttttcaggttctgagcttccactgactgtggttttccatttaaaggaacaaaaaagcactagtacctaaaatttgctgtaaaagacatttcacctgctttggtattacctcactgccatctgactgtatccctgcctttcctgatttctgtggctatagtagaagtcttgtggagtttgtggagtttttgaagtttgtgtagttttgaagttttgagaacagacctgtttgtagttatgatccagtggcataagctgacctcaggatataccagcttgctttattagtgacttaattttcttactgtagtaaattgggtgtgattttaacttgttcattctttgtatatgtatactttaagtatacatattttgtatatgtatattttaacttgtaagtgatcagacatctctatcatcatctctgaattaaaattaaaattgtttaactcctgaaaaattcaactgatgttatgcaacttggaacataagaccggacaaattactgaatctgacatttcaaatatttcctaatgtgcttttaacttttgctgggcacaaatggaatttctcagcctctgtcataaaaaaagagtttgttattgtttggtaagacagattaaaacacagctgggaatgaagtagttagcccagtctcaaagacattagcctccctctgtttatttcctcctgtttgtattcctagaagcaaacagctgtgcattccattttattctttattcctttacttaaaatctggatcccaaaagaagtaaattgggcatttaggcttagaaaagttgccttatctgtaatttttattgcccttttcacttgaaacaatgatgtattcatagtcttaaatatttttaaaagtagttacccacaatctcaccatcaaacattttcatatagtttacccataatatagataccattcagtagtctgcttttctcagatgattgctataacattttcttacccatctacagacttatagttttaacttctgctgttctgttattctgtttattctgttattaaatgtttcatttaaaattgtgcacagttcacttagttccaaaataatattactttcatgtatgaataacatacattttaaacttttaaatgtcttttctagactgattaaatgtttaaattctcataaagccatttatgctatacaaattagcataggtctgcaggtttcagttcaaagaatgtcaggtataggtaaataaaaactttaatttgaaaaattgaaataaatactcaaaagtatttgaagcccgtagagacaggcaaggcctttaggaatgcatcagtgaattcattttttatgtatatacaggaatgcatggtcatgcataattatatataattggcaatagtaagctgtttattatagtaagttgatgtgggtccttcagatgacaattttgtggatggtggaattaagatgatcttgtggtagagcatagttggcttctgtgatttatttgttgatgggcccccatatagctctcattttagttaacatattgttatttatctgtcatccatggacttatttttacactgttaaatctattttttagtatgtattaagtaaataactttatgttttagttttttcttttatttctcttaaaatgatttattatgacatgtagtcatagaattccagtgttcttatttttaagataaagttcatgttattgaacactgacagtcatctcatcccattcctatcattttcttcatcatcatcatcatctgtcttatagtatgaaattataccttgggtcataaattactcctttcattctttttaaaccaaaagctttttaactttaagttgttatattgcaaccaaatgggacataacaacaatatactccttgaaaaaatgttttttctgaatagaaaggaatatgtgcttctgttgggaaacgtagaatatcacaccaaaaaatgttaatacctgtactctaccactgtatatgtaactattgacatgtattctttcagtttccttcctatacatttatataataagagaattgggattatagttcacacattcataacttgattcacttaatgtgtcttgagtatttactattaaatattgatgtacatctttttagttattattagaaaagctatatgtattgatgataattcccctgccttttcagccttcttttgtcagctactgatgaaacttttttatataataataaacagtgctgggtcaatgtatgttttagatttttgacattttaatattaaattttaatttgtaggggtgtagaggcttataatctcaatattgtcctaagaatttttgttattcaaggattttatggataaacatggaaatagaatcaataataacagtattagtaatagtaaaagcgtacatgtatgaaacaaaagagtaaggttttgttttcattttaatcaaaggatttattatagaaacactagtcttttaatcttttattgaaatgtccaacactgttttgtttagtaaatctgagtttttagaagttcatgtcccttcttagtagagctatattaatattttaagttagaaatattcagatcattctctgaataaaggcattagaacaattctctgaagaaagggagtaggaaaacttcatgtattttttttccccactctttacttccattattttaaaggaagagaaaatgaaatgtgccaattgccctcacttgtgctcccaagtgcttgttctcccttccccccacagcttatttgagttaatcattggttcttcactggaaaaacacttcagtgaatgtcataaaacttctatctgaattggagaaaatacgttctccaaaaatattaatatctaacttataagaaaaccctttgggtgttaaaaactaacagacttaccggttagctgcttattaaaacgcacaatcagcacccctctcccaccccatctccgtgtctccacccctcatatttgtgggcatcccacagaattccattataatttacagcttctcaggtgatcccagtgtgcagccaaccaagggtgcgaaccaccgttttaaactgatgtaatgataaaattttgctcaaagtaaaaaccaaacgtctatagatttaaaataggactttaactttctaaagtgtgttggccattcttgctctccaggattagcagatattgagatatagattgagaagataccagtaaaaccatttctaggagcaaaaactttttggcattgaaagaagaggatttactataacgtacgtgttctgggagattaaccaagattgagtatgtggatgccaacttcaaaacagaactgcgaatattctttccttcaggggaaagaagtataatcttgattatattcatattagatgtctctttttaaagcgggtatctgcaataactgtaatttgatatgaaatatctaaattctattggtgacaaatcagagatactgctaatacaagtgtggcttgttgcatgcatccataatggaaggaaatgctaaattttagttagagaatagtgaaaataaaggaaaatttattttctacccaacttagtgggttttctgaattcatctctagacccctttgattccctggattccatggaatactaggtttatgtatgttaggggctgtcttcatctaaaaattatttatttcagtggatagtagagataacactgaaataatgtgccttcccccaatgaaatattcatgtaaacatagaaggcaggcaaagattgtaataagtattaaattattaacaatttttagggttcagtcagaagctgttttgcacatcgataaatatttattgggtgctttttatgctaggtactgatctggctaattttacatacattaattttagatattctctattttatggatagcatttaccttgtaccctttaaaaaagacatgtgaaatgattgacaaattaaagcacaatgaaaataagatataaatgaaatcagaagtaagttagctttaaaaaaaaaaaaaagagttgggggcagagagcctgttgtctgctacagagacaggccatctttctttttaatgaacttcagcaactttattgaacaaagataacctaatgaacattaaattgatatggaacaagtcattcaatctccctgcctctcagtttgctcataggctctggcagctaagtgccctgtctacctaagagtgttgttctcaggactaatgagacaatgaaagtaaagtggtataattatgggcggtgatggtggtggtagaaagtaactcacaatatttaaagtgtgtgaggtgtggctaacacaactaaatctaagacagaattttataggaggctaggactctagactagtctagtgtcttcattttatgcagagaaaaaaacctaatatttatttagtgccttttaagtgttaagaaacattgctggctctttttatatattgtctcctttaatacttaaaataatttgacaaaggtaggtattgtaaattgtcccttctcccttttaagcagatgagaaacttaagacacaaaaaagtagccagtccaacatcatggctagttaaccaggatccagaatttgaattcactttttttttttttttgagatggagtctcactctatcgcccaggctggagtgcagtggcacaatctcggctcactgcaaactccacctcctgggttcacgccattctcctgcctcagcctccctagtagctgggactacaggcgccagccacaacgcctggcttatttttttgtatttttagtagagacgggatttcactgtgttagccaggatggtctcaatctcctgacctcgtgatccgcccacctcggcctaccaaagtgctgggattatgggtggctcacacccaccgcgcccagcctgaattcactttcatttgctcttttccgccatactgtggaggccctgagagtctattttgtctgagatgaaggttatgtaccttcaaatgttatccccgctgtccatcactgatgtgtttcagtgtcctggaaaactatgtttaacttcttgtttgtgattttattactagtttttcagtgtggtcttcctatctatctatctatctatctatctctttcctgttctcttgggaaaaataaaataactcatttgggaccattacaaatttctaatttccagatttcacctgagtcctcagtaaacactcagtggctctttaaatggcccctaacctcctaaccacctctgtagaggttacacaaccacacccttctctctcaatagagaaaagttggctgacaagaatgttctttatccaaatttttccttctagcaaccaaactcagaattttcttccatttttacttccattctttctgtttgaaggggtaaccattattcttctctctcaagaaatttttcttgcccttttgctatggatttccaccccctgaccaaggctctttaggatgttacttgggtaacactcttttcactttgttttatttcttcaaatcagaaaacttgcttaagccaccccctttctgaaaaggcttcttttaacttgccctcattcttgatattttccccacttcttgctctccagatgtttttgtttttttttttttttttttgagatggagtctctctctgttgcccagggtggagtgcagtggtgcaaactctgctcactgtaacttccgcctcccgggttcaagcgattctcctgcctcaacctcccaagtagctgggattacaggcgtgtgtcaccacagctaatttttgtatttttagtagagacggagtttcaccatgttggccaaactggtctcaaactcctgaccccaagtgatccactcacctcagcctcccaaagtgctgggattacaggcgtgagccactgctcctggcctttccagattatttttttaatagccagattcattgacaccttttgaatgtggctatgatgttaatctttctttcttggcactattgcccaccccttaaaatccccttctttacctggctcagcactgctctcagtggaacatctctgtgcttctctgaagacaactcagtcttgtcccttggctcatcttctaccttaaatgctggtggccttgcttgcttatatccttaatgtgtgcttattctcgatatctgttctccctgagtggccttattctttcaatatgtatcatccacagccacagttgatacctcataaaattttatctctggctgtcttctttccccagcttcaaaccctttttttccatttctacttgcggatgtcacagacttatcaattgaagatattccaaagtaaacacattcttcctccctgccgtttttccccacctcaactcctctgttttccctctattttttctcctcaaagcaagcaaccaactaacctggacaaagctcaccaaaccaactaacctccccaaaataaaacagcaacagcaaaaataccccgttctgtccttcatgaagaccccagtctctgggacactcacccactcaaattatatagaagaccttaagagttagagttttggagctgctgaaaatttcttttcttgatggggtggagatgacgatcccaccagtggatatattgcaggtcttcaaagaagtgctacatgatgtttggttttcctgtttagtagtctataaatggctttgtaagaaacacacactgtctatcccatgatcacagcactatttatgtcaagcttacacacgtgcatctttgcagctaatacatgcctgatgctcagtaaacatttgttttttgatttagaaaccgaggatatgagtacctcacctcttttctgtgtactctattttttttttttttaatttatgaattacattttggatcaaaagaatcttatttctgggtaggaactttttatgttatggcctcctagacatcattttacaggtttttagagagtgtttatttaatcagttttaaattggcagtgataggctctttgacattcagaggtgaggtctgaagtacagaagagttaaactagaaacctgtaatacctgttcaacctgtgctttaaccaagactgggaagtttctctgtaggattcacttgggggaacttcctacacttagtagtttgtactgtcatttacgctctaaaacctctgtattttggtctaactatcaaatggccagaccactttgggggtgcaatttcatcatagttacacaatgagcagttttgaagaaggttcgcaaaagggaaagtacagtacatcctcacttaatgttgtcagtaggttcttagaaacttcaactttaagcaaaaggacattcagcaagtccttgaaccttgttttcctccttgtcattttgttacgaggttgatgaaaaaaatggttttattgtacttcatttcattttatagatggcaactgaggcaaaaagaaggcagtaactgcccaaggtcagacaggcagtaagtggcagagttgggatctggctcccaagtccctgttcttcagtaacattatgctgcctctcataatgttctttttttcaataaactgtgtgtgggcttctaaaatagtaacagttctttatataaaaggggaaaaaagttttaaattagagcagggttgaagaaagttcaacttaaacttaacatttgactgaattttatctgactttttccatgtaatattgacgtcatcgaaacatactgtagttatttaaacgtgtcgtggttctaaatgtcttgcatctaatgttatataactaaatggccaaagataacagtgttacctcgttatccctgcttttgcctctttttatttgagtgtctgtggctgtcttttcctgcgggttttttgcgcccgtactcatctttcacacattattgattatcacgcctgagtgatctgccacatcccaaatttgtccttttataccttacctgactagtggctgtgatccaggaactttcctccctggcacctatgcaaagatcagtggctgccagctctaagttccagatcatgatttctctactctctgcaatttactagttaagtatcaactttccatgtttgtaactataataatgtagataatgataaactgaactttaaagaaaaccctatatatttcactttttccaccttctctttgaaagtagtaatgaccatggcaacataaatttatttttccctaactacgtgaatcatctgacctttgatttgtcaatctttgtgactcctattaatgtatagtccaccttatatttgtttaaattaagttatcaaattccaaataagccattggttttaaaactacaaagtattatctttttgctaccaaaaacataaacaattaaagaagtcactaaacatatattcgagacagatgataactactccctgtagacttaacacttcattagcaaactaatactcttcacacacccatgccccaccttccccacctcattatttacctgttgtatctgttaaggattgtttccctttttgcaatccatgctttgtatagaaaagtgaagaaagcaatctccagagtaaccttggagcagtaatctgatctcagattgttctgggagctaagaagaatagagccagagaggtaaaaagaatgtcagtttcaaaagggatactgaacatagcctacttatatgatatataaaagtgacatcagatgcaatcgcttgtttgatttaggaacctatgcaggaagaggccttgattttaatgttggcatcatacttgctaacaacactctgcaagtcttctgaggcttaatttttttttttttttttttttttttttttgctttggaagcatggttgtgggcagagctgggataattttgtgtgtgcgtgattcttagttatgctgacagctttcaggttttgaaatcctgtctcttccctgttggtttaacctgtgttatccacatttttttatctcatttatttcattaatttcattcactcagcccaaagatgattatttggcctctactgtgcactaggtgatgtgttctttactgggctttcttgttgtgagtgaacatagacatggtcgttgtacttatggagtcttcattttactggggcaggtagtcattaaacagttgtcatataaataaacataaaattacaactatgatcagcttggtgaaggagaagaatgcagtgtcataagatgtctgctggggaaagtgacacaccacttgatattttcctcttctacttgtcattgggtggctggaggttttcatagttccctcagccttccataagtcacccctggtagtatgtgaatcagtctagtttctgttagttgataattccatatttaatcacagcctgcattactgttctagtctgaaagtatgatatgtatatcggttagtggagagactaaaactacttcatactggttgagagcttctatttgttcctatccccatcctgtcccagaaggagttcttgattactttcaaaacataagatttcaagtcataaagtcatgggttttaaatagagataaacttcagcttggctttaggatttaagctattcttagataatcggaaggaatcaccttctggctgccattttgctgtatttcttttgaggtattctctttggtggactttacagtttttgagattctattgaaattgtgtatttggattcagttggtggaaaaaatattatgttttatgtataaatagactattctaatacaaaataaagcttcagagtttgtataaccaaagtgaattatatcttatttgtgccacagatgaaacaaatcatttgtggccaatacatgggtggaaaccacaagaccccaaattgaaggcagtttattgcagtgatttaaaaaaaaaacaaaaaacaaaaaaactcagtaggagaaataaaatttgatacgattagtagtatttttgcctgtgtttgaatattaaattcacttaaaattctgcaccttcctatgcattcccccctcccatatatacacctgcaacatacatatgtgcacattctgattttcataatgctttactacaaataataacagcaataagaaagggctcttcaaatgagtgtaataataatggataatactgaattataagattccttctaagaatgtgttatggtcagaaacacagtaaaaggtggtaaatgaataatggtgaaataatgagtcaatatgctggaggtaactgggtgaagtgaaaagagctgggcattggaatcagccaggcttagctttgaattccagccctgattctagccatataacctctttgagtttctgtctctttttctgtaaagtgagcttaatcacctgccatgcaggattagaataatattctttaagctactggcacatgatggatattcaaataatttatcaaagaaaacaaattactgatttattctgtttgtagtcctagaaaacgtggcatattttccttatttttactcttaaagaaaaatggaaaaatcagcaattggcttagcagctttactaatattgtagttagtttagacccaggtggctaacttaaggaacaatgttgagttttaatatttgaatttaagtaaaggtctgttaattgctatttaaaggttgtcaagttaaaaaaaaaaaaaagagggttgtaaactaaagccaacatagataaattaagttagtgttgcttgcctaggtggcttccgctgacagtgaaaggaatctgagccctttctccctgcctagtactggcagagcctccagcatcttctggtcttcacttatagggcagtgctaagttggctctgcccaccagtggtaggcttgtttctaatattgcctcctgacacactgattgaaacatctaccagtgatttaataccatcttgtctatgagaacaagctaccacattaaatgcacacattgaatctaaaatgagccaaatttcaaatgcattaaaatgttaaacaaaatagataaattcaggaaatatgtgattggaagaacccatacaagtcttttcagaccttgtatgtgttgattcaattaaggtcttcctaaaccttgtcttccttctttatcctgcaaaccatcattggcttttgggaaatggcccgggtaaaaaccaggtcaagatttaattgggccacagtctcttggacttggattgagcatctttctgggccattaccgataacttgcagttctttctcatctactttgtgtaacttttctccactgtttttttgtaaactgtttctgtcattttcttctgattcccgactcaatggtgtgcgctaagaaatgaatgttaatcactatctgtagagaaaaggcaatatataagagaaacaaattcatatttagtcagtacttattatctgttgttaattatgtgtagtctaactgtcctagagctgcctggtaacctctagccctgagttaaccatttttaggaagcagcctacatataaaccaggaaataaggtatgaaatgagatcaggtagaaaccccaatcccagtatctggaaatgcctctcttacctattttcattcgttgataaaatcaaaatgtctggcctttgctgaatgactaaaaatatgtggatggcttatatggaatgttttttttctttgagttaaaaaaccttgtacaataactatacttgagtactgatgtttccgcagatattttgtgtataaataataagaattgaaagtgtaggaatgggtgaggtgaaaacttttaattgtatgagggagacttgtgagcgtaacaattcagaagactttttttttttttttggagacagagtctccctctgttgcccaggctggagtgcagcggcacaatttccactcctgcaacctctgcctcctgggtttaagcaatactcctgcctccggagtagctgtgattacaggcacctgccaccacgcccaactaatttttgtatttttagtagagacgaggtttcaccatgttggccaggatagtctcgatctcttgacctcgtgatccgcctgccttggcctcccaaagtgttgggattacaggcgtgagccaccgtgcccagcctctctaataattttatatttaactgacttatcattcttcatttctggagacgacatacttttttgaaacttgctgtcttttcttacatactttggttcaaagtaagcagccttcctggctgagagggcagggtagttgaattacttgggaggatgactgtgccacagaccctacatttattaaaccacagttgtaaaactcttgtttatagttgtagtctgttaccattgtgtcttttggtgtttgactaataagacaattgcaagaagtttataaaatctttaatcaagtgaaaacttttctgcagtttggtatgtaaaatgagaatagtaattaattgtgatagagatatttctccttgctttttcccatcccctatttcagagaaaaaccccagacaccttgacttgacttataaaggggctctatagagagactactttattaatagcttgaggattgtgatgtccagttattcctgaaaagactgtgattgttaagaagaaatcaattgagagagggagtgagcatttacattctgtgacaagactttgatgaaaggactgaggaagatgaagataatcagtttcttcatctgcctctgggaagattttaatgtttcttttaatataaaaatgaagagacactcataccctgtaaaaaaatagctacctgtaaatatagatttaccaagcttaagaaagcttgatttagctattctaaaatttatgtggatttatttatattgatatacaattttaacttttttgagatggagttttgctttgttgcccaggctggggtgcagtggcggtacctcggcagagacagggattttaccatgttggccaggctggtcttgaactactgacctcaaataatcagcccaccttagcctcccagagtgctggaattacaggcatgagccaccatgcctggccctttaaaatgttttaaaattcttgcaatttttaaaaattcttgactcttgtaataacaattagcttaaaacacaaacacgttgcacaactacacaaaaatgttttctttatatccttattctgtatgcttttttatattaaacttttttgttagctttttaaacttttttgttaagaactaaggcacaaacacacacattagcctggggctacacagggtcaggatcatcagtatcactgtattctaccaccacatcttgtcccactgtaagatcttcaggggcagtaacactcatggagctgtcatctcttgtgataacaatgccttgcttccggaatacctccctaaggacctgcctgaggctgtttacagttagcttcttttaataagtagaaggagtacactctaaaataacaataaaaagaaaagtttggtaaatacataagccattaacagtcatttatcattacccaatattatgtactatacataattgtatgtgttatatacttttatatgattggcagcacaggaggtttgtttacatcagcatcactacaaacagttgagtaatgcattgtggtatgatattatgatggctacaacttaaccaggtggtaggaatttgtccgccccattataatcttaggggactactgttatctatgctgtctgttgttgaccaaaatgtcattatgtggttcatgactatatttgcagttcatatatctggcaaagaaatcatatccaagtaacataaagaactcccaaaactcaccaataagaaaacaaacgacccgggggggcaaaagatttgagcagtcacttcctcaagaagatatacagattgcaaatacatacttgaaaatctgcgcaacatcagtagtcattagggaaatgcaaattaaaatcacagttatatacatcgcatacctgttagaatggttcaaaacaaaacaatggagacaactgtttgcttgattaagtgcttatcatttaccaggcacagttctcttatatatacgaactcattggatctttgcagtaacccttaagagagcaccatcattattcttattttcagatgatacacctgaagcacagataaatcaaattggctacagtcacatggctagaaaatggcagagccaggaaaataacacagaatttcatgaacactgtatttattgctccaccatattcagtgtgtcctgtgcttttggggtgttaaagtagtggtggtgatcattctcctcgtgtctcgggtatgttttgcatctgagcaatagaatgggaaaaaagttgtttttttttttttaaagaaaattgctactgatttccctttctttttttttttttttttttttttttttttgagacggagtctcgctctgtcgcccaggccggactgcggactgcagtggcgcaatctcggctcactgcaagctccacttcctgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccttgatttccctttcttgtatgcatacacccatacacataaaattttgccatctgtttatgaaaaagtacagctttaatttctttttattgccagttttcaatctctgcccatcagaatagtaaagaaaggattctccaaaaaaaaaaatgtgctccattatcggagccagacacagttgagtgtggggacgaaaccagtgctagctgggagcagtgctttttacttttttcccccaggtaacagtaatgacatggtactaatactttttattagcagtaagacctcaaagattctcaaatcactcactatttgaagctgtcattatcccacgaatccctttggctccagggaacaggacaaagaagaggaatacagcctaggggatagcttaaggtgtcatgtttgatttcttgtaattaactttatcatttaaaaaggcatcatgtatttttatactttttgaatttggccaggtctcatgcggatgatagtggtctagatagttcatgttagtagtgataaaaaattaggagccaccatcaaaaatcaaacattaggttttaagtattggaattaggaggtttttacctttcaggactcatagactgaagctactgttgctatagaaatgattttccacctacataatttgtgtttgagacaattctttcttaaatacatttttaaaactataaaatgaataagcgtaggcatcacagcacagaaataattcttcagatgggagaaaagtgatttgtttttaataatatcatgagtagaaccatgaaaacccaactacaaatctaattttattttaagatatttctttaatacaaggattgaaaaattaaaacaatgtaaatgcctgtaaggggcatggtactattctggcaacaaggagcttttaagagcagtgggctcttaaataggtttcgttttttgttgttcttcctgctaaactgctcttaaaatgattatcagaaaatcgcactggaggtgttaattctttgaatatattcgctctatgtgtatatttccccaagtttctaatattctgagaacttaaaaaagcaaacatgggtagtatcatgttgctaatcttgttataatatgatttgagttttatttttaacatatacttaaatgttatttgttttttacttcataataaccagttatttcattttgtcctataggtgtttcatgctctaagaaaaacattgcgagctcttagaggcgtgggatttacacttggaagcaggcgtagggaccgttctgcccaactttttcattttactgaccgatgagctgatactttgagggctaaggtgacacctaggttattcagcttattgtagcagagccgagaccagaattagatttaccctaagccttttattatttacatgatgctgtgtctttgttagcctcttccatactagagggccacttggttgtatttttatctgtacaatagatttatgtatgtaaacataaatctccatgcagtcatctctgttggatttagatgaataagttcaagaatctaaacaagcagttcatacaacacagggaaactacagccagtcttcaaaattgttttgtagtgagagaaattttatttgcatatgtagcattttaacatagttgattcccattaagaaaataatgatcaagctaataagaaatgtgaataaaaaatgggaacagtgaaagtcagacaaaaagaaacataaatggccaattttttagaagacagctggaatgaggtatcttattcctgtatcaaattggcaaagatttcaatgtgggaatatccctatgttagtgaaggcagagggaaatagttaactctcttttactactgatcgagtgtaaactgtgaaaatagtcaaatataaaatgctcattcatcagttctatacctggagatttatcctgcaaatttaatagtacagtattgatattgagttgaacttgcatattgtttttaaggatggccattgaaatgttgtttatacacccaacacatacaaaatagcaaaaatagaaattaaccagacttttttcagttttataaattatggaacagtagaatatatgtagcaatagatttgtatgtgctaacatctgatattaagagaaaaaaagcaagttttaaagcatgttatatactaataaagtttttatttatgcttttctatataaaaattctggtaggacacaaaagaaaatgttagcaataattacttccaggttttattgggttttgatgtggatgcagtggaagagattttcttttacactttaaatcctttgtaggttgtgggaaaaaaatttatatgtgcactatacacatgtgttagctttgttaagaaaatttgaaacagtaaagtgtacataacattgttgaaactcttttgcttagtaactgtgactgaagaaatctttcccttattttgaaataattttgaaaagtttgttcttgatttctttataatttaaattctcttaaacaaacatatttagtaccaagatacaattaaagtatattgggagtcaaccaacaaagtttcacaatcaataggattctgcccgggttgtaccccacacctcagtattcattcaggaagataggtttgcctaagaaatacgtattaaaagccagaaggtaatcccttttgaattctgtaattctgtttctgggtctagatgttaaaaaaaattaaataaccttcaaaatagtgagaagtgaatataacacaaatgtctaacaattgacttattttattaaaccatgagataacaagatacaatgttgtatagctttggagggagttctccagacactctctctctctctctctgtcccccccccaccttcctccctccctctgtcttcctccctccctctgtctctattatttaaaataaataaagtagataagtaattttttttttttttaagatggagccttattatatgccgaggctggagtgtagtgctgttcgcgggcacaatccctctagtgatcagatcagcacaggagttttgacctgctctgtttccagtctgggccagttcaccactccttaagcaatctggtggtctcccgctcccaggagttcagcatattgatgctgaacttagtacggacacgctatcagcatagcatgctgcagcccggaacttttggactcaagcagtcctccagcttcagcttcctaagtagctgggactataggcgtgagccaccatgcctgcctttctcttcattaacagagattagcaagtgttgtaaaggtattaagtcttgtaccaaactgaagtgttttccttgatagaagcttaggtataggaaagaaaactgaagaggaaatcaccttcttattttgagacataaggcattttttttaactttctgtatttacttaaattgacaaataatatatatatcatatgctacataatgttttgaaatatgtatacactgtggaatggccagatcaatctcattagcatatgcattacctcacatatttatctttttttcttttgagacagagtctcactctgtcgccaggctggagtggagtggcacgatcttggctcactggaacctctgactccctggttcaagcgagtctctctcccgcctcggcctcctgagtagctgggattacaggcacgcaccaccacacccagctaatttttgtatttttagtggagacagggtttcaccatgttggccaggatggtcttgatctcctgacctcgtgatctacccatcttggcctcccaaagtactggaattacaggtgtgagccaccacgcagggcccacatatttatcttttgtttttgtggtaagaacacctaaaatgtctcttatcagtttccaagaatacgatacattgttatttatgtagcttttaaaaatattgaacatagagatgtgataattaatgatgtgttaaaaatacagtacaaaatagtactagtgattacaattattctttttgagtgcatatgactaccagacacgtggtagaaaccagatttcatgtattatctgtaatcctcataacagaacatataaggaagatgatatttcatttgatagatagggaaactaaggatgagggaggctaagcagttgttatgcagacgagtttcattttgaaagggtcaaagcctttggatcagttcccactgcaacacatctaatacacccacagtgccgtgttgtccttcgggaagaagttttgtgctcttcttttggtaatgttgctcaaatgatcataataattttaaagcacaccaagagttgacctggagcctgtttgaactatggcatgcccaagtagtggtttcctttatgccccatttccagtttatagttgaggataatcaggcctgtgctatgtatttatttacttcaataagttataatttataggtgcatttttaattctacggatcagtaagaggtgatttccctactcaaaaatacttgatttggctttctagtggtaggaatattttctgccatgattacttttctgtgatgtagccagtgctgatgatcagcttctgtgtgactaattggatagctctgtgagttcactgtggaaatgtaaactctagctttgaaattgagcatactgttccttatggcagttaaggctgtgatgttagtgtcatcatcttcatactcctgcacacaacttccacggctcctggtgtgctgtgattaggtttctggaaccattgagcactcacccccacccacgtttcagaaatctccttggtctattattccagtgtgctgcccaagtattgtcatttcctttgtgtgctgtgacgtgaaaaaaactgaggatgcattcactggtagcaagccacatatttataaatgagtacaacacagaaattggtttgatttttctcttgtacattatattttgttcagaattcattattccctaggtaaatgcaggagacatcgctgaaacatcaaactgatcccatcattaaagacagtagcatattcagggattatgccagcataattttgtagaaaataaaagaagtcacaagttagagagacaggtgcagcattgcagctacacgaagtggagcgtgcagttttccaagtaggtagttaattttatccttagttttcatgattgaagtaataacattgataaaatgaaataagttaaaatatgacagtgttgggaaaatgtagaatgataatactccgtagcttttgagaacctgcttacctctttctagtgagagatccaggatttttctggttgatagagatctgtcctgggcagaaaatggcaaaactgagattcggctcatgacttcattgcttttattgtgtccttagtctgccttactgggcgttagtttccttaatctctacagaggagttgtgggctaatatgcagtgatgtctgtggattgatttctttaaaacaacaacaaaaataaaaaacaaacaactctcaaaacacaaagtagtagaagtagaaatatttatagtggctggtggagtgctgttggatatatcagtctaatttgttgaaacctagaaatcatgtatgtcctagttggtttattctacttgggattagaaaccaagtgcttagggtaaaggaggagagattctgcatttgttttattttcattgcagatgcacattacctctttcagaaattcctgagtcatacatgattacattatgtttttatgcgagacatttaattcctttgcactgggaaataagtttttcagttgcagttttttaaaatgtgaaattggctgctttatataacaattgtttaatgctctttttattattccatttttgatcccataggttgttgttagggcctctgtttaacagtatgtattatttatattgaaacagaagaaacagttgtgtcacactgtgatctcagttttatgaatttatgcataaggctaaggactggaggggaacctgaaaaaacaattgaacaaaagaatgaagtgttggccgggcgtggtggctcacacctgtaatcccagcactttgggaggctgaggcaggcagatcacctgaggtcaggagtttgagaccagccttaccaacatggagcgaaagcccgtctttactaacaaataacaaaattagcctggcgtggtggcacatacctgtaatctcagctactcgggaggctgaggcaggagaatcgcttgaacccgggaggcagaggctgcggtgagccaagactgcaccgttggactccagcctgggcaacaggagataaactccgtctcaaaaaagaaaaaactaaaacagtgaagtgttagttaaatataaatgtttagagcgtaaatttttccctggtatatgggggagaggtgggtttattgcagtaattacaggtgagttaattaagtagctgaaagttagcctctcatttgtaaagacacacaataataaccttttttagctaaaaattagagacactgaaaaaaaattagaaaaatattttttaaagagaaagggtctcgctatatttcccaggccggacttcaactcctagactcaagatatcctcctgtctcagcttcctgagtatctaggactacaggcatgtgccatgcaccaccacgcctggctaacaggataaatttatatgaaaagacttgtaaacaaaagtctttcaggctgctctcaaaacacacacatgattaatgatacttagtttttgtaccttgtatcaaggtgcagtatgctggtgattattttttagagcacggaaatgccagcggtagtaagcaaatctcaaactgtcagcttagaggtttattgtgcgtgtctgctctttgagtctataaagggattaacagctgaatatagactttaaatcactgttgggatttaaatttttactctgaaagactaggtcatttgacagtaatcaagggtattttcattctcaagactgttttgcaggcccagcagaaaacccctctatttaacccatgaggggagtcatcctcagggctgaggcatatgaaatctggggtacttcacacagaaaaataataaaaatgtagggggatttgccttgtggttgaatccaggaagttctaaattggcaataagcagatagggaacaattttgtcagatactgtggattaatggtatttaaaaggcaccttgttattatttttgatgcacaaataattttacatctgcaagcatattttagaaattcaccaatatgatgactaattatttggccaaaaaaattgacagtgattgttgcaattatatttctaaagacccatgcaatacaatggtgatttaaaatatgttggtcatatgagtttttaaaactgaattgtttgttatagaagtaatataaatatttaaaaaatatatatctttgaaaaatatagtgtttttttttttttaaactgtattccaaagccgattcctgagactgtgctttatatgcacctacggctcctaaaaaacatcagccacagcttcaagcctaagctcacccgagacccaagtcagacacctctggtgtggagcctggggatctgtttttaaagaactccacagtgcacagtcagcattcagaaccaccattctaaagttttatatgtttcacatggataggcagatagttgaaattgtaaaaaaaaaaaaaaatcaattttgattctctaatataatggaaaatatcagattaaaaagaactctatagtaatatttcactatttacttgagatgacctgaactaggtataacgaaatggaagactatagcacattggatagccacagaccagtactggtatgaattagaattgaattctgcttagattgtaaaggaacttaaatttagcactaagataagattattaaaggaaaataatgtgattaaatgaagtagaacaacagtacctaaaatgtgttatcttttaaagtttttgaaatctcttgttgaataaagcacaataattgtatagcattgaaataaagattttgaagtcttactataccactaactcaatatagtaaaaggtgatgctgaaaaaacattaatgtggctgtattggttattttgatattttaaaaagccctttagggctgggcatggtggctaacgcctgtaatctcagcaatttgggaggcctaggcgggtggatcacttgaggtcaggagtttgagaccagcctggccaacatggtgaaaccccgtctctactaaaaatacaaaaaattagccgggtgtggttgcaggcgcctgtaatcccagctgctcgggaggctgagactcgagaagtgcttgaacctgggaggcagaggttacagtgagccgagatcgcgccactgcacttcagcctgggtaacaaacagagtgagactctgactcaaaaaaagccccttagagaacaaattattaatctaagacaactaaggtaaggtaatgggtaatgtcaaggatgtttttgctgattgggacaatttgtattcaactgcaattcgactacattcattagcttcatcagaaataaaactgaggattatgtgtctagatctgggtgagctcaaagatgattactgctacatagtccttgctctcaagagattatatattacataatttgctttctatcttatggtttcagtagttatttttagcagcaaacagttatgttttttaaaggcagcaaaaatttatgttgttgggttattatttatttttactttttaagacttatttatataccaattaaagcccagaaaattagtcttgagcaagagttaacacatgctcctaaaattttaagttttttgtttggccagatgagggcactttttctttacatttctagaatttgagctgtgaagcagattgttttttcgcatccaagcgatttctttctttcttttattattgccagtgagacagttttggcatttttgatgttttgattgtgctgtattctcatagattaatcctttccatcaatcctttcctaaaggaaaagcttcagtttcttgcaaaggtgttgtatatgggaactttaaaatgaatgacaaaatttaatggaaccaaggtggttttaggaaaatgtccatgttatttgtaattttgcttatagttaataatggaagttgaaatgtacttttaatttgagtactctaacaatagcaagacgaagtagcattgactagaccctcctcttctcccttaccatatttctagtgcctgctttacattgaattaatgttgccttgcattattgccgtcagaattatacagaagtaatggagaagaaataaaataccagaaacattttgtctgctgcttagaaataaacaaaaataagtataagtactgaacccaacaagtataatattagaaatacagcatatttaactttcttatttgctgtcaaatgccagactgaataggataaggtttctaaggttatgtgtaatgtactaaaacaacacagactgcaactatttggtgtcagtgtgaacagtcttaagaagaaaatcaaagagaataatgtttaaacgtcccacaaaacaaagctgttgtcatttcgtcacagatgaacaaaacaagtttatgttttttgaaagttaaatttctgaagagcaatgaaacagagctgttgctaattaaagtttaaaaaccactagtgaaaataaacaccaaaacatggttaacttaaaggagattaaaaggagagtgggggaaacagcaaggatgaattcaatgtgcaagtttgtttaaaattatatacaacttaaggagtcatgaaaaggaaatattattgtattttacatagatagatagatgagtataaatagtatctcccttgtatagattaaagaaagctgttatcattatcagctgactctggaaagaggtgtcagcttagtgaagccagcaaaccttagtttcctctgagtgccagagagccactgttatcatattctctttcatgagcaccaaatgtgctttaggtacttttcctacatgttcacttattatcaacaaccctgtgggataattattagtattatcattttacaggtgagaaaatgtagaatattaagtagtatgtttagtgtcacagaaaccgataataatgaatttctcaaaccaaaattcagattgtaacgacactttaatgttaagaggcatgtcactgagaagcaagtggtttgggtttcaatgattgagttagttgttctcagtctgctctgccccaaaaggccatctcttggtgtttcaaggaacagcagctggattgcttgatacttacaagggaaaatttttttattttctttctttttttattttttgagatggagtcttgctctattgcccaggctggagcacagtggcgtgatcttggctcaccgcaccctctgcctgccaggttcaaacgattctcctgcctcagcctcccgagtaggtgggactacaggtgtgcaccaccacgcccagctaatttttgtgtttttttgtagagacagggtttcaccatgttggccaggctggtctcgaactcctgacctcagattatccacctgccttagcctcccaaagtgctgggattacaggcatgagccactgtgcctggtcttataaggaaaaatttgttaaggcctctacagaaaccacgtctggtgcctatggatggactgttgtttttagtcctttggaggaacaaagtttcctagtgtttaatatctattattattattttaaaagtaattttaaaaatcctcggggaatggctatgaaaaagataagaagaaagtagtgatttttaaattttcattctattccctgactttttgctgtataaattttggtagcagtcttgttgcctagaccttatttatcaagccatagtctatttgaatagtaaacccccaaaaatctggttttatggctgacagatctttaataaaaatgaatccctctgcccctttctcattaaacatttgctggggactttttatgtactggctatttgtacttggatgtaggatgtacatgtgagatacagctatgcccttgctagtgagtttatattctcgtgtaagagctcagtaagtaagctagtcatcacaatgaaatgggataagtactgtgccggtgagtagggtgctgtgaaagcatacccctgtcttgtgaagagagaggggaaggaagtcttcatggaagacagaatgtctgaatgatcagatcatttcacagatagattgagaggtaggaaaggctaattttgttgaagagaataagtgatgtttgttttgaatattttgggtgtggctataggttttgagatctacatttggtttttaaaaatgcgggaatggaatttttcaaagaatttttagcctggaaatgaatatttgagagttacttgaatagaagtgataagatagaaaaagaggagaggacactggggaatacctataaaaatcagagaggtagaactccgctaatgcaggtcctggaagccacagtcagaagacaaaacagtacttcaagaagtgattgttatatagtcggtggaggcaaatgcagtgcttacaagttgaggaagcagagtaaggcactgtatttgattaaggtatcagttacttgtgagcaatatagtgcagggttagatttaaatcgacattttagaaatgtacttcttctctataccttttttttttttcttttaacattggttcttcactttggagaggagattaatggacctctttgaaactgtgatacagagatggcgtacatttcttttgtgccctgtccatcctctgtttcttctgagaatctaactcacatttaccttggagaaaaactccttattcagtacttgttattatactcaggtctggtcagtatttgttccatacctcctgatcctgtcattgaccagggtgtgcacattatgtaagctggaccagtaatactagatcctgggactttccttaagctctggagaacgagaatgtcttatgttggatttgaagctgtaaagatgtcagcctagagctgtcctcatggggcaataacagagagaaagacagagagaggaggggtagggatggcctgggaggaggagagagaagagtaggaggtaaagaacggagacagatagatacacactttatcatattagttgagtctctggatctagccattcctgaatctactcctgaacttttaaattaattgaaccaatacattccctccttttgtttaagctaatttgaattggattttctgttatttgaggctggaagagtcccattcccatgaagaatgcctgtgtacttaacatatcttaaagaatgcaaatgattcgggagtctccatatctgtaggggcccaatgaaacaaaaagtaatgaagatcaagttgttccaaggatagccattaactaattaataacacacacatacatataaaatcttgttatttattgtagttgaggggatgggatatttttattaatgccttttggattaatcaagaattaacacatttatcttcttcagtctctttcataagaatatcctttgtgaaatatttggattgcatttcatttgttatctgtctctctaggcttataaatatacttgccaaccacatacatgtcttaggactcagaccataaacccatagatacaacgtaatttgccagaggtcccataaaatactaataataaggctagttgtccctggctctagcttagttaggtaacttgaagaaaaaaggaaaatggctgtgctaattttgttaggagtaagctttcagttcagtagaaaatgacgatatatagaaatataattcaataaactgtttgatgggtggtaccattaaaaataacagagcagttgggaagtacttgatatataataaaatatcaaaggacattgtcacatctgcagtcagataatagttctaagttaggttggccacagtgagggtgattgtttctttctggtcactgcacttggcagtagatgtagctcctggcaggttcacaatgatgttcgttttgatgaaatagaacaagaaagttggatggtaataacgtgaataactgaaaataagctcgaatttagtataccaaatttactttcttctatagaataatgccaactactttctaattagtagctagaagaaatggagtaagagtaaaaagtttagattgaaattgagtccagtctacattccctctggtcatgtttttttgaaactgacccaaagctctcaacctcttgttttttgctttcttccttttttagaataccatttatggttcgtatccaccccttgaagtcctatattctaactgagctttcatctataagcttttttgggcattgtatgcagaatttaatagcttcctatttattaagaaacattcctttctctttgggcagaatttatattttattccttctaaatgctttgttaaatcagaaggtcgaggaataacaatatgctgtttctgccctctggtggttgaaagagatgttgtaaataagtaattacaaagatgtgtgtcctatgactctaaccacctatggcattatagtttcttttattccacctgcatttattggttcactgatgtatcaagcatgtaatgagcatcttctatatgaatgtctttatcagtactctaaagtgccttgtctagtagcattctggccattagaaacaagttaacatatgtgaggtcttacaaatgaagttccaaaagcccgcttttgctatgtctagatctgactttttgcactccaggtttggattgcaaagtgttttcctatctaaatctaaaatttctagatacactgaacttaattggtagtacacatggtgaatgaaaactgaggaaatattgtgtcttagtcaacagtaagtatttaatatctcagtttctgtgagtcaggaattatgtaagtgacttagctgggtggttctggctcaggttctcttaggagattatagttaagatgttagtcttaattacagttaagatgcaggcttgtctggggctagaggaactgtttccaggttgatccaggttgttagcaggtggcttcagttcgtcagtcatggtgcttggctttacccctagttagtgatgcaagagaaagcaaagagaagccacaagggcttcagtgacctagctcagaggtcaagttttgccatttctgcaatatcctactggatataaaagtcagatctttttagtgtggaaggggaccagaatatagataagttctgtattcctatctgatgattttaaatggaacacttagagaagtaggaaaagaatggtaattgagatgaatgagtgtctctaccttactgaggtgtagaacccataaaggtaacatacaagaacatatttttatgaaaatgaaactagaccattttaatattttttaaatgtgatctgtttcaatttatgtttctttcccagttgggtgagaaacatttcttctgatagagtgcctagtaagtggtggctgaccaagcttcacagaaacgactacttgtttgctaagattctttgacaaattacttacatatttgtgtttttttcttcaagcaatgaaaaccatttttggtctgccacctgtcagaacattgccattctcatcaaggtcattatgaaaaatagaaaaaaatgaagtcaattgggtggtaaggaaagtgtggccacttcacacatatgcaggtttgaacattactaggttgtcaagagcaggtacaaatagagttgagtgtaaagaagtgtccagactagaattttactttaacattaaggacataaggactttgaagtagaattagagaggcaatttaaagttaccaatcctctctgctcctaccttcccccaaaattgttatttccctcctctttctttcatcctaccttaatacatttttttcataaataaaatctgttttcagatcagcatgttattttcactttgaaaagacaaaaattatacttctagtgtaatgaatgtatgagaaagaaaaatataggaagataagaatttaaaacattaaaatttcattaatctgtctttcatataaagatttcaatcatattagattagaaatgatgtttctggttctgaaattttattgatgcttctggcaatggccaacttagagtaaatatttcaacggaataactgtatcagaccatgatgcttgtttacctttaaggtcttattttgcagattcaacttatgaaagtactgtattaataaacttgtaatccctaaagacaaaagaacagatttataatacatattatgttgatttagattctattcctttttcaaattaaattcattttttattttaccttgtcattgtctgtttgcatttataatttatgtgtaaaggcattatatatacttaatggtaaatgggattcgatgtaaaagaaagcctttcaatgaccaatgtttactgagcttttattatacaccaagacctctggtaacttttggggttacagtgatgaataaaacaggcactgtccctgaattcttgcagctgtcaacatagagcaaagatagacattagtcaagtttttacacaggtcaataaagtgtgtttaaatgggttgaacctgagactggacatatatttagtttaccagagaagaatcttctaggctgaagacactcacagggtctaaaagaacccagtgtgcctggaactaggcaagcaagatggggtcccctagccatggctggtgagggggaccggggccacactgtgcaggaccaagtagcttcattgaagtcttggcagtttttggagaattaaatgatgtgagaattagagtagaaacaaggagaatagttaagaagctattgcgtttgtctaaatgaagaaagatggtaaatagatgaagaaagtgtcagcagagatggaggaaggtagaccatttgaagtggagattttgcagatagactacataggatttcttgggttagaagagaggaataaattgcagccctgtgattcatgcagctgagtggagagttcatgcttagaaatgggaaaaaatatttgttcttttgggggaaagggcagggggtcagggaggagttgtggattgaaggtgggagatcaacaagagattcgtttttggtaggttaagtttgagatggttgtgggaaagccaatggaaatttcaggcaggaagtttggtataccagtctgcaactcaggaatgggttaggaaaataaatttgactcatatcaacatattcatgctattcagaccattaaacagactgctctcaagtcttgtgtagaccaatgataaggactagggtgacataactgctaaaattttattgacataaataactcctttctgaaaaactaataaaaatgagaatgttgcttagaaaagggctcttttgagaacagccagaattttcctttcattagagcttttgtgatttaatgcccccactttctattcttgatctcattctagtggaatttggttacttgcttttctgtgcttttccaaagacattaatttgtttctttattaattgttaaaatctgcttacaacgtgcgcttcttcatttcctccttgtgtcgtatattttaaaagttattattcagctgagtcttactctttgaactcttactcttagtgtcagcttcacttcaccttttgaaagaaaaaacccaatcttgaaatcctcctttatcttgttaaaaagttttaggaaatattttgttatatttactggtaattatattttcagggatagaaatactggtttaaagctaggaaaacttccttatggataataatgcctttctcttgaagcattgcaaacaagtaaatgaattatcagttggataaatatttccttttttggtctttcaattccccaaataatttcttttaaaaaatactcatttattcaggttaatgcaaagcactgtgccaggtgctgcaagagagaaggctgagagataactgattgcattcaagatgtgtactacatgtgtggccctcatcatgaaatcagagagctttacatgctgcgcatgagtgataacaatctaaaagtcttagtaggaaatatagttattgcttggacattctagacttaaaaattaaccttgaaagcccagcatatctaatcatttctagcatgttggagaactgaagatgattcatttagccagaaatttcagttatctcagtgttattgcaagttccctatctgatcttcctctttttgcttgccttactcttgtgagacaactattaggtgtgttttaaatgggttgtcccaaaggagaagagactttcctattctcagccctctcaagataagcagaactgagattaggaaaaaagcaactgagccagagccaattttcacaggaatttaaaaatatcagtgtgaaaacaaaatgagcagtgaagcctagctatttaaagggcatgcaaaagagaagttggaaaaggaacatgagctggcagctaactggacgagtgtggtgactaattagtttcctatgatgtaaacatatttggtattttatgtcatttattttaattttttttgaccatgactcgcaataagaaataaatattattggatgacccactgtccactttatataatactaaaatgaaaatactttcttccctttaccacctataccttctcttctgttttgttattttaaagtactggtagcaaacatcctgttaactgcatttcattatctactaatgggtcagaccaagatttaaaaacacagtgccctgtgaaacagtgagatttacatgggcaagaatgggagtgaagtagggattatttcttgcatgtaactgtgggtcatagaccagtatgtagaaatcaaactgttaatactttaataccctgacacacagcttcccacactgaatgctttgagttaatgttgagtgttgttgaatgaacagcctagcatccatcactaccatgcggcctaattggttgttgttgttgtcagtcttgtcccctaaactcatcttattgcagtacagatgattgtttttcaactgctgctgccaagaaccaaaatattcagttatacaaaataagatacgttgtaacctaattagatacaggtatatcagctgttttctcaaatcacctctaaacataatgcaataatcatttattaacattccctgttcctgtgagtcaggaattctcaagctgcttggttgggtagttctggctcaggttctcttacgaggttggatgagccttatgagcttaaggctttagtctctgcaagcttgaaagctcatgctggaggatcacgtgtctggcaagttgatggtgggtagttggtttctctgcataaggctgcgtgacccatgacatggtggttggctttgtccatagtgaccaagcctaagagagtaaggtagaagccgcactgccattatgacttagctttgggtgtcacttttgtcatattttattggtgaaaaaggccagccttgattcattgcaggaggggactatacaaaggtgtgtatacccttgtatagtccgtgtataggctggggatcactgagggtcatcttagaggcttgctaccatactttaaaaggatatctttattaacaattgacttgaatttaaaaaaaattttagtatttttatttttaattttaatgaaggaaaaagtaaacatgtaaatgcttgctttatttttcaattttataaaagcagttaattacagagaagtgctgacatttctacttttcataggaaacttggagagaagtcaaaggtgtaaaaaggacaaattttagaaaatgagattcatgaggaaagactgattaagttcactttagttaatgaaatgtggaattatgaaaaattaaatattaaggagaaccctaatgaaattataagaatagaaaataatttactcttggcctggcacagtggctcacacctataatcccagcactttgggaggccgaggcgggcagatcacttgaagtcaggagttcaagaccagcctggccaacatggttgaaaccccgtctctactcaaaatacaaaaaaaatttagccgggcgtggtggcattcgcctctagtcccagccactcgggtggctgaggcaggagaattgcttgaacctgggaggtggaagcggtttcattgagcccagatggcacctctgcagtgcagcgtgggccacagagtcagaccctatgtctcaaaaaataaaaaagaaaagaatttattcttactaaaattagtaaacctaatcattaataagtgaaattgatctagtaaataattgatcagaggcatgtggtactaagcttttaaggagtgatgagactatcatagacattctacttaactaatactttcgattaggggttagtaactgtggctgtggaccaaatccagcctgctgcctgtttttgtaaataaagctttgttggaatgcagccatactcatttatgtaatgtctatggctactttctcactatagcaaagttgatagttttgacagactgttgggtccacaaggcctgaaatatttactatctggtcctgtacagaataaatttgttgacccctgtttcagattttagacttttacattgtagattaggttttggagtgtttatgaggtgcataaatccaaggacagtagcatgtgagtcaactttaaacataagagggtgcaatgttaatgtggttttgattttttaagaaggaaagtcttaatacttagaagaggggcagaatatagtaagattcacaagaatgatgcttcattaggtaagactttgtttattaagataatttatgagctttcagtagaccccatgttgggaacacatgaagccaatattttaaaagcaaataatgttggttaaattaggttcttgtgagaaggcagtttaaatttttaatcaatttcttacttcaaatggaaagttagatatgaattttatacttggacgtttattctgatttagagttttgatttttttaatttgtatataatcatagggtacaagtgcagttttactacattgatatatattgcattgtggtaaaatcagggccttcagtgtgcatctatcactggagcaatgcacgttgtacctaccagagagcctcccagcacatcgtacctacgaagcaacctcctatcatccacccttctcctaccctcccatccctctgagtccctgtattaggccattcttgcattgctataaagaaatatctgaggctggataatttataaagaaaagaaatttaattggctcatggttctgcaaggctgtgcaaggatggtgctggcatttactctgcttctggggaggccttggggagcttttacttatggcagaagggaaagtgggagcaggcatgtcacagagccagagcaggagctttaaaagaaagaatggtagggagagaggtgcctcacacttttaacaaccagatctcatgagaactcactcagtattgctactacagcaccaagccatgagggatccaccgccatgacccaaacacctcccaccaggcctcacctccaacattggggattgcatttcagcatgagactggggcagaacaaatatccaaatcatgtcagtcgccattgtccttcattccatactctgcttccatgtgtacacgttatttagttcccacttataagtgagagctgcagtatttatctttcctgtgtctgagttgtttcacttaagataatgaccttcagttccatccatgttgctgcgaaagaaatgattttattattttttcatggccgaatagtattccactgtgtatatgcacatttactttatccagtcctccactgatggacagttagattgattccgtatctttgctattgtgaatggtgctacaataaacatacaagtgcatgtatctttatgatataatgaattcttttcctttgggtagatatccagtagtgggattgctagatcacctggtagttctatttctggtttattgagaaatcttcatactgatttccatagaggttgtacaaatttacatccctaccaagtgatttttttaaatatgaaagaatggtctggagaaatgcccctcattagtatcccccttttacctctctactgcagaatgacttcaaggggtacaggtatttacaagtttcattatacagacaaattgaatattgaaatttctgcataagaggcacagattttaggattcaaagttgtatgaacaaggacaagtgctctagggacttgcaaagctggaattggaaatctcagatgaaatacatttctagtagtaccaccagcatatattctactgaattggctttgtgatcatcattaatacctacttattaaaactaatgaaaagggtttatatcaaatatactttaaggtataaaaatcaaattataggtaaagctgttttctttagcattttaatttcaaaacataaaatagctaccgtctattgggcatttatactgtaccagacactgtgtttgtcacatttcaaaaatgttctcatggtaatgttcacaataattctgtagggtgagaaatagtcttaccgtagtaagactattcagtaaacgaaacctctgaaccttggagttcaacttgcgcaaagttagtaacaggactaggacttgaacctgaaccatcacactccagatctctccataccacactgctagcacatgtgcctgtcatcttattcctggctcctgttatttccctttttatttcctttcccttcctcccacaacccctttttccccccatttcttttctttctttttaattgttaattacataactaatacatgcttatcagaacaattgatatagcacaaaaggatataaagtacgggtgagtgatagctcatccctgtaatcctagcactttggaaggccaaggcaggcagatcacttgagtccagagttcgagaccagcctgggcaacatggtgaaaccctgtctctacaaaaaaatacaaaaatttagccgggcgtgctggcacacacctgtagtctcagctactctgagggctgaggtgggaagattgattgagcccaggaggtggaagctgcagcagtgcgctgagattgcgccattgcactccagcctgggtgagagagagagaccctgtctcaaaaaaaaaaaaaaaaaaaaaaaagtgaaagtagcctgtatttaggctattaacatataccattcggttacctgccttttaggtatatatctatgagatatatatatatacacatacatacaaaaataatgtatgtatatcatagatatcttccatggcagtgcacacacttctacctattatttttgacagctgcatgatgtgttccatactacagatgaacttcaatttgtgaagccattctctattgactattctgtttactttggcatctttctctttgttgcaattaaataactttgtttaatgagcatctggtgtttgccttacctacactaattgagatgattgaagtgtatctagtttcaattttcaaaaagcaatagttatgtttttttccatgacattgaacagtattttattgagtctgatttcttgaataatattttatttctacaatgtgagctctcatgagtcttttctaaactttttgaaaaatctatcatcttcctttctcagttgtcaacaaagattatattttatatgtcagtactgattaagcattttttaaggattaactatttcaatcaaatgttttcaattaacacataaagacaatttaatagtagatttttcataggtctttagactgtaaaatcttgtatattgttaaatgcatatagtgaaaaaatttgaaccacaaactgtcaacaagtaatttgtaatttttccaatagagcattaaggtaactaacataattcctggtgttataaagaataaaaaatatcatatctagctagcaagagtgtctcttacaaagcaagaagaaaacctacccctatgtgatctcttgttctgagcaggtgtgaataaaagagggacactggcaaagtagaaaaagcataagctccttctaatcccttcctgccatttcctagcagagaaaccctgttttacctttcctcatacacagtatgaatagtaaaacctctgtgacaatattcctgtacaaacaaaagattattaatgtatccacaacacccagagtggatctcaataaatggtggctgctatcgtgttgctgccaaagctgctactctggcttatgagtttttaacttgttttttcttttttttttcttttttttttttttttagagaaatagtgatttttcttttcatggtttataattgaatgagaaaataaaatgagttttttggattccagcactgattgaccatgttgacataattaaaattttcaaatcctgttcactggctgtgatagagtaagaatttagttaaatcccaagagccaacctgtcctattacctttagaagtgaatatacctcctgccatctgtacttcctcccctgcccttctgtagaggtagctctcttccccactgactccacactgcacttccaacactagggacctctctgttcagatcttacttcacttcctggcagcgttcagcatcgttgagccttaacacccttttctcctgacttctatgacatcatacccttctgggtttcatgctgctttcatgaccattccttttctggcccttttctcactgctgcaatcctgctggtctcccattcagaccagtctctcatactgttctggctatttttcaaatatgtcaccaatacttattttggaaaatgttatgtattcctgcctcagggtcttaacactgaccttttcctctgcctgtctttttgttccctttttgctcacgtctcaccttttgaatgatgcttatcctgactcctctttaatttcactacggtaaccacactcctgagccacactctgctttttctttcatagcacttaccactttctaatgtactacatcgtttattgtgtttgcacttgtcttctctgatagaagctccctgaagacaaagatctgtttttcccaaagatacaccgagcataggactaggcacacagttggcattgttgaagtcacagagtctatccggtgctgtgtgtgtgtgtgtgtgtgtgtgtgtgtgtgtgtgtgtgtgtgtgtgtgtgtgtgtttaagtcgcctcgttcacttccaaggctctttttacaccgtatgccagtcagccataaatcttcatctccacctctttcctcatctccacattcactgacctcttcatatagtgtctaatatacagtcagagaaaacaactttgctgccttgcagccattctcaatttttctctttccttcagttaacatcaccccacctcccctccagtctgtcatcagtgagccctgttgacacttcctcccctccaaaacgtatcccaaatctgctcacttctctccatctctgccacacctctcgtctttgccaccatcatctttcactcagacaactgtggcagcctctttgcttttcccctgcttctccgctcttgaccctttacaatccattctccacactagctagattcattttcttaaaatataaaaatgtaattcagatcttgtcaatgtcttccagtggctttccatagcacttagaataaaatccaaagttcattatctgacttgtaagtctaaccctagttgacttttctacttctacagctgttttcctctcaccctaccatactctagtcacagaggccttctttcatctcagatatgccaggcttagagcctttaaactaactgtccactctctctatccggatttcttttcccctttttgtgacattaagtcagtgcttaactgttggccctcggggcttttcctgacaatccattctctgagtcactgaacctgtcttagttctttgcataacccttttccactatctcatgtagtcttttgtttattgagtttcatcccccatgagaatatatgctccatgagagcatagacctttttactgctgttatgtgtaatacatagaacagtgtctggtacatagttaatgcttagtagatatttgtggaatgaatgattgtgtgaatgaacaaagggagcagatttttttaattacaaatttttaatacttaagatattaactatctgattaacaatatccttaggcagagtgggaaaaaaagtgactattctgattttggggaaaggagcgctaagaaatatttatttttctgtcttttagcagaatgcaggaatagttatccccatttttttatttacatagtgaaatattttttaaaaatttttctataagaccattactcagcagcaaaattatttcatgtatggttttgtttttttgtttttctagcaaaacatgacagattttcttatagtctaaacattgtctatagcaaaagacagcttgaatgccaaaataatgtataattaggtctattcattatcttgccatatgctaagtagatgctaaggatttatcactgcagtaaaagtcactggatcattacagttattttatggaaatatgttttaaaatttacaattcttttttgtaagacagtaacaaattattatgcagaatttatacctctgcctaagactcttgcaaatataagctcctgatttggtagagatcttcctaaagattgaatatttaaaaatcaaaatacttgttttctttttttgaaaaaatgccttctgtagatatatctgggtgagaaagcaataaaatataaataaaaatcttttatcaacaacatgtagtgtcattacttcatgactgattgtcagtgtgttgtactgaggagtgtcactggtttgtcccaaagaatgaagtggtggcagtgatggcagcatctgtttctaacttgtggtttatttctcattttcaagatcctgttgccactggtttttctccccagtggttggttaaaattcagacttgtttcatgaatacatggcagtgtgatcttaggagcttgcagttgctcagtagccaaccacacttagaaagtttgatgtaaatatttgtactgcaagatactctttgttgagataccaagtcccagcaaaaagtagcattaaacctgaagaccacagaagccatggaggaaaagcacattctacgacttgagctttttttctgaagctgtgtgtagctgattctatattttattctctaaggtgaaatctcaaactttttgaaaagggtcactaaaagagaatgaaatcatgtcttttgcagcaacatggatggaactggaggtcattaagtgaaataagccaggcacagaaagacaaacagcacatgttcacattcttaagtggaagctaaaaaaatgaatatcatggaggtcgacagtggaatgatgacagtatagggggaaggggagctggagaaaggttggttagtgggtacaaacatacagttagatggaaggaagaagctcaaatgttggatagcagagtagggtgactatagttaacagcaatgtattaaatgcatttctgaataaatagctagaagacctaaaatgttcccaacacagaaaaatgattagtacttgaggtgatggatcccctcaaataacctaacttgatcattacactttccatgcagcaacaaaagtatcacccatcccccttaaatatgtatagatattatgtaccaataaaaaaaaatttaaacattaaaacaattttttttatcctttatccttccagctgaatagatttccttttcattcttcctgggaatagaagatgtaatggaagttccagtatctgtatgcaggcctatgactagcttcacttcttggtgactaatactagttgacaaaacagcatattctaaactgattgtcttcgttatccagtagctttcctattctccataacaaatgttccaaatctttgattactcacctcagaatgcttgtctcactcctcttttcctcattcctagtagatcataccttggagaagaaagtagaaactatcaggcctgaacttcattagctttttcttcctcttcaatccaaatctgtctgtatcttcattcatttttcttaaccctttccttgcttgctatttctgctttccaaaaccaaggaaggaattttgacagaggtacccaaggaattcactgggggaaaatgaatgattcaataaatgatgttatgataattagatagatagctatatgtaagcataaaaaatttttaaaaccttaggcccttattatcatatcatgcacaaaaattaagtggattattgatttaaatgtaaaaacaaaaagtataaaacttttagaaaaaagagattatttgtgacattgggtctggcaaagatttcttagatgcgattaaagatttacaaaagaaaaaattgataaattagacttcatcaaaatttagaaattttgctttatctgtgtaggatactgaagagaatgaaaagacaagtcacagactgggagaaagtacaggcaaatcacatatttgtcaaataactcatatccagaatttttaaagaacttttacaactcaataataacaagacaaacagctcaattttttaaatgagggaaaaatttaaatatatttcacatgagaatatactcaaatagccagtgagcacatgaaaagatgttcagcatcattagacattagcaaattgcaaattaaaaccacactgaggaacccactaggaatggctataatcaaagacgatcagtatcaagtattgcggagaatgtggagaaactcaaactctgttacactagtaatagaaatataaaatgttagaaccactttggaaagagattggcagtttctggaaaaaattaattgtaaatttgaccaagcaattttactacgtaagtatgttaagaatgaaaacgtgtgcacacaaagatctgtactaaaatgttgatagcattattcataacagcctaacagtgcaaatgtctgtcaactactgtgaatggagagacaaaatgtgtttattaatacaataaaactacccagcaataaaaagaaataattgactgataaatggtatacgatgactgaactttaaaaccttgatgctgcctaaaagagccagacacagactacacattgtataattccatttttatgaatttcccagaaaggcaaattatagagacaaaacaaatcagtggttgcctagggctggtggtggacgtggagattgactgtaaatgggacatgagggaatttttttgtggtgatagaaatgttataaaactagatgtggtaatagttgcacaactctgtaaattcactaaaagtcactgaactgtacacttaaccataggtgggtttaatgaaatgtgaattacactgcaataaaactaaataaaagctgagttagtaccacttgccttgggttcattactttttgttcgttcttaattattcccttcacagttactccccactcttcccctacctttttccatatttctttactcttgaaaattattttcagtagttttgcctgctgagttcactgccttttaggtcacatttagaccttgggtttctattaccacaaaaaaattccaaaatctgggtccaaatttcaactctattcacttatctgtgtgacactggagaagcctctgagtctctgtgtccagatttgtttaccaggtagaatattaataagatctattatgtgaggatttgtgaatattaaatgaaatcatatatatgagacattccgtaagtgctagctgtcattcatcaccttaaaacaagactcataagttgaaaggctgtgaactggtgagcatctagagcagtggttcttaatcagagcaaactcaaaatttagggaggttttacagactggctccactgacaggtcaggttgaaaggtttctggaccctgagagtatgtgtgtgtgtgttctccagcttcacaaatggttctgctataacccaatggtaaacaaaacaacaacagattgcagtgttaagactcagcccgtagaatgtacaaacgccaattgtgaaccctaacaaactccaattgtgaaccctaacaaactgtggtctctgggtgataatgatgtgataatgataattgccgtataaggctcatgtattcatttccagtcttgctcctctcattccctccctttggttaggtatcagatggaaggcagatacgtttaagtcatgagcgagatccacccatcctcatgtatcagttacaaatgcactgtcctacctgcgttaggacaaatgcactaaaactgtataaagtcttcagaggatattcagttgtcatagaagtgagttatatctttggttgagtttttaaacattcattcttactggggtagtatttgggaaacattgtatcaggttttgctggtagagaaagggtaaatcagtaagttaaagaataagtgatatataaggatttaaaaaagaaggcctcaagtttaaaggatatatgtaattacaagatgatctcaattttaaatcagaacacttaagttggatgtataggagacaggaaatgcatgttagagagcaatttagtggtatggaggaattcataaagtgaatttgaaatgagtaagtactatgccggtgtgactggaattaccacctctttacctgtcctcatttacctgtttttctgtctgtctcttagagttgactccctcactcttccattatccagggtatagaacacttcttgccatctgcttccagattccatcccagaataattagtttttatctctttctttcttcccattgttgacagccgtcactttctagtattcgcattgtcaatacaagttctccagtctccacaccaccagttcccaggtcctccactgtgccatatctcagccttgacctggctgtttcctcctctttctctctcctgtctagtctagatccttagtattcacctgggcatttcagaaagttcacccctctcacaaagactactaattgccttccttcaaatgctttctctcttttctctaaactctcaagaacactaaagcacctgtcttttgctgtaatacttagattagttatatgtatatgtactcttgcctagtctttcctatcagttgaactcttttaaaagcagagatagttgtactcatttttgtttccattgtgtattgcagcgtaccgtgactcatatataacctgttctcaaataatacttagagatcacagttagattttttatttgtttctttttagtgaagaattttcactttctcatttaggaatcatagagctttctttgagtactgtaggtaacttactctttctacagaactaccgcacccccatacatacagtacttagagacacaaaacatatgcgtattgacacattttaatttttgcgaccttttgataaccttgtcccaggaagggccttatcttagctgtttccatgggatggctatttcctatgtcttcttaccttcccacaccctccatgttaagaggcaggagggtagaggattgtgaggctactgttctcaaaaatgagacatttatatagaagggtgatttacaatagggaagtaatagaggtgaccaggaagggttgggaagaagggaaaagcactaattagcatatgggtacatttaaagatgggtcagccccactctgtcagtgacttgctgtcgtgagcttggtgcatgtcaagtgttcaaacacttcctatttttgctcatctacccaaggtgaaagtggaaagtagatatgaaagagttgtctggctggttttagtggggctgtactagatctggatttatggaggaaaattaaaatggagcagaggagaaaacttcttgaccatattttcatcatcccagactaatggccattgcagcaatttacttaacaaactaggtgaattatgtatttgatggcataaacatgcatacacagaatattttgctgatttttgtgccatttttataaaactttttctcaaacttgcaacattatttaaaaatttttgtataggtttgtcaatatttgggtgatgtatgatctataaatcaattatttaatatgtaaacaacagataagaaaaatcctatcactgtagtttgaagatagcaaacattttaataaatacattgaacatttcagtttattagtctttattaatatttccaaaggagaagttaaaataccactgcatagttttcagattgttttacttggtgaacaggcaagagaacagaataagagattgaaaagtgaaataaggatagtttatagtttgtttaatttatcactggtcccatttacattttgggatcacatcttggatgttttgcaacttccaattcattctagcattttgggattcttatgttgacatagttaattctatattgaaacctaaggacttgttatttaataaacttgtagaaataatcatttccagttaaatgaaccacaaagattatgaagttaaaaacaaatcagttatcatttggtagttctgtatagtttattgtcagttaatgatctttattaaatttgcagctttctcagtttatttgcatgtaggtcatcatatgctgagatgaaataccaagtcatttaaattagatactgagcatgctcatatgaagtacttactcttggagactgcggtgtggttcagttttcttatagtggaaagagcagaaaagagatcacggtgtgcccctttgtcatcgttctgtcaggaagcatgtaatttgtctttagaaaccagaagcctgagacaaagaaaagaacacagatttttagcaaaaggctatttggtgagttaattggctgttttgttctattttgctctaatcggtcagttattcctagctagtctatgtatttacttatatctgctgcttttttgtactgtgctgaagctttatgtagcaagcaacttagccgagatggggagaaaattgtttctgcagtctaaatcttattcttctgaaatatttccagtacatttctgaggtgacaagttcataaattgctatgatgatactttctcatgttctccacaaattttcttgctgacttgttttgaataatgctggcggaattatgtgccgagatacttcaggatttgtttttttggacagtatagcatttttgttcttacatcttaatgaaattacaatttttgctttcacatttctatattgtatctaccaaagtaataggtaagacccagtttgcataagatcaaaaattctttaaagaaaatgatagggtatattacagtaatatgtacacatattattaaaaaggtcgtttaaaaatgaaagtttgctgtgtaatacagttgatcatataaactattctaaaataaaatgaaattgacaacattttgtaaaataaaaggtgttacagttattctgtattcatatttagaattctatctttatttactgattagctacagaagagttgcatgataatagttttgccagtttaggctgttactttctctgagctcatattatggtgatcaataggaagataatcttatttaaatgttttgtgatttttttttaaatccaaagtgttcatgttttaccatgaagttaaagggcgatatttttatgcgttttctccatattatgctcttataatattatgtaatatttaaaatctatacattgttattttcatgatgaacacaattttgattatgtatttataataggtgaacttggcaaccaaatattcagagtcttctcctggagattaaaatagcattactctgctagagataaaccattatatgttttgatgatttgaagaaaaagcataaaattaccatatttatttccttcggggaaaatcatgtttgttagtacacataaatgtcaggtagggaatttgaggctataaggtgctttaaagaggtctagaaaaatgatgtggggggtgggaacgataggaagagactactgaaagcttagtaccttcaaatgccaggcaattatgtgaggctttcctgaaatatctttattttgtgaacttcccccactatgccattttccaggattggcacatatgaaggaggtgggtgtatacttaagtttatatattcatgaaaagggagggttagcgtttagagatgaggactgggtgacaggactcaagaaatctattcccacttctttatactgactcacttgtttgaccttgcacatgatgcataccttgtttatttctacttacttttagtgtaatactttaccatggcaataaagtggttcatttatagtttctaaagcaataaaattatttcacagactgtgacaaagattcatgaggggataagtcattcgctaatagccattgtgggaagaaaacaaacaagtattgcttttccgaattctattaaatttttttcaactaaaatatttcaagtgtataaaatctataaagtcctctgtagtctttgaaactaatctcagaaatacatattctatgtgtattatgtaatggtgacagatgtggttttaacttctttctcatattcactgtaaacttgatgatcacaaaattttcatggcaagattgtattattatactattttatactattttctcttatttttttagtcccagatacctctaatcataagtcttcatagatcaatagaagagaaataatgaatagaagatctatgaaagaaaagtgtggagaaatactgggaaaatgaaagaagaatacagaaagaaaaattaccaatggcaagggtgtctttgccaggtttctagatattaagcatatacctatctatcttattgatttccaaatcattacattcatctgctcatttaacttaacatctacccattaaggaacacttatttccttaattttgatgaatctcagtagtgcttaaagatcctaagtagtggtagatgaaaatgggttttgtggtcaagtacgtttggggaataatagaccataaaggattgttcatagcagaacttcttgccctttaatatcttattcagaaccttaccctggaacttaattttttctggcatatggtttacttttaaaaggaaaaactgtaatatataatattaaacatttggcaagcatttcagtaattgtaactatgaatttctatattaaaatatctggataagtgaaggaaaaattgtcagtttgctttttatcttctattttgtaatcttagaattacacggtaatgagaagtaaaatgtataattagtagataaggtgattgtaatagttatataagttaaaatggcatttttgaaagccactaggagtgtagtcaatgactactacatgaaatatttataataaaatagtaaccaagtaaagactttgataattctcacaagtttcgactcattctctactctagagaacctactctcatactctaaagaacctagcatggtgttagtcacaaagtaggcattcaataaatgtttatctaggccaggtgtggtggctcacacctgtaatcctagcactttgggaggcctagatgggtggatcacctgaggtcaagagttcgagaccagcctggccaacatggtgaaaccctgtctctactaaaaaatacaaaaattagctggcatggtggaaggcgcctataatcccagctactcaggaggctgaggaggagaatcgcttgaacccaggagtcggaggttgcagtgaaccgatatcatgccattgcaccccagcctgggcaacagagcaaaaactctgtctcaaaaaaaaaaaaaagttcattttttcactcgaatttaaaccttctgcctcttcattgaaacacatcatactcatggacgtagaatacctgttgtctgctccattggcccagccacctactttaggggactttttcttaaattgtattttgaaaaattgatagttggatttggtttccagctaagctctcattttttggcactcctgtgaaatttgaaacctaatttaaatagcagttttctttgctgtaacctaatgactaatacatgttctcaaatcattgtttattctaaaaagagaggatacaaatattaacagatctaggggcaagacttcctattcttagctacttaagagcctgagatgggctagttgcttgatcccagggtactctgcagatcgaatgttggcctcaaatatttgacatcaatatgattgtccctgagaatggagatagattgagtttccattaagattagtgtaaaattgatattttggtagtttagtagccatatttttctcaaaataaagtactagaaattgaatatgcaattcagagagaaatagtgaaaaatatgaggggacttcaaaaattcatggaaaatggatattgtgataaaactatgcatggatttaataaatttttttacaccaaaataagcctgtatgaatgtgttatagcaagtctgaacaggacctagtttgaggcactaagaaggataagacatcagcttgaaaagaactcctatcagagcaacatgaattctgctaaaattgaaggaagaataaacatcaaatttatggtaaagcttgggtggaaggatggtgaaatcattgatgattcacaaaaagtttatggggacaacactccaaagaaatcagcagtttacaaatggataactcattttaggaagggacaagacaatgttagagatgaagcttgcaccaacagactatccacatcagttttcaaggaaaaaataaatcttgttcatgccctaattgaagactgacagttaacagcagaaataggaggcaccaccatagaccgcttgattgattcagtatacacaaatctgactgaaaaattagttgagcaaactttccactcagtgagtgccaaaactgttgcacccagattagctccagagaagagcagagcttccagtggaaattttaaacaagtgggatcaagatcctgaagcatttctttgaagaattgtagcagaagatgaaatatggctttaccagtatggtcctgaaaacaaagtacaatcaaagcagtggctaccaagaggtggaagtggtttagtcaaagcaaaagtgaactggccaagaccaaagatcacagcaacgattttgaaagatgctcaaggcattttccttgttgactttctcaagggccaaggaacaataacatctgcttatgagagttttgagaaagttagtcaaagctttagtagaaatgtctgggaagtcatcttcacagagttcctctccaccacaacaatgctcctgctcattcctctcatcaaacaaaggaattttgtgagagtttctgtgggaagtcatggggcatacatctcatcatcctgttttggcttcttctgacttcttgtttcctaatgttaaaaaaatctttaacggatgtccatttgtattcagttaataacgtgaaaaagactacattgacatggttaaattcttagggctctcagttatttagggatggactaaatggctgatattctcatttacgaaagtgttttaaccttaatggagtttttgttaaggattagtttataatatttatcttttctttcatttttccacagacgttttgaagtcccctgatacatcttagtaaaatgttacaaatattcagagatttttatttctgacatttttaaaagtataagttcaaaatctactttgtaaaggtaacaaagactgtaaatccagaacagaggacctgtgacttattaatacaaatggaacttttcccattagttgtcatttaacatgaatgatttccggtggaagagttctggattttaggaattggaatcttctcccattcttcttgatgtctggtgtacagcttgtctgctgtctagcacacatctttgggttattttccattccagatgagctatgattttttatgcataattttttggagctatacattttccttgagaataaatatctgaaattatagtttaagtcaataagaaagtatgatttttaagtatatatcagaaacatattttccctttgaggtcacattgtcagaggcaggaaaggaagaagtgcagcagttaatatctagccagcaaaatttatctgggagatggattactaaggttaataagaagtagaaattatagagcaaaggatgtgaatgttgggagacttaatcagtgtatatgtttcctgattggtcagagacattgtcattttcactgccttttctccactttctaaagagttgataaggaaacaatttttttttttatatttgaagagttgatctatttataaattttaacaatgacattcaatagagttactgctgtaaatctagacattaacatgaaacttagccgtgtattttaaggcttaaggaggtattgtctagggtttatggaggactattacattatattctttttcttgtttttaatacttaaaaattatgaaataattaatgtaaaaaattacagatataccaaagatatgaataagatagagagttgcccctacactttgttctttggttttataacacataccctgcccccaccaagttgaataatactcccccacttcagagtgtgtactgataatattctgatcccagaacctgtgaaggctactttctgtggcaaatacttagcagatgtgattaaattaaggactttgagatgaggttttccttgatcttggtggggagggcggtggcgaatgcagtcacaagtgtccttagaaggggaggtgggcagagggaaatttcagagagcagcgtgactcctgaggcagagatggagtgatgggaccacaagccaaggcatgcagaagctggaagaggcgaccatgaacttattctcctttacggcctatggaatccctctcaacaccttaatatctgcccattaaaactgattttggcatgaattctggcctctagagctgaaagaaaataaatttctattttaagtcaatagaagatatcaaatgacctagtcacaaaaaaaatttattttaaagatcttaattggcttttatttgcaattctagaatcagatgagacctcatcctataaaacagaatgagtgttgtgatgagctgagcagaggaggttggttttattgacagaaaagggctgaagaaagccgaaacagagaacaaaaagcagtttggttgttttaaagttacttaccttttttaaagtttaaagcaggaggtactgccttatcatgccagctaaaattggcctgcttggggatttggctgttatctccattcctctcccgatttcttggaaggtcagataaacaacttggttttggcttggtggtgtgaacttcagcatgagtaactccattttggtttggtctgttgagcctagtgcaggagctcagtccaaaccaatgaacttctataaattttatttaacggaggcttgtattagtttccaatgactactgtaacaaattaccacaacattggtgactttggtaattcagtcacatctgctaagtctttgtcacagttgggatcacgtggaataatcgcttgaacccaggaggtgaaggttgcagtgagctgaggcgacggccactgccctccagcctgggagacagagcgagattccatcttaaatttaaacatggggcagctatcaaccaaagtcaaaagagaaacaaaaatataaggcatctgttaaaacattactttcaagtaaatgtaagcaggttttgaaaaattaattggctgcgtgtggtggcccacgcctgtaatcccaacactcagaggccgaggcgggctgatcacctgaggccaggagttcaagaccagtctggccaacatggtgatatctcatctctgcttaaaatacaaaaattagccaggcatggtggcgggtgcctgtaatcccagctactccggaggcggagacacaagaattgcttgaacccaggaggcagacagggcaaaaccctgtctcgaataaaagaaaaaaagaaaaagaaaaattaatccatgctcattagtttagctttaatcttaaatatttataacttttgaaatgttgcatgaccagtatgttcataaattcatcaaacatatcctcacagcatctacagggaagatatcattcccatttcagaaagaggaaaacatgatgagagtgggtttttttttgttgttttttttttttttttaatttcaggctcccggagactgtaagtggcagagttagaatttaagcccagatctatgtaactccaaaattcttaatctctaaactgaagaattgttttcagtcttgttccagtacctatactagatttccaagaattcagacaactcctaatctaccacataggggaaatagggtctataagaatatcatttatgtcagatagtgaaacaaacatgagattatttacacattccagacccaggtgacctaaatcttcaaagaaggtgactgatccctttggagcaggtgctgcgtacagtgagagagaagtatgtgtattgtgtgcagcggcatggatggggaacgatttcttctgcccaaggatatgagggtgtgggtggcttctcagagcagattatgtctgtgttgggttttgaaggatgaataggcatttgctaagcatggtttctttgaaaaaaaaaaattgctaagcagaaaagcagggatgtgtggcactctagacaagagtgaacagcaagaccaaaagattatagatgtcttcaaggaacaggtccttcagtgctgctagagtattcaatgtgaggtgcttgggggcagggagcacaggcagatgaggaaggcagatctgaaaagccttgtatgccatgctaaggagcatagacaatcctgcaggctttggtgagggtcatttttaagggtttcagtaggggagcagaacaggacaaattgcatattagagaaacttgcagcagtgtggaggacaaattgaaggaggaggagatagggcatagattccttaatgtttgaaatagtacagttgaaaatgggacaaggattttaaactgtggcagtggaaatagagatagatcaatacaacgtaagttaaggagatggaatgttaggtttgatgaactgggatggcaggtagcgaatgtgagagggagaactgttctctctggcatttgaattgtgtttgagatgagacattttcaggggaaaaacaggtttaactgggaatgaagattggaccttttaagtttgaaatgtagataggatattctttttgttgagaagcaaaaattggatatagggctgtacacaacaaaataataataattatgataatactaatattatcagagcaatagatttagaatgtaaaggtttagttaaaacatcaatattgttattgaatgataaggttaataaggaatggattgaaccacttaaggatggagtgtgtaaaatgaagtaggtttggaggtagaaccataaaagaaacaaatgtctagctgctgtgtaaaggaatgctaattcagcagagcagacctagcagaagtgattagcataaaagaaccagaggactgagattaggaaaaccaggagaggggagtgttaactgtctcaggtgctacacatcagtcctttgagatgcggaccaagaagcaccttttgactttgtcagttaaagagacatcagtgacctttgctgaggcaatagggagaatagaattaagattacagttaatggaggagggaaagaggtgggagggaggaagtgagaagtacaaatagcctttttgactgagaaggaaaagagaaattcaacaacatcaaagaatgggagtgactaaagtgtgtttttcagctggtacataggagccagtagagagaaaaggttgaagatggagggaagagaagaaccagttgttaggacaaggtgccagggatgttgggaagaaaacagatccagcgacatatgatggagggtggacttaactaccctaagatttgagggcaacaaatatttgcttggggcatgggagtgattaggatggtggcttaaggagagtgacaaaaattttagaatagctgctaaagggagaatgaaagcaaatgaaagagttgtctgccagatggtgttaagagcccatctgaaagtgaaaaccatgaattgttcatcacatcattcaatctgcatgggtagatgctgcctttcatttgaaagcagcatatttctttccttaaaaaaaaaaaaaattggctgggtgcggtggctcatgcctgtaatcccagcactttgggaggccgaggtgggcggatcacctgaggtcaggagttcgaggccatcctggccaacatggtgaaaccccgtttctactaaaaataaaaaattagctgggtgtggtggcgcatgcctgtaatcccagctactccagaggctgaggcaggagaatcacttgaacctgagaggcagaggttgcagtgagctgagatggtgccactgcactccatcctggaagacagagtgagattccgtctcaaaaaaaaaaaattgctctaaaatgtatctgcttactaaaaactatttcttcttttgcactacttggaacttccttgtcagtttaagctggtttaggttagccagctagccaaaagtttttttttaaatgtaaaatataaaaatatgttatgagttataaataatatggaagctataatagaatccagacgctgagtaactatttattgagtgtttagtgctttctagcatgcagaaatggccagggaaatatgtcctctgacatgttaacagctaacattttatcctcatgtgtgtggaggtaaggggcgttgcatatagtagtttggataacagcatcccctgtcacttcaagttatactttttaaaaattgtaaagcattcttatatttgaaatcatataatcatattcttctgagaacatttcataaaataagccatataaagagccctgttctactctgagacccctttaaaaattttagcagttttaaatttagtctcaagtaattcagcaagtttaaaaaaattgttctagccaacaagagctataataggcacttaataattgccaacatggtaaatataatatcaatagcttgaagaagcactgacttttggctttctgactaaatttgtgtctccaaaggtaaaatggtaatttaacaacaagtcagcccccaacttacaaataagatgtgttagaaaaggttgtataatattgagttgggtatgaattacatttatttttattgtttttttctagaaaacttaaaagataagtgtaagcaataaaatatagataagtttagaagtaaagaaaatcacaaaataccgacttgctaaacatagaagtcaataacattgctgtaattgaacttcagttttagctccgtttcccattgtaaaagggaaatataagttaccatgctgtcagaaagaagaggcattttggtttatccggagagacagtttttccttgaatagaatttctcatgtgggtttttatttaggaacactgggtggtataatagacaatttgctgtacaaaatttttgcagctaaataggcaggcttcctttggttttttattacagctgtctttggaaaaaatctaagagagtaacattgaactcatcttaatataggtgattcttagaggtcctaaactaatgtgatccttctagtggttaaatgttctgttggccgggcacagtggctcatgcctgtaatcccagcactttaggaggccaaggtgggcagatcatttgaggtcaggagttcgagaccagcctggccaacatgccgaaaccccatctctactaaaaatacaaaaattagccaggcgtggtagcaggcacttgtagtcccatctactttggaggctgaggcaagagaattgcttgaacctgggaggtggaggttgcagtgagcccagatcacaccactgcactccagcctgggtgacagagcgagaatccatctcaaaaaaaaaaaaaaaagttctgttaagggcagagcctagactacctaagggattcactgcctggatggctgtgggctaagaaccgttattaggacagggagaaaatgaaggtgagacataggtttttcctatcatgttttcttgtaaatgtgattactatcttccagatctactactgattgtctgcctgctactgttacctcttaatatgttaaatataacctgggatgcttctaatccttctttccttgactctctctccagaaaaagtcctccatgacttcttttctcaatactgtaattactgatgtagttattttgattgtgttttatagtcatagcagtgagactgccttacaacaatattgtctaaattaagtaaatgcaatagccaatattagactggttttgaccttcagaatggcaacgccaaggattcatccccatgttgtaattatgatttttaaacgtattataatcaaaaacacagtattaaaagggatacatggggtttttcagtcatgcaacaaatattttactctgtgctccataaacacctactatgtgttaagcattattctctatgccagggagatgattgatatgatagtaaacaagagaattacacgtgtggaatgcagtttactcccagaaagggaaagattgaataaagcagtaggttacccagaattgcagaaatatttaggcaccaaggagtaatggaaaggctaaatatgtacaggatgatatatgtgataggagcttggcatacggcctgagcacataaatgcttaataaattttaattgtgccagttgcttttgttgctgtcactatgccaattgtgggataaggtagggatgcaaatcagaataaaaatgttcaacaggtatgaataaaaatacagcccatgaaggaagttggaaaattagtccaagtaggaaaattctccctgggtcagagctaaggagaattcagtgctgcggaagccaagaatgtaaagatttccagtcgtcaaaagctgcgtagacatcaacagtatgagaaagaaacagagatcattaatgtggcaatgatgagaatattgattgacctttaagaaagcagtttcagtagcatgattggtgtggactctctggaggagtttggcagaaggagaaagatgaaagagctgagggaagaagtgtgctttttaaatttgaggacttaacaatatttacaagctttcagaatagttaaatggattacattaagttatctattgctgcataagaaatcatcccaaaatacagtgtttaaaacaacaataaatgtttctgtgggtcaggaaattgctacagtttagctggatgactgcctcaagattgttggataccatcttgggggctggctaccacaggtggttgagagaagacgtcagatgatttaagttatttcagtaaattagaaagtaagattatctgctgggacttgttcgaagcttaagaatagttgaaaaatcagtagcttctctgtggctgggggacattaatcagagagggataggattgtcaaatagcattgttttagatacatccgagacattgctccacagagagttataacaggttaccagtaatgtttgcacaaaatgttttctcctccagtgttacatgagaaaacggagttatttttgcctaacttctagctcttaaccttccctgtaatttaaaaaagtcaaagatgccagtgattttttaaaaagtgatgccatatatttaatgtaattggcaagaatagaggataaagattggaatgctaaactcttgaatagataacattttattctcatttatgaaagaaacctaaatttcattagatacaacaagaataagagataagaacatattagtctgtatttataaattcatgatctttgtagcaatatccaaaaatcctgtagaataaaaatgtttctccataaaatattttctctgtaaaaaacatgtctaaagttgtatgattgatttttctccagtaaaaaggaatggaggagtatttcaataatttgtatatctgaaacagttgatagaaaggttgcctggatagctttgaattatctaattatatgtatatattgtgtttacttatttttgtatatcagcagattatcctgggcaatgggatcactgttctgttacattttcctctatatgttattacatttttaaaaaagaaaaaaggccacaaataattattattattatttttttttttactttttaattttctttttttttttaatttttttttttattatactctaagttttagggtacatgtgcacattgtgcaggttacaaataattattatttattgaaaaagaaactacagttgacccttgaacaacacagatttgaactgcgctggtccacttatatgtggattttttttctaaccaaaagaggattgaaaatacagtattctcaggatgcaaaatctgcatatactaagggctgacttttcacatacatgggctctgcaaggacttgcatatgcactgatttgggtttacacgggggtgatgatttggatataggcaggtggtcctgaaaccgaattcccgagcatgctgagggatgactgtatatgtgaataagacttaaattatatttccaaacttgggatggaatcaaacattttagtaacaattctgttgattacacttctatttttaatcttgtaggactgtatttattttttatttttgtgtttgaatatatgtgtgtgtatgtgtgttgttttgggaaacaattataaaagatttgtgaattatttggatgtatgctattccaaatactcctgtttcccttcttttttttttttttaagttcttcccttgaattggcaatcataatttacagagatttgttactatacattgaatacttataggttacctgttattattttaaaagcatgctaatataacattttacatatgcctttatttttaaaatatggttaaattgcttttaatcttaggctttaattgatttttttcccatggatttttcagaggggaaggttattctctgtacctaatgtataggctcaatttctggtgtcattcagagaaaaataactgatacaagatctttatataattggttttggtgtgggtatggatgggggagtcatttaaaaagtaggaacaatagaagtacctttctggttttgtcaagcataccataaaacaacagttaatactttcaaaacaattttcttctttctaaaaaacaatttcacacaaaagatgagttgatagaagaattgtagatagatgtgtggtaaacaaatacaatgttatgtaattacaaaacctaaatgatgagtatagatgttaaccatacaattaattcaacttttaactagaaacttttcataataaaatgctggaaactgctcccatccccaccccaccccacccccaaaaaaagaaaaagaaacaatttcacacagagaaagtccaagaaactctccaattgcttttttctcttttctttttttttttaagctttgagtaaatgctttcatcaatcatatgtgttcatggaatgcagttgtaatttctacataaaatgaagttaattgtctttaaatagttgttagccacatttccagatgaaatgcccaatacttcctgagaaaagttatcagttaactgacgtcatctagcttgcagtctgcgtcattaagtttgacagaggtatgaaaatgaaacatagatgtatgctagagccccggttgtggacaagctatgtcattcatgactcattttaaacaatacaactttagatgttttataaagccaaattgtagttagaatttatagttagcatgttaaaagctatggtgtgcactatttctatgaatgtacattaatatctttaatcccttctccataagagattgtgacctttgggttgattccattttttgtgctgcttttaaaaagaaaactgaaaagttgagtcgtttattattggttcctgtgtgaaatgcagacctagacaaattgttgaaatttatttgtaatctattgtctagcaaattatgtgaattttaacagaaagcgtaattccttcattaaaaatatctgaactcaataagaaaacagacaacccaattaaaatatgagcaaatgatttgaacagacactttgtcaaagaaaacacacagatggcaaatgaacatgcaaaaaaaatgcttaacacgtttgtctgtagggaattgcaaattaaataacagtgagatactactacacacccattaaaatggctaaaattcaaaaaactggccataccaactgctggcaagattgtgaatcaacaggagctcttattcattgtggttggaatgcaaaattggaagacattttggcagtctcttactgaagttaaacatagtcttaccatatgattctgcagtcatgctcctaggtatttccccaaatcagttgaaaacatgtccacacaaaaaccagcacttgaatgtctatagcagctttattcatagttgccaaaactggaagcaaccaagatgtttttcagtgggtgaatgaataaataaactgtggtatatccaaataatggaatattattcagcagtaagaagaaatgggctgtcaagctacaaaaatgacataaatgggtcttaaatgcatattgctaagtgaaagaaggcaatgtaaaaagtctacttactgtattattcccatacacgttctggaaatggcaaaactatagagtggaaagaccaggggtttagggggtgagaggaagggttgaataggtgaagcgcaggagagtttatggtggtgaaactattccgtatgacactgtaattatgttcatgcgacactgtctgtcaaaacccattgaagtttacaacacaaaaagtaaaacccgaccgtatgcaaaaaatccttggggatgtcaaaggagatcccaaggtagaatgcagactatgacaaaggagcctattacaaatgtatgacacaacctcactgaacggcatggggcaaaaaaggtgctcacctaattaactttggaagtgtatggagtctgtaagacgaaagacaaacaaaactacatactttatttcagtaaggtcatcaaaaacaagaaagtctggggaactatcatagccaagagaagcctaaggagacatgatgactaaatgtaatgtgatatcctacaacagaaaaagcactgggtgaaacctaagggaatctgaagaaacaattgactttagttaatttttaaaaatattgccaggcatggtgacatgtgcctgtagtcccagctactcaggaggctgaggttagaaggattgcttgagcctaggaatttgagaccagcctgacagcctgagcaacataacgagacccccgtctctaaaatatatatgtgtgtgtatgtatatatatgtatatttatgaatatgtatatttgtatacatacttatatatatttatacacacgcacccacagtccagctttctttgagattatcaaagaaagatcctcaaacaaagctacatttttttaatcctttggagttacagatgggttggatttaggaatatttatgttcatttcctagtgtctgtaatttctgttttatgcttcaaataattttgtgctttgtaaaaatcttggtacagtttccctttgcaaatgtaagcagagcctaatttaatgatttgttcgttctcagctttgggaattacagagtgcactcacacatgcggacgcctcacactcaccatccctttttgcaatgtatactcaatgattattgattgaaatagcaacttagtcataaccagcctcttcctatgaagattttgaaatggcctataataaaaaggcaatcaattaataatatataaataagaggaagtggaaagtcagtaccggagaaaatatgtgtttgagtcagacccacagggatgtgtaaatgatttttgaaatgtcagcacatcaggttttcttttagctactctttaattctggaatgacaagctcaaatgcctttgagagctgggcagatgctgtaaatatgtgcagttggtgaagtgtaatatagtaggaggtggtggagtctctgcttaccctgccaaagacattcactcgattgaacaccacacttcggggggtagctgccagtttgctttaattttggcctaaatttttgcagtgaatcagctcatataatccaagggatattattaagtaagcatttgattgttttatggagaaggaagaaacaatagatgtgagtgaaattttgtctttttttttttttttttttcattgttgtgtgacatcaaacctgataccctccagatagctttgcagttaggcaggcctagcctaattttgatccctgtatccaaaatgttgctgagtgcctcccgctacaacccgtggctcctaagtggaaatgtgtgctctgctgttgtctctagggttgccaagacattaacacactctctacctctgttattcaagcatacatgggtaatgaaaacaatatcataattgccacctggtggacagtgatcataaaatccatcagatatgaaagaagcctcttaatttcagctgtttcttaatttcagctgttaaaatgtttttgtttttttaaaaagtattagagtaaaataagtagggtactctaggaatgtttatatagttgttttcgttgtgagatcatataccaatactttagaacaccagtaacttatctgggaaatctgggactttcaatccacagccatacttgtttgttttgttatatttaaattactcactttttctttgtacaggtttaatttggtttttcccaaagcatggtatacatatcaccgatagtatataaaatgatttttaggtatgttgtgagctgagataaacaaatttgggcatttgtaataggtataaaaatggtcatttaaactgttcctataagaatagagtccctctctgttctttttaggcattccagcaagtatcttacatcagagattaactcaaaacataatattctggcagagggatcagctcagttaatggggtcaagcagcagaatccttcactgtgagggaggaagagccaagtaaaattctttgctggaccgctactccaaagttgtttggcttccaggatagccagggatcttgtttcttatttatgtaaagactagagaaccagccacatactttgaatatcactcatctcactgtgaaaaaatatttccaacatcccttatgctaattaatgaaccttctgatacagaattagttagtgatacttgtagtgcctgtgtgattgttgtctaggtttccttgaatgtgaatcattaataggatatttaatagattaactgtcttcctccactgtttatactaaagtgttttaaagttaattacagtgtaacaaggtagtatgtggatgaaattttctcattttaatattgtgtgttagaaaactatagctattttttgaataaaaatctgcaattttgcggatactgcttaggatgagactaggttgcttttttaataaagtaactctcaagtatggttaatagtacatgtggcactcaagttcaatgagatccaggaatgatgaagtttggaagtctggtttaattgaatgacttttgtttttgtttttgtttttttcctgggcagaattctaccattaacttcttttcccactcacttgcccattatcagtgggttttgctcttacatggtataaaccagttttctgcatttcatagtaaaacattatcccaaggaacacctaccttctttacaaccaaatagggccatatgaaaaatttttttaaaaattgttgcataaaataagtttaaatggccttcagttttggagagtttaatgaaatatttctaaataaatatgactaagttacagaattttagacaatttgcttcagtgactatctctgcttaaagcattttcaatgaccatcattcagtgttctaatgaaataaaaattacatttcattacataatgatagtgatatttcaaaagtatatggctttaaatatatagatacagtatacacgttctaaaagcaatgtttttgacatttacttggaaaaaattagtgttttagccaggcatgatggtgtgcacctttagtctcagctgacaggaggctggagtgggaggattacttgaggccaggaggtcaaggctatagtgtgctattgtgactgtgaatccagcctgggcaacatagcaagacctcatcgccataaaaaggggagaaaagaatctgttaaaattggggttatctcttctgttagccacaacgggatggcagttttaagacaatgaaggacagataccagtggaaagggtttttgcaatcccttgattccatacagtaggaagtgcccatcagtacttgtccttttacagctactttcagtccgctttcccaaaggtgagagtctcaatatttcacggccacaaaactgctcctttttactccatctttggggagagatgataaaccattgcctactgcgtgtgtcagagcatgtagtccttttcataacgttcctcagagcagaaattgtggaccagtgcagaatttgcttactacatctaaaacatctgagggtaggattttaattttctgtctcttttttaattgaaaatttgcaaacaagtaaaattctagaaaatatggggttttagttttagcatttgtggagttttagtacagaatttgcagttcttgcttattattttccctcgttacattatgctgtatggtctgccttctagagaggaccactctgatccttgtagaagaacaagacagtaggaaacaatctgttaaacccatttttctcatgagaagcaacaaaagcattataaggtgatgttagagggtcccaaactaccaaaaagtttcctcaaggatcttcataactgtaaattattaggatctccttcatttgtggtttagatcagaatgctttttaacctgtttgtcttctgaacaagttggatgtgcagtttggcaattccatttgcagtgtggggattaatctgaatgtagactcacattttaagtcttcttagagggctggaagtaatgaagatcatcccaggatatattcagttgggaaaaaattgtagaaaattgtgcgattaaagcaagtcaaaatcctactaactagaactgattaaattccaatgcacatcttccttcagatctttacatatttcatattaatgctacgttagttatttttcaattgtggtaaaattcatatcgtgtaaaagtaaccgttttaaaatgtacagtacattggtatttaatacattcattcacaatggaatgcaaccatcacctctatccagttccaaagattaatctgctttctgtctctatggatttactatttggggcatttcttataaatgaaattctacaatatgtgatcttttgtgtctagcttttttcacttagcataatggttttgtgattcatgttgtagcatgtatcagtacatcattcctttttatggctgaataatattccatcatttgtaaatgctacgttttgtttttccattcatttgttgattggacatgtgggttctttccaccttttggctattatgaatagtattgctgtgaacatgtatgtacaagtatttgtttgaatacctgtttttaattatttgggtatatatacctgggagttgaattgctaggtcatatggcaattttgtgtccaactttttgagctaaactgttttccatagcacctgcaccatttacattcctgtcaacactaaatatttatgctgagatcctgaactgactcttggacttccaaattaaattgtgaacaatctggaattttttgttatagttaggtaacactagcatatattgttatgaaatttttcaaagaaaagctgtgaaactggtccatttttaaagtttgtgtttggatagtcgtaattttttatgtctgatcttcagtcatctgaacatactttttaagaacagtgtttaagaactgaatgtgctctgttatttaaattattatgccttattcctttcttgttttgtcttttatatctaatatgtaggtaacatttttgaaatatttagccaatttaggaatcaaagagttatacagattatttagaattggagaatctttctggatagcaatttttaagtttttttttacttgattgacagtaattttactgtataaggaagtcggttatatccttccagttcccagttccatacctcttttgtgatgttttctattatgcagaacttaaagttttggcagcttaatcttttgttgctcattgttaatgttttcagtttcttaatacacagaactggctttttcattttaaattacatttccattgattaaatgtacttttttgggggtcacagaatgtgatagaccattcttggtgcctaccaaattgctatccactcttccttccaactttcttcctattggaaagaatcccaattttgttctagtgatttctttttttttttttttttccctcatgtcctctgggaaggtaagcttcctcagccccaggggctaaataatagttattcttgtagagttaatcctgttccccatgccagtaattggtttaagctgaagagcttctgtgagtagtttaaacacagagtagtttattctttcaagtaaagcagtcccagagataagtattccagggttggaatcagagttccttccattttcctgctttactgtcctagaatgtgagtgattttctcaagattaattcatgctctgaaatggctctcattatgtccagaaggtataaaaatcagaagggcaaatgaattaatttcctaaggtcccccacctcattggctgtgcctaattaacatgcctgtacctagttgcaagggaagccaggaaatgtagtacttttgcagggtgcattccttccctgaataaagttgagcaagaaaaaaagaatgggcagtggatagcaatgaccgatctctgccacagcagcagttgttgaaggttaaccaggtttagagttcagtagcagctgttttgcaaaaacctttataagagaacgtttcattcaaaatctaaacagtaatataagctaagtcaaacttgttttgtgatgtgaacttaagttcatatcacatctcattttctttcatattcatttctgtagtcattcactgcatcacctctggacaatgggagcccgctaagatcccagcttagtgcttttaattgttgtggtgggtccttagtataagccctgcatcacagtaagtgaaactacttcatgggaaaatcagctttctcaagggcatttgtgataaatccaaatccttgccaatcctccatgtgacttatggtcctctgctgataaatctcctttgattataacccttgtctctttagtagctgtttgtggcctactatgttacaccaggtccctttgtctaatactcacaacctttcagtcctgctcttcatataccttactaagccattgcattatacaactaagccaaactaaccatttcatttttaccccaatatatttgcatcatgacttcctgttttctactctccagatcctacctatcctttataggattcaaactcaaagcctatttatatttttctctgtttttttctgatctacatgtcttttagaacaatagctattgcaaaatgagctctaattatatgtcagacactattgttgtaagtcttgtaatgttttcatttgtttcatcgtaacaattatatgaggaagatgttattagacccattctagagatgaaggaagaactgaggcacagagacgtacaatagttttcctcagacctgatccagaattctgatctaggcagccaaagtccatttgtgcagtagcatatctaatattctcacttgtattttacttctgtacttatctattccacttacccacccacacctagacattctctttttttctttttaattttttaattctcctacaggatctagaaaaaatgcttattttatggaaaaagcattacactctaaatatttgctaaacaaatgaaaaatctattagccaagtaatcaaatctcaaaccatttatgtgatttttttaacactagacagcagtatgtgtaacattttcaatagatttccaaaataaggataagtggtttcatttaaaagggaagaaaaaacttgttgacaaaggaatttatacaaatgaagtgtaaaaacagacaaagaaatctgccctccagtatcagaaatatgaatgtagaagtgtggcaagttaaaacttgtttttgttttttaagtcactcatagcagagaaatgtttagtttgttttttgtttggttttaagggaaaatagccataccccagtaaaacttgatgttggcaggcagatggtcttggttagagttgttgacatgagaccacatgactgtgtctgttatgcaatattgtgtccggaattggtgggttcttggtgtcactgacttcaagaatgaagccgcggacccttgcggtgagtgttacagttcttaaaggtggcgtgtccagagtttgttccttctgatgttcagatgtgttcggagtttcttccttctggtgggctcctggtctcactggcttcaggagtgaagctgcagaccttcgcggtgagtgttacagctcttaaggtggcatgtctggagttgtttgttcctcctgtctagagttgttcattcctcccggtgggtttgtggtctcgctggcctcaggagtgaagctacagaccttcgcagtgagtgttacagctcatagaggcagtgcggacccaaagagtaagcagcagcaagatatatcgcaaagagcgaaagaacaaagcttccacagtgtggaagaagacccaagcaggttgccactgctggcttgggcagccagcttttattcccttatctggccccacccacatcctgctgattgatccattttacagagagctgattgatctgttttacagagagctgattggtccgttttgacagggtgctgattggtgcatttacaatccctgagctagacacaaaagttctctaagtccccacagggcactgattggtgcatttacaaaccttgagctagatacagggtgctgattggtgtgtttacaaaccttgagctagatacagagtgctgattggtgtatttacaatcccttaggtagacataaaggttctccaagtccgcaccagattagctagatacagagtgctggttggtgtatttacaatcccttagctagacacagagtgctgattggtgtatttataatcctttaggtagacataagggttctccaggtccccaccagattagctaagatacagagtgctgattggtacatttacaaaccttaagctagacacagtgctgattggtgtatttacaatcccttaggtagacatagaggttctccaagtccccactagactcaggagcccagctggcttcacctagtggatcccgcactgggccgcaggcggacctgcccaccagtcccatgccgtgcgcccgcactcctcagcccttgggtggttgatgggaccgggcgtcgcagagcgggggcggtgctcgtcggggaggcttgggccgtgcaggaacccatggcggaggggaggctcgggcatggcgggctgcaggtccagagccctgccctgtggggaagcagctgaggcccggcgagaatttgagcacggtgcgggtaggctggcagtgctggggcacccggcgccccctccacagctgctggcctgggtgctaagcccctcactgcctggggccagcaatgccggccggccactctgagtgcggcccgcggagcctgtgcccacctgaaacttgcgctggcccacaagcgctacgtgcaccccggttcccaccggcacctctccctccacccctccctgcaagcagagggagccggctccagccttggccagcccagagaggggctcccacagtgcagtggcaagctgatgggctcctcaggcacggccagagtgggcgccgaggccaaggaggcgctgagagcacgcgagggctgccaccacactgtcacctctcaatatcatggtgagtaaaggacaacttatgaagtcagttactttttcaggacctttcattgagtttgttgcagagatagaattgtcttttaggtcctaaggctgtgtcttaatcatgagtctccataacacagtctgtcctgtactgtggttttttttaaaacatgggtattttcttccttccctacaaaagggtaaacaggagtttcttaataagtaaatcaagctaacacacaaagcaaccattgtaagagtttctttgaggcctgtttttttgatgataatgaaactggtaacactatcatatgtttaattctattcctacatcaaaaacataccatgtatcttccaagcagatggtacaagtgtagaattgactgttagtacttgaataatagatattgttagtaaatcagactctgtagaaaacgagttagattttatttcctttagaatgaaaatcattttatatacagttagagtgtaagtcacaaactaccattcacaagtgtacattcacataaatatgtgcaatttttgtccattttaagaaatgtatattcatccaaaaggttatacttaggacctaggtaaggaaactacaactaaatttgtatatatgtacacatatatatgtatatatatttatatatgtacacatatatatgtatatatatttatatatgtacacatatatatatataaatactcataaagcttgagttattttatattcatcatatttatgatttcatattcatcaacgtgttcttgaatcagaatttatcatgctagaatttgaagattatctttcataaggcacaaatttttacaaacctaattttttattactactatatatttaattataaaatcagtaaatttaagtttttatactacatttgttgcatatatactctgactggaaatttttctagaactgtagtgattaagatgaaaatgtaaagattccattaaaagaatcaccactcaatctgtttttttccatcgagaaaaattgtcttcaagcacccaaagatagagtttaaatatgccaaaggggatataaatataaccacacatttctcctatagctcagaagctgagatgccctatgaaaacaaggacacggggaagaaataggattagttttattgctcaaataattgctgctttttagattgtatttctcattttggtttgtatttggctgtatgaatgaacttattagatgttagtccagtctccatgagtacatactttccatctgttgtgcaagatagtttatattaacagattatttgagatggaagtacccatgtctctaaattttgttggttatgctgattgttcctaatatgtagtactggaactacctgagtgagggagattggggtagatctctctgagaaggtaacatttgagctggacctgaataatgtaaattagtgagatatgcaagttatgacagagttcagaaggaggaacttgtggctactaatctcgtacaagaagtggaaagaatttagaaaggatttggaagaaataaggagaataaaaaatgtctaagtctcttattaaactggccttagaggggtaactcgtcattgataacttgaaaacttgatattttcaaattaaacagttctgaatcccattagtaagcaaatgtattttagaagttgtcactctctgaggaggaagattctagtgtatgaagggctttctcattataaatggtctcttcctaagcaggtgtttatggattcatttgattcttaaatcattcaactcttccagttactgtttctaagagttgctgtgtagtgaaatttcacctctaaaagaaaaccaagatgatagcatggagcaacccttgaacatttcttgggtagtggatgaaaaatatctgaactattatgtcagtatcaaatgaggatgactagactgacattgtgtttagaagttgttggccccatacccatgtcgattgtcttccttggtggcatagagtttattcttatactctacttcagtttatatagttgttacctgtgccataagttcatgggatatttgaaacctacctcaggtaatcattaggtgtgagagtttaatttctgtaagctgatttaccccttacctgattaccaacttttagcagaagataatgaggatatgagagagagaaagacactatattttcaaattattttaaaatttacttttgtaattagtgttactttggtttttctttttttaagtcatgaacaaatggtatgtgctataccaaaataaatgaatttggaaatttgggaaaaagtgagaaaggaggttttcattatccttaatttttgcctctgtttaaacttgggatttaatgtgcagttgtgcttttctcgtactagtatttttctgatctgaacaatttgtattaaatgacctaggcaataaaaatcagtagtcaactgatgaaacatttgcatgcatcatgtcgtacagcactgttaggtactgtatggaaaagagattggtaggagatctgtttcttaaccgttaaaagaactactttaaatatgtgtgatgagtaaattggtaccaatttacggtattcagaacacctcaatgctggatttagttgtttgaacataagcctgtttactagagtgaatgctgggaaactaggttaagtcaaggtcaaggctggcactttgaagaagagagtggtcaaagttttaaatggcactgagaagtaaagtaacataagggctgaaaaattacaaatatcacaattagatctttagtcattatcacaaatattgctgaggaatgtgctgaaacgttatttggtggagagtactttggaggccctcactggattttttctgtggctttttaatgaagcattgttcttcacctatagtatagagataacgtgaaaagagaatcaggattaattgagatttaggattccccttgatttaaagacgtttattagctctcacgaagtagtggagcattgatccgcagtctacctcagcttcttttcctaaaacgtggtttgggcagaattgagaaagttaaacttgtcatcagtgacatttggggaaaactgggcagaattttacaaggaacttgtgagaattgccctatttgtaacctattcttttccttaaatgaatagtttctctttaacagggcatcctttttaaatgtaaaatttagattacatcttagatttgcgcttttataactactgctacctctaactgaaatcgcctcttgaaacagtcaggtcagctgtcagtttgttaagccttttccagattcccccaggcatttagccatttcctcttctgtgctctacaaatgaggttgtgttataatgatctgtttacagctctttctccttcttattaaactgtcacttcaggctgttagggccttgagagcagggaccttatcttatggcccccttcacaactgtgttttccctgtggcagtccttctgtaaacggtggctgtattaaagggcctgaccttcacaggttctacagaagctgtgcagggtgctggtaacttcataagccaaacacttggttgacttgatgcctcttagtatccctcataagcttccagagtctcttgacacatccctgctgattcgatgtattgtttttctcctggcagccatatgcagaaccaccataccactgtgtgattatgcaaacattgtgctgcaattttattacaaaaatgtctgccttcaaatggggtgatcttatagcatatgcaacagtgaatacacctaaaccaactctgccaggataatacaaaattccttctcagtaagttttagaggtgttttgttacagctgtctgatgagaacagtgaaggctttattatataatagaagatcaaattgatttgggggtaaggatagtaagcttactatattttaatcttcatacagtatttataggttatggtttatgttttttattatcttttagtttctctgatttatgttttttaaagggggctgtcgttggcttttagaactgtggaaaagttgtttcattgacttctttttcatgtttctgagaatggatttgttttcttttattgtatgaggagtttaaacttgaacatatttgaaactaacaaagccttcactgaaaaaaatgagaaggatcatgaatcactacttctctaaaacatatgcaaacccttctggttatagcaaactgtgttggcttgcttatctatatttcaaattacatgatgaaataattttgttttctcaacttgagatgctatttttaatttttgttacagcagtttcatatgaaaggaatttgttttagcaccagttatgttgcgtgctagatttagttgtaagacaactcagattgaggtatctaaaaatttttatatcagtagcattctaacaaggtatgtacaatatgttttgtaaaatggtttgcccatacactgttaaaaatccccattttgggtaaagggcatgaactgtagaagaaatacagtcagccactaaatgtcagtcagcatttaattaaacacttacaatgtggtaagcactgttctaattgcttgacatggtttttctcatacaataatcagaaaaatctcatgagtattacattattatgtttattttctgagtaaggaaatggagtcacggggaggctaagtaacctgcctgtggtcagaaaactgttgagaaaaggagctgggcttgaactggggtcatctgacttcatagctgatgtgcttttgacctttaagctgtactgctttctgtgtgaataggcatatgaagaaaggtttaacctcactttaaattaaaacatacacacacacaattaaaacagtgcaatggctttcttgcaaagaagaaaaataattgtcagtattcaatatgagctgaaatgtggggaaaggagaaatttaatgcactgaggtacaaatatacattgttacctctttttggaggatagtgtgtgtaaatgttgaaaacatgcacgtgttttgacctatccattccacttctgagaattatcctacatagctaaacacagaaaagcacaaagatatctgagcagtcatcacaaaaggaaagttaggaatgtaattgctgacatggaaacctgtccacagcatattattgagcaaaagaaagcatgttgcaaaacatatatagttttatttccttctgttgaataaataccaacaaactctggtttgaaatgatgttcaccacgatgttaacaactcttaccttttctgctagttagtatacgttggtaatcaaatgtctgggcagcgcaggcactctacctgggtttgaatcctatttaatcacttattagcattgtgactgtgggcaaattacttaactactttgtgccttagttacttcagtaaaatggagatcactactatagaatctatcttgttgggttatgaggctcacatgaatttgtaaagtgcttaacatagtaagtgatcaataaaactgagcaaccatcatcatcgtttctgggtggtggaattccaggcaattttagccttttgtataccttttattgcttgaatttttgaaacaaatatatatcatcttggaaaaaacaggaaaaactgtttttagagtcattttagttggggtgcttacagtttaaacaagaaatatgcatttatttagagctaagtttattttaatactcagtaaacgttttcttcagtaactatttgcatccatatatcttagtgttttatcctatgctatatgccaattttaagggaattgaaatcatattttactcttatggctggaaggcatgcataatcacaacagattcttcctggaggagctgccttaatttgcggctgcaatgacatgttctgatgtgacgtcagtctggtgtcagacttccagagtggcaggccagcctcacaaccacagtgtatttcctcagtgcttcatccccacagtgctcactgagaacagctcaaagacaaagcagttgagtcttatttttactccagtgttctttttgcctgtaattgaatatccttttaagaattgattttgatgaaggctggtgagtaattcttgttactttaatgtattaataataaatagctaatagctaagtgaacagtagtccttttcctcagttaatgatcctatggcaaataatcttggtagctctggtgccaggcataatatctagtgcaaaggatttacatactataaatatttttataaacaaagtattgttttgttgtagaaatataagtatattcattaggtttgcaaatgcttgaacattttaagatttgagcattgggaatgtcttcctcttagtctctccttaactttaggctacatgaatacatagtagtcacaaattgctttaaaacctaaagatttttatttaaaatcttattgttccttatttttaacttactcacagaagatgcttgatttgcccctagacctccaaagataattagatgaataattcctcagatgttcctgtggaggtactaacagtatgcattatgtaattttttttaaggtatatcgatactagtctaaacttattaatagaagctgctatgtctttaattcttcaattatttgggccatatcagtgatatgattcaaagtaggaatgtttattgacttaaaatttaagagcaatataatggcaggagattatatattacagatcgtattttatttagcatttaaagaaattaagaagtttcttaattttttaaagaaattaagagttctgctattaattgtagaggccaggcaagatttattattaataatatcaattcatgtttctttgaattgtactatgtaaattgattttgttgttttaaaagcattagtttaaaaagtaggttatgttgggtaagctttttcttttgtttttagacatagctattttgcttataaattctttttccctatttcatagggatgaatgatattattgtaatttcattctatttatattgtacaaacaaaagcctacaaagtcttacattttgctatttctcgcataattgttttcttgcattttcagcagcagcattgtgatttcaaggtcttttagaagaatttccaaagttttttcttaaagaataaaaaaagattagtttttttcttataattgtgctactctagttttttgtttgtttgctactctagttttcaagtctagatgaggaaaacatgatatggaaattcttactaaatatgttaaatattttcacttcagttttctgaagcagttgaagaatgacttgctgtacatattttttgtgaataatatagttaggtattgaagtgatctaaatcagctttttatatgtgaatgtaaaaagaataacaagttttaggaattaacactaactgcttcatattatgactcccagtatattatacatctatacttagaagcattgaaatatagaagtagggtttcaagtttgctctatttgacttgacagtcctaatttaagagccacaattttttccttaagttgcagaattttcagattccaactaagattctacccaatttaactatacagaggaatatttctattcccttttaaaatttatcttgaatccgctgaaaatgttttaacgtggctttaagtctgtattttaaacttaatcggtaagttactgtggtgatgatgaattggaatattcagtatacattttaaacaaagatgtttttgagacattatgacatcataggtcatgggttgctactaaagttcaagtgaagagaaactatttcaacttttttttgtatgaacaggaaattaaatctggccaaaaaaaaaaaaaaaaaaaaaggaagagggcaatgagcagagctgtggggataacttgaaattaacataaaagttttactcaagaataaagcagtaaaacagagcacttgtctgttttccagtgaataaggtatgctttgaggaacgctttccaccaatactatagactgcttgaaaaagtgtaattgtgctactcttctttgtttgaagtttagcctagtaaactcagatggaatagtatttcttaaggcccttatagtcttaaactatatttttgttcccttgtggtagacagtacaaaacgttgtatatataggatgcttaataaataatttcaacacgaagaaatgaattggcaaagcaagttaaatacgaggaggatatcttgatctttgcattgtagagattccatcttcactctgatgatcaaaacctgctagttaactagcctgttgatagcatgccctgcgttgtactctgctggaaggaaatgtgtctccagagtgaaatattgccatcacagtgtcctgtagtggccattggatttccccccatgtctccagttattgcccactctgctcacaatgtcactgctattggaaactgggttacttaccctgctattctggattgaatttctgtccccctcgtgcctcatctgcaagtgagaaatttctcagtgcttgaggataatgatttgttgactaaactgaacctaaattaggtgttatgtgcatcacataaagtgcattactatctgggccttttcagagttttaacaaatatattattttggaattgaagtaaaagaaaacctaggaggggagcaaatacattgtttcaaaacttatataacacattttatatacataaacatattgttagtcaaagcctagattttcaaccacatttctttgtgccctagccagcttcaatctgtgctgaactccagccacatctgactaatcccgctgattccaccaggctcaattcaaatggtagccacttccgtgatgccttctctgctcttttcctttctaagcaagatcaatccctaatcggtttcccctttgtattttgtttatggttatgagactcttcatgtttatttatttgtatttgtgatattattaaggctgtgtcaccagtgcctagcacatatagaatgaataaaagtgtttgttatgctacaagatagctattttgaaagaaagccaaacgttttttacaaaatctttttgtatcataggaatatcatttgacttatgagtcagctccttttttattcttgaagaaattgtttaaagctcatgcagtatatgaaaatgaatactgcacgatacggaataagtgattagcagtttttccccttttgaattgaactgttactctgtcagtttgactctactggaaagaatgtgttttatctacaataaaataattggatctctttaaattgtgtggcaatttatgtataggttataatttggttaactttctaaagtggagtgtgaccacacgcaaaagagtggatacttaaactttttctaatttgccttttgcttccttcccaaaggtataataaacttctatataatgcatgttacaataaaatattacaaattagcattcattagggagtttttttttttttttttttaaagacagggtcttgctgttgcccaggctggagcataatggcaccatcatagctcactgcagccttgaacgcctaagcttaagggatcctcccacctcagcttcctgagtaactgggactacagggatgcaccacctcacctggctaagttttaatattattattattaattattattattattatttttttttaagagacagggcctttctttattgcccaggctagcctcaaactcctggcctaaagcagtcctctcacttcagcttcccaaagtgctgggattacaggctgtgtatatttttgaatgccatgttattgcttttaaatgacgagaatatttctgattattgaaatgtttctgagttagggttctgcccagttttattttgaaagtcagtaagactcttgtgacacaatatttttatacaagtgactctgcaacttttcgagtaagtattctttttaacccgctaaaatataccctgtgagcatttttattctgttatgtggctttataagtgctttttccatatatcattcaacagtaaactttaaccttggatcacattatcagtgttccttattcattaaattacagttgtatgcaagccattatacttcacattaaagatgatgcagagaaccaacaattatttaaagcaaggaagtgacataatttacttgtttttaagaaatctgattctactaacacattcaagttcagctgttatatggtgaggactctattagatccagctaatatgccttgatgtgtaaccagataatttatccttttaaaggggtaggggttttgttgtgctgctggtttggttttttggttttaattcctattctacagaaagaagctgaagctcagcttggaggatagactcaatagtgaagagtcttgttacaatgaggtggattcagatgctgttaagagagtcttatgttgtacacgataaatacatactgtcttaatttttcagttgaaaaataaattgtaaaaatagctgggtgtgataggctcatgcctgtaatcccagcactatgggaagccgaggcgggcggatcacttgaggctaggagttcaagaccagcctggccaacatggtaaaaccccgtctctactaaaaatacacagattagctgggcatggttgtggtgcctgtaatcccatctacttgggaggttgaggcaggagaatcacttgaacccaggagttagaggttgcagtgagcccaaaatcacaccactgtactccagcctgcctgggtaatagagtgagattccatctaaaaaaaaaaaaagaaaagaaaaataaattgtaaagataaatacatacaattttttttttaaaaagagtcttagaaccatatgcgcctgcacagtggctgagatgttattagcagtcaatatcacttaattcttgaatacttggcagaaaattactttggcaaattagtgtgtacattttaagaatcatatttctgttttaaccatatagtaccagttaaccttcccattctcttaaatggttaagttcagattcactcaaattacttacaggtgaaagaattatctaaattatgttaagcacttttgcttttaatttatcaagtgatctaaaatgtaactctgctgtaatactcgggatggatgtgataggtacattttaactagcatggtgttaattgaatcattcttacattactttcaaaattgctttaaattcattaaaaggtgttcattttgtaaattcctttttttgtttttttttgttttttttgttttgagacagagtctcactctgtcatccaggctggagtgcagtggcacgatcttggctcactgcagcctccgcgtcctgggttcaagcaatactcatgcctcatcctccctagtagctgggactacagatgggcgccactgcacacctggctaatttttgtatttttagtagagacacggtttcaccattttggccagagtggtctcaaactcctgacctcaggtgatccacctgcctctgcctcccaaagtgctagaattacaggcgtgagccaccacacccagcccattttgtagattctcagtgtgtatgctggttttatttaagagagcttttaagaaagataacttagaaattatcagtgaaaaaccaaatcctaaaacaggtgagttggcatgtgagctttttatgttttgaacatttaatttttttccccttaatgttcttaatgtctataataatggttttagctttgtacttacagtgttacatcatactcatattttctcactggggtttaagtcatctcttctgagtcaagcaagattttcagttcctgttgggtgcaacacatgctttataattgttattatttgtatttaaattctttgatacctgtaatggtagaaatgtgaggtaacatttctaaatctgttttggaggtaattttgtctgaacagctaagagtaggaaatgattatgaagcttccaaggatgagaggcattgggtttaaaattaaactggaattgggaaagctttcattactgtgcttcagatagaaatgatcctggggtgatggtaggcagtgagatgagaggaggagggaagaggagcagtgagagaggcagcatgtgcatggcacatctgctgtcagtggaagaaggaaagggcctctaaggaaagtatggctttattctgttctagtgtcattgaacagaagatgaaaggcagaactgagaagtctcattggctgtggaagagttggagaaaggggcagctgttgaaaggttgggatctgaaaaggaaagcagctcaagccttggaggcactcctacttggagtatgacttctggcaactttctaaatgctatgagcctcggtttatgtattcataaactgcaaataataacacctacctcaaatgggctctgtgaggattgtcaaggccattacgtgacagctgaatatgtgagtagcactgaaatgcttaagggtagctgttatggtggtgatcataatatttattgctggaggtgaggttgagtgaggttttcacacctgattaatcccttcctttctcccaagaaattggaaattatccgttttctaaatgatgagaggagaaagaatagaaattaaagggttaagaccttaaggagaatttgtagatggtgggtaaatgaaacattgaggtttgagcaggatgtctggaagcagttagttctaagttaaaggcaaatgacatttagaactaaatgtggggaaaggaaatatatacttttcatgttttacccctcaaaaaaaattacagtctttgagattgctaactcagtggttatttcttcacataaaaaagcctcaagaattcagtttcaagaaaggcaaagcacttttaatgtttttcttttgttcttaaaacattgcctttaattgtaggcacaattttctatgccagcgtattttcagtttaaaaataaattgcagaaactgtctttgtggcagccagatttcaacaggacatttttctcctttttattacaatgaaagtaaatgaaaagttatctatgtgaaacattaagaaattttatatttaataataatttttaaattacttgactagcataggctgagttgatttaataactaaatggctgctacaaacatgttttttaaacctaattaagatttgattgtttgagttgcaaaattacaagacactgtgtgatttctattgatgaaatctcttcaattttaaggcaagctagagagtataattgtttttaatagagtaatgaaactaaggccaacttaagaagctagtaaattatagttaaaaattatggtactctttttggtttcactagaaggatactgaaaacacaagttaaaagcacacatctgagctttttgctgcatagttttcttcatagagaaatacagtagcttccatagtttccacacctcttctgccccactccagtctaacattattgtggatgtgtggcagcttttgtgggttgggcctttgcaaaagtccaagtcatgatactggcctttgttgccaggagtggcagaagaattgccaaatggcagctgccaaaccactatgctattctatttttcttaaactaaattaaatctttttctttttcccttaagggaaatacatgattcagagcaaatcatataaatgggtacacatgtgagtttagtaagaaacaactgaaatctcttctgtgggattctaaaatatatattactcgttttgcgcagtagatacattttcaacgatattaccatggttacatatatgaaacactgcataataaaggttgctttgcctgactgtaatggatcactcagaagaatagtattggctgttattggcaatatgttaatagcaatttcaatattcttttaaaaaagcagagtggattttggattaaaaagcagagtggattttaactgctttgtcactgaagttgcccatgaaatagagatttaaaaaaaaaccccaccaaaaacacatgctcccacaaggaagaattgcattatgaaaggtagtgtgtagccaaaacattaaaacatttttctgaaggtagaaacaaaatctctaaaggtctgaagttcaggttaaattacccttttaccttcccaaagcaagaaactagtaaaaccattttcctcttttaccatataaaacaagagaaatctacttttgaatatgctagcgcagatattttctttggaccatgtgtaagttgctttgtctaagaaaacagaatatttcttagctaatagcctcttccttcccctttttccttgctattataatataactgcattttattcagtttcctctaggtcggccacagacaaagttgtgaattttgactggagttagctcgctcaccatagtagtcccacttattttgccgttggttgaattggacatagaatctcatatctctgactagtgagattcttgagaaagatggccagggagattttgggaaacttagagggcagatcacctgaggtcaggagttcgagaccagcctggccaatatggtgaaaccccgtctctactaaaaatacaaaaattagccgggcgtggtggcaggcgcctgtaatcccagctactcgggaggctgaggcaggagaatagcttgaacccggagacagagcttgcagtgagccgagatcacgccattgcactactgcctggggaacgagagtgagactgtcaaaaaaaaaaaaaaaaaaaaaaaaaaaccttccttttaactctagacttcgtggttcagagtattgctttgtgatacagcagccaccttgggcttgagaggatgcctaactaaaaggcacagggcaacccaataaagatggcagtgctgcagtattaagcaatcctgagtcatcatctctttgaaatcataagtattattttaaaatagttctttccgtatgtggtttaaagaatatatctcatttactgccttttttttttttttcctttttttgacagagtctcactctgtcgcccaggctgtagtgtagtggcatgatcttggctcactgcacgctccatctcccaggttcatgccattctcctgcctcagcttcccgagtagctgggactacaggcgcccgccaccacacccggttaactttttgtatttttagtagagacggggtttcaccgtgttagccatgatggtctcgaactcttgacctcgtgatccacccgccttggcctcccaaagtgctgggattacaggcatgagccactgcgcctggcttgctgctttgttatatatatgtaacattacttgaatttttaaatgtttaaatctagtacatttaaggctgggtgcggtggctcacgcctgtaatcccagcactttgggatgctgaggtgggtggatcatgaggtcaggagtttgagaccagcctggctatgatggtgaaaccgcatctctactaaaaatacaaaaattagccaggcatggtggcaggcgcctgtaatcccagctacttgggaggctgaggcagggaactgcttgaacccaggaggcggatgttgcatttagccgagattgcgccactgcactccagcctgggcaacagagcaagaccaaaaaaaaaaaaaaaacaatctagtacatttagtactggattcatttctataaaaatcaaattctgatttttaaataacttctaataagggtattttacctatagatatcagataaaaaaagatttttgcattcaatgaagtttcgcatggttttggtcttattggataacaggaatcttaataccaaatttcttttgtcagttagtacttaattccattgaatactttagtttctttccttgtataatttgaagtaactctccattaagaatgaaataggcccctcacttttatgggcttttattattttaactggaaatttgaaacaccatattaacaaacaagttttttttctaattgcctatttttattggggtttatattgaaatgtgcactttatgcgtttattttcatgagagaatgtgtgcatggttatgatgttttttaaggaatgccattggcatcctcctttgtatgtctcctgaggagggaaaaccatagcaatgtcgactctacgaaaagtatcttcctttaattaccctggaaagggaggcaaacaacagcttcccccgttttcagagtgctgtcatacagttttagttatttatataaaagaaacctgtcacttaaagttgatttaaacctggtaaattgctcttccttccatcagtagtttataggagctgtgtgctttagctttctctttttatctaagcttccagaaagctcagaactaagatgtctgcttaaaagttcagcatagcccaggtgttccagtagttacctacgtaattcattatttggtttataaaatacataagattggaaaaggaattaggtagactaatgaatttctattttatctccagtagacatgtcattttagtgttatacagtttgatggaaatatatataccattttatatacacactgatttagtcatcttaaaatccttcacaaccaaattattattaaatgaaataatagtttcatagaagctttaaagtatcaggcctttcatttactcttctgattgtagtaaatgattaaaactctggtaataaataggaaaaaaacaatgccaagcccaagcaatctgtgttgctatttatcaattccttggtatcttttctttttttaaaaaaaaaaaaggtagggggtgagggcattcgttcattttatgctgacctttagtagagcataatcatcaagttgagcttgtaaatatgacctgttttctttagccctggaagctctagaataacagagtgcttttaaaaaaaaaattaacttttaatttaaatttaattaaaaaaaaaagagagagagagagagagacaaggtcttgctctgctgcccaggctggagtgcagtggtaatcatagctcactgcagcctcaaactcctgggctcaaacatttctcctgcttcagcctcctaagtagctattttaaaaattaggtgggtgtgatggcgtgcacctttagtcccagctacttgagaggctgaggtaagaggactgcatgaacttgggaggttgaggctgcagagagttgtgttcacatcactgcattatggcctgagggatagagtgtttaatctttaatgccatagttttttgcccagactttagtgcattggcactatctcaactcactgcagcctctgcctcttggggtcaagcgattctcatgccgcagccaccagagtagctgggattacaggcgtgtgtcactatgcctggctaatttctgtatttttagtagagacagggtttcgccatgttgtccaggctggtctcaaactcccggcctcaagtgatccaccctccttggcctcccaaagtgctgggattacaggcttaataccatattttttaatgtaccttttctgtgtttagatatatttagatacacaaataattaacattatactgcaatggcctatagtattcaatacagtaacatgcgttacctgtttttatcctagaagcaataagctatactatatagcctaggtttatatataaatatattttctatttttatagtaggcagtaccaactaggtttgtgtatatacactttatgatgttcacacaactaaaatcacctaatatattttagaatgtatcaccatagttggggttgagtatgatgaaacaaacaaacaaaatgtattaccatagttaagtgacacatgactgtatgggtaggcacgaagttaaacttttaatttaaataattgaccaaatactaatataatgatgacatatactgaatgtcctgcagttcataataattgtaaataacatttatcaagtgcttattattttctacagcttctattataaagtaagttccatgagggcaaggattttttatgtttttctcactgctttatgatacattttaatttataaattaggcacagtgggacaggcatgctgattcatgcctgtaatcccagcagtttgggaaaccaaagtaggaagatcacttgagcccaggagtttgaggccagactgggcaacccagcaagaccccatctctgttttttaaaaaattaggcacagtaaaagattaactacaataactaataaaagtgtaacagcatgccagcatcactagtcttgtactttagggggtggggtggggtcattattaagtaaagtaaaggttgtttgaacacaaaaactgcaatacctcaacagttaatctgagaaccaagccaactactaagtaactaacggggcaggttgcatcgacagtttagagacactggacaaagggatgattcacatcatagatgggatggagcaggatggagagagatttcatcacactactcagaacagctcacaatttaaaacttaagaattgtttatttctgggattttctatttaatatttttgggcggcaattgactgagggtaactgaaaccatagaaagcaaaaccacagataagggaggactactgtatataaatatatgtctatatagatgttatatttttgaaaatatttgtgtgtatatacatgtatatgctgactaaatgaaggaataacctgtgacatagctgcctttattcagttgagacacagagaggtaaagtaagttgccaaagatcacctagctattaagtggaggagctgggattcaaacctatgtagtctgatttcagaaactgtgctctcaactgccattgttttctgctacctctgttgtgtttacagaaatacaggaacacgaatagtaaatattgcttttcttattcagtcgagtcagttattttaagggttatgatagcctagtgcagggcttcccaccctcagcactgctgacctttctggaggtttatttggacatggagggctctgctctgcattataaactgtttagcagcaccctggcctctacccactagacaccagtaacatttccccagttatgacattcaaaatgttaccagggattgccaaatgctcccctggaggcgaaatcacccaattgagaaccacttgtctagacctatatattaaaagtctggaagtaagagtaggtaaacactggcattgtatttagaaaagtttggacttcctactaggccacagtgactacagagacaaggtgggaattagtttgttctgtgaccataggtatgtattatatcaagacctgaatttggccgggcgcagaggctcatacctgtaatcccggcactttgggaggccaaggcgggtggatcgcgtgaggacaggagtttgagaccagcctgaccaacatggtgaaacccctctctactaaaactacaaaattagccaggcgtcgtggtgcatacctgtagtctcaaatacttgggaggctgaggcaggagaatcgcttgaacctgggaggcggaacttgcagtgagctgagattgtgccattgcactccagcctgggcaacaagagtgaaactccgtctccaaaaataaagataataaaataaaaaaaaataaagacttgaattttatcctttttataaggattcttctagaaatacaaattttttaaatacttttttttattctcggtttttattaagcataaaatatctggcaagaattttttaagtgacaccttgtttcagtgtctgttaaaattctaatgcatttttaataggatagtgatatgttagtttgtaatttagtagtgcaatacgtattgcaaaaatatagcatgtgtgtccctaaaaatcacctcttcatgcaaaatctggaaacaaaaaacgcagggcttggggggaaaatggatctaggagcacactacacaaaaacttcattagtgacacatgggaataaagataggaaccgaataaaaatggtagcataataaatatgacatttggccttgaaaaagacccgcattttgcttgtgaaagtaactgagtgttgaaagggtttcagcatgtgaattattgggaggtgctgggaggaaggttatctgaaattgagttgaaagctgtaggcctggtgcggtggctcacagtgtaatcccagcactttgggaagccaaggctgatggatcacttgaggccaggagttcaagaccagcctggccaacatggcaaaaccccatctctactaaaaatggaaaaaattagccaggcatggtgacacacgctcgtaatcccagctaacttgggaggctgaggcaggaggatcctttgaacccaggaggcagaggttgcagtgatctgagattgcgccacttcactgcagcctgggcaacagagcaaaactctgtctcaaaaaaaaaaaaaaagaaaagaaaagaaaaaaaagttgtatcaccagatgaggataggtgtgtttcataaaacaggcagtgaactgaagtagctggtacatgtttgaggtgtgtgcagatatacattttgtgtattcctacatggctgggttttgttgggtgcagttttttgcatccatctagagtctctcacagataaaatcatgcataagcaaatgccaagttgtgttgtgctcaaattgttcctttaacgtacaaatcatgttgaaacagttccagcaagcgttatagcagaactgatgattctcttgatctgaattttgaggcccatccaaaaaaaaaaaaaaaaaaaaaaaacttgtgaaatgcagaaaagaatggcagctctaagataaaaacatacaatttgtaataatacaggggacaaactttggtagaattgagaaaaggctagaatcattgtcttcccttccctgcccttcctgtggtcctgagcagtccactcctccgttgtgccaagacaatggtcaggacctaacagtgagccagctacctcccagggtgtcaagtgctgtatctattaaattttttctaaatattaacagatggctctatgtgcttcttagactacttgatttaaggaataatagaaacactatgtttcattaatgattctactcttacaatagtcaatatggaatttttttaaaactatctatatctttatattaatactgtttcaattttatttaatggataaagcttcagagtattgagttacccaaaaaaatatgaaaattaggatttggaaaaagaacttaagcatatgaaatttacctggaagtttgcaggttgtggttatagacttctcaccatacacagcacatgtactaatattttaagattaacaaaagaaaactaatattcaatacagaccttacaaggtaaattttctaatgtcaggcatgtcaatgataggtctctgttacagattactttatggtatatgacttaatgaaaattattatagactatttaatatatcaatgtatattgcatattattttgagcatctaatatttttggcttaaataaatagggtttttttccttctttcattcaagaagacagttgaagacctaatcttatcattcaacctagaaagaatactatttcttaggcaaacatctttttctccaaaaatagtcataacttaattcaaagcaatttttttcagtaaatataacagatttttctttgtttttgttgttgtttccacatttcatttaagatttttgcttctccttcagatttcatttttttctacaacataccttcctcaagtgtcaaaaaattaatctcattacattatctatataaaggttatttttaaaacagaaacactgtaaattattcctgtttcagaaccttctatttttttaaggtactggtgcccatatagtagtactgttaggttttctttccatttatgaatttggcattagtactctgtaatgcacccatgttggaccataaaacagtggaggtaagtagacactcatacttacttttcatgacccacctatgaagtgtaaaatacagtaatcattgtattttacaatgcagtgtaaagagctaaacagccaaatcaacttaccttttttttttttttttttttttttttgggagacagaggcttgctctgttgcccagagtggagtgcagtggcacaatctcagctcactgcaacctccatcacccaggttcaagcgattctcctgcctcagcctcccgagtagctgggattacaggcacacgccaccacacctggctaatttttgtatttttagtagagatggtgtttcaccatgttggtcaggctggtcttgaacgcctgacctcaagtgatccaccttccttggcgctccaaaatgctgggattacaggcgtgagccatggcacctggcctacaacttaacctttgtttataaaataatgaaaaaggattgaggccagactgagaagggatgcatttaacttttttgtaaaaatataagtaacatttacacacatatacactctcaatagatagtaggaaagatatatttaggaatctcaaaaggctggcggccaggtgccgtgtctcatgcctgtaatcccagcactttgtgaggccgaggcgggtggatcacctgaggtcaggagttcaagaccaacctgaccaacatggtgaaatcctgtctctactaaaaatacaaaaaattaactgggcgcgtgatggtgggcgcctataatccaagctacttgggaggctgaggcagaagaattgcttgaacccagaaggcagaggttgtagtaagccgagaatgcgccattgcactccaacctgggcgacaagaataaaactccgtctcaaaaacaaaaaaaaaggctggaagtttgaatttcatttcctttgtagactaatgttacaataaataaatgggaattttaaatacctgcatgttctgtttttcttttttccttttttcagccataatgaaaggaaagtgacctgcaaacatccagtcacaggacaaccatcacaggacaattgtatttttgtagtgaatgaacagtaagtaaagagtttcatggaatgcctgtattcaaaattgggttagcattgaaattgctgttatttatatttcaatttagcagttttcttatctggacatttgtagtcaagtataataacagaatgccagctgttcacaatgtgtcatatagaaacctgagttaaacatttttttcatgaagaatgtaatttcagaagctgtttttatagtacttcaaacgcagtaagctcaagaacccgggatgcaagcttagagaaactgtgtaaatggttagattattaaactaatttgagctcacttttctcatccttaaatcagatagtggtaattactatttcacaagagttttataagcatcaaagaatgtattatactataaagctattcacagagttagttactgaaattgttattgtttttaaaattagaataatctcataattcatttttaatttttcagttgggtgaccaagtagaatatctgcaataatgcctattataaataaacatgataggccgggcacagtggctcacgcctgtaatcctagcactttgggaggccaaggtgggcgaatcacttgaggtcaggcattcaagaccagcctggccaacatggtgaaaccctgactgtactaaaaaaatagaaaaattagccgggcatggtggaacgtgctggtagtcccagctactgaggagtctgaggcaggaaaatcacttgaacctgggaggcagattctacagtgaaccaagattacgccactgcactgtagcctgagcaacagagtgagactcttgtcttaaaaactaataataaataaacatgataataatgtatttttggcttaggaaaagcgttagctgtatttaaagttgttgtaagtattaaggcctgactctagagtaactaggatccaagtactgtgaaaaagtaggacactcgcattgttaactgtagagaagtgtaattataaagcgggttacatacacagcaagttctagcattttgacatatattttcaggactgttgcaaccatgacatctgaagaaaagaaggaacggccaataagtatgataaatgaagcttctaactataacgtgacttcagattatgcagtgcatccaatgagccctgtaggcagagtaagttattttgctttatattaattattgataaggagtaaacagtatctataccgttactcataatggacttaaaagtatagaataataattacatttttattattacatgaatttgaaggtaattgatataagaagcaacagcccgaaatacaaagtaataagattgtaattcagtgacttaaatttttaaatttggaataattttagaaatacattgatatttgtgagagagaatgggtacacttaagttttaaaggtgattattcatgtaatagcctagaaatcaaattatctgactataagaatgcttagatggagaaaacatttttcagcaaaaccattgtaatagtatattatgtttattgtaaggaaatagataattataagataattataataatagtattttaaatgccagttaaggtttttgaaataaaattttgttaggagattataaatgaatgtaaattttcaagtaatataaataatttctgattattaagtaaaataaatccaacaggctaactgagcataatgctttatgagtatattttaattaaaatctggagaaattgatgaatggattgagagccactaggtcattgtcttgaaagaaagttgaatctgttcctcatactttacaccagaaattttctagatggatcagttgttgaaatgttaaaaacaaaactaagaaaaaaacaatggaagatttgaaaaaaaaaaaaaaagaaaagctcagaatgcagatgggctttctaaatatgacataaaactcagaagtaacaatataaaataatgagaaattcaaccacacgtaattattatccatgcagagtatctgtaattcatataacaattaaagaataatttccttataattaaagaagtgctgtgaatcaataagaaaagggcttatgagccagtttggaaatggaaaaattatatgaaatcagttttcgggaaagaaaatggaatttactcttaaatatatgaaaaaagattctcagcctcatccataatatgaaaaatactaattaaaaccagaaaaagacaccatttccacctgcagatttccaaagatcagaaagtttcataacacagcacactaacaacagtatgggtaaataggcattcggtttatatagtgagctccaagaaataatggaacagaagagtggatattaaaatatgcagtcatttcagaaaaatactcattaatcatgagaacaattattttagatagataggcacacacatacagtgatattggttgccacacagttgtgagtggggctagctgggtgctggagcccaagagtgagtagattgatctttgtgtatctttttgtgtcgtttgagttttatactgtttttaagcattacctgtttgaaagtaaattaaaatctatcaagaaaacatgctttaggaaaaattttgttgatattgggccttaaaattttcttatatactaataaaagcttcccaaaacaaaattctaaagaagtatgctggatttccaaagattctgaacaagtagaaaagtaagagataattttatgttactttatagcttcattgttttcatctttgttggtcaccattatgattcctgccaaaataaatcttcatggtaaccatagcagtatttttaaagactgtatatccttatgtgtattttgaagaatccagtaaaccccatctgtctagtttaagttcagagttgtccataaaaaagaaaacactacatcacattaagcagatccttcctgtcctgttttgacttgatgtgatatatttgtttatatttaatatctgtatatttctcctcagactgagtgccattaactttctttaattgaacctgcactattaaatgcagatataaagggaaaagttctgtcatttggtttattcttaaagatctgttaacagtttttactcaagatctattcattttatatagcaggtaggacaaaatactgccacatactctgtgtttctaaaaattgtatatcctatccagattttaaaggaaagattgtaaaacttgtgataccctgggggaaaaatttttggtgcggaattcttacacttcaaaaaactaacccagcaaaagtagaattttaataatttttctgaaaagatttaagtcctgcaagtcttgggaaaatctgaaaagagattaaattttaagaggaagataagctcaaatctctaggcattaataccacattttctgtcatgctctttttctatttagacttcacgagcttcaaaaaaagttcataattttggaaagaggtcaaattcaattaaaaggaatcctaatgcaccggttgtcagacgaggttggctttataaacaggtatttttttttttttgatatgaaacaaaagacagaattagaaggaaccttttaaactgaatgtacctaagacaattctataaaatcataaaattaagaaggaactatggagaagccacccaggttatttgactgcttgttacccctgaagaatatcaagggaacagtgaagacagaaaaaggagtggacattacttacaactgagattgtgtgtttgttatgggtatttctagacttaaaattaaatatatgctgtatgaaaatgttagaaatagcatggtaaaagtatccagacagaaatatttttaaaatgtcaaaattgaaataaacaactaaatattaatacaagggtactcatttttctattgatataaaaattgttagagaaatatacagttgtatatttcccccctttatacagaaattttacaataatttcagatttttctgagttttttcagatttttgattctataatatgagattattctttcttcctcttattttttttggttatttattttttcttttctttttaatttgctcatacagggtttactctcaggcgtcctgattggttgatattgctgcactgactggggaacttgctatctaagctcttttggaaccttattagttttgcaattagtaaatatatatgtacattacttccttggattttgacatcatttcgattacatagaggctatttacttcccagtttgcagctaggtttcagataagtgactggtagataactgaggtgacatcctcaatcttcaaggcttttttctttctgattctatatacgtacagatgatacaaagcaagttaaatattagttcattggtgtcagtttattctgttaaatattgctgattgctttcaggtgacctaatgatttttatttattgagtcataatttttattgaaagatcattgactatattttaaccatctgatatttaagctttccaggctaaaaggtttttgcacatttagtttcttttttttttctttttctttttttttttttttgtgagacagggtctcactctgtcacctgcccagactggagggcagcggtgtgatctcagctcaccgcaacctctgcctcccgggctcaagcaattctcctgcctcagcttcacgagtagctgggattactggcatgtgccactaccgccaagctaatttttgtatttttagtagagacgggttttcaccaccttggccaggctggccttgaattcctttcctcaaatgaccacccaccttggcctctcaaagtgctgggattacaggcgtgagccaccacacccagcccagtttctaatagaaaattttctccatattttccagctagtctttctaataagtccaaattatgatccactatttcagtgcaaaactgagcctcataccctaatggcattccttatttaaaatagctcttgttcttatttcttgatcccttggttaatttagcattgcaaaagtattaccaagtagcttctctaacaagtgtttattttgggcctagtacagtggttcacgcctgtaatcccagcactttgggaggccgaggcaggagaatcacttgagcccaggagttcgagaccagcttgggcaacatagtgagacctcatctctactttaaaaaaaaacaaaaaacaaagattaacctggtgtggtggtgtgcatctgtagtcccagctactccggaggctgaagtgggaggatcacttgagcccaggatttgagcttgcagtgaggtatgatcatgccactgcactccagcctgggtgacagagcaagaccctgtctccaaaaaaaaaagtgtttattttgtaatatgtgtgtgacacatatttgtttacagtgtcccttatctgtactaaagaaagaatataatgaagtaattgaagatggctgggtgtgatggctcacacctgttattccaacactttgggaggccaaggtgggtggatcaccttaggacaggagttcaagaccagcctggccaacatggagaaaccctgtctctaccaaaaatacaaaaattagccagctgtagtggtgcacgactgtaatcctagctactcgggaggctgagacacgagaatcacttgaaaccaggaagcagaggttgcagtgagctgagattgtagcactacacaccatcctgggtgacagtgtgagactgtctcggaaaaaaaaaaaaattgaagatatcatttgccatttaatttttttttttttttttggtttcttttttggtatagctgtcaattttaaggccaaatcttttattttgaaagattttacccatgttaatttctataattctgaagtcattactcacagctagaaataaatttagaaataatcaatgcacatccaaactggcctctcgttttttcttttttcttttttctttttttttggtatctgtttaattctcacttccaattttgctacattgcatatgggaaagtaatttttattaaaattctaattttgtttgagcctgatattttaatgaactaaattacttagaaatagctgccaaaaagtctctcttttttgcatgatgagcaaatcccaaactataggtgtaagaaaaaaatgtttatgaattgcatttgtatattaaggtttctttattcatagtcattttaaatcacattacctttggaataatttcaattcacatatttctcttcttgttgaagattaacatatttattaaatctggtttaccagaacacatgcactgctgcatggttacattattctcatcctagcagatgtttgtgttgagaagagtgaattccaaattgcttacaaatacgaagccaaatcaaattgccttaatatattccttttgcatgatggtattttcggagaccagtctagttgggaatatctaaggccctagaaaactacctccaaatttttaattggccttttagataggttatattacacatgtatcaaacataccttgttttaaaagtttaaataaatgcacaaggccaggaacagtggctcaagcctgtaatcccagcacttcggaaggccaaggcgggtggatcacctgagtcaggagttagagaccagcctgaccaacatgctaaaaccctgtctctactaaaaatacaaaaaaaaattaacctggcatggtggcaggcgcatgtaaccccagctactctggaggctgagacaggagaatcgcttgaacccaggaggcagaggttgcagtgagcagaggttgcaccattgcactccagcctgggcaacaagagcgaaactccatctcaaaaaaataaaaataaataaataaataaatgcacatgtgagtttttgttgtttgagaaataatccttaaatatgctgatttaatccaggacagtactggcatgaaattgtggaagaaacgctggtttgtgctttctgacctttgcctcttttattatagaggtaagtttaccctactgtcttagtgtattattttgtaattgatatgtaatataagttaagtatcagatactttaaaaagtattgtaactctgtgtgctattttattatcaacaaatagtatcaaacagattttttctcctttgacatatcattctgagttttggggttatgatagaataaatatggtgcttcagaccgtgtttggtctgagttttggttcagcttccctaatctttgctctataatgctactcttgaattcggtgcttaatagatacaatccttagtttgaggaggttcttttcacatgtcagttttgtcagatctagcttatgggtccttcaagcacccaattctgctccccagcaaatgatattagaatattaaggactactattatgtaatggcaaatgaaaaaagtgaaatacaaatttcattttgaactttttttttgaccaaacactgatagcttttctctggttagtaaattattaattcagttttaaataaaaatccagagatgtttcatacaccacatggatctcttagatactacaagatactacaaagttgttacctgccaatgaaaggcatacctgggtggcactctccggaaaagtctgtctcagctatagtataaaatgatgaatctggataatctctccttcttctctactttaaactttggataatgaaagaattagattgtcaagccataattaataatttatgacttttctctagaagtatagcttataagatataacagagttttagaactgattagcagtttctacattttttgactgcacaaaagaccggtagcaaaatttatagttgtgtattgaagcattgtaatacatattaaccttcaaaatttggaattactagaattgtttccatctgcaaattgtagttgagaattactgctgagtcagaattaaccaaccgtataaaattgcattttgtcatagagatgttccttaggctgcaattgcggtgttgtctttagttaaatgctaagcttactctacaatttttcttaggggttttctcactctttcagaaagttaggagttgtatttcaggcattatccttaagcttataatttctcttctcgtctctttttcagtatatttatggactacttataacaagaaatgtttattatttctaatattttaaatttctaatacaagaatttgttgggttttgttttgttttgtttttgagacagagtcttgctctgttgcccaggctggagtgcagtggtgcaatcttggctcactgcaacctccacctcccgggttcaagtgattcttgtgcctcagcctcccaagtagctgggattacaggcacgcgccaccacacttggctaattttttgtgtgtatttttagtagagacggggtttcaccatgttgtccaggctggtctcaaactcctgaccttaaatgatccacctgcctcagcctcccaaagtgctgggattacaggtgtgagccaccatgcccagccaagaatttattgatgttaatttgcaacaaaaaccactgaattccttgtaatttgctattgttgttgctcagggaaaggtgggactcatcacttttactataataggaaagcttttgatcatatttcaaaaatgtaaaagtgaatcagaagccatgctgatggatataaagatgagaacagtagacactggggagcacaagagaggggagggctgaacatagtaccaactgggtactgtgctatctgggagactgattcatttgtactccagacctcagcatcacgcaatttacctttgtaacaaatccacatgtgtacccctgaacctataatagaagttggaaaaacaaacaaacaaaaaacaagccatgctgagtctgagattccttattattaaccacctgcattttatatgcaatgtatttattaattttagtagtttcccagatggggaatataaaaaagaagaaactgtagaaacaagagaaatatcatttaactcatttcagatgactgctctgcaggctgttggaaagaagtatatgatattatacatttttactattttatcaataagaaatattagattttaaattaaaataattagatttcagtgagatcataatagcctatatatttttttttgcatatttagtatttgttgagtactgtgctgagcaagttatatagatgctctattttatctaaccctcacagctacctgataacgtggggaatcttatgttcattgcacgcgaggggaaactcatatacaaagtgcttacctcaggtctcacaattcgcaagtggcacagtcaggatttgaactcaggcactctgactccagagctgacactgttagtttctattctcttaatcacgagtttttgcccccactcagatatcctcttcacttaaatgctgagggcagtggccccattcatttcttctccatttctcaaagcatctagtctactgacataaaaagtgtgttgtcagaattttttggagatcagtccatgttttacagataatggaaattaagacagagaaaataactgatttgctaaagatattcccaaatatctttaaaactaagtagaaatggggaatctaaaatgtcacttgaatccagtaaaatgttgagattcttacggctcttgtcccagctcatcttccctacgaagcaaattttgtgatggagattaatatgtagaaagctttttggagagtgttgttcttggaaccatcagctgtggcaaagtgaaggaaggaaatggcagagacaaaagaaaatgggatgccatgcagtctcagaaaggcctcggctgaccccatagagagttctttcattctacaaacattactgagtacttactctttgtcagtctatgagtctctctaggtaatagaaactaggacagtgcttccatcaggcttgatatagaactaaacagaagaatgtcatgattagaagcagtttaagaagctgaagaactcaggatagtcatttgatagaaggtgaagattttttacacgcactgtctttgattttatataataatggcaatatttatttaatgcttcactctcagtgctgtttttgatgtgtattaactcatttaaccctcataacaatcttttgaggtaagtcctattatcctcaattttatagatgataaaacagatactaagcatcaataacttggcaaggatttcacagctagttagtgttaggcaggaaaacggcctcacgtaatctagggaaatcaccctgtgctttagtgcctctgtctattctgaagcaactttagaaaagattattttattatgggacatagaaggatgtattatttgattaaaatgattttttaataaagatgacttcatgtgctgtttgtgactataccctttacatgaacataaaacataaaattggattcaaaattagggtttgacttattcttttaaattgtcacattctctgtaattcatgactgctttccaactctttttaaccttttggactaaatctgtacttccgttcatccttttacgcattaacgaatcgtacctgaatgagcacagaatagtaaaaacaaaattttgttccattgctatgagaaaagctattgaaaaaagcctccatttaatgtaactttttcccttctggatgtttcaccagatactctggaaatgagggcgaaataaataaaatcccatgttaagtttttgataattaggaaaaacaaaaaagtcacacacagcaaacataataaaaagaattatttcacttttatgatttctcattggtgagtttattagcctgatgacaccgctttattaacttgtcttataggtctataacaatgaagtacatatttcaagtttcataaacatctctgcccccaagcagcaagttaataatgtgaatctatactgtgtcaagattaatgtttatcattttcctaggtatattttatgtgcttgccttgtaggcctgtaatttagtcacactattgtatatcagaatgattagtaaaaagcagaccttcaaagttaaatgttttaaaaagcgtataatttatatagcatagttcaaatatgtattcacatgtcgtcttcatttattcaacaaattcttttgagcatctaccactgtcattctaagtgtctttgtagaacttacattctagcatggagaaaaagataataagcaaataaatagctaaaacatatagtttgccggaggtattgagagtaggcaatggtaacattctcgaaggagaacagagaaaacgttaaataaataacattttaaaatacagtagtcaaggaaggcctcattgatgagacctttgagcaaagcctgaaggatgtaaccaagaaagccatgtatttgtctggggatagaatggttgggcatttaaatcctatcagagatgtgggtgggttaatgccattacttatatgccagtatgtttttcagtgaatgacatgtaaaggggctttgtagaatgcagtatatataccaaagtataaattcttgtgctatttgatattttcatttaaaaccttataaaggcctgcctgaacatgaatatagttcatttatgtacaagaaccttttgatttggcaaaaatagatcttgaaaaactttgcttcataagaacatttaaaattctaatcagatgttaaattatctcttagatgagaaagaagagggtatcctgggaagcatactgttacctagttttcagatagctttgcttacctctgaagatcacattaatcgcaaatatgcttttaaggtaaggaaataatgcagtttttaattctgtgttcaaaacttgcgttggttaaaatggatattgagccatagattattacaaaaaagctaccttatagtgatttttatatttaaaatatattaattaatggtcttatggttgtatagaagaatgtccctctaattaggaagcacgtgctaaaatatttaggggtcaagtgtcttcatgtctgtgctttcaaatggttctagataaaatgaacatgtcagaatgctaataattgatgaatataattatggatgtcctggtgattattatacgttttttcaacgttactgtatgtttgaattttttaataataaatttggggtctgggcacagtggcggtaattccagcacttccggagaccaaggtgggaggatcacttgagtccaggagttgagcctggggaatatagtgagaccctgtctctaaaacaaaacaaaacaaaacaaaaccaaaaaaaaaaacatactagccgggcatggtggctagtcccagctacttgggaggccgaggtgaaaggatcacttgggcctgggaggtcaaggctgtagtgagacaggatcacgccactgcagtccggcctgggcaacacagtaagaccctgtctcaaaaaaaaattattaataagatgggcacagtggctcatgcctgttatcctagcacttcaggaggccgagttggacagaaagcttgaacccaggagttcaagaccagcctggccaacatggtaaaaccccgactctactaaaattacaaaaattagccaggtgtggtggtgtgtgcctgtagtcccagctacagaaaaggctcaggtgggaggatcgcttgagccctggaggcagaggttgcagtgagccaagattgcaccactgtactccagcctaggtgacagagtgagactctgtattaataattattaataataaatttggaggaagagtactataagagacaacaatattttttaataaagatatatatatgtacctttattgaaaaacttagagaataattgcaaagatgttcttgggtctaagtacatcatgatcatcgggtactttacagagaacactgaagtcaggatgtgaaatctgctgttattaaatccaagcagacctgagatccccttccctgattaatagtacccaccaatctttgtggtattactggtttgtggatcactctcaagtaagaggtcttcaatgctatttttggagatttttgttttcaaaaatcattctgcattctttgctttatgattatggctaaaataaatttcagaggtcacctagtttttcagtctgttttagagtaaggaactataaggttcttgcagaaatttcattttaagagaaaagaggggggaagtgctgctggttaacaatgaacatgtttgtaccattataaaattgattcaattttaaattcccaccacttgtagagaatactgaggactgcagctgatttataacttttgctaattaatatgttacatgagcaggccgggcacaggggctcatgcctgtaatcccagcactttgggaggctgaggcaggtcaggatcaactgaggtcaggagtttgagaccagcctggccaacatggtgaaacctcgtctgtactaaaaatacaaaaattaaccagacattgtggtgcttgcctatagtccttgctactggggaggctgaggtgggagaatcactcgaacctgggaggcggaggttgcagtaagccgagatcgtgccactgcactccagcctgggcgacagagtaagactccctccctcccccaaccccccaaaaaaatagccaggcacggtggctcatgcctgtaatcccagcactttgggaggctgaggctggcagatcacctgaggtcaggagttcaagaccagcttgaccaacatggaaaaaccctgtctctactaaaaatacaaaattagccaggtatggtggcacatgcctgtaatcccagctacttgggctgaggcaggaaaatcacttgaacctgggaggcggaggttgcagtgagccgagatcgcgccattgcactccagcctgggcaacaagagcgaaactctggctcaaaaaaaaaaaattgttacatgagctatggagaaaaagaacaggaaaggtatagtggtgaggttaaggggttgggtgatggacggcctcaatgagaaggtaatgtaactggagcaaagacctaaggataagaggggagtatcttcatagttaaattaactttatcaaaataaactgtatcaacagtataaaccagagaaacataattaagtattttatgatgttaaaacaaaagttaacactttgaaaatttaaaattataactttatgaagtacacatgtagaggtgcgtgatattagcactattattaggccatgaatttaaatttttttgttgcttatcaatttagcaaatgtttatcaatttatgctatttgtaggacttttttctgcgtttttagactcttaaaaaatactacaatgttaaaatagcaataaaagtgaccatacatgttaagtatattttctctgcaattatttggttcagttttaattttatctgtaacaatgatagtaattgctgtttcactttctctcttctgtgatgttgtttcctctgaatgtatgagctgctttactcctaagtttgctgacattgttgcaaatgcttatcagaatggtaagtagaaactttatagacaattattgaacacaagcatgaaacttaaagctagactgggtactttgacatcatctagtaaatatttccatttgactgatggcgagcatggtggggattcttagtgtcttgagtcatggctagaactggatcgtcttgataccaacccagtgttccttacattgatcacaaatatgggcagtggtctttatttttccaaaaccccactcagggagtccagtaacattttgtaggtggttttaattatcttaacatagaacatttgagtagtttattaaggaacagctcaaaaagaaaacaccatttcggatcatttataaatcttttgtgtttgggtgtagatacctataaaggattctataaaatacagcagtgccttttgaggcctaaagaaattgctaacgcaggagggaaatgccataacatgtacatttctattaattttgttgctggttgctgggaatattcttaaataaagaatatttattcaagaataaatattcttattctgggtgtggtggctcacacctgtaatcccagcactttgggaggctgaggcaggcagatcacttgaggtcagaagttcgagaccagcctggccaacatggcaaaaccccgtctctactaaaatacaaaaattagttgggcatggtggcacatgcctgtaatcccagctaatcgggatgctgaggcaggagaatcgcttgaaccagggaggcagatgttgcagtgaaccaagattgctccactgcactccaacctgggcaacagagtgagactctgtctcaaaaaaaagaaaaaaaaaaaaaaaggtgtgaattgcagtaaatggaaattgctagaaatgtggagatggaagaggcaccactaagtacttcatttctcacctcctttcctttccatgcactcttttttttttttatttttaattttagagtgtgcacacaactaaaagaaagagggtaaaattaagggggaaattaatatatatttttcaagttaatagttatattttttcttgattcatttccatatctcaggtaaaagataagtctactttctctgaaatttgatagcaacgttctatgtcaggaatcacttacctttttttctttttcttttacagaatcctatatttttatttaaaatgatcgtgtcattttcaatcaggcagcccatccaaacatgcggacctattatttctgcactgatacaggaaaggaaatggagttgtggatgaaagccatgttagatgctgccctagtacagacagaacctgtgaaaaggtaaaggcttgtagaaaaaatgatggtgatttccacttccattttattccatgccttgcaagtatttcactgtcatagtacatatcattttaatagtcatggtatgaaatcattttttcctcagaaagcaaggatcaattcctgttctgaattaaattaatacacattttgttagtttgcgataccacctacatttttattccacttttcttctttttcttctttattcattttcacctatcggtgtactggggtgaatccagaatcctaacattcaaactgaatgttctttcttcttacagaattacctttaatttccggtgagtacgtttttaattgttaccttaaagctacacagatttttatcctttgagatagtgtttttaagattctaaatcttagaagagagtttatttttatgaagttaatttgtgtttttctgtaatagtgtgttgatgtttctaaagtgtgatgaattacagtaagaaactttgatagtttcattttttcaacatttctgattaatttttattgtttttgtaatgaatgtctccagaaaatagttcgtcaagcatttagattgtttccaaatccacttcttggtgaattgtaccttttttatattgaaactccactactcagattccttgataatatagataagtgctgttaaaattgacccatgtatttttccctgcttgaagatacgaatcattttaatattcttcagtatagctagttagaggaaatctgattctcagactacataaatacaagtagtataatgtgctttttaaaaaatatatattcctgtaattcgaagaaaaaattatgatgcaagttaatttttcttccagtcagtgacagctgagcacatatcttatgtaagaaagatgctaatgtgcatcttttttccctcttcttttttttccctcttctcaggaaattagggattgttacagtatacatctagtcctttgtttttcttattctagtgtgcattttaataaagtcttggctttttggctaaaagacttaggttgatgctgtgtatttgtgctatttttgtaaatatcaagtctaaatcaagttacccaatcactagtaattagagctggggaaaaactgaaaagaaaagagggtctaggatatagctctaggacatctatttttaagaaaaaccacttttgccacatgcatattgcaggatgagagcagatagaaggaaaatctgtttttggaattgcatgtgtaaaaattacctgagtagcataaagatgaggtggttagcactgataacgagagaaaatgtgtaggtgaagagaattcatttaaaatcttcaggctgagcatggtggctcacacctgtaattctagcactttgggaggttgagggatcacttgagcccaggattttgagatcagcctgggcaacatgatgaaacaccatctgtaccaaaaatacaaaaattagctgggcgtagtaccacactcttgtagtccctgctactcaggaggctgaagcatgaggatcacttgaatcaggaggttgaggctgctgtgagctgtgactgtgccactgcactccagcctagacaacggagtgagaccctgtcaaaaaaaaataaaaataaaacttcaatacttttaacttcaaagcaaaatttttaggaaattgtttagaatacagaaatctgtataataattaaaatatttatgtccaaataatttcaatattgtatattatacttttctcagaatttcagcatgtttctactttattttattaaatttaccactctaaaaactgataattactcgtaatttgggatgataaagatggcaattatttggcttggcttttggcaacctgatagttcactagttaggtgcttatacagttttcagccgtctttgttagtgtaatctactcagacaagatttattaataccacctgcgtgcccagcttagagtccgttatcctgtagaaattatgtgttttcttctactcctagttgttggcatttttatcccactctattagatttagtcattcaaagtgaaagtaagtatagagagattttgtttgcttggttttaagctaatgcactcattttgctgtatggctcaaatacttaaaatatttatcagagcttatcactgtaatacaacatccagtttttaacttgagagttcattctccctaactttataaagtatttcacctgttcacgataatgtcatagtctcctagtgtgcagatcattgatggcccaaagaaaaaaaaatctaagtataatatggattctctgaataattttcatctctaagcccattattttcattttatatatctcagtgtattttctgcaataacttaaatgtcactttttaaaattagatcacaagttttatattatttatggtaccttagcatacttttctgagtcagctttgttccatttagagaaaagtcatcatatgtgtctttttgactactttttcaatgataaatcttggggaaaaagaaaaaaaacccaccacagttttaatttaaaataatagctttaggctgagcacggtggctcacgcttgtaaccccaataatgtaggaggccaaggtgggaggattgcttgagcccaggagttcaagaccaacctaggtgaccagtgagaccccgtctctaaaaaaatttaaaaattagctaggtgtggtggcgtgtacctatagtcccggctgctcgggaggctgagagggaaggatcacttgagcccagaaagttgaggttgcagagagccaagatcacgtcactgcactcccccctgggttatacggcaagagaccttatctcaaataataatgataataatcatgatgacagtaataataatagctttagatagactacagtaaatatgttttaaaaatcttttcagttattttatgtttaatgttaaaattcctaccctcccaaatagcaagggatacatatgcttttagtgtaaatgttctatgccttctttgttgttcttgttttgagatggagtctcgctctgtcgcccaggctggagtgcagtggcacgatctcagctcactccaaactctgcctctcaggttcaagcaattctcctgcctcagcctcccgagtaggtgggattacagatgtcctccaccaagccagctaattttttttttatttttcgtagagacggggtctcaccattttggcccggctggtctcaaacacctgatcttaggtgatccacccaccctggcctcccaaagtgctgggattacaggcatcagtggccacacctggccaacttttatttttcaagagaaagaagcacatagtctatcttagtaaattttcccaatgtctaatgttgcctccaatctagaagccatggtttatatttaacctaaatatatggatggttcataactttactccaagaaaaatagtcaccttttttttttaattttttttccttggtgaccatattccaaagcttctagatatcttcatctatagttgattacagatatatgtatatagatctacatcctttccacacgtcataaacattggcagcattaccacacctagtttctgatagaagcatttttatttattggaatatggagggttggctggctcctgagaggcctcctagagtggcatgatcttggcagtttcgtgcaggttcacacactcagcttgatcttttcagagtctggaagtgattaggctcagggaaagacctagatatggcaactagaatagtgagcaagtacaactgtcgagtgacctagacacatgctgttaacgagctcattctttcagtggccaggtggacatgggatgccagattctaacccaagattgcttgatgtgttggaattataatggtaaaataaggtctgtgccagccactcattaactcatctgattctcacaagaaccctctgatcttggtggcacaatcatacccatttaccaaagaggaagcataggcactttaagtgttctgtactttgcctgaagactcagctagtaagaacagagttgcaagctggacatgtgcagtcagactccaagagctctaaaatcatactgagttcctcttgaatacaaacaaaaggagttaattatatggttcagatctttgatagcatcagactatgatttcctgttgcagccatttccacaaccagactcatgtttgtctcatgagtcaacaagcagctaaccttggctgggagccatgtggctcctttcaagggactatctactgtggtcctttaagtgtagactttgtggtttaactgtcataaggcaatcttaatttgctttattttcagattcctaatggtgggagcacacatcactttttacgctctagttctttatgttttctttttccccctttctgtttatacattctggtgttgtgcttgaatgttaatatcacagcattgggtatttgtgtagacttgtccactgtgaccctttccagtcccctggcccccacccccgtaaagtataatttttcctagattgaatcccagaagtaatatgtacattatttcatctgatttactatgattttcttctctgatttcagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccagggggtaagtgtctgtcttgtcattatgaacccaggtttctttgatgctgtgttggtggagattggtttctgagctactgattaaaatattggtttaaattgtgttttagctgttatagcttcattactacgtcttttgtttataatgatcagatataagtatttattctctgtctcttatgttctgtcacccaactttgctaatggcaaggagtcatccttcctggccaagcacaaggaaaggcttgggttacaggcagagatcgagtttatttgggagagggagggagcaagccctgtcctcccaacccacccctgtcttgtcccctgccattatcacctcttctctgactgtcctccattaccagtttctgcaggttggtacaatgcaaggatctcctgagacaagtaatatggaggcagcaaaggcctactgctctctaattcccagtcttattcttgggctttctttaaatcagaatgcacataactattaaattcaaggccaggcgcagtttttcggcttgtaatcccagcactttgggaggccaaagcaggagaatcgtttgatgccaggagtttgagaccagcctgggcaacctagcaagaccctatctctgtaaaaaattcttaaaaattagccaagcatagtggtgcatacctgtagtacctactacttgggggaagttgaagtgggaggattgcttgagcccaggagttgggagctgcagtgagctatgactgtgccagtgcactccagcgtggcagcacagtgagaacccaactctaaaaaaaaaaatgtaaatatatttatatgagcatttattcatttttgcatgcaccttttcttaatatatttattttgcaactactatatgctaattgtgggaccgcaaagtaaaataatgaaaagatacagtccagatactcacagagataattctctagtagaggagacaattgaataagtagatgcaatttagtgtgacaaatacaatgaaggcagaccagggtgctgtaggaacacatttcgggacaacagcacaatcttaaggattcagagtctaggaaaacctttgtagaggaagcaaaacacaagcagtgatacgaagaataacatgcatattatggcttagatatgcaaagcgccaggcttggtagagaacagaagaatcaaaagaaatccagtatgacttgattgtaactggggaatcaatgagtgaagaacaggctagagacataagctaggagagagagattcagattggtgtctcagaaatctggataataaattggagaaagttcaaaagttacttaagtgattgaagtgagaagaggatgaggatgtattcgggatataattgacaagtctagttgattgctttgatgtgcttgattgcaaactcgtcttgctcaagattaagtttggtgccgggcaaggtggcttgagtctgtaatcccagcacttcgggaggccaaggcgggcagttcagttgaggccaggagttcgagaccagcctggccaagatggtgaaaccccatgtctactaaaaatacaaagattagccagacattttagtgctcacctgtaatctcagctactggggaggctgaggcaggagaatctcttgaacccgggaggcagaggttgcagtgagccaggatcgtgccactgcactccaatctggaagtttcttgaaggaaatcaaaaatgacaccctgccttttaggcctgggcaactagggtgatttggtgccttttactgcaaagaaaagatttgggaaaagagaagatagtggttggatgggttatgtgaggtaatacatatgttaattagcttggtttagccattccacaatatacatatttcaaaacatgttgttcaccataaatatatataatcttatttgtcaattttctttaaaaaggaaactggcagatgctcaaatttaccagtaatcagggaattgcacattaaagaaacaattaggcattatttttcacttaccagattgaccaaaatcataaataaaagaattaaggcatagatgaataaaaattagattacttaatgttggatggaatgacagacatgaataagcttatatattactagcaggaaaataaattaatacaatgtgattagacagaaaagaagcaggaagcaggtctggggggaaaaaaatgaaaggatgtttggaagtacttgggaaagtaatcactttcagaaaaattataaaaatccaaatcagaagattggtgcgtctctgctcaccaagttaaatcttacttcaaagaagaatcacttttccccgaaaatcatactttcttaagtttaaaagtgtatagagagagtcaacagatatctggaaattagaggatttttaaaaattgtgaagtataaatactagttttaggttcctttatgagtgtaattaatatcagtaaagtctttcagtgacttcttccttttggacatacaccaacagcttctgaaggctggttttaggttattttgagctaagattttctctgggttcctcctacatttttgggttaactgttatgccagtttttataaatactgttatttagatgttcttttgaaatggcttgagtccactttggatcataagaaaatatcatctacattatgatataaacttcatcataaaaatagttgtagtgttttataatgaaatgattttttattggtggaatgaaacaattgtaattcaatatataaatcattttttaaaaagctttatgaaagtcttctattattaaagttctgatagaaagaaaaaggtttaatatttagtcaaaatagtagatccctgcatctgtgaacaaagctttaaagtttcattctgagtggcaggcactgttaagatgcatggtccttaagccattgttctgcatggcagaatcacagggaaagggcttttatggtgcttgacaggcagctgctggccaatggggcactaaatctgatgtaggagcttagagtgttcatttcttaagctttcagttaaaagtaaatcacactttgcttaatttgaatttctttggggaaaaaagtcactaaagggaattgtagttttgaaaaacaggtctcaaagtgctagaaatatatgggataaaaataaatttgcttgataataatttaatttttaattaaaattccccaaatgtggttccaaagatgacagaagagccttttaatgtcattaattaggcaagcttactaaaaatatatatatcctgctgttaatgatcatatgatagttgacagttcaggttcaatatacgtctctacaacagggtccaacccaaacattatgaatacttcagagcacttgacaaaagtgttttagtgtaattatatttttgaactataatttagatattagtttataagcaactttgggtgtgttttagattgataatgtatgtccccttccttacatgtttctatgatatagctcagtgcttaatctctagctttttgcatattaagcctcctgtagtatttcttcaatttatgaatgaccaaacaaaccaaggtgtgtcagagtaaattgctttagtactagggcagtctctttgatggagtcagctttccctagctgacatatttgcacatagtcatgggattgccagctctggatgttttccagtttctggctttcgtgtgataggagacggtgaagatggggaggaagaccaagcagaaacaaaataggaaatacccatggagggaaagcctcaaggaattgaactctttatactggttatataagagcaattgggtacctttctccctctctccaccccgaaggcatcgaatcggatggttggcctgaatgcagcggttcttgtctggagacatttcgttcaattttgaacaacctctttttgagtagagacattgaaatcctgaagaacaaccaccatgatgaaggaaatttagtttaggagaaacggttgaaagaattagaaatatttaaaatacaaaataaggcatagaattttagagctctagaataagtttatgatgaaatcatcttctagatgagaaaagaggatcccagtttcagttggccattggctagattttaatagcatattaaagagctctctggtgcgataagattatatccttcctaatttttaatacctttttatttttaactaagtcattgtgatagatgagtatggttttttaaaaataatattcatatcgtggcaaaatttaaaaatagagggatttttttaaaaaatcaaaaagtttagggatcactggcatagttaaaagagtgctgctttagaaagtaggagacctgcattttagttctatttagcccgcaagctctttctgtaaccccaagtatgatctcttggaccaggtgtggctcacacctgtaatcctggcactttgggaggccaaggtggttggatcacctgaggtccggagttcaagaccagcctggccaacatggtgaaaccctgtccctactaaaaatacaaaaattagctgggtgtagcagcaggcacctgtaatcacagctactcgggaggctgaggcaggagaatcgtttgaacctgggagacaggtccagtgagcggagatcatgccattgcactccagcctggacgacagagtgagactccatctcaaaaaaaaaaaaaatacatacatatatatataaaatctcttggtcttttctcccctactcccctaccctgcccccaatattctgaaagccccagaatatgtaactcatccaaggtctaagtacttaataggaaagcaagaatcaaaacttggctgtcttgatttttgatcaaccacttttcctgttttactgttttcccactatatcccctctggatgctttaacccacaaagagaaggtatatttaacatgagatttttctcttagtgtaaaggtaacataattttactgccccaatagacacaaattatgccggcagtttattaattaggtgcctcatagtccagaatgcacttaattcatcacaatgaaacctgtttttttttttttttttttttttttttttggagacagggccatccctctgttggccaggctggagtacagtggcacaatctcagctcactgcaacctctgcctcctgggttcaagcagttctcctgcctcaacctcccgagtagctgggagtgcaggagcatgctaccacacctgactaatattttctagtttttgtagagacgggattttgctatgttgaactcctgacctcaagtgatccacccgccttggcctcccaaagtgctgggattacaggggtgagccgctgcacccagcctgaaatctttttgtaactataatatatcagtatttgtgcattgttactgacaggtctttgggtcaaaagagagctcttatatccagattatcagcgaaggattcccagattattaagagtatggtcaaatgattttcccatcaaatatttaatcccttcgggtccatgtaattaccaatatctctgacattttcacaaccagtaggagcccatgtaatattaggaaaaagttgttaactaaacattgaaagaagagatcagaaaacctgagtttgtggagtcccaacccttccacatacttggttcattgaattctgttgattttgatattaggatataaatttatgcctatggagatgattgtataagatgaatacttgtaatttaatttttctttttctttttttttttttgagacagagtgtctgtcaccagcacgatttcagctcactgcaacctccacctcccaggtttaagtgattctcctgcctcagcctcccgagtagctggaactacaggcgtgcgtcaccacacctggctgatttttgtatttttagtagagacagggtttcaccatgttggccaagctggtcttgaactcctggcctcaagcgatctgcctgcctcagcctcccaaagtactgggattacaggcgcaagccaccacgcccagcctaatcttactttttctaatctagatgtttcttgttctggtggtggttaaaaagttacgtttgggaaaaataaaaaattagccacacatggtggcatatatctgtagtcctagctacttaggaggctgaggcaggaagatcacttgagctcaggaggaccgggctgcagtgtactccactgcactccagcctgggtgacagagtgagaatccatctcaaaaaaaaaaaaaaaagtatgtttgtatttagaatttgaattatacctacacctctgtatctaaaggaaatggaggccaggcgctcactcctgtaatcctggcactttaggaggctgaggcaggcagattgcctgagctcaggagtttgagatcgccctgggcaacatggcaaaaccccatctctacaaaagtacaaaaaattagctgggcatggtggctggtgcctgtagtcccagctactcaggggcctgaggcaggagaatcactcgaacctgagaggcggaggttgcagtgagctgagattgtgccaatgcacttcagcctgggcaacagagcaaaacactatctccaaaaaaaaaaaaagataatagggaaacacaaatgctaactttacgtagagtttttaattgattcttttttttctggctcacttctcccctaacttttaaaaatcttttttatatcatgaatttcacctagtatgaagttggcactgtgatagttttataaactcaaaagagtatgtttatcaaagtggtttttgttgttgttgttgttgttgttgttgttttgagatggagtctcactctgtcgcccaggctggagtgcactggcgcgatcttgtctcgctgcaagctcggcttcctggggtcacgccattctcctgcctcagcctcccaagtagctgggactacaggcacctgccaccacgcccggctaatttttttgtatttttcgaagagacggggtttcactgtgttagccaggatggtctcgatctcctgacctcttgatccgcctgcctccgcctcccaaagtgctgggattacaggcgtgagccactgcgcccggcccaaagtggtttttttaaaaatagtaaactgaaattgtattctttcatttttggaaatggtagtattctgtgcttagtaatatgcaattacatatccaattcccaaaattaacattttaaaagaattatactttgcatgcataatgtacatgaagcatttttagattgctttaagaagcctcctgaaaaatattctaccatctatgaagtggaatattaattactgtgctggaaactttgcaaaattgctgagattgcacttttatatctgaaatattgtgatatttaagtattttatctttaatagaattctgagcatcagctccaagtcacttttatatctcaagttaggaaaagctatgaaaggaagttattccttcaaaccaaatgtactgatgtatttactcccataaataaccatacttcctgaaagaaaacatacaacagaatagtcaacatatacttgtagtaatttatttcctgtctttatgctctatgggtataactcacttcatatttcatccatacatagaaatcctagtcctctgatgagatgtataaaaatgagagtttatttatataaaaacaaataaaatatagtgacagaattgagattagattttaaacattcttatttctcaaatgaagtataatactctttcatctttaaatcaaactctacattgtgtggaactaatagtcttttgtgtaattgatatagatgctgtttatcttgtattaagtgtgttaaatcgaatttcattaaaaagattaaaatctgttaatagtttataccttggataatattttgatctttaaaaaaatacattctaagctgggcacggtggctcatgcttgtaatcccagcactttgggaggccgaagtgggtggattacctgaggtcaggaattcaagatcagccgggcatggtggtggatgcctgtaatcccagctacccaggaggctgaggcaggagaatcgcttgagcccaggaggcggaggttgcagtgagccgagatcacgccattgcactccagcttgggcaacagagcgagactcttgtctcccaaaaaaaaaaaaaaaaaaaaaaaattctaatgtatattttacttactggaacaaaagaaatgtactctaatttagaatttggaaaataaccctccttcatgtttacattttaattatttttttattttagagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaaggtaaaatagctgctgattttgtgttaactcactaccttataaatgctgtgttttctttctagtatactattttaaatgtgagagacaaaagaatggggataaagtaagcaaggcagctcttttttgttttaaaaaataaataaaaatattttacaacattaagatctcatgtataaaaaatacctaattgcaacacttcatctctcaggaacacaggagcagttcttttgagcagatgcattctgttttctctgcttgataccatatctcatcagttctccgtgtagcttaacaccacatgcatttttctgttgtttttgttgttgttgttgttttgttttgagatggagtctctctctgttgcccaggctggaatgcagaggcataatctcagctcactgcaacctctgcctcccgggctcaagcgattctccttcctcagcctcccgagtagctgggattacagacatgcgccaccacacctggctaatttttgtatttttagtagagatgtggtttcaccgtgatgcccaggctggtcttgaactcctgatctcaagtgacccactggcctcagcctcccaaagtgctgagattgcaggtgtgagccactgtgcctggcctagaccacattcatttttattggctttttacacacttggaaattctacacctactgtcttctggcatacctgaaattttgtatcaagctcatcctgttgttcatgaggataaaagtgttaactttatcttctaaccaatgaatatatggcatattgagataactccttaaacactcgatttaatattgtagcttaatggtatgtatacattttaaaaatggagatcatgttttactttgtatattaagttggtttaagcattgcttagtatagattatttgaagtgaattcaaagtgctttgtatcaatcagcttttcataatgctaaagcagtggctttgattagtcagctagtacacaaccagttccctaatgtctatcctaaagtgctttttttttcatactgaagagttctttgaccggacatagtggctcacacctgtattcccaacactttggggagccaaggccataggatcacttgaacatggaaggttgaggctgtagtaagctgtgattgcaccactgcacccaagcctgggagacagagcaggactctgactcaaaaaatagtaataataagttattgctttatactgttttaaaatgctcttttcttatccttgtgacaagctgatttcttcagctgcgttattacctaagcatttgcttgatatttccataaataagcatttgttaagattaatagattaatcaggaattttcctttgaagaaagttttaatttgcctcacaacaaaaggctcactttgaactccatcgtaacaaagttcagtgtttcctcactttttccaaagactaaatcatgattgataaaaatagtaacaatatataagaaaaatctgatctaatacaacttaatgtgtatggtctaacaattggctctaaattacatgctctcatggttaatagtatttttcatgttcttggccagaatatatcatctgtttcgacagcaaatatgagatgaatctatattctctatccaattctcaactgtctgctactgctactcccaaaagacttctccaaaattgccaaatttttctttcaaactatcctatcctcttccttgatctagatcagtggttcttaaagtgtagttcatggacccctgtgggggttccctcccatgaccgtttcagggagtcaaaactatttttatgatcataataaggcattattcattgtgttcctatttgctctagtagtgcagaagcgatggtgagtaaaatttctggcaccttagcataaatcaaggcagtggatccagactatgctagtggtcattgtagccctccctgccacacacttgaagtaaaaaataaagtatcaggttcacttataaatctcattcatgaaacagtagaaaataattttattgaaccttaacattttgttacatattcttttactattacttgtgatgaaatggtaaatgcataaagcatttctatggcataccaaagtgctaaccgttgtctcacagtaaaacacatgatggagttgcaagctgaattagttccttttattgtgaaacatatttttacttgaacaaaagacaactgtcaatattcagacgtggtatttgatagacacactttctcaaagtgaatgctatcctgtcacttcaaggaaaacaactgacagtatttgttactgataacaacgtttgagttttcaagcaaaaaatagaattttgaaaatcatgtatctgccaccctgaacttgacagctttccggtgcttaaagattggcggtgatattaacagttgtgatgtttttatattgtatactgacatatgtcaatatttagaacattgcataactcactgaaccaatattttccagatgaccagtgtttgatgtcacaagattcatttaaagtacaaatagaccaagtggatattaatgtaacagagtatcaaaagttcattgataaggtttcagatatcactttgtaactaacctttaaaaaatatcagttttttgagctatagcgcagtgtcaaagatgaacatctataattatcaagaaaaactattaaaattctctccttttttccaactatatatattgagggtagattttcttcacatacttccactaaaagagattatcacaacagattaaatacagaaacagatacaagaatccagccagacattaaagatttgcaaaactgtaaaacaatgccactcttgccactaaattttctttttaagaatataaagggatcctgaggtcaaagagtttttgagaacctctaaaccagattttagaattactctgttcaggccgggcaagtggctcaagcctgtaatcctagcactttgggaggccgaggtaggtggattgcttgaggccaggagttcgagaccagcctggccaacatggtgaaaccccgtctctactaaaaatacaaaaattagtcagacgtggtggcatgcgcctgtaatcccagctacttgagaggctgcggtaggaggatctcttgaacccaggaggtggaggttgcagtgagctgagatcttgccatacactccaggctgggcaacagagtgagactctgcttcaaaaaacaaaaaaaaaaagaattactctgctcatccacatcattatttttttagatggagcctcgctctgttgcccaggctggagtgcagtggtgctatctcggctcactgcaacctctgcctcccggggtcaagcacttgtcccacgtcagccttccgagtagctaggattacaggcccacgccaccacacctggctaattttttatacttttagtagagaaaggacagggtttcaccatgttggctaggctggtctcgaactcctgacctcaagtgatctgtccaccctggcctttcaaagtgttgggattacaggcgtgagccaccgcacccagccccacatcagtattttatgtcaagaaatgttagtctctatcatctttcataagcactaatagcaattttaaatggtatttcataataggaatttaagatttctccttgctgacattgataagaaaaaaaaaactttaccacagaattacattgtgcctttactttcctagcatgtctatgtgcctgacagaaggtcagtgccagctggcctgactttacagtctgttagtccccagagcctccaagggaaaacggtgagtaatatctttatttaccataccatgttttatttatgtgctgcacaggaaggtacatatctaacataatttttaagtttgaattttcagaggttctcccaaagaaaaaacattactgcttttgtgcaagagatgctcatcagaatttgaaatcatgtagccatttcagtgttttagtggataccttttcctaagtgtctgactggccaaataaaagattatattttgaaactttatggccgggcacggtggctcatgcctgtaatcccagcactttgggaggccaaggcaggcggatcgcttgaggtcaggagttcaagaccagcctggccaacatgttgaaaccccatctctactaaaaatacaaaattagccgggcatggtggtgcgtgcctgtaatcccagctacttgggaggctgaggcaggagaatcacttgaacccaggaggtggagtttgcagtgagccgagatcctgccattgcactccagcctgggcaacagagcaagactctgtctcaaaaaaaaaaaaaaaaaaaagaaactttattgtatgaactaggtgggtttctttactttcattcccttatccttaaaacagaagttgcagtaattcattagtgaacaaatccagcaagcagttatttgtagtcaaactaccagcgtattaagtttttcgtgtgaatttttagattaacttctttagagctgtttgtaaaataaactgatttacatatcagcagaaaaagactgtaacaagcgttcgatcaaagcaagtatttaccattaccatttcattgtcagtgttatgttaattggaaaggagttacattagcaggacacttcttctagttaaagagaaaagatgacttttcctcacttcagtttattttaatggtattcttttatcaggggcactggctttattgtcagtagataacctcagtttctgtaaagatgtgattttagcacctgtgtgtatagttgttcattatttaaaattctcttcctgcagtaatcaaattcatcttatgtgttttgtaaaaacattgttttattttatcttttacacatttagataaaatgaaatatttccttgctttaagcttcctgcagtttatttgccaaagattatttgattaagactaaggacttttaaatgtgggaatcttaaaacattagattgttggcctgacaaatagtcattaatcatagagtaaatgctaaatagcataccacaaatgtttctcttctgccttgctccctctagtggatatttagccaaaatttatttaccaccacctactttctttggtcaaatgtgcctctttatttggcctcaaaatctaaataaagttattggtatctttcatccttttgaaaatctcttagtctgtttagctccataaataataaaccagagtttcagtattccttgcggtatcactctgggttcttagaatatctaaatccctttgcccatcttaccttctccctggcaagacctcaagtgttggagatgatgatcataaaacaaggactatcctagcatcatgaggtcacgagataggattggcatcagagcaaaagcaactgttctttttctcttacatggtttatttaaatctcatacaccaaatattctttgaccatttaatatacagtaaaaaactgttgtctcacctgtggatacccagttttatctaaggaatccaatagtaacttctgctaacactttttcttctgaaggcaataatttttaatatgattttggataatggttaaaaatgatttctgtttttgaaaagaattgtcagaaaataaagagcaatagcaaataaacagaacggaagagagttaatgcaatgctgtcgtgtaggcaaaacaaaccaatcttgggaatactttttagcctggaatttttaagagtacattgcagcactccagtgaggaaagcctgtagcctgctttcagttgttaatcataacaaagctcagagaaataccaagtaatattttatgggctataagaatgccaatgatcatactttactgtatttctaagaaaagtatattaaattggcccattaaggaatttcatccactgttgaaaatttattttcctttggatcacagtcaccaatcaggaaccaaaaaaaggttctcttcttttcccagagtgaagaaggagggtttatgtgcccatggaaactctctttttcttaaaaaataaaactgatcttttggtcataaaaaatgctatatgaaagcactaacagtgacatttcagagtataactgggaagcaattaatagaacccagatcccaaatttaataatgtgaagatatccaagttttattttattttattttatttttatttatttttttatttatttattttgagatggagtctcgccgtgtcgcccaggttggaatgcaatggcgtgatctcggctcactgcaaactccacctcctggattcaagcgattctcctgcctcagcctcccgagtagctgggattacagttgcgtgccaccatgcctggctaatttttctttaatctttagtagaggcagggctcaggctggtctcgaacttctgaccttgtgatccgcctccctcagcctcccaaagtgctgggattacaggcgtgagccactgtgcccggactacatttattttaattattttatgtagttctgttagaaagttggacatgcaggtatttgtactattgctgggaaaaggtgtaatttttttagatatcttagtaaaatatcttttaataattttttagtagcacttatgtacaaacctttataatgtttttttggcattgtgcttttttgtacttaacatttaaatgttctcatgagttctgagaaaatgccttaatttactgttgttttgctgtatcttttaaagtaacactgttccttctatttctctagatatctatgcatttatgtaggacctatcatcatagtgcctaggcactatgtttgatgtcaaccataagaggaaacttgccaagaaatcttggtttaatatctgtcacttaagacaacaattaatctgttttccactgtttggattcttaaattgtactccttcagccagaggagcttacgctgctgctaataaagctgagacggcagcaagccgaactgagtagtatccgggagcatacgttagcacagctcatgcagctaaagcttgaggcccacagcccaaaggtcagctatggagagatttgtctgtgtcgtctgccatcatctcttattttgaaacactcatcagtcaatatgatcagcatcattagtgttgagcatgagcccataccatcattatagtgacaacattagaatctcctattaaccctttgagaattcaacttatttatacattactgaaagaaaatacaggtagggtgcatttcttcttagccttctaccccacccgctcacccactggcttttggttttgaggaaggcaatgcgtacaatacttcatgtacgcattaacttcatgttgttactcactgaatactgtgacttccatatctggtaaaacaaatattgagaagtcctataatttccaataaaacaataaattaaaaattcattatagctttaataatactgccttttaaatgttaaaaattaattttaaaatgtcttatttttaatgaaaagaacgaacacataaccgtttctcaaagggtttatagctctggttatataagaaagatcttatttaaagaagtagtactatattagaggaaataattgacatgtaaaagttctaacagtcagtttgctaaagctattttaaggaatttttctgcttaatagttcattgttcatatgcatgtctacgtaatttcttacaaaacaaaatataattttgtaatttaatatgtcagcggtaccatttacaggggagcatgtgcgtgaaagttgtcgtgtactgtgatataataggttgtagtaaattacctgtttttcttattccaaaattgaccttttcttgaattccacatcctctttctctgtcccttttttcttaattggtgcctactagaatgaaattctttcacatcatctccaaaggaacaccatatatttggatcatcaggtgggattcatagagattttcttacttttaatacttaatagaacttcttaaatataatacagtttttcaggcttctcagctatttcagtcacgttgaattaataacatgacttttacaagtgatagaatatgaaatctctgaccaggtggattcaggaattccataataaacagggagaaaggacaggtgtggaggtaaagagggatacaaatgctgggtcacctgaaattgagggcctaaattctctagacttcgttcttcttatcccattaaaacacctactccttgaggcttatctcagcttggagctgacctaattaaaggaacagacaccaagctgtgaattgtcttgttggaaggcaagaaggagggtgaatgtagtgtgctctgtattcctaaaggggagtttaaaggtgggtgaagttggctggatgcaatggctcatgcctgtaatcccagcactttgggaggctgaggcaggcggctcactggaggccaggagttcgagacgaggctggccaacatggagaaaccctgcctctactaaaaatacaaaaatgagccgggcgtcacagtgaacgtctgtaatcccagcagcttgggaggctgaggcatgagaattgcttgaacccgggaggtggaggttgcagtgagccgagatcatgcaccactgcactccagcctgggctacagcgcaagactctgtcttaaaaataaagaaacagagaaagagagagagggagggagtaagggaggaaggaagatgggtgaagtgtgtagtggaggtgatttgcagttgcctgtccttattccctgtttgctgtgtacttccaatgtttggtctttgccaacgtgtgtagagccagttttataggaggctcacattcctagcattacctcagtggtggcaccaggtgtgcctggttgaggtgaatgttcaaaagtgaaaatggcaatgggccgggtgtggtggctcccgcctgtaatcccagcactttgggaggctgaggcaggtggatcacctaaggtcaggaatttgagaccagcccagccaacgtggcgaaacaccgtctctactaaaaatacaaaaactagccgagcatggtggtgtgcacctgtaatccctgctacttgggaggctgaggcaggagaatcacttgagccctggaggcagaggttgcagtgaaccaagatcacaccactgcactccagcttgggtaacagagcgagactctatctcaaaaaaaaagaaagtggcatttaacaaggagtgactcagtttttataaaatgttctattaatatttaattttaatttgttgggaattttttgttattagacataatttctttcattgaatacatttttttatataaatcaagctaaaacttattctagcttgtttcaaaatgtccaaacttgactattttatcaaataaagaggttactgtagaaaataagacaaatgctttcatatttatatttgcctgtttgaaacaaaacagtaatgtgctactttaaattagttgtatttaaagagggattttgcattaggataaccctttgaaaggtgttaaatcattttccttattttaatttttaaaagtaacacacttttgttaatataaaatttatatattttccacaaaacattttcatcagcattttggccattggaatactttaaaaatcagcatttcatgtatccgaattccagatcttcaatccagagattgaggctattgaaatttaaccacagtgtatattatgcactttgtatattatgcactagaaaaatgcatcttccttcaaaattctacactgccagaaagctgctaagatacatgggaaataaaaaactcctttgtatttagagctgcaaatagtcctaaaaaataggtttaaaaaacaatgatataaacatgaatctgaagttaccccacatctctgaaaataaaccttgtggtttactgtaatttattactgacctcattgaatcaaaacttgcagagacatagaacttcagaaaattttagaaaaggacaggtaaatatatcaaaaacaccaccatatgctaagatgcccttcctcaatcactttcccacatcgagattgtgttttatccctttacctaaatgacctagacctcgttgaggttcacattcccatctctcctctcaaagaaagctttgttgaaccttttctactgctccatgcttgtggtcctactggtgacttctaaacatcctaatgtgttattgatcttctctattctctcaacatctcaccaaagcttttccagtaatttatctgaagtaaagctattcaatttttaaagtttgtgataatgagaagaattacagaattgtttgaatggtacttgtgtttgaagtaagaatattttgatagcaaaaattgggccatttttaggtaataattagacagcatatgaaaacatggtggagactgcccaaaaactcagatatacttaaatgtatgtatccttaaggtttcctaaagaaaatctctccttagataattttattaaaaatttatgatttagataactttgaattttaataaaatttttcattcagctcaaacatttccagcttttaatcttgttactgccagtagcgtaacattttagagtaccaggtccgttgcttttgtagggattattggttccctggatttatgaattgattcatcagttttatgtaaccacaaatttgagagtaaattataaaatctgaaagaggaaaaggctctggtcacattttatactatatatcataacaaatgaacatgtactaatctattctcactctaacacttactctgcctcccctaataaatcatcagaataacccaagaccagcaacaaaatgtagttttcctcctgccccttgtgaggtattacaataatcaaaagcaaaactgtaatttctttaaattctgttaatcactgtcagtattcacaaaacacatagacccaaagagtattctcatagttacttcagaggtcaactcatttctgatgctactggaatgtttaataacaaataaaaaataaaatagccttatctgaaagtctgcagatttacatattaagcaggcaatccaaaaatcttgacttctggtgcctgtaacttcagcaatataatttgattctcactgtcaccgtttatgaggatgaatcatgtattaaagtggtttaaaaataacaatagatatactaattacatggtagaattttcttcagttttttgtttcatcattaagtacactattacagtttgtttatgcttccatagcccagttagtgtattattcaaagtccacatttatataagactagccctggtttatttgtcatttttgtgaattttaagatagcataggcccaaagtagaacctgtatacatacagtaatcccaactatatattttatgtacctcatccatgctctatgtagagaatgaataaatgcataatatatcagtaactcattttcttctcatccagcttagttgttgctgaatattggagacacttttggttacagtttaagtgaaacttgccagcttcatcctaaaatgcatgtactgaatggatttaacatttattagctttttccatgtttatttttctgcctaacagaatataatagggatggagggaagccataagtaaagtgttgcccttgctgtgtacttgccaggaggttggaagtaaatttcagattatcagcagttaaagtggggtctcctcccctgaagaatgaaatatcctgttgtagttctttgaaagtgccatagtagctggtgtttattttatgagggaaaaagaaaattttgaaaaaaattttttttcttaacagggcagatcaagcataagctgccctgctgagcaatcattttatgattaggagtccctaaaaggttccatagagccaactataagtcatttgtttgaaactggagtaacaggtttccataggagctgattgtagccaaaccatttgatgatatttggttgtaagatagagaagaaggagcacactggttgttttggctcctgtaccctactggttattaaggatttttcatagtatccctggtggttagattcccaagccaggccatgaaagatagtattttaccctgtgctatatctgaagaccagactaacagtatcacacaccctaaccacactgaagaaaatatctcttttaaaaatgtattcagtggctgggcacagtggctcatgcctgtaatcccaaaactttgggaggccaaggcaggtgcatcacctgagggcaggagttcgagaccagcctggccaacgtatagtgaaacctcgtctctactaaaaacacaaaaattagccaggcatggtggtgggcacctgtaatctcagctacttgggaggctgagacaggagaatcacttgaatccgggaggtggaggcagaggttgtggtgagccaagatcacgccactgcactacagcccgggcgacagagtgagactccgtctgaaaaaaaaaaaaaattactcagtgtggccaggcactgtggctcacgcctgtaatcccaagactttgggaggccaaggtgggtggatcacctgaggtcaggattccgagaccagcctgggacaacatggtgaaagcccatctctactaaaaacacaaaaattagccgggcctggtggtgtgtgcctgtaatgccagctacttggtaggctgaggaatgagaatcacttgaagctaggaagcagaggttgcagtgagccaagatcatgccctgcactccagcctgggtaacagagcaagactctatctcaaaaaaaaaaaaaaaatgtattcagtgtgcaaacctcagatcttaggaacacgtatgccttcttcagcagatctaacattgggagtagggacttgaagtttctcagtcttgtcacttactagatctacgctagtttctagttcttggctcctgtagcctggaccaggtctggttgggttgagcaaaagaatgaaattaggcgtttagaaactagaccaggagctgaagacaggaagcagtcaaaaactctccatgagtgaagaggtagcacttttttgatccaggcatgaaaggagtattaataggaatggggaagttggaacgtgtttccctccatattcctcacgtctattttagcttttccttccatttgtttcttactctttttctttctaacattctctgctagtgtttgaagagcagttgtgagggaacttaaatgatattccccttttccttttccctaataaccttcctgccagattttcaagtaggcaatgataacagcaggtgagatattaggaactgtgactacgaagtatgtagatggagatgtgcagaaggatccagagacttagagcaatgcttcacatgcttttggtaagcatgctccctactgtgggtaaaccaaacatgtaccaacccccccagaattatgatattctactgcagtaaccagcctcttcttttaacatcagatagctaaaggacgttatcctcaaagtcatggaaaagcaggaagtttttcatgacaaatcagtttgccatagtacagttaaaaaaaaaaaaatacaggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgaggctccgtctcaaaaaaaaaaaaaaaaaaaaaatacagtgcaagcatacctatgtattcttttttgcatgaaaatgtttaaggtttgccagagtcaatagctaaatccttctttataatttaccagtaaattattattttttttttttttttgagaatgaaaaacatttcatgtttatttggagatccagtagactggggatagattgtcaacagagtcagcacctatatatgtgtctttttatcagtacattttttaaaaaacaattatcaaattctgaggaggagggtaagaaaatcttttttgggctgggcacagtggctcacgcctgtaatcccagcactttgggaggccaaggtgggtggatcacctgaggtcaggagtttgagacagcctggccaacatggtgaaccccatctctactaaaaatacaaaaaattagccgggcatagtagtgcgtaccacccgctacttggcaggctgaggcaggagaattgcttgaacctgggaggcagaggttgcagtgaaccgagatcgcaccactgcactccagcctaggcaacagagggagacaccatctccaaaaaaagaagaggagtaggagggacagagataaaactgagaaaatccttgagcaggatatgaaataataataatggcagaactgtaagactaaatggataatggagtaaattagaatttaatatgtgtctcttaaattggcctatttagtgctcttacattattatcatgggtctgttcttagcagtaatctgtcctatttttttagctttttttttttttttttttttgtaacctatctcagtgctaactggggaagatctccgtctcttggtgtccctgcctcagcctcccgagtagctgtgattacaggcacccaccaccacgcctggtgaatttttgtatttttagtagagatagggtttcaccatgttggccaggctggtctcgaactcctgccctcaggtgatccacccgcctcagcctcccaaagtgctgggattacaggtgtaagccaccgcgcctggcccaaagcttgtcatctttatccctcaagtccctcaccaaaaagctaaagcaaaaaaataaaataatttaaaaaaaatggttcagaatatcagttgctattaacgttggtcatgtcacaagcatttattgaatacatcttccttcagaaggaactcactgggctttgagagccgtcagcactcttgctttactatttgcttagactaggaacttaaggctggcaccttaaaacccccagcggaaaagaggataacacatagagaaagtgaggccgagtctcctctacaggctatggctgggacagcctgacaccagtctctcacagtctggctgactgatgaagaagaagaaaaacaagtggcagaataactggaaggacctaaggtatgacaagcctccttggcatcctgcctgcctctccatcactgtaaggatggagattttccaaatttgtgaaaatggcagaattaagtcagacaagtgcctggagttctattatgttctcctaaaatcttgtctgcccaacatcagcatgtattaaagttaaactgatgactttaaactggaattaaatgtactttaaaaacagtttcactgaaaatggaaaaatcatgagattctgtagaactgtctgaacagattttttttagctgattacatgttggcatggtgtttgctcaggagaacaaaggctaccataacaccttatgtatatgagatccctcattaccatttagtcagcaaatcttggcaatgcttctcctgaatctttagtcagcaaatcatttagtcagcaaatctctgtaatgcttctcctgaatctttgcacgcacatagcaatattcctggtctcacatctagatttcgtcacgtatcccgttttattgtataatagtcttggatattcctcatcttaatttccctggctttggataataagtttgttaactgtaagcctccactctcacatttgtaacagagtagtaatgtgaacctttaagggttgttagggattaattgaggtaatatctataaacttctgaacacagtaagaggagcttgtaagccctcggtaaatgggaagtctgtgactgctgaaattgaaattaggtccagttgctcatttgatcttcctaaagctcctgccacattatgtcttttagccaactcaggaaatgtcacagactccttttgccttacaaaaaaaagtctctttttgtcatttaagccttcagtcttccaccaccacgccacaacttgtgaaataattcctcccccataaacccgtttctccagccagtgactcaccatttctcagatacttccaaagcactccgttctctgcatggtgtacctgtgtagtgcctgttcaaccttactgtgtaagtatcactttacagttcacaaagcaccatcctatacaacatcccacttgtttcacatacacaggctctgcagcatatggaccaattaacctttatccccattaaatcagattccatgacttgcccaaaatcataagctagagtgaaaaccttgtattaatggattttctttcatcttttaaaaattctattttaacttctttcaaagttaatggatcattctgttcttagagtttggctgcagtctttgttacctgaggaatatcagcttctagctatggctctaacaagacagcaaagtgaaaacaaaatgtccctacctattctaaaatgcataatagttatacaattctatttttatttacaaaatattataaatactattttacagttacaaaattataaaagtagctcattataccaggctttgcttctgtcttaattttacagtaggttttgcctctgtcttaattttatgtacatttttcagcaagtttattcattctgcaaagatttatggaactcaggatgcaaagataagccatgatgctaatgcccacaatgtagaattcttgttcaaaacttggaaggaaatgaggttgagtataaatgccaaaaacatttctaaaattgacctaaaggtgtcattatgttgttgaaacataagctgataaatctttgaattaatggtaggaattcagctactcagtgccatttgtaactttgtaagaacacagttaaccattgataaaatccagatccttctatctagaagttattttaattttgatttaaaatttggacgggtgcggtggctcacacctgtaatcctagcactttgggaggccgaggtgggcggatcacctgaggttgggagttcaagaccagcctgaccaacatggagaaaccccatctctactaaaaaaaaaaaaaaaaaaaaatacaaaattagcctggtgtggtggcacatacctgtaatcccagctactcaggatcctgaggcaggagaatctcttttacccaggaggcggaggtcatggtgagccgagatcgcgccattgcattccagcctgggcaacaagagcgaaactccgtctcaaaaataaaataaaattcaagtatattttagaatagatttatccatggcaagaacaagtacctttttgactaacagagatgtaagattttcacttcaggaatgttttttcacttaaaaatggtagattttagtgtatccttaaaatatttgcaaagaagaaaatgtgacaatttcaaaccttatgttcacagtaaaagattttttttaattcatcttgagttcttttaatatttcctgtttcctgtggatgccagggataaacatagtagtagccttgcttgaaattaaaggaacagggattaggaaaaggccattaaacaaggaaaatacattaagctactgaagtaaaaaaaaaatcagatctgtaaaacttatccctagccaaatgtaagtaaattatttggaatggcactagcccaggccttcaaagtttgctttcaaatataccacaaggacataatctatcttccttgaagaaaaggggaaatattataaagtctagctatatctttaaaaatattgttgattcttatgactatataacaatagtaatgtttgcaggttttacttacaggaaaaaacgtatgataatttattcaaattactttaaaacttctgaagtaatctcaataaccccttcagttataaagagacttatttacattcttctgttactgaagtcacttcacatttccctgcttcctgttgaagagtggtttcaataggtagcatacccttcaatctcaggttcttggactttcaggtgtgcctagagagagtggaaggcaaatttacattgttattatctaaatgacctatttataaagacccctgcattccctaaagcctcaccctgggcacatcaaattctttagctttttagttttgctgcacatcttaagagcttattgatgtagacacagaaggacattcttgagaaaatggagtattctgtgattacgctatggagttttttgcttttgttaagacagattcccaactgaaaaaatcttttccgaagaagtcattaagaactcaggaaaaagtccctttttctcttaaatggaaaatgacagcaagagatgggtcttcttcttagttaacagtgaaggacagaagctctgctctgtatccacccacactgttcaagaaaaaggaactattggcacagaattcagactcaagtaaactaagttacaagacagcttgagcaaaggtttcccctcctgcaaatgacttgcagatcatggggaaaatcatacttgctttactggtcctctgtcgccgaggctggagtgcagtggcatgattttggctcactgcaacctctacctcccaggttcaagtgattctcctgactcagccacctgagtagctaggattacaggcgcccaccaccacacccagctaattttggtattttttattagagatggggtttcaccatgttagccaggctggtcttgaactcctgacctcaagtggtcctcccaccttggcctcccaaagtgctgccgttacagatgtgagccaccacccccagcctactggtgtagaatttttagacctggtatctaatatgatagccactagcaacatgtggctatttaaatttgtagttacatatatatataagtaaaaacatgtcctcagtcatgctagccccatttcaagtagtcaatattgaactacacagatgtggaacatttccatcatcacagaaagttctgttggacagcactgttctgtatgaaatttttttttttttttttttttttttttttttttgagatggagtcctgctctgttgcccggactggagtgcagcagcgccatctcggctcactgcaacctccatttcccgggttcaactgattctcctgtctcagcctcctgagtgagtgagactacaggcgcacaccaccgcacccagctaatttttgcatttttagtagagacggggtttcaccatgttggccaggctggtctcgaactcctgaactcaggtgatccacccacctcagcctcccagagtgagtcaccgcatccagcctctagattattatataaacttttaagagagcaattaagccactgcttaatcacttgttatttttaaagggagtatggagaattaattttttctaaggatgaattatatgaatgaccatcttggctctgctcactactcatctcttttccccctccccaaatgattcaggagcattttacctcatgagttagaatatcctattttttctgagttcagagctggtccaatttctccagagatagatttgaaacagacatttaaaagctactaaagtagctggcacagtggcgcaaggctatatagtcccagctaccaggtagactgaggcagaaagatcacttgagtccaggagttgtgggcttttgtgcactatgccgatcaggtgtccacactaagttcagcatcaatatggcaacctcctgggaacggaggaccactgggctgcctaaggaggggtgagccagcccagtaggaaatgcagcaggtcaagacttctgtgctgatcagtagtgggatcacatctgtgaataagcactgcactcaagcctgggcaacatagtgagaccccgttgtttttgtttttgtttttttaagatatcctttctttgagctttttttttttttttttttttcttgagacatgatctggctttgtcacccaggagtgcagtggcaatcatggctcactgcagcctcaaccccctaggctgaagtgatccttctgcctcagcctctcaagtaactgggaccacaggcctgcaccaccatgcccagctaattttttgtagaggggggggtttcaccatgttgcccatgctggtcttgaactcctggcctcaagtgatccacctgccttggcctcccaaagtgctggtactataggcgtgagccaccgcgcatggccgagaccccatctcttaagaaaaagagtaactggccaggcacggtggctcacgcctgtaatcccaacactttgggaatcctgaggtcaggcgttcaagaccagcctggccaacatggtgaaacccggtctctactaaaaactcaaaaattagccgggcgtagtagtgggcacctgtaatcccagctactcacgaggctgaggcaagagaatcgattgaaccagggaggtggaggttgcagtgagctgagattgcgccattgcacatcagcttttaaaaggcagttaaaatctcttaatgctatatcttagacaacaagaaaatattttaatctagatccaatatttgtgtttacttagtttgaagttttttatctttgatagttgtgcaattaccttgatcagtatctgatatcaactcatctggaccttgaaaaattctttggcagtcatgtttacttgaattgatgccaggataggaccatggttcacaagcctgacttctcagaactgacagtaaatcttcagaaagacaaaaacaaagtacaatactcaaggctgtctttcccccagtccccaataagaattgccagggcccagacctgtaaaggttttaaatctccacaggtagttttatgggggccggggggcttttttttttttcttttgccagatatgagaactacaccaaagaaagaagaaaagtcagctggatgtgatgcctcatgcctgtaatcctaccactttgggaggccaacacgggtggatctcttgagcccaggagttcgagactagcctggccaacatggcgaaaccccttctctctttctttttttaaaattttttagttagaaatgaaaaaaagaaagaagtctaggttttctgaaacaagcactgtcttggtgctaccttttttcatgtgtggacacatagaaagcgaggatatttgtacagcaccttgaaacaaataagcaggaggtgatgtcatgagccttagccctgcagggaccagactaggccttctgaagctgaggtggtccttgtccccacaccttgtaacccatttccagcccatgggtgtcagttgggaaattctacacaagatcctagtagatgtaattacatataattcagtggtttttgatgatggggttttaaaatcaagttattcaataggtggggtgcagtggctcacgcctgtaattccagcactttgggaggccgaggagggcagatcacaaggtcgggagttcaagaccagcctgaccaacatggtaaaactccgtctctactaaaaatacaaaaattagcctgacagggtgatgagcgcctgtaatcccagctactcaggaggctgaggcaggagaatcacttgaacctgggaggcagaggttgcagtgagccaagatggcactgctgcactccagcctgggtgacagcgagactgtgtctcaaaaaaaaaaaaaaaagacccagcacggatggcttgaggcctgtaattccagcactttgggaggccaaggcggacgaatcacctgagatcaggagtttgagaccagcctgactaccgtggagaaaccccgtctctactaaaaatacaaaaaattaactgggcattgtggcacatgcctgtaatcccagctgctcgggagtctgagacaggagaatcgcttcaacctgggagtcggaggttgcagtgagccaagattgcgccattgccctccagcctggggcaacaacagcaaaactccatctcaaaaaaaaaaaaaaaaaaaaaaacaactatgaagactgggcgcggtggctctactaaaaatacaaaaaattggctggacttggtggcgcacgcctgtaatcccagctactcgggaggctgaagcaggagaatcgcttgaacccaggaggcagaggttgcagtgagctgagatcgccccattgtactccagcccaggcgacaatccgatactccgtctaaaaaaaaaacaagttattcgtatttgccaaacagacctcaaaactgctgaagaggccaggattaagtatcagattttctagatagtttttctaaacatttggacttagaaatttcaagtaaaaatgtgttttgttgtgaacagaaattcaccggcattattacctaagtgtatttccgagatgttgccacgtatgttttcttatttacagctagagttaattatgaaaattgtggggttggaggcgaggtgggggtggccgtttgttttctcgtgctctccaactagcgtgctctcttcccctcccccgcggcgtgcagtggggtagagaaaaggtggcgacggcgactggagcagcagaggctgtagcatcggatacccacctcccacgaaccggttcctcttccccctccttgctgtgtgtttgatgtgttgaagcaggagggagaacgccgcgagcagcgccgtgagcaacactaccatcgtccccagcactgcggatccgggccctagcggcgggcccagtagcggaggtggtggcggcggtggaggcggcggcatcgaggtaataggtgactgatctccccgggcgctagctctgagcagatgcggactctcttcggtttcctaggcaagatcgacgaaccacacctcttcccgccggataattcacctttgccaatcgcaatctcgttaaattccatgatccagactcagcagttgtcgcaccatgtctgacaaacactgtattccttgacagagctttgataacgtaccatatgcagaaggagttattcctgataaggctaaggcttgtctctgttggcaccagctaatgcaatggcaggtcttctgcttggtgttgggctcctgcctactcctaacccacttactcagactggcgctgttccaccggctgctttgggggctcctactcttgttcctgcccttgctgcgcttgggcttcctggagcaaacttgaactcaatctgttgccacagatagttgctgaagcttatgagcactgttggtcccaagttgaagcatgtagctgctggtcttgtttcaccaagtctgaaatcggatacctctagtaaagaaatagagaaaggggccccacatggtggctcaggccagtaatcccagagctttgggaggctgaggagggtggatcacttgaggtcaggagttcgagaccaacctgaccaacatggtgaaaccttgtctctactaaaaattcaaaattagccgggcatggtggcgcatgcctgtaatcccaaatacttaggaggctgaggcaggagaatcgcctgaatcctggaggcggaggttgcagtgagccgagattgtgccattgcactccagcctgggcaacgagcacaaaactcttggctcaaaaaaaaatagaggaagctatgaaaagagtacaagaagcacactgcctaatttcggctgctatagaaccagagaaagaaaaaagaaggcattcaagatcacattctaggaggaggaggactctcatcttctagacacagtcaaggagcagatcaagagagtgattacattgtcagtctaggagtcgttgatgattcaaaagcccaagacagagaagatctcattccagagagagaggcagaaggtcaaggagcacatcaaaaacgagagacagaaagaaagaagacaaaagaaacattcaaaaacacccccagaaagttacagcacggctagacattatagaagtacaaacagagagacaacaacgaagaagcaggagtggaacaagatctcctaaaaagtctcggtgtcctaaaagaaaattgtctctctcaccatcccctgggaaacataaaaagaagaagaaagataaagagagaaataggtatgaaagagaacgatcaacaagcaagaagaagagtaaagatagggaaaaggaccaggaaagaaaatcagagagtgatacagatgtaaaagttacacgggtttatgatgaagaggaacaagggtatgacagtgagagagaggaaaaaaagagaagaaagcaatagaagcagattcccctaaaacaaagaaacgttctgtggaaaagggaactggtgattcactaggagaacccatagtgaatgggaatgatcatcatgaagaagacatggatatgagtgactgaatattgcctctatgggaatccagctgtatacatgcatcagtgtcattgctttgtgtgatttctgaatgttgtatttgttcatctcaaccctagatgtatatagctctgagttattaatggttataaagctcttgttattgatattacctatttacatcaaaaagcttttagaaaatggtatgatgtaagcaattcttgtcatggtgaaatctgatggtgtaacccgttttactattggcgctgcttcataacaaaaatgaaaagctatatacatctacagccagaatggattgtttatgtcatataatttcctttactaagttcacttacattacttacagagttttattcattgccataatagagccatgtaggaaatgcactgactgcatgttattgtggcaagaatatcctaaatgtcattaaaatcctccaacatgatggatctccttatggtcttgtttgttgacatgccaaattaacatagttccatctggaaatgagcatttgaaatgataatccggctgggcacagtggctcacccctgtaattttagcactttgggaggccgaaggggggcagatcacctgaggtaaggagttccagaccagcctggctaacatggcgaaaccttgtctctactaaaacacaaacgcacacacacacaaaattagccaggcatggtggtgcatgcctgtaatcccagctactccagattctgaggcaggagaatcacttgaacccaggaggcagagtttgcagtgagccgagattgcgctactgcactctagcctaggcgacagagcaagactccatctcaaaaaaaaagaaaaaaagagaaaagaaatagataattttttaagccttgtagcaaaatttttgtgattttggtttaactttggacggttattatgcactaaccttttttgatggctaattagggtttaattacagaaacaaggtttcaagtaaaactgtctttggcagtgaacaaatagtatattttgaagtagagttgtatagtttttcataagatgtttgggaattttttttcctgaaataatttattccacatctacatcagtgaaagctgtctacctatcctgagtccatcttaaagaaaaaaaaaactcatctcttgcccttattttgaattttccactctttcattaatttatttgttttaaactctgttggaaattgaccttcatatgcttttaaaataagacaaatctgggtgtagtggctcacacctgtaatcccaacactttgggaggccgaggcgggcggatcccctgaggtcaggtgatcgagatcagcctggccaacatggtgaaaccccgtctttactaaaaatagaaaaattactggtaggcgcctgtaatcccagctactcgggagtctgaggcaggagaacacttgaacccgggaggtggaggttgcagtgagcctagatcgtgccactgcactccagcctgggcgacagagtgagactctgtctcaaaaaaaaaaataataaaatctcaagttgtataaaaccgatacatttgtgttactgcagtagtattcttaggcacacagtgatttcatgttatatatgcaaagtagttaggcaactgctttctttgttacagacatttcaagctccactatgtgcagtaaaaacaaaagtaggctacagtctgtgccatgttgatgtacaatttcgaaattattttacaagactttgataataaaaccctttaacttaaaaagaaaagaaaattgtgtaatgcctgaatcatacattttcattcctattattatgaaataatctgccttttataatagctttataatttagcaattaaatgtaaatctgtattacctgttacttcaaagaaggaattaaagtaagaagcaaagcatttaactcatttcaagtgaatccttaaacatcctacgtgtactatttagtctttcctctgattccttacacaatatgtagactgttaacaccactcttaaaatggtttcttggattcttatattcaaaccagaagtgaattatatgtattctttatttatttatgtatttattttaagaacttgaaggccaggctcatgcctgtaatcccagcactttgggaggccgaggcaggtgaatcatcttaggtcaggagttagagaccagcctgaccaacatggtgaaaccccgtctctattaaaaatacaaaaattagctgagtgtggtggtgggcacctgtaatcccagctactcagaaggctgaggcaggaaaattgcttgaactcgggaggcagaggttgaagtgagccaaaatggtgccattgcactccagcctgtgtgacagagcgagactccctctcaaaaaaaaaaaaaaaaaagaatgcaggctaggcacagtagctctcgcctataatcccagcactttgggaagccaaggcgggcggattgctttgagctcagaacttcaagaccagcctgggaaacatggcaaaaccccatctccacaaaaattagctgggcgtggttttttgtttttttgtttttttggtttcccagtgcctgtaaaagtaatgattatactgtattctgttaaatgtgcaatagcattatgtctaagaaaaaaaatcctgtattgctaaaaaacactaatgatcatctgagccttcagcaagtcctaatctttttgctagtggaaggtcttgccttgatgttgatgcttgctaactgatcagggtggtggttgctgaaggttgggatagctgtggcagttccttaaaataagacaacagtgaagtttgttacatcaattgactcttcttttcacgaaaacatttctctgtagcatgcagtggtgtttgagaacatattgcccgtcgtagaacctctttcagaattggagtggggtcgggcatggtgtctcatgcctgtcactttggaaggataaggtgggaggcttgcatgaggccaggagtttgagaccagccttggcaacataccaagaccctgtctctgcaaaaaaaaaaaaaaaaatttttaatcagccaggattaaaaatgtacttgcctatagtcccagctacttgggaggctgaagcggcaggatcgcttgagcccaggagaggaggtcaaggctgcagtgagctgtgattactccactgcactccagtctgggcaacagagcaaaactctgtctcgaaaaattaaaaaaaaaaaaaaaagtaaaattgaactgaatcctctcaaactctgctgctgctttatcaaccaagtttatatattctaaatgctttgttgtcaacaatgttcacagtaccttcaccaggagtagattttatctcaagaaactactttctttgctcatccataagatgcagttcctcatccactcaagttttagtatgagattgaagcaattcgctcacatcttcaggcttcacttctgattctttttatttccaccacatctgcagttccttcctccactgaagttctaaacccctcaacctcattcatgagagttggaaccagtgttttcaaacttctgttaatgttgctattttgacctcctctcttaaatcacaaatatctagtatccagaatggtgaattctttccagaagtttcttctttaattcacccatatccatcagaagaatcactatctgtagcagctagagccttatgaaatgcatttcctaaataatagtaattgaaagttgaaatgactccttgatccatgggctgcagaatggatgttatgttaacagtcgtgaaaaccacattcatccacttacatgtttccatcagagctcttgggtaactaggttcattgtcagtgggcactcatattttgaaaggaatctttctttctgagcattagttctcaacagtggatttaagatattcagtaaaccatgctgtaaacagatgtgctatcatccaggctttgttccttttttggagcataagcaaagtagatttaacatcaggattttcacaatagtaaatgagcatcagcttcagcttgaattaccagctgcattatccccaaacaagagtgtcatcctatttgaagctttggagccaggcattgactttccctctctagctatgaaagtcctaggtggcatctgattcccatacaaggctatttcgtctacattgaaaatctatcattgaattcagccaccttcttcagttatcttagctagatcttctgaataacttgctgcagcttctccatcagcacctgctgcttcaccttgcacttacatgttatggagatggcttctttccataaacctcatgaaccaaactgccagcttccaagtttccttctgcagcttcctcatctctctcaaccttcataggattgaagagagttagggccttgctctggaataggctttggcttaagggaatgttgtgactgtttgatcttctcttcagaccactaaaactttctccctattagcagcaaggctgttttgctttcttatcatttgtatgttgactggagtagcacttataatttctttcaacaacttgtttctttgccttctcaacttgggtaaatgtttaccacaagaggtctagttttcggcctgtctcagcttttccacatgccttcctcactaaccttaatcatttctagcttttgatttaaagtgataagcatgcaagtcttcctttcacttgcactgttagaagccattgtagggttattaattggcctgatttcaatattgttgtgtctcgaggaataggcaggcccaaggaaaggaagagagatgggataacggctggtcagtgaaacagaacacacaacctttatcgatttcatcatctcttatgagcgaggttcctggctcccccaaaacaattataaaggatgagccaggaggattgcttgagcccaggagttcaagaccagcctgggcaacataatgaggcccctgtctctacaaaaaataaaaaattagctgggcatggtggcatgtgcctgtagtcctagctatgcgagaggctgatgtgggaggatcgcctaagcctaggagtttgaggctgcagtgagccatgatagggccactgcattccaatctgggcaacagatcaccgtaacacttaagaattttttgtttaactgatgtgttgttccaaatacctttacatgtaattattaagtttgacaaaattaatttattaattaatcaggttggtggtaaagtaacatgagggaactacctgggtagatggaaacattctgtatgttttgattgttacatatgtgaatacttttgtcaaaagtcgttgatgtataactaaaatttgtcaatttattcttcagtgaagttttttttttaatatcctcacttccaaaaagcagttgtaggcacagagatttaaaaataaatggtctagtctgaatgaaatttttaattgggatattgttaaaagacaaacatgtgtttcattatcacttaactgactaaaaagtagattaaaccagtcacaggaggtttctaatttgataactaaacaaattttattggcaattagactgaaaatataattgtctagaaaaagagttttaagatttagttttttcttacattatattaataaatttattaattttgagattaatgaacttttgttgtagacttagctgaaccagtaaagtagcatttgtcaaccacgatagaaatgcttattttctgtatatgaaagatgaaaattaagcgttacaaattaccattataaacagacctgtcgacttacaaatggtaaagctttcttggccttttactatatacatcatgatggtcttttgagtgctttaactcaagtacagagcctgctaaaacaaatatttttctagaggcagtaattaagtacaacatagctggaaatgttaagcttggtttcagactacctttttagaagctaaggagacataccaagtctttgctgaataagtcttagtttgcatatccttgagtaattctacatgtggtattatactgtgagaaaatccaaaatagagtctctataaatgtcaagattacctttaataaaatatgtgattaagtgacacattcagtatattatattttaatacttgtagagaactaattttttataaccttacacagaactgaatatcattttcagctttattactgaattcataatcaaattgtaccatttttctcctgattgtgtaggttctcaccctttagtttaccctttgaattatgatttatcatctattttattatatgtagaaatattcattaattgactatatcatgattatatgtatgaagtaaaactagttgtgacagtgttgcaattagtagttttttcttggaagtatttcacagcgtttaatacttgtttgaaatggtttatatgaattaaatctgtacaaccatggggtaaaatgtaaacaactgcactattaggaagatattaaagtagaggctatatttacagtgtcgtctttcaaatctagctatgctgtaaactgatgtttgctgtatgctcctcctgatttgaaatagatgaaagaaaatgaacctattatcaccatggttcacacaatgattgagaactcggcgctaagaccccaactgtaccagcaagtaaggtcttggacagtgaatgatactgctttatcatctgcaaaatccctcagtgacagttttgatttattctcagatttactcatgacatcagtgtttttcttattttattttttgtttatgtttatttggaaaaccacaattcatccatgcttttcaagatgctgcagtattcttagcatggcttcgctgaacattttgctgttgaatattaaatgtgccattttcctaaagtttttgtgcagagtatttgattgatatgtacttggaggtctgcagtacatttgcaaaattactagattttcatatggttttattaactttaaaagcattatacctattttttagggaaaaggctttgtaaaaatatttactttcaggggttgccctccacaacttcccccaacctagtgttttaagaatacattatatttgtatgggcgttatttaaatctagtttctgtactatggtatggtaaaacttaaagatagccactttttaacatactgggggtattttgtcgctgtattcttaccattctcaagcagtcgtcaagactatcataagttaccctattgtttttccttattcaaaatgtgtgtcatggagttggctggctttaacttaggaaccttagtaatctgcagatctgcaaaagaagtcatatgtttctatcaaatttttgtgtatctcatggtctaaatgtttctagctatgtgtttctcaacatcagcttctttcacttcaacaccctcaaattactctggcgtatgacctttacaatctttaaaaatcatgcagaagaagaaaattaactaacatgaaaaatgaatatatattttgatttaaatatataaggcacctagtaaaaagaacgactttgagctcatgctggcttttaaggcctctatttggttcagttgccatgggatctgcatcacagggccatgtaactgaggaatggatacaattgatcagagggtgacttatatttcagcacagttttcaaaatatttaaagtatattattagatgactgaaaatagtctcaaatttgcaataaagagattaacaaactattaaatatttaaagttaaacagctttacttatcaaaagaaaatggaatctttcaattcttaaagtcaccagattatagaccttggtactctattccaaagtaccacaccgagagtatttggaataagtattattccgaataagtattattccaaaactgataccttctgcagtgtctgaagctgtcagtaaaatatatcatctataagatgctaaattgacatgagatcaaagggattttgttgtaataggttatgtttttatcacattttgcatattttagatgagaatggtagcctggatttcaaatctgtttggtttggttgggtttttttttataatgctcaacattcatggttcaggatgcggaagtctgatagtttaaattatttggttgcattaaaagttctaattggggttttcccaaagtgtggagatctgaaatgggaagggctgaggggggggaaagtgaagatgtctgagactggcacattatagcatcactgaccttgaataccgaaagagcaatagatttgtataaatatttctttatattaatatgtgaaagaaaactaaaattgtatagaacagaaagatctgaatgtctaatgtcagcagccttgcctgggcatggctgagtcaccagttaccaggaaatcagtgttaactctcagtgctgttaaggctagggagtcttcagactgtcttatttttattcagccactagtaaaggacttaattattaagcagggcatccttaatagattaaagtgacagcccgacacattttttaaactgtgtttataaatttgcacaaactgaaattatattttatttttctccaggtttccctcatcatgttattatccagggaaaatgtactgctacagtttgcttttctgaagttgaatgacagtgttttattaataagttattgatatttagctagaaatacaatggcaaaatgttttataacctattttattctgaatcatagccactcagtttttggaaatgtttgcatttttcttccttggagaacactcaagaaattacctaggcagtaattttcttaaaattggtcaattaaaaaagacttaaaactgaatccaggcttgtcgaggtggcttatgcctgtaatcccaacaatttatgaggccaaagctgaaggatcgcttgaggccaggagtttgagactagcctgggcaacaaagcaagaccctgtctctgcaaaatataaaaaaattagccaggcatggtggcacacacctatagtcctagctactcaggaggctgagacaggagtccgaagctgcaatgaactgtgattacgattacaccactgtgctctagcctggtgggtgacagaatgagatactatctctttttttttttttttaagcattctgtattctacaccacctttcacagttacattttaggaccatagtttttataacatgattaataccagtgaaattaatcacctgataagtaatttgtcctaaaagatgcaatatcaacaaatgcctatagtcctatgagcattttttttgccatctgtggatataatgtctaattttatcaaattttaaaatatttccccaaaactcctttttggagtttatgtatcatgttcatatactctaaaatatatatagtccacatacctaagggatattgaagttgaattttaattaacatatgtaactttgttttaatgccaagacagtttataaaaaaaaaaagtatcagatactttaaatggttccgacatcctaaataaaatataacacatgtccttatgtagttaataaaatccatataacacactcctcaacctgaagttggagcactgcacaagtttatgtaattactacatagcccattttttcatttgcttttctagtgttgctaaggtacttcgaatgaagtattcaaaccaaaccttttttttttttttttttttttttggctaaaggtgtatttgaaaaaaatgataaacagtgttaccatgaacttaaattaaccagaatgctcatgaaatttacttttcttttttttcggtagggccaggggttgggatgaggagtcaggattttcatgttgaggacaaaatagcaaccttttcaattctatgaaggcgttttttgtttgtttaaggaaaaattttgttttcttatgcttttattctgtcataaaagcaatgtgtggggagaggtttaaggatttggttagttgatgtctaatgaatatctttattgaataacttgataaaagatttcaagaaaaatttcggtggtactaaaagtagaaataccacaaaaatctgattgatatgtataatatatttatatggctataaaggatatatcgctctaaagttgtaactacagtagacatttttctctattatgatatgctaactgatgtaaaaataaatctgcaataagattccccaaataaaaatagtatatcaatatcctaaagatttactataaattagtaagttttcactttaatatactaatgtttttttctgttgactctgagatatagggtacatttgatattttaatctagatgaaacactgtctgctagttatattcagattctgtaatctagtaaagctgttttgcatttaactttaaatattaagcaaactacggctgggcgtggtggctcacgcctataatcccagcactttgggaggccaagatgggaggatcacttgaggtcaggagttccagaccagcctggccaacatggtgaaaccccgtctctattaaaaatacaaaaatcagccaggcatgatggtgcacgtataatcccagctactctggaggctgaggcaaaagaatcacttgaaccctggaggcagaggttgcaatgagccgagatcgcaccactgcactccaggctgggcaataacgagactccatctcaaaaaataaataaatattaagcaaactatatttgaacatcttagtagcttatgacttttcatctttaatttgttataaatatgaaaatggaattttggcattgtcttactttttttatcatagatctacctatttaaaacttacttcatattactttttttccagataggaatataaattattttcttggatctaggtgctttaatttacaatgacagttgacacttctcaggacacacctgaggatacttattttgaatagtataagagtattctaacttttgtcattaaattcatttttcatgtaatattcattcctatgaaagttttgtggtttaacaatcactgcatacccttaaatagtcacagattcatttgcatgaggtatgtgaaagtaatgtcttgaaatgaaatataaatccaggatttattgtatgtttggaatgcttatatttttaaccttctcctgattcccacatttctagatcaattcaaagttatctcctgtttaaatgatgcttccttttaaagctgtaactgtcaagcagtttctttcatagagaaaacatatagaattgtcatttatacattcttatgtattatgcgtatatgaaatttaattttttaaactggaatgtaattgggacacattacttctaaccccaccttgaaaacattgtgccatttagtaaacatgcaatgagccccatttaaattttttctactgtgtttttgttattttctcacagtcaatataaaaatcaaaagacaagaaaaatagtgaagtattgcctgcagaggctgtgatgttatctgtggtataactgactgggatggctattgaaatcttgctaagcacaatcagaagtaaccaaaatatcttttaaccaaaatgtactgggcagaagctgaagaaaggatatttaagtacactgaataattccttacaatatagtaacataaatggagtcaactaacacacataaactttttatgaaatttgactatccatagtttataacataggctttcagttttataagatttcgaatgattttcctcttttcaattaaacccatccttttccttcattatcttttagttcttaagacagaagagcaagataagtctatattgtgtatgtgtgtttatatattatatatatgtatacaatatgttataggttttgttaagatgtgttgacatttgagtgtacacatacacagtgtgtgtttatgtatataccgtgaaggatggttttggctgttgaactatgcttaatttaagtatttgatttgacacagttgctacgattgtatttgtcagtttttttattaaaataatgtgtgtctttaaaagaaatgatgtaagatactgtattagttttgtttgaccagcatattattatgtttaacaagcttgttacatacatcgttcgtatgtatcttgcatattatatcactgttaagtattttctactttgttgatcagtgtttgaattaaacttctaaaagtgtaagaatcattaaaatctatttttgttatgttatatatatttaatataaatccaaagtattaattaatagggtaaatatatttttaaataagattttttaagttgctatatgatttttttcttatagctgtcacaagatgaaggtagaggcacattatacaaatacagacctgaagaagtagatattgatgtaagtattagtatgatatatgtggtcagtactctgtcgtattctccgccaaaaacactggaaataagcatgaccaaaaaacttctttctcccaagtcctccaaagtgacatcaggtaaattcatattttatgtgtgtgctctaaattattattccctgccctctacgtcccactgctccctattgttagcagtccaacgttattaagcatcacttaaatgaaagtaaaaactgtttctgatttttagaagttacagattggctggacacggtggcccacacctttaatcccagcactttgggaagccgaggcgggcggatcagttgaggccaggagtttgagaccagcctgggcaacatagcaagaccctgtctctactaaaaatacaaaaattagctgggcatggtggtacacgcttgtaatcccagctactcgggagtctgaggcctgagaatctcttgaacccaggagggacaggtgcagtgagccaagatcattccactgcactctagcctgggttatggcgtgagaccctgcctcaaaaaaaaaaaaaagttatggaagactagagactggagacgaattgctgtgtttttcagataaagttcggcctttagaaattttatcactactcctttttaaatttagtttcttttaaatcatattttagattgctgatttgccatacattcttcactcattatacccccttttcttttcttttcttttcttttctttttttttttttttttttttgagtcagggtctctctctgtcacccgggttggagtgcagtgtcatgatctcaactcactgcaacctccacctcccgggttcaagtgattcttatgcctcagacacccaaatagctgggatcacgggagcatgccaccatgcccagctaactttttgtatttttttttttttttagtagacagggttttgccatgttagccaggctggtctcgacctcctgacctcaggtcatccacccaccttggcctcccaaagtgcagagatacgggggtgagccaccgagcccagccccctactttttctttttaacacctttcattttgtgtaggctgagtcttgttgtctgacaaagataaggtagttattttaatagataaatggcaaagaaagtaaagtctcaaatttcttgcttatgtgtcattatgccataaagttggggacatatttccaatttgtccagtgttttcattttgaaacattaaaactggtttattgtactattgaaattttattagaatactttcttgtactttcataattaagaaattagggtaatattaagaatttaaacactaaaaccctgatgaaagttatttttctccattaataatatttttatttgtatttcaattagaagtgatctattgtttatattattttctaagaatctaagagtgtgttttttaaacatataacaatagaatccagtaagcattttaattaaggactgcatattatcacttaacctatttagcagattgtagaggcaaaatgcttgcatgcctattttttaaggattctatctttgtaagctatattttaacttttattgattgaaatatagatttttggtcatataatgactgcctacctccaattacagaaaaaataaaaaattgctaacaagacatcttctcttataacctaggccaagttaagccgattatgtgaacaagataaagtggtgcatgctctggaagagaaacttcagcaactccacaaggagaaagtaggacaattatgtttattgtctacaattgatgttacttaatatgattattatcaggacactgataagtaaaaagaattaatacaatgatgcagaacattaagtgtaattctttttatcataatagtacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgtaagtagattttttttttcccctaataaaagtagcttaaatatgtagttctattttcttctcttttttttaatactgggctctctttaggattcttctatattattatagcagaaaatattaatttgttattagtgtgcttctgtttaggaacataaaattaaaagattatttaattagtgggcattctgttatttacttatgagacaaggtctcactctgtcacccaggctggagtacagtattttgactataactcacttgtagcctgaatctcttggactcaagtgagtgcttcagcctcccaagtagctgggactacaggctggcactactacacctggctagattttttttttttttttttttttttttcatagaaatggggcctcactatgttgcccagactggtctcaaactcctggtctcaagtgattctcctggcttggcctgccaaagtgctgcgattacaggtgtaagccaccacacccagccaaacattttgtcctttgtgaaatgagtgttttacaggggagatgagtactcctgtttattgcattaagaaaataagtagtctggatgtggtggctcactcctgtaatactagcactttgggaggccaaggtgggtggatcacctgaagtcaggagttcaagaccagcctgaccagcatggtgaaaacccatctctactaaaaatacaaaattagccaggtgtggtggcatgcacctgtaatgaggcaggagaatcatctgagcccgggaggcagaggttgcagtgagctgagatcgcgccattacgttccagcctgggcaacaagactgaaactctgtctcaatcaatcaatcaatagaaatataaatagcaaggctgggtgcggtggctgacaccgtaatcccaggactttgggaggccgaggcaggtggatcacttgaggtcaggagtttgagactagcctggccaacatggtgaaacctcgtctctaccaaaatacaaaaattagctgggtgtggtggcaggtgcctgtaatcctagctacttgggaggctgaggcacgagaattgcttgaacctaggaggcagaggttgcagtgagccaagatcatgccattgcactccagcctgggcaacagagtgagactctgtttcaaaaaaaaaaaaaaaaagaaagaaatgtacgtaacagaaccgtgtaactcatagtcatataactatgactgtgagtctcttggaattaccaaatctaaaagtcttaacttgcagcttataaactgttttatgagtttaaacagctggctttaggtcctatgatgtggtcatctctataaacatagtaagagcaccagtctaagcagctctttgaaagagaaatcttaggaaaaactgccatgttatataaaactgctcccaaacccttgtctgtaccttcaatgggctagggagcagctatcttttaagaagggccacagacagtatagcttaatttagaggagtctttccaggctggcaagatcccagaatctcaacttggcttctattctgaaccctgaattccaaacgtgagccatttttaaaggaatataccatgattttaaaatcactgaaaacttagtttgaggaattcttaaataccttacatttctatttccatttttaaaatactgttatttctgttgtctcatttgagtcttaattatattgtcatgtttgtagacttttttgaaatttaatatcctttccattgtgagtatcttgaaataagaaactatgtctcattcacattggatgaatgattgagctgaatgacttacccaaggttacaaagctaataaataatatacctaaaactcaaatccagatcttcttaccacatttctgaagatttagatctacatggatttctgtaatatagtcataaagaaaatataagcacctgaaatactgtctacaaggaagtagtactgagctaatcaaggataggtaggatttggatacaatgagaagagaagtgaagagtggtttattcaaataatacaaaacaccctaagccacagcaaagatgagaacataggagacatgtttggaaaaggaggaaatagaactaacagcctgactgggatagaggattcctgtgagaggatagaaaatgtgagattagaaagggaaaatggggttaaactgtcaatgccaagctaatgagaagctcagggtctctgtgacaacttgagtcaaatcaaaatggtaggctctacagacatttagttggaaactatttaatgatttggtatctgctcttgaaattccgattttagggaatccctttccttatcaactgggattaataaattaaatctcatcagtaggtttagaatttgctgcatctcaaggttaactttagcccagatgggaaatttgttaaaaatatcttaatagaaatgaattttgccaggagtgctggctcacgcctgtaatctcagtactttggaaggctgaggcaggaggattgcttgggcccaggagtttgagaccaaactgggcaatttagggagaccctatctctacaagaaacaaaaaagtagctgggcatggtggtgtacacctgtgatcctagctacttaggagactgaggtgggaggatctcttgagcccaggaggtcaaggttgtgtgattgtgccactgcactccagcctgggtgatagagtgatacactgtctctaaaacaaaatcgttaataatagaaggccaggcatggtggctcacgcctgtaatcccagcactttgggaggccgagacgggcggatcacaaggtcaggagttcgagaccagactggctgacacggtgaaaccccgcctctaataaaaatacaaaaattagccaggtgtgggggcagatgcctgtaatcccagctactcaggaggctgaggcaggagaattgcttgaacccgggaggcggtggttgcagtgagccgagatcgtgccattgcactccagcctgggcgacagagcgagactctgtctcaaaaaaaaaaaaatagtaataataaatagaaaataggccaggcaggtgcggtggctcaagcctgtaatcttagcactttgggaggccaaggcaggcagatcacctgcggccaggagttcaaaccagcctgaccaacatggagaaaccccacctctactaaaaatacaaaattagccaggcatggtggcgcatgcctgtaatcccagctactcaggaggctgagacaggagaatcgcttgaacccgggaggctgaggttgcggtaagccgagatcacgccattgcactccggcctgggcaacaagagtgaaactctgtctcaaaaaaataaaataaataaaataaaataaaataaataaaatagaataaaataaaatttgatcttgtttgagtatccctttttctggtttttgtcttatgtaatcactttcctggtttctttttccttgccttcaacaataatcagtggttatgacaaaccctcagaatatattcttctaagacaagtcttattgcatagaatacaaactatgttatttgtgcctttatgtaaacttatttatatttgtagcttaaggctgcaaatgttagcatgtgcataacatcatactgggcatatggttggcactcagtgaatgttgattagatttaaatttgaattacatttttgctggcagaatctcaaaggatttcactgaatctttcacagtcagttcatagcactagttcaaatctaagccccaagcataaggggtataacattagcacctctgtagatcaaagctgtgattctgaaaacatcttctcctcacctggtaggccacaaaagtacacaaaactaggattagcacaagggaagcatgtaaagcagtgttccctatactttttatttatttttattttattttaggtttgggggtacatgtgtaggtttgttaactgggtctattgtgtgatgctgaggtttggagtatgaatgagcccatcacccaggtacctagcatagtactcgatttcaacctttatcttccattctttccccacccacagtagtccccagtttcactgttaccatctttatgtccacgagtaccagtgtttagcttccacctgtaagtgagaacatacggtatttggttttcttttcctgcattaatttacttaggataatggcctatggctgcatccatgatgctgcaaaggacatgatttcattctttgttatggttgtgtagtaccgtggtatatatgtaccacattttctttatccagtccaccattgatgggcatctaggttggttccatgtctttgctattgtaaatagttctgtggtgaacatgcaagtgcatgtgtatgtttggtagaaagatttgctttcttttggatatacttttggatatatacccagtcaatgcaattgcttggtcaaatggtagttctgatttaagttctttgagaaatctccaaactgctgtccatagtggctgaactaatttatatctccactcactgtgtataagcatttccttttctctgcagtcttgccagcatctgtttttgtttttttttttttttttactttttaatagtagccattctgatgaatgtgagatggtatctcattgtgattttaatttgtatttctctgatgattagtgatatggagcatttttttatatgcttattggccacttgtatgtcttcctttaagtgtctgttcatgtcttttgcccattttttaaaagggttatttgttttgttttttcctcgttcaattgcttaagctccttatagattctggatattcaacctttgtcggatgggtagtttgcgagtattttctctcattctgtaggctgtttactccattgatagtttcttttgctttacagaagctctttaattagctcccacttgtcagtttttgtttttgttgctattacttttttcttttttcttttttttttttttttctgagacagagactcactctgttgcccaggctagagtgcagtggcgcgatctttgctcactgcaacctccaccttccaagttcaagcagttcttgtgcctcagcctcccaagtagctgggattgtaaatgcccgctaccaagcctggctactttttgtatttttagtagagacagggtttcaccatgttggccaggctggtcttgaactccaagcctcatgtgatctgcccactttggtctcccataatactgggattacaggcgtgagccaccatgcctggctaaaggattcttatagtttgaggcctgacacttaaatctttaatccaccttgagttaatttttgtatatggtgaaagtaacgggtcagtttcattcttctgcatatggctagccagctattccagcaccatttattgaataagaagccctttccacattgcttatttttgtcaatttgatcaaatatcagatggccataggtgtatggcttaactgctgggttttatattctgttcccttggtctgcgtctgtttttgtactagtaccatgaagttttagtctgtagccttatagtatagtttgaagtcaggtagtgtaatgcctctggctttgtttttgtttaggattgctttatctgtttggactcttggttcaatatgaatttaagaatttgttttctagttctgtgaaaaatgatggtagtttgatagaaatgacattgaatctgtagattgctttgggcagtatgaccattttaacaatattgattcttctaatccatgaacatggaatgtttttccattggtttgtgtcatctatgatttctttcaacagtgttttgtagttcttcctatagacatctttcacctccttggttagatgctttcctaggagtgtgtgtgtgtgtgtgtgtgtgtgtgtgtgtgtgtgtgtattgtaaatggaattgcattcttgatttggctctcagcttgaacattattggtgtatagaaatgccagtgatttttgtacattgattttgtgtcctgaaactttcctgaagtcatttatcagttgtaggagccttttgatagggtctttagggttttctaggtataggtcacattgtccgtgaagagaggtaatttgacttcttttcctatttggatgcattttatttcttcctcttgcctgattgctctgactaggacttccagtactatgttgaataggagtggtgagagtgggcatccttgtctttttccagttctcaagggaaatgctgccagtttttgcccatctcagtatgatgttggctgtatatttgtcatagatggcctttactattttagggcatattccttcaatatggatttatttcgtaagggtttttatcatgaagagatgctagattttatcaaaagccttttccatgtctactgagatgatcatatgttttttgttttttattctgtttatgtggtgactcacatttgtgatttgtatatgttgaaccaatcttgcatcttagaaatgaagcctattttatcatggtgaattaactttttgatatgccactgaatttggcttgcttgtatcttgttgaggatttttgcatctatgttcatcagggatattggcctttgttttctttcttctttgtgtctttaccaagttttggtatgagggtgatgttggcttcatagaatgagttaaagaggagaccctcctccttatttttttggaatagtttcagtagaattaataccagctctttgtatgtctggtagaaatcggctgtgaatccatctgatccgtgcctttttttgtttggcaggttttttattacagattcaatttcagaactcaatattggtctgttaagtgtttcagtttcttcctgattcaatcttgggagattgtatatttccaggaatttatctatttcatctagattttctagtttgtgtgcatagtggtgttcgtaattgtctctaagaatcctttgtatgtctgtgggatccattgtaatgtcatctttgttgcttctcattgtgcttatttggatcttctttttttctttattattctagctaacagtctgtcaatcttgtttttgttttcaaagaaccaacttttgatttccccaggctggtgtggtggctcatacttgtaatcctagcactttgggaggctgaggtaggcagattacttgagcccaggagtttgggaccaacctaagcaatatggtgaaactccatctctacaaaaaaaaaagcaaaaaacaaaaaaaactagccgagcgcagtggcgtgtgcctggagtgccaactactcaggaggctgaggcagcaggatgacctgagcccagagaggtcccggacaacaaagtgagaccctgtttcaaaaaacaaaacaaaagaaaatccacaaaaaagccaacagaagtgtggcgcagtaatagttatttatttaaatcttcccctgtgtgctagcctttctatttttattatatctagaatttttaacaataaaaagcaagcactttctttgagatgagaagttagttttgtttcattgaaaacattagagaagaaactaaacatgggagttaacaattacaaatagctaaaacatagaatgactacaattgtggtcataaactagaaatttaaaatatggatagctttataattgtggctgatagttgagcctcactttatacagtttgagttggtgcccttttaaacatcttttttagtgtgtttcaagtcgaggctaagtgaaaaaataataataaaacgtaaacatctttttaggttaaaaaaagccagtgtagtcattagatagtgtaatgaggcatgccatgtgcttaataagtagtgattttatttgagaagcagttacatgacaagtataaattcgtaaaaaaaaattattttttaaaaaactccttaaataattaagcacattcttcaaatgtgagccaggaaatctctacatcctgaaggtaaaatgaaaaaatgaataaatcagacataagtttcttttgattgacctgaaaaatcaactgcttctaataccagttggcaggactgttatggtggagtattagtgaccaaaaattaacattttaatttttttgcctgatcctcgaaatataccagtaaaattaatttaaatatcataaggctttgattttccaagatatagtggtgggcattaatttgtaatattacttaaatttggaaagagatgtttgagtttaaattaggaagttaatgaataattacactacatctattgcctctccctcattttgatattaaaaacctatgtcaatacttttccaaagttgtaggttttattttttaatgaaaagcagaaaaatgaattgacatttcttaaattaaaacttagaaaccctaattgagaagcaaaccagaagtaaaacagtttattagctctaagaataatagtaattatttgcttttttttaaactatagccacctgtagtcttacaatatttacttgattattttaaaaagaggcaatgtgacagcaaaatacagagaaaacaatttgagatttgtgtctagtgtattgtgtaaccattcccttgagtagattttgttgtaaattgccattgattttagataagaaaaggaaagttttcctcatattaaaaacttggaaatgcatcattggttttgatttttttttaaatagaatttttttgtagagatgagatctccctatgttgcccaggctggtcttgagttcctgagctcaggagatttctcccacctcagcctcccaaactgctgggattacaggcgtaagccaccatgcccggccattaatcctttcttaataaaggacatagtatatatctgctatatagccgtctagctaaatattaaaatccttaactgatttttttggaaatctggaatttcattacattcctgcttcactttctcccccgcacagtggccaagtcttgtctcagtacagactacatagaagtaagcactattaaaatttacttgttccataccctaaacttagacaatttttttaaaaaaaatcttggccgggcctgctggctcctatgtgtaatcccagcactttgggaggctgaggcaggagaattgctttagcctaggagttcaggaccagcctggacaacatagtgagacctcaagtttacagaagattaaaaaacaatgccccagcatggtggtgtgcacctgtactactcaggaggccaaggtgggaggattgcttgagcctggggagttgaggctgcagtgagctgagatcacaccactgcactccagcccaggtgacagagtaagaaaagtctggcctggcacagaggctcacacctgtaatcccagttctttggaaagattgcttgagcccaggagttcaagaccagcctgagcaacatggtgaaaccccaaattaaaaaattatctggacatggtggtgcaaacctgtagtcctagctacttgggagactgaggcaggaggatcgcttgagcccaggagttcaaggctgcagtgaattatgatcatgccactgccttctagcctgggcagcagagcaaaaccctgtctctagaaaactctgcagcaatccctcctcctgcccaacatgcacactatttttttcttttcttggaatataacatgttctcagaaaagcacacagtttaggagtttagccaatatctatatcaagacattgaattttactagcataccagaagctcctctcccaaaaggaacactgccagacttttttcttctttcttttcctttaactttttaaaattgttttagagacagggtattgctacattgcccagatgggagtgcagtggctattcacaggtgcagtcatagcacaccacagcctccaactcttagcctcaagtgatcctccccctgcccagtctcctgagtagctatagcctagcacctgacatttaaactataggtgagttttgcctatttttgaacttgttttttggagacaaagtctcttacacaggctggagtacaatggcacaatctcagctcactgcaacctgcacctcgctcaagcgatcctctcacctcagcctcccaagtagctgggactacagacatgcgccaccatacctaatttctgtatactttgcagagatgggatttcaccatgttgcccaggctggtctcagattcctgggctcaagcgatccgtccatctcggcctcctaaactgctgggattacaggcatgagccactgcactcagtcttgaactttatgtgaagtgtaaccatatactctttgcctggcttcctttaacttacgaggttcatccatatagttccagattgaaagaatccattcaggcgggcagatcacctgaggtcaggagttcaagaccagcctgaccaacatggagaaaccccgtctctactaaaaatacaaaaattagccggacatggtggcgcatgcctgtaatcccaactactcgggagcctgaggcaggcgaatcgcttgaacccaggaggcagaggttgcgatgagctgagatcgcaccgttacactccagcctgggcaacaagagtgaaactccatctcaaaaaaaagaaggccagccgcgggtggctcatgggtgtaatcccagcactttgggaggctgaggcaggcggatcatgaggtcaggagattaagaccatcctggctaacacgatgaaaccacgtctctactaaaaataaaaaaaaattatccaagcgtggtggtgcgcacctgtagtcccaagtatcccagctactcgggaggtcgatgcagaagaatcacttgaacccgggaggcagaggttgcagtgagccaaggtcatgccactgcactccagcctaggcaacagcataaggctccatctcaaaaaagagttcattcattctcttttttttttttttttgagatggagtctcgcactgtcgcccgagctggagtgcagtgacaccatctcggctcactgcaacctccaccccccaggttcaagcaattctcctgtctcggcctcccaagtagctgggactacaggcacccaccaccaagcccagataatttttttgtatttttagtagagacagggtttcactatgttgaccaggctggtcttaaactcctgacctcgtgatccccctgcctcagcctcccagagtgctgagattacaggcgtgagccaccgcacctggccttcatttattcttttaactgtatagcctggcattctctactttttattgaaagcactattttgtggcaagtacttgagattttaaggtaattgtatatttgaaaagtattagcccttgtaaattatcttgctatattagcttcttgaccacaaatacgtaaggtcatatttaaagattattagcatggtactcatataatctagtaaattctttaatgaaatacccagccagatgttgggaggaaatgtgttgtgccattgctgtcctttcctcgctgtcctctgttgtcttgtgttcctacccacctggtaatcatgtttgaggagctgaagtaaagacagaaacaggtaggcctagcaggattacaggacttgggccagttcagtggcaggactctccaggttaggaaaattgaaagtatactgtgcctcttcacttctaaaatactgataaaggaatgtctagctctcaatctgtatttttaatgtttctttaagaaagagaaggattcctaccatcctgaaatgttcttatacttaaatgcctctgcagtgcagttaagcctaccctgaactctgcatttccacaagggagcttaggtgttagcctgtaataccctcttagccactgggctgtcattggatctgttgtcttaatttactctccctaaagccatcaaagacccactatttgcagtttttgtggtgcacacaaattaaaccatggctagaattaatttttgttaaaggaaattaattttcatatttattcatgtaaaaagaatttgctgactagatgtggtggctcacacctgtaatctcagcactatgagaggccaaggctggtggaatcacttgagaccagcagttagagagcaacctgggcaacatggcaaaatcctgtcttcacaaaaaaaaaaaatatatatatatatatatatatatatatatatatatatatctctgtatacgcacacacacacaaaatattagccgggcataggggtgatggcacacatctgttttcccagtacattttgaataatttttcttcacctaagattttttttttatgaaaaaaaaaaaaaaaaaaaagactggcaagatagcttcagttttttgtttttttttttttctttttggagacatggtcatctgtcacccaggctggagtgcagtagcacaattttggctcactgcaacctccgcctctgggctcaagcaatcctcccacctcagccctgccccgagtagctgggaccacaggcaagcgccaccgcacccagagaatttttgtattttttcgtagagatggggtctctctatgttgcccaggctggtctcgagctcctgggctcaagtgatccacctgcctcagcctcctaaagtgctgggattataggcgagaaccaccacacccagccaatcacctaaattttctaaagttattttaagttagttacagaatatacaaaataagatagctctttattttttttcttttactttatttatttttttttttgagtcggagtctcgcactgtcacccagggtggagtgcaatggtgcaatctcggctcactgcaacctccgcctcccaggttcaagcgattctcctgcctcagcctcctaagcagctgggattacaggcgcctgccactgcgcctggctaattttttttttttttttttttgtatttttagtagagacagggtttggttacgttggtcaggtagtttcaaactcctgacctcgtgatctgcctgcctcagcctcctgaggcgcaatctcggctcactgcaacctctgcttcctaggttcaagcgattctccctccacaggcttccaagtagctaggaccacaggcacaagtcatcgggcccagctaatttttgtgttttcagtagagacagggtttcaccatgttggccagggtggtctcaaactgctgagctcaagtgatctgcccccgtcagcctcccaaagtgctgagattacagatgtgagccactgcgtctggcagatgatgtatttttaagcacctctagaattattctatattcaacaaatgacaagctgttaaagaccaaacatcaaaatcttctctgtgatattattggtttgggggtgattttttttccaaaggagaaaagtacagatggataatagtgtctatattgagtcctcacaaacaggattcactgaattgtttaaatagctagctaaattcatttgttttattgtattactataagcttattgtaagtaaagtcatgtcaagcctctgatgttattgaaattccaatatgctaaaatacaaactatttccattcatggagaacttttaatgaagacagataagaaaatgctttatttatgcctcttctacattttaggaaataaacagcagcacaataatacttaggttgcttagtaaatttttgttgaattgagttttaaaaagggacaaaaatggttataaaaattcctgttttgctaagtataaactatatgactttctaaaatctagaaagttacaattggagtgataacaccataaaagcacattttccccattaaagtaattaacactttttggttttaggaattggaacgagcatggagagaatatgataagttagaatacgatgtaactgttaccaggaaccagatgcaagagcagctggatcaccttggtgaagttcaggtacaaaagtataatattctttatattgttttaactgtttttactggtactgtacaatccaccttgttagatttacgcatacccataacagtttttacattattggctacctgagacctggatttgaatacttttaatgacaggaatcttactatctcacaaaggagaccatcccctcttgtttaagagttctttgttctgttgggcacatggtgagccctggagtgttctgtgctcctatcagtctcagctctacagtttcctaaaaacatggtttcatatcctttcacaggtccatctgtgtcacttggtattgagatgttgaattatatggatttatcaaataatgaatattttatcttttatctttttttttttttttttttttgagacagagttttgctcttgttgcccaggctggagtgcaatggcgcgatcttggctcaccgcaacctctgcctcccgggttcaagcgattctcctgcctcagcctcccgagtagctgggatcacaggcatgcaccaccaagccttattagaataggggaagatacagcaccatttgctataaagaatccagttaataagcaaacagatctgagacctagttccaagggttagttttcttatctataaaatagaaataataatacttggccgggcatagtggctcacgcctatagtcccagcactttcggaggctgaagtgggtagatcacctgaggtcaggagtttgagaccagcctggccaacatggcgaaaccctgtctctactataaatacaaaaattaggtgtagtggcaggcatctgtaatcccagctacttgggaggctgaggcaggagaatcacttgaacccacgaggtggaggttgcagtgagctgagatcgcaccactgtactccagcctgagcgacagagcgagactctatctcaaaaaaaaaaaaaaaaaaaaagaaataataatacttgtcttaaaatgttgctctgaggaacgcagataatacatgtttaagaaaataataaaagttacgtcacgcttatgacccaatgtaaatttgaacattttagttggaaatgcatggacttaacagacagatcaatacaatgaatgaaaaattagttaagttcaagaccaaccagcctgaccaacatggggaaaccccatctgtactaaaaaatacaaaattagccaggatcacgaggtcaggagctcaagaccagcctggccaagattgtgaaagcccatctctactaaaaatacaaaattagccgagcttggtggcaggcacctgtaatcccagctactccagaggctgaggcaggagaatcgcttgaacccgggaggtggaggttgcagggagccaagaccactccattgtactccaccctgggcaacaagggcgaagctccatctcaaaaaaaaaaaaaaaaagattagtaaggttgaatcagaaattcagctgccctctatctgtgctgtccagcatagtactggccacatgtagttgttgggcatatgaaatgtgactattgtgactacacaattaaaactgaacttttagttgtattcatgttaactatctaaatgtatttacttgtttattgaatcagggttttgttctgtcacccaggctggagtgcagtagcatgatcctagatgaaaccttgaactcctgggcccaagtgatcctcccacctcagccttccaaagttctgggatcggctggacacattggctcatgcctgtaatcccagcactttgggaggccgtggtgggaggatcacttgaggccagaagtttgagaccagcctggccaacgcagtgaaaccccacctctacaaaaatacaaaaattagctgggcacttgtggtcccagctacttggaaggctgaggcaggagaatcgcatgagcctgggaggcagaggttgcagtggagtggagatcacgcaactgtatgccagcctgggcgacaaagggagactctgtctcaaaaaaaaaaaacacaaagtgctgagattacaggcatgagtcaccaagcccagtttgtctaaatttaaatggccacatgtggctgggacttctgtattggacactgaagttacactgtcagtaatcagctacaataatcagctacaggcacctgtaatcccagctactcgggaggctgtggcaggagaatcacttcaacctgggaggcggaggttgcagtgatcggagatcacaccattgcactccagcctgagtgatgggcaaaagtccatctcaaaaaaaaaaaaaaataagaaatcagctacaaaaatgagatgctaaatacactagaaaaatagctataaatacctaagatattactagaggtcagcaaactttctgtaaaaggccagatctgtcacatattatttaatgttttttgttattttataacttctcttttttttttttgagacagagtttcactcttgttgcccaggctggtgtgcagtggtgtgatctctgctcactgcaacctccgcctctcatgttgaagtgattctcctgcctcagccttcctagtagctgggattacaggcatgtgccaccatacctggctaatttttgtatttttagtagagacaaggtttcaccatgttagccaggctggtcttgaacacctgacctcaggtgatctgcccgccttggcctcccagagtgctaggattacaggcatgagccaccgtgcccggctataacttcttaaaaatagtaaaatttgttcttaactcacaggccataccaaaagaggctgcaggccacagaaatttgccaatcccagatttaacctgccaaaaaatatatttattatgaaaatttagtaaccttattacaggatataagagaagacctgaattaatggagaggtgtaattggtataccatattcatggatggtctgatttaacattatcacaatgaaaattcttcctgtaaatgcaattttattccaaccaaatttccagtagaattttctaaagaaatttctgaaatggctctaatatttttaaggtataataaaaaccacaagtagttaagacatttcaaaaaaaaataaaagaatgagaagtcatactctatgaatggtaacattgcatatacagccttagaccagttacataacaactctgggtctcagtttccacaactataaaataaaataatacctactcctgctaggttattatgaggataaatatgtttatattttgcagcatgtagaataaaaccaggcatataaaacacgctatataagtgtttgttaaataaataaacaaggaaacataatgtaaaactatagtgttaaacatggtacaggaaaaaatagaccaatggaacagaatagagagtttagcagcaggccatgaatatccacaaagcagagagagaaagaaagagagagaattgttgaacagcatttggctttatcaaagttaaagatttaccctcaatgaaggcaacatagacagagtaaaaagatgacctactgggaggatgtatgttttacctcaaaaattcaacaagggataactatttagatttgcaaggaagtttttctttttgatttggagaaataatcctttagaaaaacatacaaaaaacatgagtaactaatcataggaaaactcaaattactaacacgtgtttgaaaaatagttcaaagttactgggaagagaggagcccctctgcccggccagccgccccgtccaggagggaggcggggaggtcagccccccgcccggccagccgccccgtccgggaggtgaggggcgcctctgcccggccaccaccccgtctgggaggtgtactcaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggactcaaacactgcggaaggccgcagggtcctctgcctaggaaaaccagagacctttgttcacttatctgctgaccttccctccactattgtcctgtgaccctgccaaatccccctctgcgagaaacacccaagaatgatcaataaaaaaaaaaaaaaaaagaaagaaaagaaaaatagttcaaagttggctgggcacagtggcgtatgcctgtaatcccagcactttgggaggccaagtcagacagatcacttgagggtcaggagttcaagaccagcctggccaacatggcgaaacctcatctctactaaaatacaaaaaaagagagagctgggcatggtgtcacacacctgtaattccagctatttgggaggctgaggcaggaggattgcttgaacccaagaggcagaggtcacagtgagccaagatcacatcgctgcactccagcctgggtggccgagtgagactcagcctcaaaaaaaatgaaaggaaaagaaaaatagttcaaagttagtagtaaccagagaaatgcaaataaaataaaaattagatttgcattgtataccgtttcagattggcaaaaatgtgtctatacatatatatatcttttaaattttatgaaagtaatacatgttgtatatagatgtgcaaggatctgttatttatagtgaccttcccatcctctgtgtcagtatttacatctctgggctgtcgttgtgtttggctcttgcatgggtactttctttttttttactttttgatgcttccaggctgtagcttggaaaactagataacttaggttatgtagtgcctttttggagcagcattaattcatagtctttaggcttatagacttttcttgagttttttctttttctttttttaatcttttgatcaactcccaagtgcttggaagactttgaaaacatattgctttttttttccccctgtgacagagtctcactctgtcacctaggctggaggacagtggcacgatcttggctcactgcaacctcttcccccaggctcaagtgatcctctcacctcagcctcccaagtagctgggaccacagacatacaccaccccgcccagctaagtttttgtatttttggtagagatggggtttttctgtgttgcccaggcaggtcttgaactcctgagcttaagcaatccacccacttcagcctcccaaagtgctgggattataggtgtgagccactgtgcctggctgaaaacatatttctacccattagaggacttttttagcatattgatgcaatactgattatattctaatatctatagtcattaataactgatactcagccaaagaaagtattgttctaggcaatgtgacagtttttgtatgtcattgcctatttttaaaaataaagttacattcctagaatagtgtttagtattatccagaatggtgttattattaccctatttatgaataagagtcatagatttctaatagaatctcagagaaaaccaatgtaatcttattttggtttcagttagtgtatttaacctgagggcatgatgtggaattttagaagtaagaaaattggccgggcgcggtggctcacacctgtaatcccagcactttgggaggctgaggagagcggatcacctgaggtcaggagttcaagaccagcctggccaacatggtgaaaccccatctctactaaaaatacaaaattagccgggtgtggtggcacatgcctgtaatcctagctactcgggaggctgaggcagggcaattgcttgaacctgggaggtagagtttgcagtgagctgagattatgtcgttgcacaaaatacaaaaattatggcatagcacgtgccgtaatccccactactgaggaagctgaggcagcagaatcacttgcgcccaggaggcagaggctgcagtgaactgagagcttgccactgcactccagcctgggcgacagagcaagactctgtctcaaaaaaaaataaaaataaaaaaatacatttaaactctgtcagtcaaaattcatcttgatatattttgttagttgtacctttgttgttgtttttatgttctagaacctaggaagttagtacaccttccatttctcacccattccccaatgccctgccacatctccccctcccagaaattattttttcttttggggtttgtttctgctctgttttcattctctctgtttgtattttccattttgggtcccttttaatcaatatgccttcctggtatcataaataatgtaagacaaagcttattggaaagatttaaaatagtatatttaagtatgaaaattaaatatttttcttgctctgctcagtcttttatatttgccactggacttgcaaaattgggagagtcacatcaatcatattaaatattcgtaacacttaattcactgcaatttgcatttttagatgtaatttatataattaatatataatcatttaacttcagtgaatgattttttttcttatatatggtctatccatttttactgatagacggaatcagcaggaattcagcgtgcacagattcagaaagaactttggcgaattcaggatgtcatggaagggctgagtaaacataagcagcaaagaggtactacagaaataggtaaattagctttgcattttattttgtgactgaccacagtattacagtcatgtgtcgcttggtgacagattacattctgagaaatgcattgttaggtgattgtgttgtacaatcagagtgtacttaaacaaatctagttgtatggcctactacacacctaggctatgtggtatatagcttattgctcccaggttgcaaacctgcacagcatgtgactgtactgaatactgtagacagttgtaacacaatgttatttgtatatctaaacatagaaaaggtaatgtgttacactctgacatgagggcaacaactaggcaatagatatttctcagctctggctgggcacagtggctcacacctgtaatcccagcattttgggaggctgaggtgggcagatcacctgaggtcaggagttcaagaccagcttggccaacgtggtgaaaccctgtctctactaaaaatacaaaaaaagccaggcatggtggcgcatgcctgtagtcccaaatactcaggaagcttagacaggagaatcgcttgaacccgggaggtggaggttgcagtgagccaagatcatgccagtgtgctccagcatgggcagcagagggaaactgtcccaaaaaaaaaaaaaaaaattttctcagctgcattataatcttatgggaccactgtcgtatatgtagtctgttgctgaccaaaacattggtatgtggcacatgactgaatgtctaaatggaatgacatatataattgagtttcttttgttattttaatgcatttttctgaacaggcactcttaacattgaatcagagcacaggtttataaagtaaaaagtgaaagctctgtcaaccatacctaaacaaaaataattattgtcttgtgtgtataattataaatatccacaatgtttacactttagaagttttatccccacaacaagaactgggatcatcctatatctatttttcaataatttgcttttttctccataacaatgcagtgtaagaatccattgtataagggaactgtaatatatttatccatttccatattgatggataatgtatgttgtttccagagttttttatgaatgctgtcataagccatgccatagtgaacattattaatacatacaactaaacacatatgttagtacttaatggattttaaaaggtgagaaataagcacatgttttccatttggataactgcggccaaaatgccctcctgaaggattatttcacattatgttaataccagtaatgtttgagaaaacccatttccccatactcttgtttaaatatttgttgcctttttaatgtaattgctttccaattctgaaaacaataagtgaatgattagaaactgaagacttcatttaaaatatgtgaaatcggccaggcgtggttgctcacgcctgtaatcccagcactttgggaggccgaggcaggcggatcacttgaggtcaggagttcaagaccaacctggccaacatgacaaaaccccggctctactgaaaaaaaaaaaaaaaagtacaaaaattggccaggtgtggtggtacgcacctgtggtcccagctacttggaagtctgaggcaagagaatctcttgaacccgggaggcagagatcacgccactgcactccaacctgggcaacagagtgaaaaacaataaagaaataaaaataagccgggcgcagtggctcatgcctgtaatccgagcactttgggaggccaaggcgggcagatcacctgaggtcaggagttcgagaccaggctggccaacttgttgagaccccatctctactaaaaatacaaaaattagccatgcatggtggcgtgcacctatagtcccagctgctcgggaggctgaggcagaagaattgcttgaacctgggacgcagaggttgcagtgagccgagatcttgccactgcactccagcctgggcgacagagcgaaactctgtctcaaaaaaaaataaaaataaaaaataaaaataaataaaaataaaaataaatttaaaaaaaaatacatgaaattgttctttttttggctggacgccatggctcacgcctgtaatcccagcactttgggaggccgaggcaggtggatcacttgaggttaggagttcaagaccagcctgaccaacacggtgaaaccccatctctactaaaaataaaaaaaatcagttgggcgtggtggcgcacgcctgtagtcccagctacgagaggctgaggcacaagaattgcttgaacccaggaggcggaggttgcagtgagctgagatcacgccactacactccagcttgggcaaacagcaagacttcatttcaaaaaaacaaaagaaattgttctttttttatagtattagaaagatatgtttaatatagttacgttttctaatattcccaggtatgataggatcaaagcctttctcaacagttaagtacaaaaatgaggtaagtttggattgtttttctaattataaattacttttaatgcttaagagatgaattagaagtaattgtcttctctaatcttaataacaaaaatattttttaaatatattgaacagatattgttttagtcttgaaattttattggatcagtaatttggtgcttctaatatgtgatttttcttcccttttttaatgcaaaaaaatggaatctctgctttttatctgttagaattttaacgttgtcatactttttctaatctaagtaatgtttgaatacttatcattgtttcttatactatgtaaaatttataggatgatcgatagataagttggttgtatgtcatgcgtagcataaagaaattacaactacaaagagatactgtcaacctaaccaaaagaatctattattttgaatttcgtataaaaaccaaagaggtaacttttttttttcctctcttaaaaattggggggccaggtgcagtggctcatgcctgtaatcccagcactttaggaggccaaggcaggaggatgtcttgagcccaggagtttgagaccagcctggtaaacatagcaagacccccatctctagaaaacattgaaaaattagacgggcatggtgtgcctgtggtcccagctactcgggaggctgagccaggaggatcccttgagcccaggagttcaaaggtgcagtgagctatgtatgatcaaatcactgcactatagcgagaccccatctctaccaaataaataaataagataaattgtgaaaatataagaataggattttaaaatcagttctttccttctagttttaaaatgaaacccagtaattagttttaaatagtaatctctttcaatgttgagtttcagtgtgaagctaacctatatgttacaggaaagaatcagatgtaattatatgttaaattccaattattggctatgataaaaaatttttgattttacttttcattattagacttttggcttggcagtgtcccttttagtatcttaaagtaaatttaagttaatataccattgcaaagaatttagatatgcttaattcaatctgcttatctaaataaggtgactgttctacaatctttaggaagaggaagtagtcccacctcgtcctccacttcctcggtcctatgactttacagagcagcctcccataatcccccctctgcccagtgatagcagctccttgctctgttatagcaggggcccagttcatctgcctgaagaaaagaagatgtatcaagttcaaggatatccaagaaatggatctcactgtgtaagtggctggaatagccacagaataatcaatcctacatgtcctctcatttttgaaaattaatttattttacactcaaactttttttttattataacctttataacctcatttttggccagcagtttttagtttatatatgactttatcatttgtgtctttcctgttttggttttgctattctcatttttaatatttttataattttaatattttataatttcatagcatttttcatattttcataaagtggtaacttttcccatgatgaagcagccgtattttagatataccattttagggtattggaggcaagattataccttcagatcagaaagaagggagaaagaaaaagaccgttactagggatggtaaaggggctgggatgtggacattttggtctaggaaaactactcaaagatgtggatgttgctaaggagagatgtcacccctgaaaatgggaaatacgtttagggttaagcaaataatgtaggatataataagcaaagagaaaaaggaaattagaattgagctaatttgagaacaacaaaatgtctgtgacaggaattttagtgctgggatgggcctcacttagactaccttgtgaatgaaaatttattgaattaatatagttatttttagccctcaattattccatcataaaaatgtgactttgttcctaagaggaacagaaatattcttttttttttttttttttttgagacagggtctcactctttcccaggctggagtgcagtagagcaatctcagctcactgcaagctccgcctcccaggttcaagtgattctcctgcctcagccttctgaatggctgggattataggcgcacaccaccatgcccagctaatttttgtatttttagtagagacagggtttcaccatgttggctgggctggtctcaaactcctggcctcaggtgatacacccaccttggcctcccaaagtgctgagattacaggtgtgagccactgcacccggccagaaatattcttaatattaaaacgaagttttgccacttaaaaatttctcaaatttcttctttccacgtaattgtgacataggtattatttgtgttatatcccagatggctcactagggctactaatgtttagagtttgatttgtgtctttagcagtaaacattttaaaagaaacttttagcagttttttagggtaattacatgtcttcctttcaagggtccagattatagactctacaagagtgaaccagagttaacaacagtggcagaagttgatgaatctaatggagaagaaaaatcagaacctgtttcagagatagaaacttcagttgttaaaggtcagcatttgtaatatgttttacctcttggtttttgtttttgaagacaatttactgccaaaatagtagtaaattccatttacatgttgactcatatatgagtccaaccctttatctgaaacctttggactctgatgagtttctaaattaagaaattttcagatattaaaagataaaatggcccataaatgatatatgtcatctcagctaggtatgaggcagcaccctttttttaacactatttctacaatattcattccaagtggcataaataaatgctaaaaataaaagacattagctgggcatggtggcacgtgcctgaatcccagttacccgggaggctgaggcaggagaatcactggaacccaggaggtgcaggctgcagtgagccgagatcgcaccactgcactccagcctgggcaacagagcaagacttcgtctcataaataaaaataaaagacatcacatcagattaggttttactaagaaataagtttatgtcaaactttaaagtttcccatttcctgggagagttttctttttttttttttctgtttctggtggttgtttttgttgttgttgttgttgttgttgttgttgtttgtgatgtgttgttgtgtgtgaggtctcactctgtcacctgagctgctgtactggagcaaacatggctcactgtagcctcgacctcccagactcggtgatcctctcacttcagccttccaagtagctgggactacaggcacacaccaccatacccaactaattttttaagtatttgtagagacaaggtcttgccgtgttgcctaagctggtcttgaactctggggatcaagcattccttccacctcagcctcccaaggtgttgggattacaagcatgtgccaccacacctggacagggtcttttctgtgtgtgtgtttaaaattatgcataaggtattaatggctgaaacaaattttcacacaatatcaacaaagtaaattctaaaataatatttctgtaatgtatactctgatttttttcttaatgctggtcatttttctagaaggcaattgcgtaaagaaaagagtagagagagaactatcctagattaaaaagatagataggccaggggtggtggctaacgcctgtaatcccagcacttcaggaggccgaggtgggcggatcacctgaggtcaggagatcaacaacaacagcaacaacaacaacaaccagaaacagaaaaaaaaaaaaaactctcccaagaaatggaaactctaccagcctggccaatatggtgaaaccccatctctactaaaaatacaaaagtttggctgggcacggtggctcactcctgtaatcccagcactttgggaggtggaggcgggcagatcgcaaggtcaggaggtggagaccatcctggctaacatggtgaaaccctgtctctactaaaaatacaaaaaattagccatgcatggtagcacacacctgtagtcccagctactcaggagactgagacaggagaatcacttgaacccaggagtcagaggttgcagtgagccaagatcgtgccactgcactccagtctgggtgacagagtgagactccgtcacacacaaaaaaataacagatagatatatcgcactgtttgaaacttgattggaccatggtttaaaagaagaatctctaaagtagcacaattaatggaaatttaaacatgttctagatattagctaacagtgtgattgtgatattgtggttgtgtagtagaatgtagtatgtgaattctgaaacacttaggacaaaagcatctgccacttttaaaggattcgccagaaagaatgtgtatgtatttatgcagagataatgtaagtgtgacaaaatgtaaaactttttagaaaaataagtgcttatcataacccactggactgatttttgtaatctgctaaaggatcactaagtaaagtttgaaaaacatcaaagtgaggccaggcttggtggctcacgcctatctataatcccagcattttggaaggcagaggcgggcggatcacaaggtcaggagttcaagaccagcctggccaacatggcgaagccccatctctactaaaaatacaaaaattagccaggtgtggtggcgggcacctgtaattccagctactcgggaggcagaggcaggagaatcacttgaactgggaggcagaggttacagtgagccaagatcgtgccactgcactccagcctagacagtgactccatctcaaaaaaaaacacaaaagcaaacaaacaagaaaacacctaagtggtagtaatgttcacatagcttttttcattgttggaatatttttctaggttatctaatgtcgttttttaaatttaaaaatactggcatcttgaaaatttaatatttatacaccttttctttctcatcctaatcctgtctccttattcaaagtctttttttttttttttttttttgagacaggatctcaccatcggcccaggctggagtacagtggtgagatcatggctcactgtagcctccttcctcctctgcctgccaagtagctgagactacacacgtgtgccaccacacctggctaatttttgtatttattgtagagacagggtttcaccatgttgcccaggcttgtctcaaacttctaggctcaagcaatctgcctgcctcagcctcccagagtgttgggattacaggcgtgagccaccacacctggccacaacaaagactttaaatgggctgggaatgatggctcattcctgtaatctcagcactttgggaggccgaagcagatggattgcttgagtccaggagttcaagaccagcctgggcaacataaccagacctcatctctattttataaagtaaaaaatgtatttagcttttttttaagcatatacaacaactatttgacaaaaatagcatataaatgaggaggaagtttattgatattaatacgctttaacatctttgttttgttctgaatcatggtaatgattttgactaacttcagactttcataagtttaagtatgcatgctagggtttaagataaaagaaattgttgagactgcagagagctgtgatcgtgccacttacacttcagcctgaacaacacagcaggactctggaaggagagaaagataatccaaaaaagaaaagaagctggagaaaatgcaaagcaaaaaaatacattgttagaaataaatctaaatacattggcaattacaacaaatataattggactgaatgcttcacttaaaaagactggccaaggcagggcgcagtggctcacacctgtaatctcagcattttgggaggccgagacaggcagatcacctgaggtcaggagttccagaccagcctgaccaacatggcgaaaccctgtctctactaaaaatacaaaattagctaggcatggtggcatagtttgcctgtaatcccagttactcaggaggctgaggcaggagaatcgcttgaatgcaggaagcagagattacagtgagccgagatcacgccattgtactccagcctgggcaacaagagcgaaactccatctcaaaaaaaaaaaaaaaaaaaaagactggctgggcctagtggcacgcgcttgtaatcccagcactttgggaagctgaggcaggaggatggtttgagcccaagagttcaagaccagcctggacaacgtggcaagatcctgtctgtctctacaaaaaaataaattagccaggcgtggtagcacatgcctgtagtcccacctactcaggaggctgaggtgggaggatcgcttgagcccaggaggcagaggttgcagtgagccgagatcgtgccattgtacttcagcctgggtgacacagcaagactccatctcaaaaaaaaaaaagaaaaatacagaagataaagtgaaaatgagtacctatagttagctattgttaacattgttagtggacactttgaggcaatattgtatgatttttttaaagccaagcagaaattaagaacatttaggttgaactaacttgttaacgatgatgatagagatgtatcagtatgacaaagaaggctttttttttttttttttttttaaatagagatgggtctgtgttgagcaggctggtctcaaactcctggcctcaagtgatcctcccatctcagcctcccaaagtgctaggattataggcaatgagccacagcacctggccaaaagagggcattttataattaatgttcttaaaaatgtcatcagttaatctgtacaattttttcttctcttttttctttttttttgttttaaggagacaagttcttacttgctctgttgcccaggctggagtgcagtggtgcgatctcaactcactgtaacctctgcagtgatcctctcacctcagcctcctgagtagctgggactataggtgtacaccaccacacccagcttttttttttttttcaatttttttggagacagggtctcactatattacccaggctggtctgaaaatcctgagctcaagtgatcatcccgcctcagcctcccaaagtgctaggattacaggcatgaacagaattttgtttttaaatataaccctaaatttatctggtggtatcattgactgactttgactcttttatttttatttatttatttttttatttatttttgagacagagtcttctctgtcacccaggctggagtgccgtggcgctatctcagctcactgcaacctgcacctcctgagttcaagcgattctcctgcctcagcttcctgagttgctggaattatagacacctgacaccatgcctggctaatttttgtattttttatagtagagatagggtttcaccatgttggctaagctggtcttgaactcctgagttcaggtgattcacccgcctcagcctcccaaagtgctgggattacaggcgtgagtcaccacgcccagcctgactcttttttttttatttttagacagagtttcgttctttgttgcccacgctggtgcaatggtgcgatctcggtttactgcaacctctgactgctgggttcaagtgattctcctgcctcagcctcccgagtagttgggattacaggcatgcgccaccacgcccatctaattttgtatttttagtggagacggggtttctccatgttggtcaggctggtctcaaactcctgacctcaggtcatccgcctgccttggcctcccaaagtgctgggattacaggcgtgagccaccgcgccaggccagcctgactctttttaaataaatttgctttctgattttaaaaagtgtcagaaattaagtaagctaaaagaaagcaatgctgtataaaagatgttttgtaaaacttactgctgttttaatttttaggttcccactttcctgttggagtagtccctccaagagcaaaatcaccaacacccgaatcttcgacaatagcttcctatgtaaccttgaggaaaactaagaagatgatggatctaagaacggtatttaactggaaattaatcttctaggaagattctcacatctatttattgctttcttacatgttttcattttcagtgtcttatcaaaattatttttgcatactcaaagaaaaacttagtaatcttagttattctttattcttttttttttttttttttttttttttgagacggagtctcgctctgtcgcccaggctggagtgctgtggcgcgatctcggctcactgcaagctccgcctcccgggttcacgccattctcctgccttagcctccggagtagctgggactacaggcgcccgccaccacgcccggctaattttttttgtatttttagtagagacggggtttcaccgtgttagccaggatggtctcgatctcctgacctcgtgatctgcccacctcggcctcccaaagtgctgggattacaggtgtgagccaccgccccccagcccgatcttagttattcttaaaaaaaaaaaattgtttttttttttttgagatggagtctcgctctctcgcctgggctggagtgcagtggcgtgatttcagctcactgcaaactctgcctcccgggttcacaccatcctcctgcctcagcctcccaagtagctgggactacaggcgcccaccaccacgcctggctaaatttttttgtatttttattagagacagggtttcaccatgttagccaggatggtctcaatctcctgaccttgtgatccgcccgcctcggcctcccaaactgctgggattacaggcgtgagccaccgcgcccggccttaaaattttgtttaaagaattagcacgtcagaggacagacctagtcaacacctaatttaagtttcttttgatcagcctagacatggggtcatagtcgtagtccacaatttgtagaatctattctctaatcactgtactacactccttgatgcctcttaagaattttctcgatgagaggtatagatgtgtcctgtggcctcccaaaagttagtggattttctagctatcatgaggttgcagggccttttagctatggtattaatagctttagagtttgccagtcctctggttactctgagaaatgtgagttggaactagaaaataaatcctatattttacattttcatctgagattcatttaattcaaactccaaaccagtcgagttttgttctttggaaaatgctgagaacacttaactccctttcttcaagtattctctagaaatttgggctgcaaaaatgcttctacttcttatctttatcaatactctacctatttggtatgagataattttaggctataagacaagaaaggtactacatataagatatatggctagtcttttttttttttttttttttttcaatggatagggtttcactctattgcctgggctgaagtgcagtggcatgatcatagctcactgcagcctccaactcgtggactcaagggatcctctcaccccagcctcctggctagctgggacaataagcacgtaccaccatactcggctaaatttttttttcttttttattagtagtgacggggtctctctctgttgcccaggctagctgttcttcaaagatattaaagtacaactacaaagtacatgccaaaaaaaactcagctgcatttatacataggaaatgtaatgttttcaattagtacaaaagtataaagatctatagaaataattatcatggaataaagataatatatcagcattaacattaatggtcatgattctgtaatactattgtttgttcagagttaggcattttttacagattggaagatttcattggaaatggtaaagctaaaataacaagtctacagaaaaaggactacaaaaagtgcatgttaaaatcaagcagaggccaggtgctgtagcttacacctgtcatcccagcactttgagaggccaaggctggcaggcagatcatttgaagtcaggagttcgagaccagcctggccaacatggtgaaacgctgtctcaactaaaaatccaaaaattagccgggaatggtggcaggcacctgtagtctcagctactcgggaggctgaggcataagaattacttgaacccaggaggcggaggtcgcagtgagtcgagattgtaccactgcactccagcctgggcaacagagtgagactctgtctcaaaaaaaaacaaaaaaaaacaacacacacacaaatataaaatcaagcagaaagatactagcaggtttaggccaggcatagtagctcatacctataattccagcactttgggaggccaggtctggaggattgcttgagctcaggaattcaagactagcctgagcaacataaggagaccccatctctacaaaaattaccaaaaaaaattagccaggcatggtggcctgtgcctatggtctcacctactcaagaagctgagatagggtggatcacttgagcccaggaggtcgaggtgagccatgattgctccactgcaccccagcctaggcagcagagtgacagcctgtctcaaaaaataaatacataaataaataaaattaattaaaattataagggaaaatatattttaccacttattaagtggaaatagttcatcataaagatcttcatcctcatcatcttcacattgactgggtggaagaagaggaagttgtttttcttttttttttttttttttttttgagacagagtctctccctgtcgcccaggtgcaatggcgtgatctcagctcattgcaacctctgcctcccgggttcaaatgattctcctgcctcggcctcccgagtagctgggcctacaggcgcccgccatcatgcccagctaatttctgtatttttagtagacacagggtttcaccatgttggccaggctggtctctaactcctgacctcgtgatctgcctgcctcggccttccaaagtgttgggattacaggtgtgagccaccgcgcccggcctaagcattttcaaatatgactgatttatagaaaataagtgttttcgtagttttattactgatgagaaagaaaatagaggtgtttgttttattagtcttttcacggtaaatgtataacttaaaacattacgttttcatcaaaataaaagaaatctctaatatttagacactgtgcccctgcttttctcctcatttgagttttattcagttttctctttcagggtcaagttttatgcaattttctatttcagggtcatgggactggcttgctccagagctgccatattctttatattctttttttttttttttttttgagacagactctcactcattgcccaggttggcacaatctcagttcactacaacctctgcctcctgggttcaagcaattctcccacctcagcctcccgagtagctgggactactggcatgagccaccatgcctggctaaattttttgtacttttatagagacagggtttcgccatgttggccaggctggtcttgaactcctgatctcaagtgatccacctgcctcagcctcccaaagtactgggattataggcgtgagccactgcacccagcctgccctgcccttttatggtggtggtgatggtgttttttgttttacccagatttactggaactgagttatgggggtttgtttgtttgtttgtttgtttgtttgagatggcatctggctctgtcatgtcatctgcatgctggagtgcagtagcacgatctcagctcgctgcaacctccacctcctgggctcaaaccatcctcctacctcagcctcccaagtagctgggactataggcatataccaccacacctgcctggctaatttttgtatttttggtagagacgggtttttaccatgttgcccaggctggtctcaaactcctgggctcaagtaatccacccacctcagggtcccaaagtgctgggattataggtgtgagccaccactcctggtccatattttttttttaagccaaaaaaatattttctattcctcttttctctctcctcccttataatatcgtctctttttctttctgttattgagcatacatcaccaattactagttaaggatcaaatagcaatttcatgtgcctttctggtgatatctaaatgacattcaaaacctcttcttgtgattttgaaaacaaaataaataaatgcactttacaacattttttattccatcatacttttcagaagttttcatttatgtattgatatgttcatttttacattgaaggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcaggtatatgaattgcatttgattattattttgtgtaaatctagtatcactgaattttggaatcagagttacatgattgataggtcttaaaaggtctgcagtatggatacttattttatattatttaattctcctaataataagctaagacagctaagtaaaatgtaaataaccctgagttcaagagaccagagctaaactacatgttggatgcccgtggactagttgtggacttaatgtcttcaactttacagtgatgatacagctgcccagactccttagagacactaagaaaataaaagggttttcaacaaatgtaaaatgctatgcaggttaccaagatagtccccaattcccctctcaataaaatatgtattgctctgtgtcctgatttaacatgacctaaattgtagcaggagagagcttctaaataaagttccaagtgtgctgtccatcacctctcaacttcaggcttataaagtgatgccattttgtttctttttgttttttgcccctctttataaattcagagacagcagcctagccaacctgttcagtagcttctgtctggtctttccctgtttgtagacacttgtcacctagcaatagtatcttaaaagtttgtctataatggcataaactgaatgcatcagctgaacatgctttcctgtcctaatgaatatcccctctttccaccgaatcaagtgcaggcattgctaatggagactaaacaaagcaacagtttgaattgtggcacattctgcaaattacaaaatgaatggttttttttaaaagagttgagaaaaatgtgtggaatagtgctatatatataaattttctttgttagttttcataggaaaacttcttcatgagtggagatccagctttgttctattttgagaattaacaggcactatttataaaatatacatgcatgcacagtatgagtataaaaatgctatatgtcttttgagcagactcgaaggagggatgataaggaactggacactgccattagagaaaatgatgtaaagccagaccatgaaactcctgcaacagaaattgttcaactaaaagaaaccgaaccccaaaatgtggacttcagcaaagaggtagcgagattattttatgaaaggtattccaaaggaatagatttgtgaagattaaatcaagtggtaaggttgaaaataaagtgtgtttctttcagtcacagagtccatagagctaaatgaaaaaataagctttctggccgggcgcggtggctcacgtctgtaatcccagcactttgggaggctgaggcaggcgaatcacgaggtcaggagatcgagaccatcctggctaacacggtaaaaccccgtctctactaaaaatgcaaaaaaaaattagccgggcttggtggcaggctcctgtagtcccagctactggggaggctgaggcaggagaatggcgtgaatctgggaggcggagcttgcagtgagccgagatcgcgccactacactccagcctgggcgacagagggagggagactccatctcaaaaaaaaaaagaaaaaggaaaaattaagctttctttagtttgattgatgtattcagccacatcaagatatgcattaattgactgggcacggtggctggtgtgtgtaatcccagcactttgagaagctgaggcaggcggatcacttgagcccagaagtttgagaccagcctgggcaacatggtgaaaccctgccaatactgaatacaaaaattagccaggtgtggtggcatgcacctgtagtcccaactgctactggggaagctgaggtgggaggatcacctgagcccaagtcgcagtgagtagagatgggccacagagtgagatcctgtttcaaaaaaaaaaacaaaaaaaacgtggcgggcacagtggctcatgcctgtaatcccagcactttggaggccaaggcgagtggatcacttgaggcccggagttcgagatcagcctcgcaaacatagtgaaaccccatatctactaaaaaatacaagagttagccaggcacagtgacacatgcctgtaatcactacttgggaggctgaagcaggagaatcgcttgaacccgggagtcagaggttgcaatgagctgagatcgcgccacactaccctgcagcctggaggacagagtgagattccgtctcaaaaaaaagaaaaaagaaaaagaaaaaaagaaaaattaaaaaaaaatgcattaactgaaaatttaaaacataatcagtcacagctagattaaattatcattaatcccggttaaggaatcttatatcccaacagctaggtcttagcaatatgcaccatctcttttttttgagacagaatctgaccctgtcgcccaggctggagtacagtggcgtgatcttggctcactgcaacctctgcctcccaggttcaagtgattctcctgccttagcctcccaagtagctaggattacaggcatgtgccaccacgcccagctaattttttgtgttattagtagagacggagtttcaccatgttgaccaggctggtctcgaactcctgacctcgtgatctgcccgcctcagcctcccaaagtgctgggattacaggtgtgagccactgtgcccggcctgcatcatctctttagacaaataactttttgcatcctagtagtaaagaatgttaatattattaatatacttgaacctaaatttattatcagtaaatatttgatagagtgtgattgtttatttatttttttgtttgtttgtttgttttgagacggagtctcgctctgtcacccaggctggagtgcagtccgcgatctccgctcactgcatgctccacctgccaggttcacgccattctcctgcctcagcctcccgagtagctgggactacaggcgcccgccaccacaccccactaatttttttgtattttcagtagagacagtgtttcaccgtgttagccaggatggtctcaatctcctgacctcgtgatccgcccttctcggcctcccaaagtgctgggattacaggcgtgagccatcacgcccgaccgtgattgttcaataaactttattttggaattattttagatatgctaatctaatgtgataagaattctttgaaaagaaaatttttctttttattctacagttaaaaaaaactgaaaacatttcatatgaaatgctttttgaacctgagccaaatggagtaaattctgtggaaatgatggataaagaaagaaacaaagacaaaatgcctgaggatgttacattcaggtaatatttaagaaaagcaaaggaatcattcacaaaactgtgtaactgcttaaaaatggtgaacttcagagtcaaaagtactggatttcagccccagcttagctacctaggagctatagaatcttgagcaagttatataacctcttaaactacacattcctcacttgtaaaaatggcaatagggctggacgcactggtgcacatctataattccagcactttgaaaggccaaggcaggaggatcacctgagcccaggaattcaagaccagcctgggcaacataatgagacctcatctctgaaaaaaaaaattagccaggcatggtggcatgtgcctgtagtcctagtctgtactcggaggctgaggtgagaagatcacttgagcccaagagctcgaggctgcagtgacccatgattgtgccagtatactccagcctgggcaacagagtgagactctgtctcaaaaaaaaaaaaaaaaaaaaaaaaggcataataacagtatctatctgacaggtgtgttgtaaagattaatacgaaaacacatgtggccaggagcagtggcttatgcctgtaatcccagcactttgggaggccaacgggggcagatcactagaagtcaggagtttgagaccagcctggccaacatggtaaaaccctgtctctactaaaagtacaaaaattagccagacatggtggtgcatgtctgtggtcccagctacttgggaggctgaggcaggagaaatgcttgaacccaggaggcagaggttgcagtgagccaagatcacaccactacactccagcctgggcgtcagagtgagactccatctcaaaagaaaaggaaaaaaaaagaaaatacatgtacagcactttacactgtgcttagcacctaggaagtattcaataaatgataccttaccccaggtgcatgcctgtagttccagctactcaggaaactgaggtgggaggattgcttgaacatgggaggtcaaggctgcagtgagccatgatcacgttactacactccagcctcggcaacagagcaagaccctgtctcaaaaaaattttaaaaagagagataaataccttaaaaaaaaaaagtcaaaaggcatataagctgtagcagagtaagcaattcatcactgcctatgcagtcggccctccatattcatggatttatgcctttacagtcggccctccatatccatggattccgaacccatggatctggagggccaactgtactatgccatttgatataagggactggagcatctgcagattttgctatctgtgggggggccctgaaatcagtcttcccaggtaatgattgacattggtcaaaattctaagctgtctcataagagttccagaaattatggtgattttcttttttcttttagctatatttctttttttgttttttttttgttgttgtttttttgtttttgagacagagtctcgctctgttgccctggctggagtgcaatggcgcaatcttggtccactgcactcggttcccggagggaacctctgcctcctgggttcaagcaattctcctgcctcagcctcctgagtagctcagactacaggcgcgtgtcaccacgcatggctaatttttatttttttatttttttttttatttttagtagagacggggtttcaccgtgttagccaggatggtctcgatctcctgactcatgatcagcccgccttggcctcccaaagtgctggtattacaggcgtgagccatcgtgcctggccatttttagctatatttcttaactagccttctttttttttttttgagacagagtctcactctgtcacccaggctggagtgcagtagtgcaatctaggcacactgcaacctccacctcctgggttcaagcgattctcctgcctcagcctcccaagtagctgggattacaagcgtgtgccaccatgcccagctaatttttgtatttttagtagagacggggtttcgccatgttggccaggctggcctcaaattcctgacctcaggtgatccacccgcctcagcctcccaaagtgctgggattacagacataagccaccatacccagccttaactggccttaagagtatatcttcaatctttccctccattaaacatattaccggcactagaaaacagaaatgctgtggtttactgttattaggaatgccttgatttcttaaatgaatagcaagattgaatttgaaaagtatttggcaatgtctgctaagaaaaatatctctgctgaatttttgtattaagaagcatagattaaaacacagtatattaaaaattgatgagttcataatgatacaacaacaaaaaaattacttgttggccattttggaggatgctagagaatcaacttttaattccaaaacttggtacattaagggaaaggatcaagtatttatcatgtttttttcccaaattgtaaccaaatagtttgaggaaacttatttttagaagaatttcaagtgggagtcagagtatcattgttttgtggcagggtgcagtggctcgtgcctgaaatcccagcagtttgggaggctgaggtgggcagatcaattgaggtcaggagtttgaaactagcctggccaataatatggtgaaacactgtctctactaaaaatacaaaaattatccgggcatagtggtacattcctgtaatcccacctgcttgtgagactgaggcacaagaattgcttgagccagggaggcggaggtctcagtgagccgagatcccgccactgtactccagcctgggcgacagagtgagaatctgcctcaaaaaaaaaatatatatgtgtcattgctttgctagccctaatgccataatggatttgaacaatattcctcagtggctgccaaagctatcagctgaaaatctgacaaggatctttatatgaatgggtcaacccaataacccctgaactcactaatgtttgttttttttttgagacgggatctcactctgtcgcccaggctggcgtgcagtggcgcaatcttggctcactgcaacctctgccccgccgcccgattcaagcagttctcctgcctcagcctcccaagtagctgggtttataggcgcctgccactgtgcccggctaatttttgtattttagtagaaacagagtttcaccatcttggctaggctggtcttgaactcctgacctcatgatcctgccttggcctctcaaagtgctgtgattacaggcgtgagccaccgcgctcagccacactgatcatttttaacatcacaaaaagaaacaatctgttaatgcaatagttcatgacacccacctaatgaagtgctacttgcccctccaaaacctaaatttgaataagccttaaaatcatataactttggccaggcgcagtaggtcacgcctgtaatcccaccactttgggaggctgaggtgggcagatcaagaggtcaggagatcgagaccatcctggctaacacggtgaaaccccgtctctactaaaaatacaaaaagccggacgtggtggcaggcgcccgtagtccctgctactcgggaggctgaggcaggagaatggtgagaacctgggaggtgagcttgcagtgagcctagatcgcgccactgcactccagcctgggcgacagagtgagactccgtctcaaaaaaaaaaaaaaaaatcttataactttatagaaaatcctgagggatacaatcatcagaatccagaatgtgataaactatataggacagatagaccaagttcttttacatataaatggcaaagaataaaagggatctggggcagtttgttttggattaaagtagactttaaggaatttgtcaggcaatatatggaccttgtttggatcctgattctaattctaaaatgacattatgaggcaccaggaaaatttaagcactgactggatatttgatggcattaacatattaaaaatatgttctgaagtacttacaaattaaatatcatatgtagaatctgctttaaatggtttagggagcaaggattttagggcttagatgaagcaagattggcaaaccaagtaattattgaaatgaatatacaggtttattatttgctctaattcttttgtttgaaactttcaaaagaaagaaaagattaattgtaagaaaatgttcgttgttaaacataggtggtggcatcttttataacaaaaaaaagaaaaattaattgtattctatagtgacaaatttttaaataccaatctattttcatcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcaggtaggtagtatacacttcataattttctacctggtgcttcctctgaacttctaaatttattttccatggggagattctaagaagggaatcgcttaagtaccttgactacagatgagtcaacgtttgcctccccaagtgtaccttcaggaggatgcagcccctgccagagtctaccctggcagagggatcaacacattggctttggttttgctttttcctttcaattttaacacatagagtaaactttttctaataaaatcttttggccgggtgcggtggctcacacctgtaatccagcattttgggaggccgaggcaggtggaccacgaggtcaggggttcaagaccagcctggccaagatagtgaaaccccgtctctactaaaaatacaaaaaattagccgggcatggtggcagccacctccaatcccagctactcaggaggctgaggcagagaattgcttgaaccccagaggcggaggttgcagtgagccgagatcgtgccactgcactccagcctgggtgacagagcgagactccttctcagaaaagaaaagaaaatctttcagtacttggaaaatctatctgttctcagggctagattctcagagtattcacaagcctgccacattgggaactgtggaggatttaatatctaaactaatagaatgggtttgtttactccagcattgctataatccatacctggctgttccttcaattgtagaaaattattatccatggcattttaaaaaaaacaagttgttctgtgctctattctctcatattttttggactcttcacaaatcttttctttttttttcctggaggcagagtactccctctgttgccagcgctggagtgcagtggcgctatcttggctcactgcaacctctgcctccctagtagctgggactacaggtgtgtgccaccacacccggctaattttttgtatttgtagtacagatgggggttactatgttggccaggctggtctggaactcctgacctccagtgatcagcgcgcctcaacctcccaaagtgctgggattacaggcataagccaccatgcccggcccttttactctttttctttatgattttttgggaacagggatgggaattagtgcatattatcgctttgcttcttctttttttttttttttttttttttttgaagctctttcacccaggctggagtgatgtggcgtgatctcagctcactgcaatctccacctcccaggttcaagcgattctcctgcctcagcctcccaagtagctgggattataggtgcccaccaccacgcccagctaatttttgtatttttgtagaggcagggtctcgccatgttggccaggctggtcttgaactcctgacctcaggtgatccacccacctcagcttcccaaagtgctaggattacaggcgtgagccaccatgcccagccagctttgcttcttttttattttattttattttattttatttttgagatggagtcttgctctgttgcccaggctggagtgcagtggcgcgatctccactcactgcaagctccgcctcctgggttcatgccattcttctgcctcagcctcctgagtagctgggactgtaggtgtccgtcaccacgcctggctaattttttgtattttttttttttttagtagagatagggtttcactgttagccaggttggtctcaatctcctggcctcgtgatccgcccgcctcggcctcccaaagtgctgggattataggcatgagccactgcgcccggcccagctttgcttcttgtagtccataagtaaaaaaccattcctacaaaaccccgccaccactcctgcccttttgcagaagagtaagaaacaatgaaattcaagtattcaggaccattcttcttaggaaaagcatggggttctgggcagaacatcttccgtatcttatataaatataacgtgtatgttataaatttaaataaaataaactttatttaatttacttatttaaaataaattataaatttatattaccagtcatgttcccttgtaacaaatactaagcactgccttttcctttgcctctgtcacttacaaggcagtatgagctgggtgcagtggctcacgcctataatctcagcactttcggaagccaaggcaggagtattgcttgagctcaggagttcaagaccagcctaggcaatgtaacaagacaacgtttctactaaaaataatgcttttaaaaaattagccggatgggatggcactatagacccagcttctcaggaggctgaggtaggaggatcacctgagcccaggaggttgaggctacaatgagctgtgtgactgcattactgctttccagcctgagcaacagagcaagaccctgtctcaaaaaataaataaatagccaggcacagtggctcacgcctataatcccagcactttgggagactgaggcaggtggatcacctgaggtttggagttcgagaccagcctgaccaacatggagaaaccccgtctctactaaaaatacaaaattagccaggcatggtggccatgcctgtaatcccagctactcaggaggctgaggcaggagaatcgcttgaacttgggaggcagaggttgtgatgagccgagatcacgccactgcactccagcctgggcaacaaagagcgaaattctgtctctaaataaatgaataaggtagtgtgcacaggaggtctcacttgttaaaaaaaaaattgtcactggccagttttggttattatgcagcaggtctggatcaaagtgttatgatagtattaaaaccacaacatttaaatcatccatagtatttagctgcatagaactaaaaaaagttccaacagaaaattaacctcaaagcagaaaaaaaaaatgtaaagtattttttttgtttgtttgttttttgttgttgttgttgttgtttgagacaaagtcttgctctcttgcccaggctagagtacagtggtacaatctcagctcattgcagcctctggctcttgggttcaagcatttctcctaccccggcctcctaagtagctaggactacaggcacgagctaccatgtctgactaatttttgtatttttagtagagtcggggtttcaccatgttggcctggctggtctcgaactcctgacctcaaatgatccgcctgcctcggcctcccaaagtggtgggattacagacatgagccaccacgcccagccaaaaaaaaaaaaatttttaagtagttgtcaggaaatattttatactgaataattagattgcaaattagaaaataacaggctgggcacataatcccaacacttcgggagaccaagatgggaggattgcatgatgccaggagttcaagaccagcctggtcaacatggtgagaccccatctcaattaataaaaatttgtttttaattatttaaaaagaaaaaatcacaatagaaccaaatgtatctattacttccttctcaaaacatgttctaatttttgtgggattacagcatcaggatttacttctccaaatgtgtcttaaagatttttatcttctcccattttctttgtgtgttttagtgaaaagtctgtccccatctcctgagtcctcggcatcgccagttccatccactcagccgcagctcacagaaggatcacatttcatgtgtgtgtagtcttagaagaagtacgtcatttccctttgcatttgtgctttagttttttacttgaattttatgacttatctgttggtttagtgaatcaaaactgggattagttctggactgtacatagggatagttggcagaacaagtaggcatatcttggaaccagggttggtaacagattgctaacattggctcctctgatgatttgctgtgtgacagcattttctttgtctcttatttcatcatccagaaaaacaacaaaatttggagggtatggcctgtgccaagacttgcagtgttgtgcagctgtgcttctacttaatgttcctttccatagcgacctgagaattttgtttaagtcattacacgttgactatgtaatgctttttacagttagggtgacatgtctgcccactgggagtttgctaattattgtaaatgacaatgaaatgtttatggtacagccaacttgatggaatattaaaatctttaatgtctatctgatattatttctaagtaattgaattctattaagtcagggaggtaattactaaaaccatggatggtatcagggagaagaaggaatcctttcttgaacaatgttccttagagcacagatttataattgagaatagtttcctgaattcttacttttaaactttctagacaattgctaattttaacctagaatttagtacttatagcgtactctaaaagttttttaactttttataaaagctctggtgtagagtaagaatgttatgcctttttctgcattttctttctcacagcatctaccatatctagtaagtttggtgctttaggattaccaccattttctgctgaacagcagcagaaacatatagagacattataagcattagtactaacatctttttgtttttttattttcttgttttttttatgttatttcttttttcagagatgtcccccatgctggagtgtagtggcataatcacagctcactgcagccttgacctcctgggctcaagcagtcgtcctgcctcagcctcacaagtagctgggatcacaagtgcacgccaccacactcggctgatatttcgattttcttatagagacagtcttactaagttgtccacgctggtctcaaactcctgaattcaagctaccctcccactgcatgagccactgtgcctagcctctttgattttcacattctcaaaatatttcttttattttctctcctttttttttttttttcgaggcaaggtcttactctgtcacccaggctggagtgcagtggtgcaagatcatggctcaatggctcactgaaggctgacctcccaggctcaagcaatcctcccacctcagccccctgagtagctgggactacaggtgtatgccaccatgccaggctaattgttttgcagagatggagttttcaccatgttgcccaggctgatctcaagctcctgagctcaagtgatctgtccgcctcagcctcccaaagtgctgagattacaggtgtgagccaccacacccagccttttttcttccttttcaagcattttttaaatttcactagctttgggtacaagtggttttgggttacatggaagaattgtatagtggtgaagtctgagattttagtgcacccattacccgagtagtgtatgttgtacccaatccttcaccgaccttccaccctctcccttctgagtctccaaagtccattataccacactgtatgcctttgcatacccatagtgtagctccaacttataagtgagaacatatgatatttggttttcctttcctgagttactttacttagaataatggcctccagctccatccaagttgctgcaaaatacattattttgttcctttttattgctgagtagtattccatggtgtatataaaccacattttctttatccactccttggttggtggactcttaggttggttccatacccttggagttgcaaattgtgctgctataaacatgcatgtgcatgtatcttttttatgtaatgacttgttttcttttgggtcgatactcagtagtgggattgctggatcaaatgctggatctacttttagttctttaaggaatctccacactgttttccgtagtggttgtactagtttacattcccaccagcagtgtaaaagtgttttcttctcaccacatccataccaacatctgttgttttttgacttttaaattatggccattctttttttttgtttttgagatggagtctcgctctgtcagcaggctggagtgcagtggcgtgatcttggctcactgcaacctcctcctccagggttcaagtgattctcctgcctcagcctcccccgtagctgggactacaggcgtgtgccaccacacccagctaatttttgaatttttagtagagatggggtttcaccatgttggccagtatggtctcgatctcttgacctcatgatccgcccacctcggcctcccaaagtgctggcgtgacccactgcacccggccaattatggccattcttgcaggaataaggaggcatctcattgttgtgtaccttcttttgagaaatgcctattcgcgtcatttgcccactttttgatgggattatttgtttttgttttttttttcttgctgatttgttttgagttccttccagattctggatattagtcctttgttggatgcatagtttgcaaatatttcctcccatcctgttttctggaatctacttcctttcacaccttattgtaggaactataatctgtgccctttttttcagcccaaagtattttgttgtcttttcatatttgtaacttttatttgagattatgtctacctggaacctcaaagaggcttctgtttttgtcagttggtatctgtgcaggactgaagtgcttgctggagagttacaaataacctaactgtgatagtcttacctgtgttctgcctttgtcacttgtgtttaagccttttttcttttttcttttttcttttttttttttttgttgagaccaggtctcaccctgtcacccacactggagtgcaatggtgagatcttggagccttgccctcctgggcttaagtgatcctcccacgacagcctcccaagtagctgggaccacacgcctgtgccaccaagcctggctgatttttttgtattttttgtagagtaggggtttcaccgtgttgcccaggctggtctcaaactcctgagctcaagcgctctgcccgcctcaatctcccaaagtgctgagattacaagattgagccatcacgcctggctatgtttaaacttttaatttaatatgtttagaaatgactgttgaggccaggtgcggtaatgccagcactttgggaggccagggctggtggatcacttgaggtcgggagttcaggaccagcctggccaacatggtaaaaccccatctctacttaaaaatacaaaaattagctgggcatggtgtcaggcgcctgtaatcccagctacctgggaggctgagacaggagaatcgcttgaacctgggaggcagaggttgcagtgagccgagatcacaccatcgcactccggcctgggtgacagaacaagactttgtctcaaaaaaaaaaaaaaaaatctgggtgtggtggcccacacctgtaatcccagcactttgggaggccgaggcaggcagatcacctggctcctgaccagcgtgaccaacatggagaaacccagtctctactaaaattacaaaattagctgggcgtggtggcacatgcctgtaatcccagctacttgggaggctgaggcaggagaatcgcttgaacccagaggcagtggttgcagtgagccgaggtcgtgccattgcactccagcctgggcaacaagaacgaaactctgtctcaaaaaaaaaaaaaaatggtgactgttgctactggtgacgtaataacacaaaacataggaaaaataaacattggactcatttgatttcatctatgtaaagacttgatgacctcttagtagaaaaatgtatacattaagagccattcacataatattttgattcaataaacagattatgactgtacacatatccttccaataataaaggatattcagagttaaaactcaagtatatttccaggttccttaaattgttataggattttattttgttttcttcttattccaagagcagtggcatactgtaatgaggtatgattattgtcggatattttctagtctcatggtatgcaactaccacaaataactaaaggcatgaaaacttgtattatttcatatcttcctattatgcatatgccatctttctgaactagtggttttggcaggatttaggaaacctttacaaatgacactacgatgtaggcagctcaataattattacgtattttagtggagttatgcaaatgtttgctcattttgttgatcttttggattcagctacgtttggtactttttttttttttttgcagttgcaagatttaatagagtgaaaacagagctcccctaaaatgggaggggacccaaagggggttgccgttgccagcggtacattttttattctgtattgctatttataatcacattatgttggccgggcacagtggctcacggctgtaatcccaacactttgtgaggccgaggcgggcggaacacaaggtcaggagatcgagaccattgtggccaacatggttgaaactccgtctctactgaaaatacaaaaattagctgggcgtggtggcatgcacctgtagtctcagctactctagaggctgaggcaggaaaatcacttgaacccgggaggtggaggttgcagtgagccaagattgcgccactgcactccagcctgggcgacagagcgagactcagtctcaaaaataataagaaggccaggtgcagtggctcacacctggaatcctagcactttgggaggccgaggcgggcggattgcctgagttcaggagtttgagaccagcctgggcaacacggtgaaaccccgtctctactaaaatacaaaaaattagctggatgtggtgatgtgcacctgtagtcccagctactcaggaggctgaggcaggagaattgttggaacccaggaggcagaggttgcagtgaactgagatcgtgccactgcactccaccctgggcaacagagcaagactccgtctccaaaatgatgataataataataataatgaagagaaggaggaggaggaggaaggaagaagaattgcattacattatgtttccttgtggggccgggtatagtggctcatgcctgtaatcctagcactttgggaggccaaggcagtcagatcagttgaggccaggggttcgagaccagcctggccaacatggtgaaaccccgtctctactaaaaatacaaaaattagccaggcatggtgatatgtgcctgtaatcccagctagttgggagactgaggcaggagaatcgcttgaacccaggacgcagaggttgcagagagccgggatcataccactgcaccccagcctaggcgatagtgataccctgtctcaaaaaaaaaaaattgcattatgtttctttgctttgtgaattaagctatggaaatgaagaaaaatatcctttgatgtattgtattttaggattttcatggccatgcttgtcagttctgttgttacagaatgtcacccttagttactttgggaaatggtaattaattaacgttgcaggtgtcaaagtaatttcctctctcttatttttcagctatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttctt

SEQ ID NO: 38636 - DNA, 33495 bp, Homo sapiens
atgaggggagtcgagactcccgcgccccaccacccccggcggagctgctgctgagccactcaatctgagccctggctactaataaagttcgtttaaaaatcataatcattcttaagagagcgaaagagggtgcgaactagccgctcggccccgcagggagagctggcgcgtcgggaggagacagcggcggcagcggttgcgccgcgaccaggaggagccggtggcgccgggcggcgggtccgcggccggtgggggacggtgagtagcggctcgcgctgcggtgcagcggcgctgcactcactcgccctctccaggggctgggggttcgtccggctccactggggaagactcagcttctccccggggtcccgggttgtgccttactctccggagtgggcaggggtatcgagggcaggggcctcccggcccggctcccccatcccccggttcggaccgccgagcgccggctctcccctccctgagcaccgatcccaagttccagctagagaaggtgggcggcagcgccagcccggcgccccctcccagctcccagcggtgggtacctggaattgcctggtgggcgggaaagaggggtggagcgagggcggcgctgcgtccccagtctggccgaacgttcggctttttgcctgccccaagtcccgactggggaaggggcgacccgggctgggccagacaccagtaagggcgtgaagtgctcaggttaggtttgatggcgaagagagtcctcagctccaccctggcatttagactcctccctgcagtgcgaccactctttacccgcgaccccacccttccctagtttcttgttcatagagtgctggaatatgaatgagccaaattgtgctgttccattgacactggttgctacagaattaactttactcggagatccgaggagccatcggcagttcccaggagtaagaacctgagagcgtgtgagagtaagaacttcattatcaggagctagtgaagtggcagtagggtctgaaaagggctgttaacttctctaggtttttatgtatctcctaacatctaggtaatttcattgaccctaagaagtttttcagtatttttacaaatataacctgtacttctacttaaataaaggctgttatgagaaaacaaccttttgattagtgagttaactcaccctttgcttctctaatttattagaccgcattagcaaaatgttaaaagttttggggaaagggtatttatataaagtattattgtcgaggtttttaattgtactcagaagtatgcttatttctaggaacgtaattgttttgatctagtgctttaagtctatagtttctgaaaagcaagagtccgactgcctgttaaaatttaatttggcttttttctttaaatttattttaaggaaattaatttattattttaaaaagtgtatggtaaaattgattttttttcgatgtacagttctgcgaattttagactcatgtaaccaccactacagtaaggatgtagaacaaatctatcgctcccccgccacagaaaaaaaacctaatgtgatcccattatatcatactccttacccctggcaattactaatcttttctagaaatgaaatcataacagttagtaatctttcgatgttagctttttttcactcagcataatgcctttaagatttctccaagttgtttcatgtatggataatttctttttttattgctgagtactattttattatgtggatatgccacagtctgtttcaacatctgcccatggaaggacattgaggttgttttcagttttctgtgattatgaatcaatctgctataaataccatgtacaggtttttgcatggacatgttttcatttctctagggtattgctaggagtggattgcagggtcatatggtaaatgtatgtttaacttttaaaaaactgttaaactgttttctggagtatctgtgtcattttgcattcccacaagcaacatgtgagagttctagttgctccacatactcccagcatttgatagtgtcagtttttttaaatttagccattctaataggtgtgtagtggtatctccttgtggttttaatgtgcctttaactaatggctaaagatgtacatgttttcatgtgttcatttgccacatggagtcgttggtgaggtatctggcaaagtctcttgcccatttttaaattgggctgttttcttatgttgagttttgaaggctctttatatgttttggatacaaattatatgttagatacgtgtttttcaggtattttcttccagtctgtctttctcttcattctaacagtgtctttcagacagcaatgtttttaattttggtgaagtccagtatcagtttttccttttatgggtcatctggtgtcatgtctaaaaactctgcctaacaggtcaagattttctccttctaaaaattgttttataaaagtgttccatttagatctgtgatccatttgagttaattgtataaggtgtgaaggtttacttttttgcatatggatgtccagttgttccgtcactatttgttgaaaagactgtcttctctccattgaattgcttttgcacctttgttaaaaatcaattgtctttatttgtgagggtctattttgggcctgttttgttccactgatttacttagctttccctttgccagtattacactttgttaatttagcattataatgtcttaaaaccaggtagtataatttcctccagttttattctttttcaaaattgttttagctattctgattcttttacctttgtgtataaagtttagaatcagcttgtggatacagaaaaatttggctggtgctttgattgaaattgtattacacccgtagatcaatttagggagaattgctgtttactttgttgagtctcccaatctatgaacatgatatgtctttccatttatttaggtctttgatttgtttagtgttttgtagttttcagcatacagattgtgtacatgttttgttacatttatacctaagtatttaatgtttttggagctattgtaaatctcattctaaaaaatactggtttcaaattgtacattgtttgtacacagaaatacaattgaattttgtgtgttgtacatatgtcctctgactttgctaaactcattagttcagggtttggtttttgaatttttggtggattccatgggtttttctacagagataatcatgtcatttgtgaatagagaaagttttaattttttcctaatctgtgttttatttttgtttcctattacaatgactagaacttcatgtatgatgaataggagtagtgagaatatatatccttaccttgttcccaatgtgaggggaaagcagtctgtcttccagaattgttttatgttatagatgcttttttttccttttttttttttttggagacagaatctcactctgtcacccaggctggagtgcagtggcacacgatctcagctcactgcaacctctgcctcccgggttcaagcaattcttgtgcctctgtctcctgagtagctgggattacaggcgagcaaccccacacccagttaattttttgtatttttggtagagacacagtttcaccatgttgtccaggctggtctcgaactcctgacctcagtgatcagcctgacttggcctcccaaagtgctaggattacagatgtgtgccactgtgctcggcctatagatgccttttaccaggttgaagaagtcccattctatttctagtttgctcagagttttctcacaaatgttgaattttgtcaatatttcttctgcatcaattgatactatgttgtgtttttttccttgagtttattaatatggtggattacattgattgttttttgagtatttaactagccttgcattcccagaataaagtccacttggttgcagtgtattgtgttttaaatattgctgaattcaatttattaatactttgttgaagatttttacatctttgttcagaagagtttgtctaattttcttttttgtagtgtctttttgtggtatcaagataatgctggcttcataaaaagagttgggaagtgtttcctcgtctctattctggaggagattgtgtacattggtgttaattttttaaatgtttagtaggattcttcagtgaaactgcctgatcctgtagatttctttctgagtttttacattacaaattcaatttccttcatagttataggggtattcaaatggacctatattatattgggtgaattatggtcgtttatacttttcaaaaatttggttcattttgtctgggttgtcacatttatgtgtgtagggttgttacgttatccttttgagtctgcagagtctatgttgctatcccctattttattcccggtattaggtatttgtatcctctctcttttttgtgttagtctcactaaagttttattaaatttattgatcttctcaaaaagccagctttttgtttcatcagtttttctgtttgcaatttcattgatttctgttcttcttttttagtatcttcctttttttttgcttgctttgggtttattttgctcttcttctagttcttgaggtgagtgcttagattattgagttgaaacttttttccttttcaaagtaagcatttagcgctctaaattttcgtatcttaggctgggcacggtggctcacgcctgtagtcccagcactttgggaggccacggcgggcggatcacttgagccaggagttagagaactgcctggccaacatggtgaagtcctgtctctactaaaaatacaaaaattagcccagcatggtgatgcatgcgtgtagtcccacctactcgggaggctgaggcaggattgtttgaacatgggagggggaggttgcggtgagccgagatcaggccactgcactccagcctggactactgagtgagactttgtctcaaaaataataacaataaaataaaatatattttcccatttcagcactaatttagctgtgccccacaaagtttcacatgtattttcactttcagttaattttgtttttttttttttttgctttccttgtaactactactttgaatcctggattatttgaaaagtgtgtgcttttagtttctgtctggagatttccctgttttatctttctgttattgatttctagtttgattccattgtgatcagtgaacatattctgtatgatttccattattttaagtgtgtttgagacaggaggtcagtagatctggttccacaagatacaggtcttaaaagatccccactgacaaaacaggatgcagtaaagaagctggccaaaaccaagatggtcatgcaagtgacctctggttgtcctcactgctcattatatgctaattataatacattagcatactaaaggttactgccatcagcaccgtgacaatttataaatgccgcggcaacgtctggaagttaccttatatcatctgaaacagggaggaaccctcagttctgggaattcccccatccctttcccagaaaagtcaagaataatccaccccttgtatagcatataataaaaaaaaaaccataaaaataaccaaccaccagccctcagggccgctctgtctatggagcagccactcttttattcctttactttcttaataaacttgctttcatgtcactctgtcggctcacccttgaattccttctgcacaaagccaaaaacccacgtggcctcctgggctgaactccagttttggggtttgccctgtgacatgttgatgtttgttttatggcccagaatatgttctatctgggtacttgaaaggaggtatattgtgctgttgtatagacagttctataaatatcaattaaattctgattttattgtgtttttagaattccattttgatttatctgtgtgtttttgagagtacctgcttgtattattgttttagtggttgttcttggtattacattatatatatagtcatgcattgcttaatgatggggatgcacattatggttttgtcattgtgtgaacatactaaaatgtacttacacagacctagatggtatagcctactacacatctaggctgtatgctattagagcttattgctcctaagccacaaacctgtacgctgttactgtattgaatactgtaggtacttgtaacacattggtaaatatttgtgtatctaaacatatttaaacacagaaaaggcatagtaaacatatggcattgtaattttaaaggaccactgttatatatgcaatccatcattgaccgaaatgttgttatgtggtgcatgactgtatatgtgatttatccccataatttatcactgcagtcaatattttacaaattcaagtgaagtgtggaacccgtacctccctttatagtcctttatccttccccatttataattgtcttaaatatttttcctacatatattgaacaccacattggacagttttataatttttttttcaactatcaaacatagtttagaacactcaagagaagggaagtctgttgtatttaacaatatttttgctcttaccatgttctttcttttgttctgacactccaagttcttcttttaaaaaattatttcttttccactgagaacttccattagctgttcttttgcattggtctgctgtcaacaaatgctcttagttttccctcatcagagattaccttgatttccttttcattcctagaggatatttttgttggatatataattttgagttgacagttcttttctttcaacactcaaaaaatgatgtgccacttccttctggcctccatggtttctgaggagaaattcactgtcgttcaaattacttttccccatcctttttctctggctgctttcaaaatgttttgtctttagttttcagaagtttgactttgatttgtttaggtctagattttgactggtttatcctgtttgggatttactcagcttcttgaatctgtagctttgtctttttccatatttgggaaattttcagtcattatttcttcaagtccttttttagctctatcttctttctcctctcctcctggaactccaatgacagaaatatctgatttttttgtggtttagttccacaggtcttgaaggctctgtcctttatttcagcctgtttgcgtggctcagattgtatgttcaagttcactaattctttcctccgtcctctctattctgccgttgaacatatcatttagttttttaaattatggttattataattttcagttctactttccatttggtacttctttatatcttctgtttatttttgagactctttattttttacattcgtttaagtatatccataattgctcattgactgccagttaactttttatttttgaaatccttattacatgaatctaatgtctgtcatctcattgctagtgtctattgattgtcttttgcatttaagattttcctggttcttggtgtgctgagtgattttcgatgaaatcaggacactgggagtgttatgttgtgattctctggtctcattacattctcttttagcttgattctcttcctttgatgtgctccaaaaacaggaagggtggggcactacctctttactaccaggtgaggataaaaactccaggtttcctgcttgtcttccattgaaacagagtgggctgggcgcagtggctcgtgcctgtaatctcagcactttgggaggccaaggcaggtggatcacttgagcccaggagtttgagaccagcctggccaaaatggcaaaaccctgtctctacaaaaaaatgcaaaaactagccaggcgtggtggtgtgcgcctgtagtcccagctgaggtgggatgattgcttgagcccaggaagttgaggctgcagtgagctgtgttcaccccactgcactccagcctggaatgtagaatgagacactgtctaaaaaaaaagaaagaaactgagaatgggaagagctcctcttactactggtcatgatgactctctactgggggccactgataccaccctggctgggaagaggctgacccactgacactgcaaagagtcagtagatggccttattacctgtgagagatagtgtaagtcctgactttctagtaggcttcatctgacaccaccccagcaaaaaagtagaggtgaaaaggggtagggatgactgaattggtggatggggtgggagttcaggctcccacatggtctctagggatgccttggtggtggttgggcaggggtggggggtgccttcatttctccccagtgaggatgcaagtcctccccagtcctccccagttggtcttttctgacaccaccccatagagggagttggggtgcatcaatatagccctcacaagggtataggtgttttctatctttctgcttgctaggctgcccctttcctggtcctttgactcaagagagtaggcttttatgtttttttgttgttggtggtgatatttcctggttactagcttctctataatccagtctgggatatatgaggtaaaaagaactcaaggaaaactcattaccatgttgtgctttgtgtcctgtggtacctttgcacttttcaatgtctaatgtttgtttatatatagtatccaaaatttttagttatacttagaggaaggaatagggaaaaatgtgtatcatttcagaagcaaaagtgtctgaagtatatatctttaaaaggataaaatgtgataagatttttgttgttgcctttttttgaacataacagtcttcttgggtgaagaattgtttaggtagagaaaggaagttgctttctaggaactgaaccagtgtgagatacagctggatgaacaagggtcagatcctggtcagaattttatatttgaccgtgtgtcctaaagactacatcttgtgtagggtaataggatgatgatacttgatgtccagattgtaccctagaccaggggtccccaactcccaggccgtggactggtaccgttctgtggcctgttaggaactgggccacacagcaggaggtgagtggctgcgagcattaccgcctgagctccgcctcctgtcaaatcagcagcagcattagattctcataggagcccaaactctattgagaactgcacatgtgagggatctaggttgcagcactccttatatccttatgagaatctaactaatgcctgatgatttgaggtagaacagttttatccccaaaccgtccctccactgccccccaccaacctcccatctgtggatgttgtcttccaccaaagcaagtccctggtgccaaaatggttgggaaccactgccctagaccatctgatcgtatactcagagggcaagatgcaggcatcaggcatcaggttttttgtttgtttgtttgttttttagacagggcctcgctctgtcacccaagctgaagtgcactggtacagtcatggctcactgcggccttgaactcctgggctcaaacaatcctgccttagcttcccgagtagctgggactacaggctcacgccaccatgcctggccaatttttttttttttttttttggtagagacagggactcacatggtgcccaggctggtcttgaacccctggcctcaagcaatcctcctgcctcagcctcccaaagcactgggattataggtgtgagccactgcccccagccaagtattttttaaagttatctagatgatcccagtgtatagccaaaattgagaatcactagcataggatattggctttgacacttacctgattgtaaaatcacttgggatgtatatccatttgagttctccaggaagtaagtatcaagatggaactaaaagtgcaagagatttattggggaaaatgcctgagaaggataaagaggctgcaatgctagttttttatacttgtgaaaggataaagaaagatggggtggaaagagctccagactgcagtgcatttctgaaaaaatctcagctagtctgatggggagccccagaccaaagaggatccatgttgtgcataattgtcccaactcaagtggcactgcctgtttagtctttacccggggagaatgcggcctcaacaggagtggacagtgcagtggatcctgaaggtgaggtagcagagactgccaggtagcagctcatgaagggagagctaaacagcaccttttatgcttgttttataaaccagattccaaggcttcctgtgaaatttctgataaattatgcctgaggcagagacccagaactgtactttaacaagtacttttaggtgattcttatgatcactcaggtttgtaaagtaccagagacaattgctgagactattagggacaaagaaaggaatgttcacattttggactcccttggtgtagtggttgtatagatggattttcagttaaagtagttgaaatataatagctaaaggagcagtagcctaactagtaattttaagaagaaacatgaagaaattgactttctgttcttttcattcttaaaatgcaaagtgcccattctattgctttcactgtatgtgtaactataaaggtttaaaactaaagcaagaatgtgtggtgtaagatatttatttgtacaggattcattgtaaaccaaacactaaatcattataactaagagtccaatgctgacacatggtcgtacactattatacaaaaccttctttggggtgcttttttagggacattattacctgtgaggttgaaaagcaatttctacagattttgaatttgttgcctatttggtgatacactatggaggatttacaatttttttttattttattttaattttttttagagacagcatcttgttctatcacctaggctggagtacagtggcgtgaccatagctcactgcagcttcagacccttgggctcaagggatcctcccacctcagcctcttgtgtagctgggacgacaggcatgcaccactacactcggctaatttattttattttattttttttagtggcaactgggtctctatatgttgcccaggctagtctcaaactcctggcttcaagcgatcctcttgcctcagcctcccaaaatgctgggattataggcatgagccaccacacctgccctatttgcatgtacataatgagatgtcttggggacaggacccgagtctaaacaggaaattcatttatgtctcatacatgccttatacacatagcctcaaagtaattttatacagtacttttagtatttttgtgcatgaaacaaagttttgactgctttgactgtgacctatcacatgtcaggtatggaatttttcccttatggcatcatgtcagtgcttaaaacatttcagattttgccacatttcagacttcagatttttggatcaggaatgcttaactaaattctgaatgcataactttcactatgctaagtgctttatgtgtatcattgatcaataaccgtatgagatggatattattgccaggaaacagaagcctgaagaagttaagcaacgtgttcactaagagcacagaactagtaagtggcacctttaaataatcaggcatcaaatctaatgatcctagtcatcatctctatgaaagtagatctaggtatttattgatatatgaatgtcatgcattgcgctattgatgaggattcattcaaaaatgaattgttattgctgtacctttcaaagagtttacattatctaaagagagtgggagggacctcagttatgaaaacacatccttgcaatgcaatgtgataatttcttgataaaacaattagtttattttgtacatttttgtgttatgaaaaaataatttcattttaaaccacagatttgagagggaagatctgatctcctagaattagagttggtacagaaaccatttcagctccaaaaatgttggaggaagatatggaagtcgccataaagatggtggttgtagggaatggagcagttggaaaatcaagtatgattcagcgatattgcaaaggcatttttacaaaagactacaagaaaaccattggagttgattttttggagcgacaaattcagtaagtacttggccattttattcctttggctttgatttgtgaactatatccaagactcattggagtaatagttaactgattgcagtggatttcgaggtgtggcaactagtggcaatgctcatgcgacagtgatggtggttttcatgacatatgtaactttatccttttttttttctttcatctcttcccttctttcatttttttttctttttctactctccacgtttttttctgtctcatagctgttttatatttattggtgacaccttgggcacgtcttaaacacaaactgatgctgactccagtgagatttccaactgctattttctttggaatgaaagttatattatgggctcgtttttattagaatgtctgttctctttttgaaactaggcaagactgtatggaagttagagaattaatagtttgctttactctaaagaaataagataaaacagatttgggaggacaaaatttgcctatgaaaaggaaatcctgctttaggaaattcatttggattctaaagcacatcagagtaatattttttgtcattagtcctgagaacttctaagtatattttaaattgtagcagacaaactaaaatgtgttacccaaatacattttagtttgtatttcaaattgtaatttaaaatattacaaacctggttactggcccaactttaacatcaaagataattttatcattttaaagattaatttctagtctgtattctattactttctttttaaaagtatttccatatttgcttcctctcttagaacatattttaagagcaagcatgttaagtcttgatgatgtttgctttttatacttattacctgaaaccaaataaatatttcagtatgcagtcaatccttattgtttataggttctgcatatgcaaattcacccacttggtaatatttatttgtaaccccagaatcagtatttgtagtacatttgtggtcatttgtggacatatatagagcagcaaaaaatttaagttgcccatcatgcacttcccagctgaggtcatcaaacaagtctgctttcttgtttcagtacctcatacagtaaacacatgtcctttttgtgttctgtttaatgccacattttttacattttgtgctttttcttggtgattttgctgtttaagaaggctcctaagtgtagtgctgcagtgctgtctagcattcctaagtataggaaggctatgatgtgccttacagaaaaaataaatatgttagataagctttgttcaggcacgagttatagtgctgttggtcgtgaattcagtgttaatgaattaacaatatatatcaatcagtaaggtgtctttaaacagaaacacataaaacaaggttatgtactgatcagttgatgaaaatgtaaccaggggttctcaaaaacctaaccctatgtttcccttaggagcagtggttcagtatttgctaattcagtgttcacattgacattatagaacgtaactactgtgaataatgagaattgactatatgacaaaatagagtaaattttaagtttaagggcaaccagtgagccagggaggtaaatcgctttttttttttttttttttttttgagacagagtctcactctgtctcccaggctggactgcagtggtgctccacctcccaggctcaagcgattctcccatctcagcctcctgggtagctgggactacaggcatgcaccaccacacacagctaatttttctatttttggtagagacagggtttcgccatgttggccaggctggtactgaactcctggcctcaagtgatccgcccactttggcctcacagattgctgggattacaggcgtgagccaccgtgactggcggtaaattgcttttttgcattcttatcctcattttatcacaaaagcaccagaacccattagaaagatgtcgggaaaggagaacaggcactgacctaaggaaattccccttcccaaaacgttaatcttagaccaccactacgctgtgactgtgtcaaagaaaaaaacatggcagataaatccaaatcatgtgggaagctgtagctttaggggaatgtttttcactctttcactgttgataatgatatcaacatccgaaagtactcagtttttcagggtgaaactgacagtgtacatgtggtctctgactcaggaaggtttgacttacagtttttcaactttagcatgggttttttgagacatagccccatcgtaagttgaggagcataaggatttataatagttcagcttatgagttttttgaatttacagtggtttaatggggtgttaaatgcatttttgactcctaattttcagcttacaatgggcttaccaggatgtaacccccagtaggtttattgggacaacccatcataagtcaaggagcatttgtagttttaatatctttggatttgaaaatgaaaaatatacacaaagctatattaccaaaaacattttcctttacatatgaaataaattcatctcttgttttagagttaatgatgaagatgtcagactaatgttatgggacactgcaggtcaggaggaatttgatgcaattacaaaggcctactatcgaggtaaaacacaggatttatttatttattttgtttgggcatattattttggctaaataaataattttgctttctttgtttcccgtataagggcttctcttgaagaatagttaaaataatttcaaagtattttttaaaaccccagttcattattcttctaaagatcttgtatagtagcaaataatacctggtactgtagacagtttgtctctgccttagaattatatgactcatgtaggcattcccagaccaaatcattaagaaactcttaagtgcctactttgaccccaagaaaatgactgtatagtcagagagtggaagctaacatacgaaaaagtaaagccctggcaaataagatggcatttgttacgacacatgaagtcacatggtaaagccttttcactgctgtaggagttcagagaagtatgagatacctgtgaaaggaaggaaccatgactaaagaatttaaagctctaaaatgtgggctaaaatttcttaaaaggctaaattaaacttccaaatggaacttaaaagtttcctttaacattttcttataaaattttgcccttttcttttggaatttaaaacaccattttcagtgttcctgtaactcaactgccaatagtgattaaagtgagagaacacagtaacaaaagcttggtggaataccatgtggcattatagcctgttgatgccaagtaaatattaattgatcattcatattgacaggtatttaatactctgcatttcgcagatgctgtgggaaataaaaaggcacaactgatatactgattatcccttctatgatgtccctcttttctgaacttttcaccgtgttgtaattaaaacttgttttctaaagacacaacttcctctgctgccttctctaagggaggctttttacccatatccctgcatactcacattcctcaagacttaaaggctgttcggcagaggttgtcttgtttctcactgctgcttccacaccattcctcctcttttctccttccaaaacctcggcaccttgaaagtccaggtcatgagacttttacccaccactaatccccctgcttgctctggtccatcaacttcctttatgcctcctttctgataacagtggcatctgactcagtttcttctccataattgtttggattactttttgaaaattcagcctgttgctcatttccttgttgttttcaaggccaacaattgtttcattaccccaaaatctaaacctctatagtctcctactccctgaccactactggtggcttgtggcttgctaactttaatatccagacgctgtcttgaaaccatcgagagcttctctgttcattgaccctaccactttttaaatatgaccttccacatggctttacttctttccttcttcagcttagtttttctagtcctgtaagcatttgcttgcaaggacctttaactcccagacctgcgctctctgcataatacttgctcagcaaaatgcccaacccagttaaacccgactatctaccaatctgcatccgagcacctgaaccatatagagaatatcagacaaccattcagactgaactttgaagctaacatcacataaccttaatgagtacatagtgctgccaggcactctcagtgttttttactcaagtctctgtcattttccaaaagagctcttttgtgttttctcttgccttaactttgggaatcccttcctcctctccactctgctgatttctttgcttcactcttctttgagaaaatagtcagtgaaaaccattttatccttcccactaccaaatcactttcgtggttaaaactcttcagcatcatatacacaggactttacaactgtgtttcccctcgtctgtccagcatcatctgctgattcctcacttgtacttcacccttgagaaatcccccatttttttcttttctttttacactatgcctggaatgctttcttgtctctcttgaccttttgccttcaggtttaacatctcagaagtctctgtgaaactttctgtggccctcatccctgaacagttaataattttttttagctaattcagtatgtttattgcatttatcactctatgtagcatttgcatatttattttccctaagagattatgagttactttagcttctggcttatggagtggcagggttttttgtctttgtctccccagccccattgcgtagcacctgttggctcaagtgaattcagttgaccttaggagacagtatcattttggttaatttttttataaagtgaaattctgctcgttcatcacacagtctcattttacttatcagatgctataactttatactctgaccttaagtaatggatgaaattttatttttatatatatatacacacacacatacatacacacacacatatatacacacacttaatatatgtgtatgtatgtaatatgtatatatgtaattaatatagtgtgtatatatgtgtgtatataaagtatatatgtatagatgtgtatatatacacacagtgtatatatatttataaatgcaaatatatgtatatgtatatatacacatatttataaacagatgtatatatacacatatacatatatgtatgtatctatgtaaacatgtctgtacatatgtacacatatgtatgtgtatgtgtatatacacatatatctatatttataaatataaatgatttcacttaaaggtatttgctctctgaactagaagccccaggaaagtaggatctaccttgtttatagttgcccccatgactgtttctctagatttgaagttttattcagaaaatgtgtattaagtgtctctgttgttctagggatataataggcatagtaaaccttgccctggcttctttgtcttaacttgtatttatattcatgtaataacattgcttagaaatatatctgaaaagtttcctttaagctaattatcttttttacttcttaaatcttttgttttctgcttttaaatctactctttggtatcataaaaattaaaatatattctatcttagtatgtagaatgctagtagttgaatactaaacagtcccaaacaacagatgatatggaagcagttatgaattattttttcaaagtctctttaaacatcctgtattgaaagatacaggtttaatgaaactgaaataatagttatgtatacaatggaaattcttctgacttcttcatggaagtcttctttaatgtgtcactttacccaatttgaaagggaacctatgtttgtgtgtcctggattatcagagaagcagtacttgaaaatagaatagatatattgaatagcagtataccagtatgtgtctcttgaagaaatctatatatatgaaagttccaagtgacagtgttaatgaacttttaggtacagtatcatataaacacataatttcttcttttagacaggatttaccactgattttattgaagtagcttgcttatttacaaacttacaccagttatataaaatcgatatacttgagaaattgggtgaattcatgtaacttttgaatatatagcttatttttttcgcttttgaaaatgtaggatttattgtaataatgacaactaaggtttcatgattgtactaacatacaaatgaccaaagaagttgcctttctaaattggtaccaaggaaacttgacttccactgcctgctctaaaacatattttggtttcttgccaccactacttaccactctatttactgtgtactttaaggcttcccgtccacagtagctttggttattctctgtggctaccagtttggatcctgagcacctgtatcatggtctaaggttgagaattatgtttttactaccccaagccgttcttggagtagatggtattttttttctacccctctgtcattcaagtagatgatatttgtatcaaattatgaatttcatcagccttgacagtattgattaacaggtcctaaatgtacagttttattcttgagtaaaagttatttgtattttttaatggggttattaccactaccttccccacacactcaggaaaaaaataaacataaaacctatgtggaaacaccagaaagaagtaggattacttgagattttcattattttatttttatctagtgaacttggtcttctaaattctctgcatgaaatgtctgttcttttttttgaggaaacagataggctggcctaatcctttctaagcttttgacagtttgatgtggcagttattactttttaaccaatagggttatttttagagaatatatttgacattatgtttctataatttaaaaaggcaaaactggttgggcacagtggctcacgcctgtaatcccagcactttgggaggctgcggccggcaggtcacctgaggtcaggagttcgagaccagcctggccaatatggtgaaaccacgtctctactaaaaatacaaaaattagccaggtgtggtggcgcacacctgtaatctcagtactggggaggctgaggcatgagaatagcttgaacccaggaggcagaggctgcagtgagccgagatcatgccactgtactccagcctgggtgacagagcaagactctgtctcaaaaaaaaaaaaaaaaaaaaaaaacagcctatcttagtaatttaactttttagctgactgtattaaaatggcaaagagggtgagatactgagataggtcctcagtttcagcgtcttctttttctaaatggtaaaagtaaacatttatcacaatacaatatgaattaaagaaaaaacagcaattatacataaaattgaaaaacagtatattgaacattattttatgttttccctttgggaaacctctttggggttccattagaatgcttttggttgctgccaaataaaaggaatttcgtactgtcttaaaactacagagacttactgatttgatagaaaagtctggaaatagcatcccttttagttgtttgttcagcctataaccttactgattctcctggctttgtctcttccctgtgtggtaccggtacctcctcatgttgatttccttttgggttgcaagattatcaccaggagcaatgacagccacatgctttgtttacatccttggggagagagggttacttcccacagcagtggttcagatgtcctgagcttttctctgattagaccacccttgacctgattgcaataatgagaggaatgtgattaattgacttggatcacattgtgctccttgccaccaccacaactcccacctccagcagagaataggtttagtctacctaaaccatatggctactatacagtgggggaaaggtgtttttagggagagatgccacctaggcaatcagacaatatctgctgctagtacagatttagatagtgatgaaattaaatagaaataaaagtaagaagagaaggtaagggctagaaagaatgaattaagatacaaatgtagtggtagaaacactatgccatatatagttatgacttgctgatttaaatcctagaaatgtgttattaatgatgcataaaaatcaacaaattaaaattttaaaaagaacaattttattataattcatttaaaagacccattatatcaaagccattgctcaaaggtattattatggacttggaatgctggcttaattgtatagtgagagatgttgaaacaagaccttcttgtaaataggttacaacagagcacagattaggaagcctctgggatcccaagtgatttctctaaagctttttagaaagttgactccaggcagtaggaaccagtgattttagttagtacagaaagatacagacgacatgaaatagatttttgttacagttttttactgtgactttggtttgtaggagaggaaaaatatctttttccttctactctttttggtccttgattgggtctctaacaaaagacagattaacaagagaaaaacttatgaatttatttaatataagttttatgtgacaaagaaaccttcataaggaaatgaaaacccaaataaacagttaaacctgaacgtttttataccaggtttgaggaagagtgcaaagttgttgaagaatgtgataggacaaatatgagctaagagcagtaaactggaggaaacttagcaagattcatcagcagaggttcattcagattccttttggtatccttctctcttcagaaatgaggattctcctttcctctgggtatatggaggtcacctctcacctgaggggcttatgacctccttcaggtgagggtcagaaaatccttcctttgggaggccaagatgggcggatcacctgaggtcaggagttcaagaccagcctggccaacatggcaaaaccccatctctgctaaaagtatagaaaaattagttgggcatggtggtgggcgcctgtaatctcagctactcaggctgaggcaggagaattgcttgaatccgggaggcagaggctgccgtgagccaagatcatgccactgcactccagcctgggcgacagagcaagactccatctcaaaaaaaaaaaaaaagagagagagaaaatccttcctgaattttaggatctgcttcagaggagaaggggctaggggagatcaaagtgactctcctgcttctgctgttttctcagattccttcagcttaaaatattcagtacgtcaaggtgccatattttagtttagcatgtccagagccccattactggtatctcttagatgtggttcatctctgcccctatgaaattcatgtgcattctttgccctgccattgggagaggcacagttccttcccaatatagctctctgctttttgtctgctggttttgatttttcactctcactctcacccattgcatttttctcaggcttgaatcaaggcatcactagtccctaatgtccgccagttgctggaaatacgtaacagcttcctaaattggtcttgtcagcatccattctttaaggtttgagatgaagcaggtggtgatagcaccctcatccatcctactgcacctttttgcaggagaaagggtttggagtacagtacttcctctaaaaaaattcttttttttttttttttttttttgagacagagtctcactctgtcacccaagctggagtgcgatggcatggtctcagctcattgcaacctcctcctccagggttcaagtgattctcctgcctcagcctcccaagtagctgggactacaggtgcccaccaccacacccagctaatttttgtatttttagtagagacaaggtttcactatgttggccaggcttgttttgaactcctgacctcgtgatccgcccacctcagcctcccaaagtgctgggattacaggcatgagccaccgcacccggccaagacattctttacagatccttttcctttccaacccccatctcatattaaaaaaaaaaaaaaaaattcttgaagtgcttgagggagttcagagttgtgcagcaggatcagccatttgctttctaaattctgcaaataatgatctgtctcataaatcttggaatcttgtatttgttacatgctttattggtacctcagtcaaagtttttttttaaaaaagggtggagggtaaggggtcatcttttgagctttttaaactaaatattagaaagggctttccggtcattaggatttttccaaacataaaagaaccatgatgaatcacagtttgacaaagtattttatctgtctagatggaagatgatattcagttaggggaaatggaaacaagtggttgtccaacatttgtcagaattattataaccataaaagtaatccataaaaagtaatccagttgattttttttccattttagtaatatttttaggttaaatcagacaaggtggtgcagcatttgatataaaggcttggtatcaggtgaaccgtcctgctttggagatttgtgtaccattctttctatagattgtaatttatcttcttaggacttatttttgcgatcttatttcagattttttatttcctgcagttcttgttttttcattttgttctttatactgcagaaatccatttttctcctgtggtttaatagtcatacattctcttattcttaaggtgattgcctttaacttaaggcatttactgtcttagtttaagcctctgtgtgccttcccactgcgccacatgggtggggctcgtttatttgggacatgatcccaggaagtagagtgaaagactagggagaatgaggcaaggaagggagaaaaaccagtaaagcgttctaagtatcactgtgggccactggggctcagtctccctgaggaaccatgaagagaggcctcaggagcccaccaaagggaggctgaggtgttcattccacccccccgccacccagaggcatcacttcccccttgggggatgcatcagaacagcccccagcagaacagcagagccccctgcagcataggcaggagcaactggcacaggaactgttctccacagctgcgctgaagcccggttgaggggacatgcatgcagccacaggcctctgctgcagggtttgtttatttacctccctgattatgtaaacatcttccctttcttcacacaagcactttggcacattcccacatttctctggtctgtacccattctgtcccctgctaaataatcttggggttgttatggacatactttcttttggtctttgattttttaaataatgttgagcttttcttaatcattcttactgcccgtatctctggcattatctgtttggggttttttttccatcatatatgcttcctctaagaggtttttttggttaagtgtctgagaccttgaacacttggaaataccctattgtgccctcaaatttaaatgacagctggacataaagctgtaggcttaaaggtaattcattgagttttatgataaagaacaaattttttttttttttttagacagagtctcacccttttgcccatgctggagtgcggtggcacaatcacagctcactgcagcctcaaccttccaggctcaagcaatcctcccacctcagtcacctgagtagctgggactacaggtgtgtgccaccacgcctggctgatttttgtattttttgtagagatggggttttgccatgttgcccaggctggtcttgcagtggcgcgatctcggctcactgcaagctccacctcccgggttcatgccattctcctgcctcagcctcccaagtagctgggactacaggcacccgccaccacacccagctaattttttgtatttttagtagagacggggtttcaccgtgttagccaggatggtctcgatctcctgacctcatgatccacagtttcttaaaatatgattacataattttttttatttgtagttgaggtaaatattacagctcaagtaaatataagtttatttatcggtatactaatgtgatctcttcagttttattttcccttaaattctgagaaggtctcagggtgtctttgtctctctctttctgtattttgcattattcatttattatttggattaaaacctgtttttaggccaggcacagtcactcacacctgtaatcccagcactttgggaggctgaggcaggcagattgctggagcccaggagtttgagaccagcctgggcaacattgggagacccatctctacaaaacaaacaaacaaaaacaaaacaaaacaaaacaaaaaaacaaagaattagctgtgcatgatggcaggctcctcctgtaagtcccagttactcaggaggctgaggtgggaggattgattgagtccaggaggtcgaggctgcagcgagccatgatcatgccactgcactccagtttgggcaacagagtgagaccttgtctcaagaaaaccagaaaacaaaaaacctgtttttagggtagggaagattttccaaatgaaccttctgtttttacagtaatagcaaactgctgttttctttctgtggtcttttgctttctacagtattcccccagtgatatatagatatacagactagttttggctctagagtgtcttagatagcccagacatatcttgagtcttagtagaaaactcttataccagagggatgtgtaaggaaggagtaatggtaagaaaacatgccttgatttcaggaaatcctcttgacccccaggatgattttctcttgttgcttacatgcctgcttttatcaccatgctacctgaatcaatagctaataatttataaaactgcttcttctaagaggtttctgcttattttagtctttgatattatcagcctaaaatgacagttgatggttaaaatattgtcaatggatacaatatgggtgggtaaaattatgcagttaaacagggtaaaactaagtttcccccaacccctctattatatatatatatactcttggcattggctttcaaattatgttccttaggatcactggtattctactgaaataaaataatacaatttatttaaaaagtgaatagaatgaacaaattatgatttttttctcataaatttttcttaaatctgcgctgaaagaaattaagcaaatgacatttttcttaaatctacgctgaaagaaattaagaagcaaattaacaagaagaatttggcaacagcctgtaattttagtttaccattctctctagcttttataatggaattaaatcagtattttatggtattccaaaaagaatgtgtatgcttttgaggtactttgacagttgaacacatttgagaaccactgtttttggtaaaaatgaaaatagaatttatatgttgaaaagtaaagaagagtagtgcaaagatgaattcaacataaatagagtttatatgttgaaaagtaaagaagagtagtacaaagatgagttcaacatttatttacataaaagttgttttgaatggataaaagttgcccccattcttcatgagattgttttcttaatgtaaatgtaatatgttaatgtaaataccttgattgattgattgattgattgtgaacttacaggagcccaggcttgtgtgctcgtgttctctaccacagatagggaatcttttgaagcagtttccagttggagagagaaagtagtagccgaagtgggagatataccaactgtacttgtgcaaaacaagattgatcttctggatgattcttgtataaagaagtaagatggctacttttggggaaggagggacagtaattctataaagttaagacatcttaatttttgcatagttttacaggttctaggaaaaattctatactttcattttgaaggctttaatgacttaaatattttaatttacctaaaatttctgtgagctattctatgtgattggtttgggttaaaaaattcattgattcctaagtagataaaattaaaggattaaaatttgaaggctcttttagaattctaatctcaggtctttgcacaagaaatctaattcttcatgttaagtcaaaccttaatatggtaagaatgttaagaaaagcatccctagattttgtaatacccagaataagtaactatcctatgttgatgaattttaattaagggttcagattcatattgttttgtatattcagaactcttatgctcaaatttgtgaacagataatttctgttcataaatatttacttattgtattattatttttgccagttttgaaaatatttgcttggtttttacctgttttttaagtcttcttatgttagttatctgttgctatgtaacaaattagcccaaaacttagtgtcttaaaacaacaaacatctattatatcacagtttctgtagatcaggagtttgagaatggcttagctggtggtttttcatgaagctgcagttgagatgttggctaggcctgttctcacggaaaggctacactggtgctggaccatccatttctatgatggcttattcacttggcaggaagccttagttccttgtcagatgggcctctcctattctcacaacacggcagctatttctcccagagtgggtgatccaagaaagagcaagacagaagccacagtgtttcttatgacccagtcttatactgtcccttgtattgcatattagtggacacccagaccaaccttgattacagtgtgggaggagactacacaaggggctgaagaccagaagccagagaaatagcgggagcctatggggcatggttacaacagtctctaatgacattaatatcaggagtccacaaccaggaatcctgataaaactaaaattaggagtacaatttggagatgtagtcattaatatactgactttggctttaggcagcaaaattgtttcatggccagtaagaataaaataagtaattcactgtaagattttcagagtgtaattaactacaggtgttctcaggaagagataaaattaattaaaatattatacaaagaaaagtgatattttcttagtttagggctagagattaatgactttatagaaaagtcttctatgtacacatacggtataacagttggtgtttatttctcaagagtagtgaaaactaaaatcagtacaggcactaaatgaaaacatagctttcaactgattttacttaactgggaaattatatcaagctcttttaaaaagaaatatgaaaattttctgaaagatctgatccaccttccctcccttccctgccaaactgtattcagtaaatgtaattaaaagtgatttaaaaaacaagctatcagaaggcacctttgtaaagcatttttttttaaattgatgtgcagtgaggaagctgaggcactggcaaaaaggttaaagttaagattctacagaacatcagtgaaagaagatctaaatgtgaatgaaggtaaattacctttaaaggatatagattgcaaaaagaaattttattcttgcgcttttaaaattgtgttgtttagaaattatatttataacgagaacaagatttttttgtcacctaacattaagtagaatttaaaggctttctacttctttttgttagtgcttaattatttactaatgcccttgaatacttttcatcctcgtaaggttttccatttttattattatctttgaaaaatgtaagctatatatgtagagtatatgcatatgtggttttgatgcatacctgttaaaaataactcagttgttttagaactccatgatagtagatattccactaggtagttagtttatttaatagtatttaatttaatactttaatttaatagtatttcctagtttaagaaagtgaaattagaaaaagatggtaagttatttttctcattctggaattgccacttatttagattgcaactagatattctcttggatgtctattttggatacttttcttcacataaaggagacatcttttcaagagtgagtctgtttagtgttgcttagtattaatcactattcagatacttagaagagccaatcattacaagtattatttcacttatttactaataaaataccattatacatttgttaatattatcattgtactcagatactgcccaaataatttttaaaagttgaatttttaactagattgtatgctcctaattgtaactttaaatttgtttagtaagtataaatattacaaatgatgtgaaataacagatttacatgcataaatcattgacctggttctgggtgttttctttttattctagtttttaagtatttggctgaaaaataccttcagaaactcaaacaacaaatagctgaggatccagaactaacgcattcaagtagtaacaagattggtaagtacataggaaattttagcccatgtttacttggtaaagttaaaaaacacatataatatgctcatttctttcagaaatgtgatttaaaagtgattattaaactattaagtcagtgatttaagtatcaggtctcttgttaaaaggtatattgtgttaatgggggtttttttgccattgaattttataaatccatttgatagattaaacacaacagagataaagactttttgtaaagatctgtcctttatataaaggaactttataacagttattcttctgaatctgtacttacactggctcttaccttttccctttcttactatcttgcttattacccattactgattttgctttttcttatgttaaatgccagcaaaactttagcattctctgaagaacaagtgtgttgtgttctctttcacaataactgcctgaccagatgtctctcttcttgttctggattccaggaaaatgagagccaaagttgctggttctaaatcttgatacttgtataatctcttaaggacttcatatctgtattctgtcccccttcactacatatgtagaaacaaacacattattttctggacctgttttaacttagatttttcctggattctggcttttttttttttctgcctttgccattttcattgcaaaatttcttgccatcagagacctcaaatgctttgtgaacacaagacacttataataagcctctacctggtgtgatctccttggctccccttttgtcttcttcatatctactgattaaagctttaataagactcattgtggaacaaagtaaatgcagattctcttcaatccaacatttaaaggtggttttgcccttccttctgtgtagcctcctgccacaccattacatctatgtaacccatttactggttctctcagaggtcttgatctttcctgagtatgccccatgcttgctttcttcttcacttttggtcattttttttcttctattgagaatgacctctttcccatcttctgtcgaagaacaattcattcctcaaggcctttctagaaagttttcagttgtgtatctgcctgcctgaagacacatcctccatactctttttctttcttttttaaagaaacagagtctcactgtgttgtccaggctggtcttgaactcctgggctcaagtgatcctcctgtctcggcttcccaaagggttgggattataggtgtgagccactgcccagcctccatcttctaaaagaatagacatctaagcccagggcactgccaagtgtccagttctaccttcttcatgtagtttttcctttcttatgtatcagatgcaatctgtccttcctttgaaacttctgtaagattttgtgtctcttttatgacacttaacatataatgtcatatggcattacttgtttactgtcttgtcttattacattgtaaacttcttgtgggcgagaactggtcttagtcacctttgtatccctgacagtatctctggcccagaattttgtgtgtcatggatgctatatcataaattggagattacattttgtgaatagcacagttcaaaatggaaactataaagttctttatcttttagctactcatcacttttatctgtgggccacttttttactggtttagtataagtaggaaaaacgtatcttactagtattaacacagaatctcacaaatagctgggtgtggttgcttgtgcctataatcccagctatttgggaggttgaagcaggaggattgcttgaggccgacagtttgagaccaacttagacaacatagcaatatcctgtctcttaaaaaaaaaaagaaaaattagctgatggcattcctgtgcctgtagtcccagttactcaggaggctgaggcaggactgctggagcccaggagttaaaggctgcaatgagctatgattgcaccactgcactccagcctggtgacagagcaagaccctatctcttaaaacacacacacacacacaactcagaaatactgttgttactgttgttaactaaaaggtattcttgaggaagtgatatgatgtgaagttagtaagttattaaaattatcgtagttgccaggtgtggtggctcatgcctgtaatcctagcacacctctaatcccaggcaggtggattgcctgagcttaggactttgagaccagcctgggtaacacggtgaaagcccgtctctactaaaatatgaaaaattagccgggcgtggcggcaggcggctgtagtcccagctactcgggaggctgaggcaggagaatcaattgactccaagaggcggaagttgcggtgagccaaaatcacacaactgcactccagcctggcgacagagcgagactccgtcttcaaaaaataaataaataaaaattatcgtatttgctgattccaaacgtcaaagataaattgttaagtcaaaagatgcagaacattgtgtagaatatgccacaacttaggtagaaaagagaatatatatgcattttagcttatatatgcataaactatatctggaaggataagtaggaaaagtaataacatgcgtaccttaggggtgggaaaactggcaaggggtgaaaatctgggtaaaaaagagccctaatgtgacctcttttacagccttggaactttgtaccatgcgtattagctactaaaagtaaaactaaaacaagagctttaaaatcataaatctgtgtccattgatgtatgaaaggataagcaaaatgtggtatatacatacaatggaatattattcacccttaaaaaggaaggaaatgcttcagtgttctacgttggatgaaccttgaagacattatgctaaatgaaataagtcagtcccaaaaagacactattattccatttatataaggtagagtagttaaaatcataagagacagaagatagaatggtggttgctaaggtctgcagggagggggaatggggagttagttactgtttaatgggtatgagtttcagttttaaagatgaaaagagttatggagatggacgggggtgattgttccacaacattacaaatgtatttaataccactgaaccgtatgcctaaaaatggttaagatgctaaattttgttggattttactacaattttagagaaactgtaaatacttgaaaatattactgattttactaacaagctggatgcaacaggtaactcaggcgtgtcagtggcaatcactcttttccctcaatttatacaggtgtctttaatacatctggtggaagtcactccggtcagaattcaggtaccctcaatggtggagatgtcatcaatcttagacccaacaaacaaaggaccaagaaaaacagaaatccttttagcagctgtagcataccctaagatgttttgggaggaaaacaattgaattacattgtgcaatgcattaagaaacccatccagctgtcatggtatgttacaaggttttcagcagactttgctcctaatggctctctgaaagtgacagacttaaatattgctctgcagtgcttttcagaatgtagagtgagacctctggtggaaaaattattgccctgtggactcctttaattttttttacattagacgaagcttctcctgtttgtaaaggaatgctataagaaatttcaaacacaggttttgcggaattttaaatgctggaaaacataaatgaaatgcctaaatatattgttacagattttaatactgtggatcaaggaaagatagcaagcattcttttcctgaaattggtcatgtagcttttctgcgaaatagtattgaatctgaatactttcacaaaataatactgaaaggtaaaccctaaatcttgccagactgcattagtattttggcattgaaacttgtgcaatatctgtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaactctagacatatattttgcaaaatgagcttgggtttaaaaagtgctttgtgccaaaaatatcatacctaatttttatagtgctttactatcagaatttatattgtttattatatcttttaaaagcagtaagcagttttcatctgacagcgtagataaaagaggagtataggaatttgaatgctagagcatctcccaggtgagccttattgcagatctttttgatatagtcacccataagcatggtgagctcctgctctcataaggtcagccaaagccccttaagaaggtacacagcacatctgcagtcattcaggaggtcctgtgaagtgtggtgatgcatctaacaccttttgctgctcactgagaacccagctttgaacttacaagattacactaaccatttttaaagtgcacaaaaatattattattagtcttaactaaaattacatattttataatgccctgcaactctaaaccatccttttgtttacacatttttgtatggtattttaagattatcaatcacttcaacatttctataaccttgtttgtatagcactttctcaagagctgtcagtcccacatacagaatcatttcttttacaaaatgatttaatatgtaatcatgtgtcaggacataaattttgtcacttgggacagtagctttccagctaagataattgcgtgaactctgttaaaactgattatcactcatcaatggctttatttttaacctataaataacccctttcaatatacctggtttttacagcattgcaaaatctgtaaaaataacttttattggaaaatgtcatgaagtcatttttcattatttgtactaaacaatgttttatgtactccttttgtgttttatcttttgtttttccatctgtactcccctcatcctcctaatgttgagaaaatcaaatttcctgggtgtgtccttgttaagtgatcaaaagtaaatgttctctttgccattttagatggaaaaataaaaaaaattaaaaagt

SEQ ID NO: 38637 - DNA, 8859 bp, Homo sapiens
ggagcagagtcgactgggagcgaccgagcgggccgccgccgccgccatgaaccccgaatagtgagtgagccccgcccgcgccgtccagcgcagcctcgatcccgaatacagggctgtacgcttaccggggttgtctggcccgggtcaggactgtgcggcgcccccacatccgggtccctcttccgctgacccccccccacatccgggttctgcccctccccccaggggccccaggaccccggctcaaaaccccgagccctcgcacccggggcccagacgtggcgacccccaggggcagctcttggagctcgagacatcggtcctaccaggccttatcggtcagatgaccccgcagtcccggtcacttcaggcctcagtttccccacctgctgcttgacaactgtcccggagttttggagcccgtcttgatagtttctggtctcgggttcaggcttgggccctttaggtcgggcagtgaatccctctacccttctctttctcctgaagcccggctcctggggccggcccagaagctagccaactacgcgggaggccccgaagcgccgcttgggtcgcgtctcccgcaggtcctctcttccggggctgcctcctaccctttgcctgggtcgcgctgtcctgtcgctcccgccggtccgtcctttcccgccctctcctcgcttttgctcaggcccccaacgccaccgtcacaccccttcccttggctgtcacactgcctgtgaagtttagatgaatatggaatttgctctcccccttcctgtgggattctctggtcctcaaactctcctcactcttggtcactccccctgcgggtaggtggcccacatctcatgcccaggactaatagttttccccaagtatcagttatcttcttccttttctgccacttcctttttctactccacatccaggtctcagatttccttggggaagggtgaagctctgagctggattgggaggggaacagagaagggaaccagcaggctctcgaagggactttggagtctgagaaacctggtttgagtcttaaagcgataaactgtgtaagttagggcaagtcacttcccttctctggcctctggtttcctcattagttgacaatgacaaaactgacttcattgaactgttgtgaagattaaatgagatgatgcatttaaagtacttcacacagggtccgtccacaggttggaactcaagtatattaaatgtgattaccttttgcctttttttttttttattttgagacagggtctctctctgtcacccaggctggagtgcagtggcgtgacgatggctcactgcagtctccaactcttgggctgaagcagtcctcctgccttgtcctcctgagtagctgggaatacagaggcacaccaccacacctggcacattttttaattttttgtaaagacagggtctcgatatgtttcccagcctgatctcaaactcctgggcttaaatgattctcgtgcctcgggcttccaaagtgttgggattacaggtgtcagtcactgcacccagccttaagtgcaattttcactgcaacttgaccacctcttcctggtgacttcataacaggtttttgttgttgttgttgttgttgttgttgttgttgttgttgttgttgtctccaaagagatggggttagccgggtgcggtggctcaggcctgtaatcccaggactttgggaggccgaggtgggtggatcacgaggtcaggagatcgagaccatcctggccaacatggtgaaatcccgtctctactaaaaatacaaaaattagctagtcatggtggcgcatgcctgtaatcccagccactctggagggtgagacaggagaatcacttgaaccagggagtcggacgttgcagtgagccgagatcgtgccactgcactccagcctggtgagagagcgagactctgtctcgaaaaaacaaaagaaaagagagacggggttgtgctgcatcacccaggctggtcatacactcctaggctccaaggatcctcctcctgtttcagcctccccagtagctggaaccacaggcacacgccacagcacccagccatcagtctctctacgtgggttttcaacttaataggttctaggctgggccctggcttctacttctggggccttctctgccaagctaggcacacgcagggcatgtactggggattccctaaatagctcctactggaccaaaccatgaagtttcagaaatcaggttaggatacccagctctgttgccttggcaggtcacgtgtcttgatttctttctccataaagtgagaatttagactcagcaagctgagagccctttgggctagctgtttgtggagggaggcatcagccctccctgaccgggactgttgggaagatctggtgagcaccatagtattctaaaccaagggatggccaggcgcagtggctcacccctgtaatcccagcactttcagaggccaaggcaggtgaatcaattgaacccgggagtttgagaccagcctgggcaacatagtgagaccccatctctacaaaaaatgaaaagattagccaggggccgggtgtggtggctcacacctgtaatcccagcactttgggaggccaaggcaggtggatcacctgaggtcaggagttcgagaccagcctggccaacatggtgaaaccctgtctctactaaaaatacaaaacttagacaagcatggtggcaggtgcctgtaatcccagctactcgggaggccgaggcaggagaattgcttgaacccggcagacagaggttgcagtgagccaagatcgcgccattgcactccagcctgggcaacaagagcaaaactcagtctcaaaaaaaaaaaaaaaaaaaaaaaaaattagctagaagtggtggtggtggtggacacctgaagtcccagctacgcaggaagctgaggtgggaagatcactttgagcccgcaaggtagaggctgcaatgagccgtgatcacttcagtgcactgtagcctgggtgacagagtgagaccttattgctaaaaaaaaaataaaaataaaccaagggatgcctcatggggtgggggaatcctgtaattgtgactccaggatgatggtaggtgggctccctgcctcccttcacgccttcccatcttctctctccagtgactacctgtttaagctgcttttgattggcgactcaggcgtgggcaagtcatgcctgctcctgcggtttgctgtgagtaagaagcctcccataccatccacctggggtcctgactggcagctggggggagaagggacaacacagagcacagtagttgcaagatctgggaaccaggggtgaagctgtaagacctgccaccagcacatctgccctgaacaagacagggctggccagctgagtgctgggaattggggcttggtggttcggagacccagctggggcagggaactggagggaggctctccaagtgggcctcacctcattaactcccatgatttcattggcccctgaactttcaggatgacacgtacacagagagctacatcagcaccatcggggtggacttcaagatccgaaccatcgagctggatggcaaaactatcaaacttcagatcgtgagtgtcgctcttcccaaaatccccagtacagaggtatccaccttgggagggaagggactctgggactctggacctcagctgacctgctcctctgcctactgtctcctagtgggacacagcgggccaggaacggttccggaccatcacttccagctactaccggggggctcatggcatcatcgtggtgtatgacgtcactgaccaggtactcctggactagccatcctcagcttggcctccttagccttaggtctttgactcttctttttcctccttccatcctctctttcctgatgcttcctggaaaggacactatttgtctgcttacaggaactaactaggaaaaagaaaaaaaataggtgactgtacttggactcatttcacaaggagggaaacagccacagaaatggatcctctgaaggccctgctgcaggttctggcaggacaaggcctcacaccttccctccccaccaagccaaacttgccaccttattgtagaccttctgggcacctttgtgttgtgggagtttagtcaggcggttggctgctatgctgggcctgtggcttcctgtgtgaagacacagtgcagggggacaattagagggccttagacaaagaagcagggaagcttgagctctgggcccaatgtgagcagagatccagaagctctgcctccagcagcagcgttagtcccatgtgactagcagtggtggtagcaagggctggaaatggttccatgaaaccttatagtttacagaacctggcccagccctcagattgcctctgatgctcagaagaggtctgtgttcccatcgcacaggtaaggagctgggctcaggatggtgaggtgacttgccgagggtccttcagctagtccggtggcagaggcagaaagcctggatggctcattccacctgctttgttttttctaccaaatgttgttgcttaacagggccaatccctgaagataaggagaagcttaaatcagccgtgggccgggaagagtccctgtctgaggagcagccgggctctttagctcaccagggactcatgatgtccccagctctggacgagctgtggggaagctacataccacccagacaagttaccagggcccacctgactgccatatatccagtgatcttatttcagcacattgacctctcgtggctttggacactgctctcttctctctccttgaaaagtggaccatcccccgctcctcagtctcctgcagcactcgattctctattgtcagtgtctatttgctggtctgtccagtgctgcctcccatcaccctgtgtttggtgcttccccactgccctggactctcctccttactcttgtgcatggctgcggccactctgtggtttgcttctgccttgtgttctgtgattcctgcatctaacagccgtggctgtggcttccctcctctgtccatgtctacactggcactttgtgtctgtattaatcctgatcttcatgatcttctctagtaaactaaatggtgaggtttgtgttttctagatgaggaaacttgcttggagaggtgttaagtaacttgccaccggtctcacgggaagggcaaagccagttttggagggctcttggcttttgagcacaccctttcccaccctcaagcagcctctgcagaactcagatgtccagcgctggcctcactgtctctccccaaaccagcgcctctatccccatttttaatatttttatttattttaagacatggggtctcactctgtcacccagactgcagtgcagtggtgtgatcatagctcattgtaacctcaacctcctgggcttaagggatcctcctgcttcagtctcctaagtcactgggactatagacacacaccaccatgccccagctgcatccccatctttgtgacacaatccttgtcagcctgaccagaaaactcttccctcccccatccagtcagtctcgagtcccctctattctctccccatcatctttctgaaatctgtcccctcataataatagcagtgatgaggataatagcagctcttgccaattaagcacttgttatgagacaagcctgtgttcattctcttcatgctcacaatcagcccttctaggaggtactgtttatagaaatgaggaaactgaggctcagagtggtcaggtaacatacctggggtcacacagtaaatggctgagccaggccttcagcagcagtggtctgactaaatcctgtgtgcttccctggctcagtgcacgttctcttccctgagttattccagccattcccagttggtctctatcttgctattctgatctgggctctgcctcctgtcaggactagcataggtgtgatcctgttgcttctggcctaagaaacgcccactggctcctggtctaagtccaagacttagccatgctaagacagtctgtgctctggcctctccccaatcccccctctttcctcccctcttccccctctcccctcttgcctttctcctccccactcccccattccccctccctgtcccccctccctgttgagtgtctgcatcccagcaacattccatttcctcccattccccagacacaccatgcccctcccgttcagtgacctggcacatgctggctccccagctggcacctctcctgcacaaggccagttcccacctgcaggcttaggtccactgttgctcccacctcaagcagaggtggtctgggggctccccagcccctgccttctaacctgttttgcccttgtgtgtggcctggtctattcatctactgtcccgtgaatgtgttagggcagggcccaagtatgatttccccctttgtccccagcacttagcacaggacccaacttggaacatggcaagaggtctaagtttgagccagtgtgatatgaccaggcttctggctcctaaggagtataagtggccctagcttgagcactttcctgaaagtcctgtcctttgtgtgtggggtaggggcgcaagtgctgggagagtctgaagccaagtaatgaggctgttggtgccaaaagtaggatgaattttaggctgttcccaggattcctgtctccccacaggccagggccacctctgagaggaccctcgaactcctgtgctccaaggcttcaaaccttaaagggattttcaggccacggtgggaactgtggctcttgcggacccgttactctctgttcctatctcccgtccgctctctctttgcttctcacatgtggttagggcctgcaagtgtctcagggagagagacagctgcagggagcagagctggcaggcccaagttggggcagctgttgaggtgttggggcagctggcaggctgctggggctgttctgggtctcggatggaagagggcagggaggaaggttcagcctggagcagagggcttcctctgcatctctgcatcgctgagcccaggacttaaggggcccggagctgtactgttcccctcagagaaggtcttctccaggcctggggtaggggtgacagttgggagcaaaataactttggcccctggccccctttaggaatcctacgccaacgtgaagcagtggctgcaggagattgaccgctatgccagcgagaacgtcaataagctcctggtgggcaacaagagcgacctcaccaccaagaaggtggtggacaacaccacagccaaggtagcagacgggccggtctgcccggggtcggggcgctggggcctgctgcccctcacctgctctcccctcctcttctctcccctcctcttctctcctctcccttgtcaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaa

SEQ ID NO: 38638 - DNA, 15603 bp, Homo sapiens
attcacggcacccctgatagcgaggtcggcgtcacggtgtaggcgcgcagttggggaaaccgaggcccaacgtgggcggcagctaccagagatggcacacggaggactcaaattcgtccattcagtcattcgttcattcattccttcgggaaaccttgcagatctcccaatctgggcaactctgagctgggcgccagtagtctgggggtgctgacgggaggaggggccagagttttcaaagacgattaaccgaggctcacgtcgcggaggaatttaaagcgcgagatggacgggaggggcgggctcaggcagttataatccaactccataaaggttctggggaggcagtatatggaactgcaaagagcatttacacctttttttttttttttttttttgagacagagcttcattctgtcgcccagggtgccaggctggagtgcagtgtcgcgatctcggcttactgcaacctccgcctcccgggttcagcgattctcctgccccagcctcccgagtagctgagtagctgggattacaggcatgcaccaccacgcctggctaattttttgtatttttagtagagacggggtttcgccatgttgcccaggctgatcttgaactcctcagctcaggtgatcccctcgcctcggcctcccaaagtgctgggattacaggcgtgagccaccacgcctggccccagcctttatttattttttttattttttaattttttttttcagacagggtctcgctctgtcaccctggctggaaggcatggcgcgctctccgcccaccaaaacctccgcttcccgggttcaagcagccctcccacctcagtctcccgagtagctgaaactacaggcacaagccaccaggcctggctaatttgtttattttttgtagagctgttgcccagggtggtctcctgggctcaagcaatccgccctcctcggcctcccagagtgcctaggattacaggggttagccacctcgcctggccatacagccttttttatttttattttattttttatatattttttgagatggagtctggctctgtcgcctaggctggagtgcagtggcgcgatctcggctcactgcaacctccacctcccgggttcaagagattctcctgccttggcctccccagtaactgggactacaggtgtgtgccactacacccagctaaatttttgtatttttagtagagacaaggtttagccaggctggtctcaaacccctgacctcaagtgatccacccgcctcagcctcccaaaatactgggattacaggtgtgagccactgcgcccggctagtacagccttttttaaagtgaacctgaccaggtttcaaattcttgctctgctgccaaggtagtagttgagactcttgggaaatctcttcccctttcttgagtctcagtttgctcacatgtgaaatgaggcatttatgagaattagaggagatatctgtaaagctgttaacccgaaatctgacgcataacaatggctcaaaatatcattggtgttcatgttcccagaggaaggaacacttcagtagagcccggaaagtgaaacgggaattcacaaggcagggcatgtttaggctttctgattaatgtctgccaaccagtaggcattaatcagcactccagtgccactcccttgcccttaataaagacatgccacctcttagagttatggttgaagccagattgtcctcttgttactaccagctgtaaccacccacaaggagacttctcccatctcctatgagtagcaacctctgtgcaatcctttccttagccccaaacaggctgaaataaaatgatgcatttatgtgtctatttccacagccaacctagaagttctctggggacagaaccttggcggacaactgaattaattgttctagtctccaggcccagtacatggatgcttgttggatgaattaatgaaccttgacccacaccaaggtgaggaaggctttcaggaggtggagggatatggggaaaaaagagagtagagagagggcaatcccggcatggcttagactttttttttttttttttgaaatggagtcttgctgtgtcacccaggctggagtgcagtggcacaatttcagctcactgtaacctccacctcccaggttcaagcgatccttgtgcctcagcctcctgaatagctgggattacataggtgcgtgccaccatgcccggctaatctttgtatttttgtttttttccaaaatggagtcttgctctattgcccaagctggagtgcaggggcacaatctcggctctcactgcaacctctgcctcccaggttcaagcgattctcctgcctcagcctcccgaggaactgggaatacaggcatgcaccaccaagccaagctaatttttgtttttttagtagagacggggtttcaccatatttcacctggccaccatgttggccaggctggtattgaactcttaaccttgtgatccgcctgccttggcctcccaaagtgctgggattacaggtgtgagctgccgcgcctggcccatctttgtattttttgtagggacggggtttcgccagggtggtctcaaactcctgacctcaagagatccgcctgcctcagcctcccaaagtgctgcgattacaggcatgagccacggcgcagtgcgcctggacctttttttttttttgagactgagtttcattcttgttgcccaggctggagtgcaatggcacaatctcggctcactgcaacctctgccttctgggtccaaaggattcttctgcctcagcctcccagcctgcctacagctactgtaatccaagtagctgggattacaggtgccgccatgatgcctggctaatttttatatttttagtagagacggcatttcaccacgttggccaggctggtctcaaactcctgacctcaggtgatccacctgtctcggcctcccaaagtgttgggattacaggtgtgaaccactgtacctggccggcatagcttagtcttaaatgaaagtctaggccgggcgtggtggctcacgtggtgcacgcctgtaatcccagctactctggaggctgaagcaagagaatcgcttgaacccagaggcagaggttgcagtgagccgagatcgggccattgcactccagcctgggtgacaagagggaaactctgtctaaaaaaaaaaaaaaaaaaaaaggaaagtctaatggtgcacagtgcctttgctgttatatttttaaatgcttagagttaatgactctgcacatctttttcgaacctgaagtcatttgtgactctctcttacacgccacatctagtcaaccagtaaattccaggtactctaccttcaaaatttacccaacttaaggccgggtgaggtggctcacgtctgtaatcctagcactttgggaggccaaggcaggtggatcacctgaggtcaggagttcgagaccagcctggccaacatggtgaaaccgtgtctctactaaaaatacaaaaaaaattagccgggcatggtggcgggtgcctataatcacagctattcgggaggctgaggcaggagaattgcttcaacccagggggcagaggttgcagtgagccaagattgcgccacttcactcaagcctgggcgaaagagcaaaactccatctcaaaaaaacaaaaaacaaaaaaaacaaaattgggactgggcgtggtggctcacacctgtaatcccagcactttgggaggccaaggcgggcagatcatgaggtcacgagttcgagaccagcctgaccaacatggtgaaaacctgtctctactaaaaatataaaaattagccaggcgtggtggtgtgcacctgtactcccagctacttgggaggctgaggcaggagaatcacttgaaccctggaggcggaggttgcagtgagctgaggttgggccactgcactctagcctaggcgacacagtgagactccctcttaaaaaaacaaaaaaacaggtcaggcgcagtggctcacgtctgtaatcccagcactttaggaagccgacgcaggtggatcacctgaggtcaggagtttgaaaccagcctggcccacatggtgaaaccctgtctctactaaaaatacaaaaattagccaggtgtggtggcaggtgccggtaatcccagctactccagaggctgaggcaggagaatcacctgaaccctggaggtggagggtgcagtgagctgagactgtgccactgcactccagcctgggcaacagagtgaggctccatctcaaaaaaaatgaataaaataaaacaaaataagaaattggtggggcacggtggctcatgcctgtaatcccagcactttgggaggccgaggtgggcagatcacctgaggtcaggagttcaacactaggccagccaacatggagaaaccccgtttctactaaaaatacaaaattagccaggcatggtggcgcatgcctgtaatcccagctactcgggaggctgaggcagaattgcttgaacccgggaggcagaggttgcggtgaactgagatagccccattgcagtccagcctgggcaataagagcaaaactccgtctcaaaaaaattaaaaaaaaatttacccagcttgttcccaccatcctcattggcccctgcctggttgggctaccactgtctgtcccctggatggttgctgtcaccatctaaatcacctctctactttggttctcgatcccagatgtgttctcaatacagctgcttagaaggcccttttcaaacaattcagacttctgatctattactgttctgctcagaatttccagggctgtcccatttgaattaagactgagtcctttcctcggcctacagagccctactctcctcccaacccccacctcatctctcttctgttcctggctgtttctcgaatatactgagcccaccccaacctctgagccttcgcttagttgcctccttcatttccttccagtctctgtctagtgtcacctcctcagggacaccttttttttttttttttttgagatggtatctcactccatcgcccaggctggagtgcaatggtgtgatctcagctcactgcaacctctgcctcctgggttcaagcgattctccccgctcagcttcccgagtagctgggattacaggtgtgcgccatcatgcctagctaattgttgtgtttttgtagagatgggttttcaccatgttggccaggctggtctcgaattcctgacctcaggtgatctgccccctgggcctcccaaagtgctgggattacaggtgtgagccactgcgcccggccaggacacctcctttgatcactttatctaaggcacactcaggcactgcatggtttttttccctctcaacactgtcagccctgacatcgtataatatggatttttaaattgtgtctccctggctggaatgaaagtccatgaccatgagctgggacattattccatttactagtttctttgggggctgtttctttacttgtaaaatgggcatttctgggttcaagttccttctgaccaggatgttctggggatatgaatttctgctgtctcgtggcagacctgaatcacaaatattttttcccagatatggaactgtattgcaggtgggctttgcatgtttccaggacccctgagacttttcttttcttttcttttttttttttttttttgagacggagttttgctcttgtcgctcaggctggagcgtaatggcgcgatctcagctcagtgcaacctctacctaccggtttcaagcgattctcctgcctcagcctcccgagtagctgggattacaggcatgcgccagcacgcccggctaattttgtatttctagtagacacggggtttcagcattttggtcaggctggtctcaaacttctgacctcaggtgatccgcccacctcggctcccaaagtgctgaggattacaggcagagacttcttcaccactagtttcccactatgggagtctgtatccttaccaccgaagataaggttgcatcatagtctggcaatattttttttatctttagacacagttcaatgagaggtattcgaagcagcaaaaatgaatcacattccaactactgacttttattaaaaagagtactattagatgaaaatagttttcacactattatataaaaagacccattttacttaccctaaggctaagatcaattaacagaacccctgggataacagcccaggcaccaaatctggcacctcagagtcgtccttgacttccctaaaccgctttcccccatctcagattctgagaatttggtttctgtcaagatgtgcctctccagccaggcctctcctgccaggacggtggccacagggccatctccctctcctggcgcccccaactgcctggccaaggtgactgctacacacgtggggtcgcagaatccctcgagtcacaacgtcttcaacgtcttgtcagtcccgtgatcgcactaaacgtatttaaagccccctactcctttaagagggtcacctctgtgtacaggcggcctcctcgtactaagtgtggtggcgttcaaggctccgagacacaggcgcctcccgcgccactccccgggcacaggaactcctactcatccctcagtcatcagctcgaaggtttcttctccaagaagcctgcccggcactcgagaagtagagccgcgagccttctcccgggggcccagccttccccagtaccggcagggatcaccccgggagcacgcgcccggccccgctgaggccaggggctcctcggaggcgcgggaaagccggggaaccagcgcagttacggcacacacgaggcggggcctgcacagatgccgggcgcccgatcctcagtgacaaaatagagactccgtggaagggacactgaggtgggggaggctgcggtgatcccataccgcactccaggtgccaggctccgccccgcccctgacggcgcttccggatccggcgggtgccggaagtgggcgggcggcggcggctgcgcgcggaggcggtggaggaggtgctgggagcagccgggcagccgcttcccgcccccgagcaggagccggtgcgagcggagcagagccgaggtcgggccgcgagcggagccggctgagcgggcgccgagctcccgccatggcccggaacacgctgtcctcgcgcttccgccgggtggacatcgacgaatttgacgagaacaaatttgtggacgagcaggaggaggcggcggcggcggcggcggagccaggcccggacccgagcgaggtggacgggctcctgcggcaatatccttccctgacgcggcgtccgggcctgcgcgcggccttctcaccttcccaccttcccaccttctcgggccctttcgggcgggcctcccctgtctccgacccttggccccctcaggtcagcctccagctccctgccgacccggcttccctgggccgtgctcccttgagtcccagtctccctgggtccctcgtccccagccctggcgccttcttctgcagcgccgtcccgcaggcccctggacccggtggacgggctccctcggcacccccgcaggtcccgcgccctcttccctccttgcctcctcgtcccctcacgctgtcccttccttggggccccagcactccgtccctcccttgcaggaaatcgggcctatggcggggctgggtcggcggcagggcggaggtgagccgcatctgagtaaccgagtgatcggggaggctggggcgcggtcctccggggcccgattgctgcatggcgtgaagataggtgggtggacggctgtggggaagacagaacccaggagggagtggaggcggccgccgtatttcagccctggggtctgagattgtgtctctcttcccccagtcagtctaaccctcccgcttaatgctgagaaagggggaccctgtggttcccctggacaccttggtggtctcagccacgctcaacaagtgagtcttggctccccccagtacccttctggtgcaggaagcagcggagaaaactagtagttcagagctaagaaaaaccagacaccttgaagcgaagtgtgaaagtggagccccacgcctggaaatgactgttcttgtggccacagaaaacagcatttagaaaagattaaaaatagaggtgattgtcacagccttgcttggtcctttagcagtatgagcgcaggaaactgacttattctcaccggaaggatttttctttattcaaatggtgttccaggaagcctgtcccctccccccgcacgggtgggggcagggttggaggcccatgctgtacataaatcaggttctcggtgttgaaccagttgactcagcttggaaagtggggcctgctgctttagggggagcccggcagtgctcctgagtgtgcctttaaaccgaaaaccttcagacttgatttgaacaggaatgtgttttccgaagtggagattcaagcttgtaattcctgccccatcaggatctcccaatccaccctccttatgaaatggggtcaagggaagggtccccaggagggaaggttggttgtagtctggtgtagggcctagttcatggacagtcagtgctgaaaggggctccagggtcaggcctttggcccaggactctcattgaacagatgagatcaagcctgtcagctgctgccttggtctgggtgcagaaccttgttgaaggtcatgtcttgggactcccctgcctggtgacaggttccttgaggctgcttagaggcctgggcttagcacatccaggggatggtcgtttctccattcatggcagcgtcagaagcgtcagaaaccttgttaccatggagagtgctccacttggggttggggaaagggaggttaacggataaaggtaactgaaaccctggcaaatacggggcccaggtggaggagaatggaactgatatttattgagtctctatcatgtaccaagaatcggacttatattagaccattgaggacaggggagcagggagagggatagatggattggggttggggagggcagagaggggccctgtcctggggctgtatagggaagtgtgtgtggcaggagatgacacagatggagtagaaggaacccggctgtgcatctgcgcacaccctgcactaccatgctctggctctgtgacctcggataggtcgcataccctttcacaactcagcatcttctgttacgtggcggacagccatgctggcttcctagattccgtgggagcctcatgggctaacatcagcatcactgggcacacagcaagtgtcctggacatgcagctcgggtctgcagatagagcggcagcatgggattgtgggaggagcttgggtgtgagggccgtgtagacagcttagttttgtgaccttgcgcaggtaatttctgttctctgagcctcaattccattgcctttaaaatgagataatgattattgtcacaaggatttttggaatgagatggcgtgtgaaagcacctggcacaggatccgagaccttgtggcgatttaaaagtatgagttcctttccccttcagtgaagcagcttctatacttctggatcagggctctgtccagagcagtggttgtgagcgattttgcacccttcccctccacccccaggaaactggagacattttgatggttacagcttggggatgccactggaatccagtgggcagaggcctatgacacacagctaagatcccacgtcagagaatcctgggtccacagtgtcagttgtgccgtgattgaggaagatctagaggagatcaagggctgggcaggattccctcagcaccacagcctgttctctgaaaaggcctaaagccagccaagtatgacagccggcttcacaaatgataggtgacttcagggaggtcctccctgcgccccacatctcccaactgctgaaggccctcacccatcaatgggccgagtgattgctggacgcgtggtgctgagttaacgccacagcagtagctttttgcccccgtggactagttttatacctgcccttccccatccatcatttgaatgatgtcatttgttagttgtgccaggtttacatgaagagcaagtgagcctatgttttctgttcagcctatgggatcctgcttattgctttggggacaccacattagaaaagagttacaagggctgggcgcggtggctcacacctgtaatcccagcactttggggaggccgaggcggacagatcacgaggtcaggagatcgagaccatcctggctaacacagtgaaaccccgcctctactaaaaatacaaaaaaaattagctgggcgtgctggcgggcgcctgtcgtcccagctactcaggaggctgaggcaggagaatggcatgaacctgggaggcggagcttgcagtgaggcaatattgcgccactgcactccagcctgggcgacagagcgagactccgtctcaaaaaaaaaaaggagttacaaagtagaggttatcagtggctgatatcaggctggccttgtttggatggggaaaaggaactccagaactgaaagacagagggactggactgcctcttgagtgtggaaggtggatcagagccaagcagggagctggggaaccagcgctgggagtggcttgcctggtggcgcagacccagctcactcaagatggatctcatactggggaagccaggagattcagctctgctccgaaggcccttcctgtctgcacgtgggtatcactgcatgaagaggagtagagacccgattgggcagaagccattccttgttctatttttgaagctttttggctgaagccagtgtttcatacgaggaaatgaaagttggctgatgtaattcagtttaaaataggtgtcacctttggggacctaacccagattgtaattttcttttgcatgctgggtattcagaactcagcaaagaatgtgttgtcaggattgcaactgaggttggggggtaagggtggagactggctcattgttggcaaaagcttctgttagattgataaactctttccaggtaacagttgggacctcattgatcccgatagatcttagaagttctagcacatcttaatttccttaatagtttaattgatgaagagcattgatgaagagttaggaggtctccctttgtacctacattttccgcttttttagaatgagaagatgagaacgacctccagttcacatgtacgggtgctgtgaggatccagtaggggagatacagtgctcagcaccaagcaggtgcaagtgagcacaatccaattttacatcaagttacccctccaggacagttgctttgacgtggaaggtagagagggagttgaaaggagggtttgcatggttggcagaggtgccctgcagcctccctgtgcaggctgtaaaccgtctctgcccccctggaagccgtggaaggtgggtggtatggatgagatcccatctgactctgttcctgagctgtttctgaagtgagcttgttcatgacggcatggatgtgcttgagcctagctatccttaactggtggtgatgcacaggggacatgcttcgggcattccatgcagccttgcggaactctcccgtcaacaccaagaatcaagctgtgaaggtaaaggggtggcgctgcggctctgctgggtgctgttgggaccagggctgtgggtgtctgcccagtgcgagtgtgagctttcatccacatcagagggagtgagttggcactgggcggggcttccagggaagcctcctggcgctccctaggtggtgaggcttctctgacatcaacgctgtcagcgtttatatacgagaacctccccacagaagccttcactcctgctcacggcctcgtaggctgagaagtcagcctggccctggctgatgaggaaaatggatgaattcgctcacctgtggtgcttatgctcccacagactgttaaataggctttgtctgcctgaggattttaagtacccgtacgctttcctaccttctaaaaactaaattgtgcttactgcatcaccaagtctaaaatttggttcagagaaaggggtctccctgcagctgggattctggcagctgtgacagcatcttgatgtcaccagtggctgcaccttcacagagttctggggaatggccccacccttctgggtgtgaacacaagagggacgctgcagccgagtcaacctggttttatttttattttttaatagtccaccaccattgtggagtataataaggccttattggtgtcatctaaaatagtgatgggctgggtgccatggtttatgcctgtaatcccagcactttgggaggcaggaggatcgcttgagctcaggagtttgagaccagcctgggcaacatagcgagactttgtctgtattaaaaaataaaaaaaataattagctgggcatggtggcatgtgcctgtagccctaactgaggtgggaggattgcttgagcctgggagaggctgcagtgagctgagattgcaccactgcactctagctcaggcaacagagcgagaccctgcccctccctccctctctccctcttttctcttctctctctctctctctctcagagttgatacttgtcctagtaaactacttactcccccaaaataagtagggtaacttgttggcataaataaaagatactttgaaatttaaatccacaaaagacgttctaacccacttattttaaccatcctggacgaattagaaactgggcagtgtttctggtgatctgtgtccttgctttggtgtggggcatggcatggcggtgccttcgcagctctgggactcacttgctctttttcgtctgcaggagcgagcccagggcgtggtgctgaaagtgctcacaaacttcaagagcagtgagattgagcaggctgtgcagtcactggacagaaacggcgttgacttgttaatgaagtacatttataaaggctttgagaagcccacagaaaatagcagcgcagtgttactccagtggcacgaaaaggtatgtgaacgctgccacgcgccccagtgagccacctggcttgccttggggttcgatcagcaggccagattttccagaacaaacgtaggacggtctgataggcgtgtggggtcagaggacgagccccaacctgggacatgtcatcacttccctctcccaaggaagctcctggtagggacctgctgtctgtggtaattgcagttacttttttgctttttagctgccgatttatgtcaggcaagacagggtgcccttggtacaggacatgtgggcagataacatggcatagtaaggtggtcagggagtctaggtaggaagggggcctgctggttggttggggcttcatgatacttgcagtggtggaggcagctgttgggggttcttagaaatagagtcctccagccagctctaagggcttcctgccctggcctcagccttagcaggccagagtgagcagtgggcagaaaccttgacctcacttaatatggccttcgtccaggtgaagcagaaagagctgtgtctgcccttcgcttgggtccgtgtgagagcaaggcctttggcaagcctgtgtcgtgcctgtaccactggggctgcctcccacaccctcccctgcacacccctagtgccgcagtaagcacgcccaccattaaagcagaccaggagttactaacctgcctgccttcctcagaggctcagtgttgagttggaagagaggggttttacagtgggccagtccttaaggtggtgtgggtgctgggctgtggttgtggccttaggtctgctggcgggtgtgctgcacctccttggcctcccctctcctgggctcaaggaagtaaacaagtcctctgtatgatggggaggccaggacctctcgtccctttaaggcagcttggtgcctgccagtcacctcagcgggcggcagtcagtgggcttgtgtgcatctgtaaactcagcactttgggaggctgaggcaggaggattgctggagcccaggagttcaagaacagcccaggcaatgtagtgagaacccatctctacaaaaaaataaactaggctgggtgcggtgggctcacgcctgtaatcccagcattttgggagacggaggcaggcggatgacctgaggtcaggagctcaagaccagcctgggcaacatggtgaaaccccgtctctactaaaaatacaaaaattagccgggggtggtggcgggcgcctgtaatcccagctgctcgggaggctgaggcaggagaagcgcttgaactggggaggcagggttgcagtgagccgagatcgtgccattgcactccagcctgggtgacaagagcgaaactccgtctcaaaaaaaataaattagccgggcctggtggtgcacacctgtggtcccagctactcaggaggatggcttcaacccaggacatcaaggctgtgcagtgagctgtgatctgggcaacagagtgagaccccatctcaaaagggaagctcgagggctctgctttgtgtgctggtgacagtgttctcaagccagttctgcccaagagccaacagctctcgggaccccacggctccaggacagggctccttccctagaatgtgctctatctcaggaatcctctttcgaggatctgtgacgggatctaggtcagggaatgtcccccctgtctctggcaagccaggctccccttggccagccaggtctcatctgacacgttttcttttcctgcccccacaggccttagcagtaggaggactaggctccattataagagttcttacagcaagaaagactgtttaaaaaaaataaaaagactcatgttaccttgagaagaattctggatgcccaggctggtgaagaagggattgacaatggaccatcttcctaggaactcccaagtaaactatttcaggacatgtatctgctgaaatgtattttattttcaaggtggaggggaaaatcgtctgtttcctaaatcctgtttaggatctgatagtctatgcctttgtctccgagtactgcagaactgacattttgacggtctaccagcgtggcggctggtgttggtcagatgcacctgtgtgcactgggggagggatggtttgggcaggtgcagatccaagggctgtggtaaacgggagagcttgtgtttttgaagtggaaaaaaacccaagagtttgtacagacatcctgtcttcccagagaaggtggacactcttgggctcattgtaaagtgcctgctgcatcaataaagctcttggcttattagtctatacattgcggtgtgtttcgtgtatgtaaaaaaaaatggtaatgaatgggatggtaatgaatgagagttcagttgttgttccggaaacccgatgtggaaggagtagacctgtgtccctgttgagccacccctgggagcgagcatggcaatccacaggccctctgccacaggacgccagcctcggcctcagagctgccggctgctgcagagaggtgtttgctgaataaactatttattgtttcttattcctttgatttgtatgtaattaattttggagcttatttaattaatttaataaagtgccaaacatttaataattg

SEQ ID NO: 38639 - DNA, 10002 bp, Homo sapiens
ggcacctcccttaggcgccagggacagccgagcgttacctggtcccgggcagcggagttctttacccaccccagttctggttctgacgccctagctcattccgcaaatttagggcttgggtctggcttgttcccctccggctcgaaccacctcttctctgagccgagccagctaccggggctcctggaattgccacccctccctgggcacccttgaggcctccgtggagggacgtcacggggcagagcgggacgtgagcctgagtttgctgcaggcgtgctctgtgtggtggctgggtgagttgtgagtatgtgcgtggcggagggggtgccttcttcacttgcatcctcctcctctgtcagaaggcgtctctggctacccagttctggaatggtcgcagggtggggcagctggtcccaggaccggaagaatcctaagaatccttctgatgcacttgctcggatgcagaccgcgaggttcctggggtcgtctgcccctccacatctcaggggtggggctacggtctggggtgcagggctaggggttgggagcgtaaggagaccagggacacagtggagctaggggttacagagggggagcagggagagggctggggacatagaagaggcacaggcacgacaggaacggggctgtgaagtgatgcgaatgccgcgctgctacaagaggagcttgtggatactggggtaggagcccagggggacaagcaagccaaaggccattgccaaggcagccatcaagtaaacaagccaggcggtaacccgagtccctcccggcgcgccagcagaggaccgcccctccacaccgcccacctgcgcccggggctttctctctgggcacctagaccgcttgctgcagggctgggggtctgctgaggcccgccaggggactgtaaaccaagggagcagcgcccgcggctccagcccctcctccctttggctggggagggggccagaactgatccccgaggtgggattggctctgggaagcagcttagggcctggtccaggtggcccaggctgggggcatcgcctcgaatgacacccaccgccctcaggttctgccaatccccgtgcccaccgggtgggcgcggccgggaagctcctgcccctccctgctggtcggcgtcacgcgtgacgtcccgcgtgatggctgggagggcccggcggcgacagcggaggcagagaggaaggcggttctgagagcttcagagagcgatggaaagcgtaagtgctcgctctccccggcgggcggggttctggaatgggggtcagagaaggaggcctgccttgaaactgtctgtcctggtgcagtcaatgtcctcggctctgtggaggtccaagtccacagggcacaagggaggttggggggaggaatgtcagggtggggctgtgtgtagtcacacattcaagtgtctgcagatgggcacagtgtgcgcctgtaaaggtgtttgaaggccggtgtatacaggacacctccactctgtctgtatgtctgggcagggtgtgcatgatagtgtctttgtgtgtgggtatgtgagtgtgaggggagggcgtctctgcctctgcgggaggaagtgtggctggagaggattagtcattctgtaggattctgcccaactcagccagatggctgcaccaggctttcctctctgtgctgggtggagggagcagccactgaatcctgctcttatccggaggcaagtggcccagagagaggtggatgagtgtctgtgccagccctgcctggccagggaccagggagagcctggggtcattcagtgtgagttggagaaaaatgggtctgtagagaggacttgtgcgtgcccacatgcacacacatggctgacatcagagtcccctgattgagatctggaacagataagccctgggtggccagtaaggccttgctctcctccaatcagggactggagtgtgggatgtcttgtgccattttccaaaacagccttgggggtttgtatccaggtctcagtgcagctggggcctaaagctcacctgagcatgggtgtgtaatatatatattatatattcttgtgcatctgtagcacacgtggctgggatgtttgttgctgcttatgtgtcaaccacatatatgtaaatcctcactcatgaaaatctgtaccaggatagagcacaaggagatctgttttcctgtttctggtcttcccttccccctcctccagtggctgcaggtccctgggctgggacattgcccaggaaacagctcctccccacacccttgcttacctacctagttgaaggggtggcctgcccctccacacctgtgggtatttctagtagggtgggacaagagactgagaaaagaaataagacacagagacaaagtatagagaaacaacagtgggcccaggggaccggcgttcagcataccaaggatctgcaccggcaccggtctctgagttccctcagtttttattgattattattttcattatttcagcaaaaaggaatgtagtagtagagcaggttgataataaggagaaggtcagcaaaaaacatgtgagcaaaagaatctatgtcataattaggttcaagggaaggtactatgcctagatgtgcatgtaagccagatttatgtttctctccacccaaacatctcagcggagtaaagaataacaaggcagcattactgcaaacatatctcacctcccaccatagggcggtttttctcctatctcagaattgaacaaatgtgcaatcgcgttttatatggagacattcagttcccaggggcaagcaggagacagtggccttcctctatctcaactgcaagaggctttcctcttttactaatccacctcagcacagaccctttatgggtgtcaagctgggggacggtcaggtctttctcatcccacgaggccatatttcagactatgcatgggaagaaaccttggacgataccccgctttcaagggcagaagtccctgtggctttccgcagttaattgtgcccctggtttattgagactagagaatggcaatgacttttaccaagtatactgcttgtaaacattttgttaacaaggcacgtcctgcacatccctagatcccttaaaccttgattttatacaacacatgtttttgtgagctccagattgggtcaaagtgctggggcaaagtggctggggcaaagctacaaattaacaacatctcagcaaagcaattgtttaaagtacaggtctttttcaaaatggagtctcttatgtctttcctttctacatagacacagtaacagtctgatctctctttcttttccctacatctagtcaccttgagctcttgaagggactgatgataagctcaggggccagggcaggggcaccaaagatttcccctagctggagcccttggacccttggactcccgctctgacccttatctctgtcctgcagaaaatgggtgaattgcctttagacatcaacatccaggaacctcgctgggaccaaagtactttcctgggcagagcccggcactttttcactgttactgatcctcgaaatctgctgctgtccggggcacagctggaagcttctcggaacatcgtgcagaactacaggtgaccacccctcaatctgaccctgtgtgccaggatctcattttctgtgattaatataatatgttttgtacctgcctcctcaagcttgacagtgaccctgtccctcaatcccctcactctctagccccgtctgttggcatcacagagctttaacccaaaggattttagggcatttgggttgagaagatggcattgatatttatgggaggggctgctctatgcatcacaaacctctacagggatctatcccattgcggggtcaccctctgcaaggatagaggtgctcaaagtggagtcccaggaagataggagggaaatccccttatctttgggaggaaaaactcttgcaatgcttgcagccatttttgacccactggaaaccaccatcatccctgacccagcattttggcagaaacagaagggtacccctctttgtgtggctataagggaaatagaaataggagcctccacttctgggaaactttggccctctcccaaagataaggagcttccttatgctgagactgggggctgaagttcctggttctctgtccagagttaccctgagctgggcaggtggggcctgtgagggcagatctgccccctggcatagcctgtctgctccttgccaacttctgcagggccggcgtggtgaccccagggatcaccgaggaccagctgtggagggccaagtatgtgtatgactccgccttccatccggacacaggggagaaggtggtcctgattggccgcatgtcagcccaggtgcccatgaacatgaccatcactggctgcatgctcacattctacaggcaggtcttgtcccacgtccccttcttcagtgccctaagctagagcatagcttgactaggtgcgcttcttgtctgggccaactgggtgagtgaaagattgtgtcagaatcgcttccattcctcagaattcagcctcaggaggtctctcaccccagagacagtaggtgtgtttgtataaatgggggtgggggtacataggggttaccagaacaggttctagggccattaactgggtcccttcttaggcttggggaataacctttggtttcattacaggggtctaaagatgagggccactgtagacggggcagaagtgagtgtctttgttccctcaggaagaccccaaccgtggtgttctggcagtgggtgaatcagtccttcaatgccattgttaactactccaaccgcagtggtgacactcccatcactgtgaggtgagagccagcccccagcagcagctgcactgtcccatctgaccctctcctcccagcctgcagtgccctctcctttctctccggttccctgtggaccatgcagccagtgctcagcgccctctcctcagcctgccccaccccgaattaccctgcctaactgaaggcatgaggtcctcttatgtatgctgtgggggacccacccctcttcacagggtgctactggggcttctagacaagtttacgccggagatggagggaaggcttcttctgcaaggagcttccccttttatgcctcatgtattgaggacttggcatatccctaaaggaaagggccacctgctggacttgtcacctctccccgtgacctggcttttccacccacaggcagctggggacagcctatgtgagtgccaccactggagctgtggccacggccctgggactcaaatccctcaccaaggtaaaggcccctcactcccctgaccaccccattcatcctctatctgcctccttcttcctcatcacacctccagttctgacctatatgccccctatatctccccagagtccctcaccaccccatggcccttagggccactgaacaacacccttcctccccagcacctgccccccttggtcggcagatttgtgccctttgcagcagtggcagctgccaactgcatcaacatccccctgatgaggcagaggtgagtgaccccggctcctggcatgtgcatgcccagaatgtagcacactgtccatccacgcagaccacctcagaatggggacatccctctccctccccagacatgagctgctgggccctggctcagtctgaccctgggatcctcaggtgggagaaccagcctttgagcctggggtgtgtgaggggaccctgaggagccgctgctcattcgggcattgcaggtgggatccggggcctgtgatctgaccccaacccccctcccttgcagagagctgcaggtgggcatcccggtggctgatgaggcaggtcagaggcttggctactcggtgactgcagccaagcagggaatcttccaggtggtgatttcaagaatctgcatggcgattcctgccatgggtaaggcgggagtggctgggtggggcataggagactctgagagaagcaggtgcagttctcagggactttggaggactctggggagagagggaggagctttgaggggggtcacccttcacagttcctgactttaactccactactaatgttctccttcttggccctgctctccccacagccatcccaccactgatcatggacactctggagaagaaagacttcctgaaggtaggcgactgtacctctcttgtcctggaatgggcgatggctgggagaagtgaccaggccccaactctctctccagcctcgcctgattctctaagacttgccagcccttctcctgacccctgcaccgcctcctccaccttcgttcattcagcaagaatgaactgggctggggtgaaggaactctgcaggggcaggaggagaggacaaaggaaggaaaccaacttcatcagtgttactccagtggcttctgacacacagaaggggactgtcatagtcatgcttgatctcatgctcattcttttaccccctagtgcctccatactgagaggtacacacgggtgaacacgcacacacagacatgaacaggacacgaaagcaaagcacaggaacaagctctggctcattcacagaatcatttattcacaaatgtattgagtgccatgcaccaggcatgttttagggctgaggagatggcactgaacacaatggttatggcccctgtcctcatgaagtttatagtctgatgcagaaaccaataaacaaggaggcacccaataaatacattcttagaaagtgtaatatgtgctttgtaggaaagcaatgggggtagtgtaattgagattcatgggggagagctgtttagataggatgatcagagaaggggtctttaatgccgcaaaggatgaggagagagccaaataacgcagagaagagtgtttggggtacagaaaacagtcagtgcaagggcactgcagtaggaggggcttgcacatttgaggaacaggttggtggtccctgtggccagagcaaattgagaagagtgccgaggaagagatgtgcttggaaagggtcagattcatgccactgggatgggaagaggtaagtggaggttcacaggaggtttcctgaagaaatcagctcctggaggaagtgagggaagaaaaaaaagggccagggagtgccatggcaaccaattctgagaggtgagaggtcatgggatgccggggagggtgatcagcagacaggcctggctggagtggaagggcgtgatctggaggtcccagccctgtcattgccttgggagaaagaaaacggccacaggtctaagggctccaaggcaaggctgatgggatagagctatggtgggtgaaatggggtgacagtgaggcaggggacacaagccgttccattgtctttctgtctctccacagcgccgcccctggctgggggcacccctgcaggtgggactggtgggcttctggtaagtgtgcaaggagttagctggggtgtgtgggagtgccttgtccatggtggatgtgggtgggtatggattgtctttaagatgtttatagacatcatccattcatacattcagtgggtgtgtgtttggaacaactatagggtctactttgtgtgttacggggtggtccctgtccttgaaggtcaagatcctagtgagggggttccagtcttcatctataagaggaaaccatggaaatgtaccttttggtgccatccaggagattcatgcccatttaattcctgattctgccacttactggttgtggggctctctttcctcagaacctgatgtccaggttgggtttactattcctaaaaggtcctttcagcttttatcaatctccacccctagggcctatctccaaggatggggtggggtgcagggagggaacaccctaaggccaaagctttacaaacctttccaacacttgtctcccccagcctggtatttgcaacccccctgtgctgtgccctattcccccagaagaggtaagtgctgtccctgggctgggtgggggactctggattggactctgcatctctggaccagctgacctagggtcttccagggtgttcaggaggaggcctggcaggcactccactgattctgggagtgggggaatgacagtgagccagtccttctggcagtagaaggagaggatttttcagcctgggaggaggtgggatggcaatccctgggcctgagtggggttggattcaggggacgttaactggcctgtgctgttctattgcagctccatacacataagcaacctggaaccagagctgagagctcagatccatgagcaaaaccccagcgttgaagtggtctactacaacaaggggctttgaggagggtcagcctctgtcccctccctcacttccttgggctgctgctttagtggagtcatgtcacccctaccacttggctatctgcctagcactgggcaggggccttggtgggcagatggcaattgagggtagcaacctattagggtgggggagggacctccataaggcttttcctcccttctctggtttcaaagatcagagcacataacccctcctgtgcttgagtgtccatgcatatacatacatgatacacatgtgtatgtgtacattgggtcctgaaagctagaagcaggcatgctagcctagtatgttctgacatctggcttcccttctcagcctcatgtccacctgcctgccagccaggctacaggtgtgacttccttctctaaactgttacaccagccaagttatttttgatggcacctcatcccttctagaaataggaggagccccaggatctcaggacagagacttatagacactagtaggacaaagcgggctgaatccttcaggtttctgatacctagctccccaagctgactgggctggcagaggagaacatgttgagacaagggaggcaggggacttatgcatccctcagtgccatcccttgtatcctggaatagctccatttcccctcctcctctctaccagacaaaggagtgcctgtgtcctgtactgccctcgctgtctcccccaccaccctacttgacagcgtgggcatcttcaggcacagccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccgaatgtacaatgttaagacagggaattttgtgttccattgacttttttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccaggctagtctcgaactcctgacctcaggtgatccacctgccttggcctcccaaagcactgggattacaagcatgagccactgtgcccagcctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttccccctatcaaccgcccccagtgataacatctgtgaagccagccattactcaataaactgcaaacttgtct

SEQ ID NO: 38640 - DNA, 32363 bp, Homo sapiens
gaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtggggtgagtgccaacggggcctgggtctctgagcctccgaggtcggccttggaggtcgggcggagccgcgcagaaacagggcttctcagaggtccccgggaggcgctgctgtccgcgctggccccttggcgagaagtgtcggacgtctgagtggaacccggttcgtcaccgctgctctttccactcggctggcctctgcgcctttctctcatcccggtaggaccagccctaacagcttcttgctaatcccgctttgtctgacacctttctccgagccttcttcctcgttccaacttttagccccttctcttctggcgactgttgttttgcaatcaaagatacttgaccttacccactatgacaacactcttcctctttcttctgaacttcttgaagacgcgtgatgtctgcctttacccactttcgaaacgccgtgtagtctagaaaccacacgactgtactgcaactcctctcagatttgcctttttgaatcttcattatctactctgcagccttccacgcattgaacacgcccttctccgtgaaattcttttcttcccctgacttcagtgacactgcatatttaaggttcttccaaatgacactacctcctttctttgtacttttccttgggaatgtaattattttctttatagtattgatactgtaaacactaactttagtccctgtctcagttcgatttgactttcttgccgtaatctcagagttatgtataaccaccacataaaagcaggccctctaccatgtagctcactactttctgtggagtgttggggccgggaggggtaaagtagagcaaacttggcctgaagattaaatgacatcattcatgtaatctctctagcatagtgcctgctttaaaaagcattcgatattagctataattttggggtttttttttttttttttttttggacacagggtctctctctctgtcgcctaggctggagtgcagtggtgcaatcactgctcactgcagcctcgaactcccgagctcaagagatccttctgcctcagcctctggagtagctgggacgacaggcaagcaccaccacgcccagccaattttttatttattttattttttttagtagagtcgaggtcttgctatattgcccaggctggtctcgaactcctgagctcaagccagcctcccatcttggcctcccaaagtgctgggattaaattgtccttccttgctttatgcgcgttcattcagcagatattcaccaactacatggttagtgtcaggtctgtgctaggttcttaagatacagagatgggtgaagcaaggcccctgtctcacttgttggaaacatattattgtatcagtcatttgggctgctagaacagaataccacaaattaggtggattaaacaacaaatctgttttctcgtggatctggaggctgatagtccaagatcaaggtgttggcaggattggcttccgatgtggcctctcttcctagcttgcagccagctggcttttcagttagtctgcgcatgtacactcctggtgcctcttattcttcttatgtggacactaggtccttttggaatagggctcacccgtatgaccttatttaaccttaactacttccttaaaggccctacgtccaaatatagtcacattgggaattagggtttcagcatatgaattggtggggggtggacaattcaatccataacaattatggttagaagaggaacaacccacgaggaccaggcagaagccttaatgccttttacgaccttaccttagaagcacataggaactcttctaccagagtcacaggtccacctggttttaagggaggggacatagaacaaaccttgatgggaggagcatcagtgtcacattgtgaaaagaacatttggaatggggcatcttattgccaccatcttggaaaatatattttactacagtgactttcataggacagacactaaataaatgagatttcttcaagccaaagtgggaacaggtccacctaggcaagagaaccaaatgtgaaaaagtacatggtttgtttgggaacaggtcggccttgttttggagcgagaatcctatggtagagggttgtaaagagatgatgctgagaacgaagggttggaccagattgtgaagggccttttatggggaagccataaaggtttgtaagtagttaactgatgacaagttctttgttgagaattggtgggaatgtgaagggtggattttgagcagtggttctaaactgtttcactgcttctcatcatttattacccaaagaggatttttagcccaaagatagggggatataggagggatgagggggagcaggtgtagtacttgtatcagaatctcattttgaggttgtagtttgacttctctagagacacactcgtattcacactctctgtcacacagacacactcaaaatgccatttaatgtgattcataaggaggaatatcttgacatcctgacactggtttaagaggccattgtagggtttgtgtaaagggagaaaggagcccgaaccaaactcggcaatgatgtagaagaggtgagatttgagagataacctgaataatagtttggatgtggtggagtaaagaaaggcagtcaaaaacgacaggtttttaatattggatatcttgtttagtttttgttttctgtttgagacagcatctcactctgtcacccaggctggcgtgtgcagtggcatgttcaagctcactgtggccttgacctgtcatgctcagtgtcccgagtagctggaactacaggcatgtaccaccacacccggctaatttttatattcttggtagggacaggatttgccaagttgctcaggctggtcttcaactactgggatcaggccttggcctcccatcttggcctctgaaagtgctggaattacagctgtgattccacacccagcccagtattaaatatcttataacaactaatatggttaggctttgtgtccccactcaaatctcatcttgaattgtaatccccataagctaatcaagggagagaccaggtggaggtaattgaatcatgggggcggttcccccattctgttctcctgatagtgagttcgttctcatgagatcctttggttttataaggggctcttccctgctattcactcggcacggctccttcctgacaccttaagaagaaggtgccttgcttccccttcaccttccaccatgaatgtaagtttcctgaggccttcccagccatgctgaactgtaagtcaattaaacctctttcctttataaattacccagtcccgggcaattcattatagcattatgaaaattgactaatgcaacaactttatgagggaggcagataacagatattgtcaccgagtcttctcacattgatttatttgcccaagatcttgtagctatcaagtgccagaggagcaattgaagcctggtctttcccatttctggttccttgttgatgccatgttgttgccattaagagagatttaagaaaaacaagtttcagaagataaattggatttcagaggaggagaaatgtacatacattgttatgggatttcagatgaagcttctctgtcagctactgaaaatgagaagctggtttttaggaatatattgagaaacaggattgcaaattttggagacactggcacttaggttgaagccagagactggataggatcacccaggaagagaagaggagaaggtaaaaatggtaaaggtggaattctgggaggcactagcccttaaatgctagtgcattaaggggctggtgaaaaggggtcaaagaagtaaaggataggaggagttttaaggcgtttctaggaaacttcccctgcttctaaatcagactctggtacctattcattggtttaaaaatgatgaaacccggcaggcatggtggctcacgcctgtaatcccagcactttgggaggctgaggtgggtggatcacctgaggtcaggagttcgagaccagcttgaccaacatggagaaaccccatctctactaaaaataaaaaaattaggcgtggtgatgcatttctgtaatcccagcttctcaggaggctgaggcaggagaatcgcttcaacccaggaggcagaggttgcggtgagccgagatcgcgccgttgcattccagcctgggcaacaagagtgagactctatctcaaaaaaaaaaaaaaaaaaaaaccctcatgctaatatttattgcccctggaactggcttcaccctgaaccttgaaacatatcttggtcttctcccctgtatgaattctccattctagctagataattctttattgtatccaaacacaaggttaatcccttcatgtacaactttgcttgtgtatacttcctacgtgggtttcagtatcatcagataaatctgggtttgaatttcagctctgcctgtctgtgggctttggaatgttagttaatccatggcctcactcttctcagctgaaagcagtgatgactaattagcgatcttaccgcattttgcaaataggtttaatctatctgaaaatgcctgcctagcgtggggtgcttcttaaagatcagccgcctttcttctatctagatgcaggagctagggttcagcacagggaccactgccctagccatttttcccccgcctctttacagttctatgtcttaacaattacgattagctcttataacagctgatgcacataatgtaaagctagagaaaaccttagaaaacattttacaggtgatgaaacagaagggaggagataggaaacatcgtctttgccttagaggcacttatggtctagaagggagaactgtgccctctttgccagccccccaacccattttgacattcagcatctgttgtcttgacctattttctagttgtttcatctgtgttttctccaaaatcacagtcatctaatatacattttttactgaagtgtgagcttctgcttgcatgtcagatgagcataattttgtcttctgattctttaactgtgtctccctttatttccccttgacaatacagccccttaggtaatatgctttttacattttgggatgctattgagttgagaaagtgcagagaaagattcttattctggttaaagtattataaaacagaacaagaaagtacatgtaaagtacttgtttggcatccggcatgtagtagatgttcagtgtttttttgagacagggtcttgctctctcacccaggctgaagagcagtggtgccatcttggttcactgcaacctctgcctcccaggctcaagtgatcctcctgcctcagcttcctgagtagctggggctacaggtgtgcaccaccacacccaggtaatttttgtattttttgtagagacggggtcttgctatattgctcaggctggtctggaactcctaggctcaagtgatccacccgccttggcctcccaaagtgctggggttacaagtgtgagccaccgtgctcagcctggttttttttaattataaaaagttatcaagtaaactgtgaaccagtctgaaaaactggttattttcccccggtattcctggtatgattaggtgagggatggaaaatgttccatgatagtgatattttgtaactcaaaattagttctgttgggttttgccttgtgttacaaaatatactgaacagctttccccattctcattttaaggagtcagactgtttaaaatctcagcagtactagatatggagagtggggtgtttatagttttgttttgttttgttttgtttttgagatggagtcttgctctgttgcccaggctggagtaccatggcacgatctcagctcactgcaacctccacctcccgggttcaagcgattctcctgcctcagcctcccaagtagctgggattacaggtgtccaccaccacacccagctaatttttgtgttttcattagagatggagtttcaccatcttggccaggctggtctcaaactcctgacctcatgatccacctgcctcggtctcccaaagtgctgggattacaggcttgagggtgtttatagtttttgaagtagttattttcaaagacaggtttccctccatttctgaacctttactcttcagactcgggacccaaatccatttggatacaatttttttagactgggctgtctggaggaaatggtatccctccttactcaagccctcactgtctgaaacttaggaacctactggcgtctgagagctacagatacttgtattcctgttgattctaccaatctaatgttgcattcattagaaataaagggcaccatgtctgaggtaaaattgagaccagtttgcaaggtgtgtttggtttcttaacattgaaggttgtgaaaggaaagattttaaacatatctttaagcaactgccacgtgcatgtccagaatggccccttctgtgtgtgtcatggagaagttctggcttatattttcagtgtttctttactagaaatcatccctcttttaaagagaagggccaaatacagtagctagatgttttatgcactgaaaggcatagtaaatcttaggttatgcttctccagttgaccagagtcattatgtgtgtcttgaacaagaaactgagtatttaaatgctatttgataggcaaaactcctttcaaaacatgaatccctaggggaagaattaataaaaaggacccttataatgaggatgcagtctctttgtgtcttgagggaggatgtctcttccttgcccttgtaaatcttccttaagtgatgtaaataatatctagtctgcatacaaacctttttaaagttatgtcattttaaaaattctaaaaggaatacaagcatgttaaaagtagaaatatacctggtaaaattcctcttcatcccagtctcattcctcttcatttttgaaagagactaaaagggaaatacaactatgtattttacaccaaaatctcatccattgggacatttttattaatgagtttaccttgtggtttcagagctgctcagaattaactctgaagcccagtcacccgtatcactaggggtggtctcagtttgccggctgggagctgcctgtgtggtaatccaacctcactggccagaatgacatcccaataggcagaggcaggaataaagatgaccatgataggggtaggggcgggaagacctcatctagctaccttaattatttgaacgttctctttaaaagagggatgacttagcaaagaaaccctgaaaatgtaagacagactttctccatacacacataggagaggtcatgccagacaaccttagtacaagttgagcatccagaatgctctgaaatccaaaactctggggcactgacatgatgccactgatgtatattaagtacttatatgtgaaaattccacccacacgtaaggaatagaaactttatttcatgcacaaaagtatttaaaacattgtataaagttaccttcaggctgtatgtataaagtatatatgaaatgtgtttggacttgggttgcattcccaagatatctcatgtatatgtaaatattccaaaatcggaaacactctgatctcaagcacttcagataagggattcaacctgtactttataatttccatcgagacaaccaggagtggcaggtctttaacgttcatgggtcagtcctgtgaacactggccaaagggtgagttcttaaaatgctgcaggtgtgcctaagtctgtaaaacaccactaaattctaagaggcagggtttcagctgggagtactcaggcatttaggaatttattgtatcttaccatcctcatttgtttttagagggaagatgcctgatacctagcctttgactgaaacacatattttgcttactctgcgccaattgctgttcctaagtatacattcacttatttaatcttaaccatagctctatgagttaaatgctcatattattgccattttgtggatgaggaaaccgaggcacagagaaattagtgacttgcccaagtcacacggccagcatgaatcctgtttggctctgccagcgtttttctcagaaatgttacatttttgttacagtagctttgttctgaaatgctaagcacctatcttctcactttgtaactagtgtaaaagtttgccaaattattgaagagtcctgtgttctgatgctaatacataaatccagttaaagtaatttttctcctgccatgtgctgtttacttcccaattcaggtttcagacctacttcctgttttttctgttgaataaggttctgagaaacattttccttttgttaaatgcaaaatggctacttggtgcttctgctgctttcacacagtttttttcctccttctagagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcatcagagttcccaggagcccaggtctgtttggttcagcaatagtaaattaagggtggaaaaagatgcctttttaatatggttcctagaagcaagcaagcaacttttcattccagtttgaagaggaggggagcaaaatcacccctggttgaaaactgtgggtctaggttgatggttctcagacttgagcatgtgtcagaatcatttggagaggctgttgaaacacagatttctgggcctactaccagagttcagattcagtagatgtgggatgggacccaagaatttacctttccagcaagtttcctggttgatcctgtaggtctgagaacctccttttgagaaccactggtctgcaaggtagaacctgtcgaagttagaaccttagtggtttccaagttcacctggtgattatatacaaagccctgcatggtccaggcacttcctggaggttcacgtggaataagaggcagtgctggggctggagacccaaccatggctcttcctacctcaccccagtatgcctgctcctacatgtaccctcatgcctcttgaggctgagttttggttggttggttatctcccatgtcttgcccccaccccattcttcctcctcatttaaacctccctttggctgggcacccagtctggtttggtagttctagccagggaagctcttaatgccatttttaattggcacctttcacaggcaaacctttgtgactacttttattttgatgacttaagattttaggccgggcacagtggctcacgcctgtaatcccagcactttgggaggctgaggcaggtggattgcttgagcccaggagtttgagaccagcctgggcaacatggtgaaaccctgtctctacaaaaaatacaaaaaattagctgggcatggtggcatgtgcctgtgggaggatcacctgagcccgggaggtcaaggctgcagtgaaccatgaccgtgccacttcactccagtctgggcaacagggtgtgaccctgtctcaaaaaaattttaaaaataagttttttgtcttcgaagctgcctatttgaacattagaaatggacataggcattacctagctgagtttctaaaggtgacagcaagttaagatttcagttatcattttgacaactgggatcagtagtgagattcttatctcttatgagagaatctcgatagttctaacatgatgagttcactgctcaaaagtctttatgattacggaatttaaaccaccagtttgatttctcttctctcttgattctgcctttatttcttgatgaaaaaaatttttacagcaacttgatctagctttgtgatggtccaggttatttcttaacattgtaaaacccctttcactagaggagtgccttttcatacttccttatagtttaaggcaggttgataaacattatatgaaaattctgaaatccactttgtagatatcttactattttcccaagattttttttagtaaattctaactatcgtggttgaataaaacattaaggctgacatgttaaagggccaaatttcagcctacatatcacagaaagttttaaattatctctaaaaagctattactgtcccacctgaattcagaggttagtcagcacaaaattgggataagagtgatgtctaccatctagaattgtttactccaaccttgtccagtctgcagcccaggatgcctttgaatgtggtccaacacaaattcataaactttcttaaaacattatgagatttaacctcccccccaccctttttttttaatagctcatcagctgtcgttattgttagtgtattttatgtgtgacccaagacaattcttccagtgtggcctagggcggccaaaagattggacacccctggtttagtctatgcctctgcgtgggctgaggactaggaagctgggatagtagcattccacccaggtaacactatcaggcttttcaacttttataatagaacagcagccttagctgttatgtgtcagatttccaaggcatatggatccatccttagcaacatggaacaccaaccttgaattatttgttctccaggtcctcagctgagagatgtggtgtttaagggaaagtactgtcctatattaggggcccattatctttagaatttactcccaggaaaacttttatgtttcccaacacatcagtgtgtttcttcgtttctcaaaatttagcaacaaacatttactgaacacttcagaagaagacagtccctgccccgaaggacctagttgtgtacccagatgatagtagcccaagcagacaagagctgcattagaggtttgttcaggttataggggtaggaagagatctgtaatcctatctggtgagggcggttgtgaaggctgagatgtcagtggggtgtaaggggaacagagaaggcattacagaagaggtgacactgcagctgattcttggaaagtgatcagggttttacctagtatatgagaaagggagggtgtcctaatggaaggaaacagcatgtgccaaaggcacagagacaggggaaggctgacttggagagctgtaagcagggtgtggaagggaagggcaggagatgaaggtagtaaggaaaacatgggttagataaaggccatatgtgcctcactcaagagttagattttagttcattatagtatctactgaatgatttttccacaggatagtgaaatttttcttcattttagaaggactataatgtagacgataagccctgtccacacttttcctgtttcctgtgtctcttctggctgtctgtaagctcagagctgaatttgatcaacagttaaagcaatcagactcattttcatggttgtcctatttattttcttcatcttattactcactttctatttctgtgttgcattcacttcatctgtgtgtcctttgatgtaaaatcacctcaaaatgtttttgggaaatggactataaattaatttttaaaataaaaaatgattaaacttgggtgatatagttgtattaaaatactgtctaaaagccttgaactctcttacagcactatgtaggaggaaatgcagctttaattggacagaaatttgcagccaactcagatttaaaggtaggtcaagtttttagattaaaacctatgcctttccctagtgtttcaataattttaggagcaagaatgagtatctattccttgattcaacttatggatcacctactatgtaccagaccctgggtcttttgttaggaagcagtaatagtaggagatagtagtaactaatactttgagtgtttactctgtgcctgacattgtctttagtgctttgcatagattatctaatccttgcaacaaaccctgtaaggctagtcggtactgccattgttcttcctttctgcatgagaaaacttgaggcacacagaggttcacaactgattggtaatggaatgagaaatttaacccaggcagtctgacccaataacccatgttcttaggcaccatatcatttaatagttaggagcatgtgggccttgagactaaggattatacaagtcatgagggaaaacaacggttggccgtgttggtgagcctggatccagagtgccaaaaaataaaagccactagatgagagtcagtaggggagtgtcttcaagacttaaattgtttggtttaagtagaattaaaaatcgttgccatgttcacagtaacacctgagtaagaagtttctcttgctatgagtagaataggcctgaagggggaggccaacaagaaagttatcgctgttttcctgtataatgattaaggtttggattagagcagccagagaggagaaacatgtatctaaaacctactacaatacatggggaacaaagaagagatttatcaaagatgattatggagtaaataaccttgatcagtgcagaatggttgtggccgctaacactagaaaacagactgtgaacagtcttctagttttgggggaccagcctaaaaatagaaatgtgagtcagagtggtggaaccagaagccagagatgaactcagaaatacggataggtcatcagcagtttcagggaaaaattcatatggagccacactatacacctggagatagatgtgctttcagtttagagaggatattaaaatgtgaacattcatattttaataggaatcaaagttctcatgaaatattagggtagaaaatacttttaagaaagaataataaaaagaaaataaagacttttgcagtcattatgtttataaattgtaattaactcccaaatagagaagattagaaattccagggctgacctttggaaatattaccagctaatgggtggaagaaaaggagattgatcataagccctttagagagagcccaggccattcccatcagaatcccaggagttttcatggtttcctaagaagccaccctcctgatcctgagaaataattctgccctctgggaagacaatacccaggacggtcatggctgagtacaagattgacctttcagtattgacctcccctgggaccagcatttgctcttggtctctggagtagctggtcctgggaccagtctgattggaaggcattctaataaaacaggtctggctttggtaggagactgaggaaagagaagcattctgttactcaatcctcacaacagtcttatgatttcaaagacagaggtctagagaggctaagtaaggtgcccaggggcacctggctagtaaatgatagagtcaggattcaagtgtcaggctctgcctttacttcaccctgtatgcactctcaaagagactcagtttaactttctgaaatgcttctcaacatggactgagagatcatctgagaactacagagattaagaactaggtattttccagaggtggtaattatagctggcacttccttctatagttttttaccatataccaggcactgttttaagttttaggtgctttaaatgtgtatgaaccaatttaaatcttcatagggccctataagggaagtctttttattatccccattttgcagataggaaaaatgaggcatggagaagttaaaactggtgaaaatcacatacctgataatgagtagagtgggaattgaacccaagtagtcaagcttcagaatccattctcctaatagccatgctatattgcatctttgaaatagacgctggtgaatatagtaaaggcaggtttagtggaatgatagaatagaagccaaatttcaggagaggaaccgtgcctttaaaaaatatacttgtgtaatcccagcactttgggaggccgaggcaggcggattacctgaggtcaggagttcaagaccagcctggccaacatggtgaaaccctgtcttagctaaaaatacaaagaattagctgggcatggtggcaggcgcttgtagtcccaactactcaggaggctgaggcaggagaatcgctcgaacccgggaggcggaggttgcagtgagccgagattgcgccactgcactccagcctgggcgacagagcaagactccatctcaaaaaaatatatacttgtggaattaggcaagaattaggaatagttattttattttgtcaaatgcttttgtcaaattctgcatttactgaggttattgtgtggttttttgttttttagtttgatatatggtaattatattgactttcacatattaaaccaaccttgcatctctaggataaagcttactttgttctgatgtattcattatccttttcacatattcagtttactaaaattgtgtttaaaatttttacatcaatgcccaagaataatattggtctgtatttttcttttcttgtaatgtctgtggttttgctgtcagggcaatactggccttgtagaataagttggaaagtgtttccccctcttcaattttttttttttttttgagagacaggatctggccttgtcatccaggctggagtgcagtggcatgatctcggctcactgcaacctctgcctcctgggctcaagccatcctcccacctcagccgagttcctgagtatttaggattgcagacacgtcaccacagccagctaattattttgtattttttgtagacttgaggtttcaccatgttgccaggctagtctcaactcccgacctcaagcgatccgcctgccttagcctcccaaagtgctgggattacaggtgtgagccaccacacctatcttctcttcaattttttttttttcttaagatggagtctcgctctgcccagactggagtgcagtggtggcgatctcagctcactgcaatgtccgtctctcaggttcaagtgattctcatgcctcagcctcccgagtagctgggactacaggtgtgtgccaccatgcccagctaatttttgtattttttagtagagagggagtttcactgtgttggccaggctggtctccaacttctgattgcaagtaatccacctgcctcagccttccatagtgcttggattcatccaatacacctggccctttcttcaatttttaaaacagagtgagtgtcgcattggtattgtatcttccttaaatgtttatagaatttaagccttctagtgaagccttctaggcccagggttttctctgtaggaagattttaaataactgatttctttaatagatatagggaaatccagattttccttttttttttttaaatgagctttagtagtttgtatctttcaaggaatttgtttcatctaagttgttggatttattggcataaagttaattatggtattctattattcctttaagatctctacaatttgtaatgatgttttccttctcattcctgatattggtcatttgtatcttcttttttttcctgatcagcttggctagaggtttataaattttattgctctttttaataagtaattagcttttggtgaatttatttttctctgtttttctattttcattggattttgcttgcttcagatttgacttgctctttttctagtttcttaaggtgagaagctacaatcattgatttgagacctttcctgttttctcatataggggtttagtgctataaatttccccttaagtactgctttagctgcatcccaaagattttgatggattatttttattttcattcatttcaaaatactaatatccctttgatttattgagatgtgccatttaatagcccattcatggactacttagaggtatgttatttagttcctaaatatttggggattttccagatgtctttctgttactgatttctatttcaattccagtatggtcagaaaatatgctttctatgacctgaatcctactaagtttttgagacctttttcatggtgcagaatattctatcttggtgaggttctgtgtgtacttgaaagcttcaagaatatacataagcctttctgttgttgggtcgagtgttctgtaaatgtcaattagatgaagttgattgatagtgttgttcaagtcttctatattcttattggtttttttttttttgtctatttgatctgtcagttattaagaggtatgttgacgtctccaactgtaattttggatacttgtctatttcctttatagttctgtaactttttgctttatgtattttgaaactcttattaggtacataaatgtttaggattgttacatccctttaatgaattaattcctttatcattactagggataaataaaatcatttcataatattctttgctctgaaatctattttgattgaaatagccattccagctttcatttgattagtattggcatggtatatctttttctgtccttgtgcttttaatctatttgcatctttttaccttaaagtgtattttttatagacagcgtatagttggggcttgctttttaatccactttgacaatctctgccttttaatcggagtgtttagaccatttacatctaatgtgattattgatatatcaggttaggtttaaatctaacatcttgctatttgtttgctgtttgccccatctctatctttgtccctctttttctgtactcttttggattattttctatgatttcattttatcttctctgactttattaggtataattctttttttcttagtggttgcattagggtttatactgtacatctttagcttatcacggtctactttcaagtgataacaggcatacctcagagatactgcatgtttggttctagacgactgcaataaaacaaatactgcaataaaataaaacgcatgaattttgtttcccagtgcattaaaaggtatgtttacaccgtactatcgtcaagtaagtgtgcagtaccattatgtctgaaaaaaagtgtacacaattttagagtgcttggttgccaaaaaatgttaacaatcatctgagctttcagacggtcataatctttttgctggcagagtgttttgccttgatgttgatggctgctggctgatcagggtggtggctgaagcttggggtggctgtggcaatttcttaaaacaacaatgaagtttgccacatcagttaactcttcctttcacaaaagatttctctgtagcatgtgatgctgtttgatagcattttacccacagtggaacttcattcaaaattggaatcaggccaggtacagtggctcacacctgtaattccagcattttgggaaaatgaggcaggaggatcacttgagcctgggcaacatagcgagaccccatctctaaaaaaaaattttttttaattagctaggcatggtggcgcatgcttatagtctcagctgcttgggaagctgaggcaggaagatctcttaagcctaggagtttgaggctactgtactgtgagctatgattgtgccactgcactctagcttgggtgatagagcaaattcctatctctaaaaatgaaaaattaaaaaacttctaaaaattggagtcagtcctctcaaaccttcctgctatttgtcattatcaactaagtgtatgtaatactctaaatcttttgttgtcatttcaacaatattcataacatctttactagaagtagattccatctcagccactttctttgttcatccataagaagcaactctttatccattcaagttttatcatgaagaatacaataattcagtcacatcttcaggccccacttctaattctagttctctggctgttttcaccacatctgcagttactgcagtttactgaagtcttgaatctcaaaaggcgtccaagagggttagaatcaatctctttgaaactcctgttaatgttgatatgctgacttcctcctataaatcataaatgttcttaatggcatttagaatggtaaattctttccagaagttttcagtttactttgcccagatccatcagaggagttattatctatggcagctatagccttatgaaatgtatttcttaaataatagacttgacaaaattccagccaggtgcagtggctcacgcctgtaatcccagcactttgggaggccgaggtgggcagatcacttgaggctgggagtttgagaccagtctggccaatgtggttaaaaccccgtctctactaaaaatacaaaaactagccaggtgtggtggtgcacacctgtaatcccagctactcaggaggctcaggcacaagaatcacttgaacccaggaggtggagattgcagtgggctgagatcgtgccactcactatactccagcctgggcgacagagccagactgtctcaaaaaaaaagtcaaaataacttcttaatttatgggttgcagaatggatgttgcattagcaggtgtgaaaacatcatccttctccttatacatttccatcagagctcttgggcgactaggtatactgtcaatgagcagtgatacttcaaacatttttttttttttttttctgagcagtagttctgaacagtgggcttaaaatacctattaaactgtaaataggtatgctgtcattcaggctttgttatatatatagaacacaggcagagtagatttagcatcatacttaagaatcctaggatttttcagaatggtcagtgagcattggcttcaacttagtcaccagctgtgttagccccaaaaagagagtcagtttgttctttgaagctttgaaggtaggcattgacttctactctctagctctgaaagtcctagatggcatcttcttacaataattttacgtacttcttcagcattaccctccaacagaaggctgttttgtatacatcgaacctgttgtttagtgtagccatgttcatcagtgatcttagctagatcttttggataacttgctgcagcttctacatcagcacttgctgcctcaccttgcatttttatgttgtggagacagcttctttccttaaacctcatgaaccaacctctgctagcttctgacttttcttttgcagcttcctcacctctctcagccttcatagaattggagcgagttaggacattgctctggattaggctttggcttaagggaatgttgtagcttgtttgatctgctatccagaccattcagactttctccatatcagcaataaggctgttttgctttccttttgttgctgttttttgtttctgttttgttttgctttcttacattcgtatgttcactagagtagcacttttaatttccttcaaggactttttgcattcacaacttggctaacagcataagaggctttactcagctttctacatgccttcgtcgctaagcttaatcatttctagcttttgatttaaagttagagatgtgtgattcttccattcacttgaacacatagaggccattgtagggttattaactggcctaatttcaatattgttatgtctcaggaaattagtgaggcccaaggagagggcgagagatgggaacagccagtccatggagtggtcagaacacataaaatatttattgattaagttcactgtcttatgtgggaatgatctgtggtgtcccaaaacagttataatagtagcatcaaagatcactgatcaccataacagacataataatgaaaacctttgaaatgtgagaactaccaaaatgtgacagagacacgaagtgagcacatgctgttggaaaaatggtgcccataggggaccacagggttgccacaaactgtcaatttgtaaaaactgcagtatctgcagagcacagtaaagtgaagcacaataaaatgaggtaggcctgtacttctctccctccaatctttatactattattatgagatatttgacttcctcatgttacaaacctcacattaaatttgttagtacttctcttcagttatctcttaaagagatttaaataataagaaaaataatcttatgtacttatctagcattaccatttctgttgttcttcatttctttgtttagatccatatttttggctgggtatggtggctcacgcctgtaatccggcactttggaaggccaagacgggcagatcatttgaggtcaggagtttgagaccagcctggcgtggtcaggttgtttcagccaacatggtgaaaccccatctctactaaaaatacaaaaaaaaaaaaaaaaaaaaattagccgagtgtggtggtgtgtgtccataatcccagctacttgggagtctgaggcaggagaatcacttaaacgcaggaggtggaggttacagtgagccaagatcacgccactgcactccagcctgagccacagagcaaaactcttgtctcaaaaaaatataaaaacatatttccatctcatgtcattctcccttctgccagaaggacttcttttaacattgcttgtggtgcgagtctgctggtgataaattctttcaggttccgtatacctggaaattcttttacagtaatatgctaagacatttgtagggcttactaagtttattcctgtttccttttttttggagacagaatctcactttgtcgcccatgccagagtgcagtggcatgatcttggctctccacctcccaggttcaagtgattctcctgcctcagcctcctgagtagctgggattacaggtgtgtgccaccacgcctagctaaattttttgtatttttggtagagatagggtttcaccatgttggccaggctggtctcgaactcctgacctcaggtgatctgcctgtctcagcctcccaaagtgctgggattacaggcatgagccaccacacctggccagtttagtcctgttttttagggatcgtcctttattgtctgatgttcacacaatgttttgaaaaccattgtttcatatattttgtcttttttgttgtttcaggcaggagggtaaatatggcctatggcccttgttgtctcatcttggaagtgaagcactagccaagaattagagaaaggaagtaaagtggttggggcaagactttttcagaattggcctgtaatgggcatgtgtcaaggcagaaaagggagaggagtatgtttttatccagaaggtgggatttcttaaataacacgaaagtacctctgtacaaagcagtctatataagcagttaattagcaagttaatgccttttgaagcttctgggtgggacatactaaatctgaaacagaccgagtatgttagctcatgcctgtaatcctagcaagttgggaggctgagttgggaggatctcttgagctcaggagttcgagactagcctgggcaacatagtgaggtcttgtctctattaaaaataaaaataaaaaattaggccaggcgcggtggctcatgcctgtaatcccagcactttgggaggccaaggcgggtggatcacgaggtcacgagattgagaccagcctgaccaacatggtgaaaccccgtctctactaaaaatagaaaaattagctgggcctggtggcacgcgcctgtaatcccagctacttgggaggctgaggcaggagaattgattgaacctgggaagtggagattgcagtgagccgagattgtgccactgcactccagcctggtgacggagtgagactctgtctcaaaaaaattaaaaataaataaaaaattagccaggtggtgtggcttatgcctgtagtcccagctactcgggaggctgaggcaggagggtcgcttgagcctgggaggtcaaggctgtggtgagctatgattgcaccactgcactccagcctgggcaacagagcaaaactctgtctcaaaaaaaaaaaaaaaatcatgaagcagtgctgataatctctgtggactttcctttaaatctcagtgccgtcctcattgttcagtggttttgaatctgctagcctggccttgaatgttgtgtcaaaaacagcggtttattggagttgaggagcaggaacagatacgaaatggcttctagaaagaatagccagagggaggctctggttggagttgaagaaaaaggttttggaaaagttgcagagcaccttcccctgaagtctctcagttgggatgctctttaattctcatattggaaaggctgtcctattcacttaacagttcagtaatgggagagaattttattccacaaatgaggtcacccggttgaggatatggtgatccagaaactttttttatactgtataaaaactcaaacagttttcatctggcagctttgttgcagacaacatcccatgtctgtttgcctgcacaaggtgtgagtgagtaaagaaagtgggggtagggtctgctttggctgccatagtagcacaataccatagacttgggggctcaagcaacagaagtttattttctcacagtggagactggaaagccccagaacaaggttccagcaaggtgtggcttctggtgagaagtctcttcctggcttgcaggtggccaccttctcaatgtgttcccacatgtcctgtccttggtgcatgcggtggggggagagagattgatctctctctcttttcttataaggccaccagttctatctgattaggacctcacctcacccttatgacctcatttcatattaattaccttccaaaagccctatctccaaataagccacatgggggtttgggcttcaccatctaaatttggggaggtgacacaaacgtgcagtccgcagcagagggaatgagatgtagcagctgcataggtgcctgacggctgtgacacagttcttttgtcagcctctcagttctgggtacattatggccataccctccagaggccttagccctggtgacatgccttctgccgcacacctccagaccaacagctttcaaaattagatttggattccaatattttgttgaaatgattagaatcagcctgaatgtactgtcctggggtgctgttgaggttctgtggggaaaggaacggggctcctgatggacttcgtgttgcttgcctccaggttcttctttgcggtccagttggtccaaagctacatgagcttcttgatgacaatgtctttgttccaccagagtcattgcaggaagtggatgagttccacctcattttagagtatcaagcaggtaaggaaatgagtaagtaatggtggcaagaccagtcaaggggctgtgtattgtcagattggggtgtgactgtgccggaaatttatctttgtaaattagcaggatcctgtttttgccatactgaaagtttcctgacctattggttctactgagctgatactggccgttgtctcaagggagactgagtattataacatggaagaaaattcccaggtctacaagcagaattgctccgaacccaagataaatcaggtcataggaaagcaagcatctcaaataaaagtgaaaacgtgttaaacacacatatataaagttttcctttatgactaagacaagagaaaggcaggtagcatccattcaactctgtgctggattctgccctaggcctttctgactgactcttccaagctgcttggggttgattccaagcttctggcaagtttctctggagcattttatttttccttgggtgtgtgaatggaagtgttttgtatttaacatcactatattgtttcccatcagatgttctaatgttaataaatccacatccactgcatcccatcccctcttcccagcagattttatatgttacgtagattaggcatctggtttctgagagaatattaaatacttggacatactttgatcctgtgtatttcctgctgtaattttccctctgctcagaactcagactcttgagtttctgattcaacacattgttaatacacattaaagactcaagcatctaaacagactaattggtaccttaaagcagcacttaatactcttcagtgaactacttccaagtcaattaagagaatcttctctactagagtaattaactttaacataagatatgaactatgttatttcttgagaattatgcctttctccaggtagaaaaaagagttgtaacatgttctggttctctttcgggtgcttactagaatcagttgggaattaaagaaggatagggtctgaaaattagggacacagcgttgacgtaggcaattcatacttaatgctacacaagtttttgagtttctcagctttagttttcccaaatgggaagtaagagtaatagtttttactgcctgatcattgtggtaaggattaagagattggttggtgtgcggaaacattgtgagcagcttggatgaaaagatgacctggccgcacgtggtggctcatgcctgtaatcccagaactttgtgaggctgaagcgggtggatcacaaggtcaggagttcaagaccagcctggccaagatggtgaaaccccgtctctactaaaaatacaaaaattagccaggtgtggaggcgggcgcctataatcccagctactcagtaggctgaggcagagaattgcttgagcctgggaggcggaggttgcagtgaactgagattgcaccactgcactccagtctgggcaacagagcgagactccgtctcaaaaaataataataataaataaataaaagaatgacctgactgtggactggaagggtctggaattgctaaagatgagcccctgaggtattgctgccatgagttccagattcgtgtcagtttttttggcacccacagcaggaactggggacctttgtgattcctggtttgtcatttttcctggtgactacagagtggagagtcttacgtcttcagcaagactttgatgttgtattggacagctgtgcctcgtatgtagttaaggagacagcacagttcaccgcacaaagagagtgtctccatccttgggtttataagcttcacacttcagtttttctttcctatgcctcttctgcatacaaagcagtggacttccattaaactttgtgaggtgacattttcctaggtccaaggagggagcctagtctagtggcagtagccctgggctcagctctctcaacagaaatccattcccagcttgtctctgacctcaatagggaaattccaagggatttgtccatttttttttccacattctctcttaccagatctccccagagaagcccattgtcaggcttgggctgggaatccagtgagtcactacgcagaggttttgctgacttactggctgagggcaggatgatacattgagaagagattgcttacaggaatgaatacaacactttgtgaggaaagaggggcgctaactaccattacaggcagaattagatccatttgcatctgccccctgcatggcctctccaacggggccatgaatatgctggaggtgtttgtgtctagcctggaggagtttcagccagacctggtggtcctttctggattgcacatgatggagggacaaagcaaggagctccagaggaagagactcttggaggtaatggcactgttacagaatttcacagatctcagctggtggttttcttcaggttccagcctctcttggcatctgctgccttgtttcctgtggaaacagcaagcagctctgcacggttcttctcatccttgccttgcagaagagcctgtttatttttgcctctgtcacttcctgaagaaatcagtgtattttcaatacagtgtggctcctttctcctaggttcagttaggtcgtgtttcctagcagtgtcactattcaagggttgagtccacgtcttgctctctggagaatgtcaatgtaatgtatttttcccatcgtacagagtctttgttgatttgcaaaatgttggatttggggttcatacccatattttttgttgtcatgggcatttaggtcatcagtctgttctcttatttgcttgttcttttgttaattcattcccatggctatatgccagacacagcatgatgcagaaggaatacgacagaggatgacacaggccctgccctcagctcacagtttactgccagagatagacacttggaaaaagtaattgcaggccgggcatggtggctcacgcctgtaatcccagcactttgggaggctaaggcaggcagatcacctgaggtcaggagtttaagaccagcctggccaacatggtgaaactccgtctctactgaaaatacaaaaattagccaggcgtggtggcgggtacctgtaatcccagctactcgggaggctgaggcaggagaatcgcttgaacctgggaggcagaggttgcagtgagctgaggtcgcgccattgcgctccaacctgggcaacagagtgaaactccatctcagaagaaaaaaaaaaaaaaaaaaggaaaaaagaaaaaggaattgcaaaatcatgtgcctcagtcctgtattagggtacagtggtggccccagaaaggaggtaatcaagtctgcttaggggtggtaggattaggaaaggcttcatgtttagggaggaactagcacttgaacttgggtctttaaacagtcattcctctaaagcaactcacatagaagcaactggagcagctagatagtctgatcctttggatcaggtgcccagaaaccactgatgggcagcagggaagaggagatgcagtgagcttggctgttgggaagaaattcagcctgcttaagttccaactgaatgaaagatgctcagggcaatgctgtgaggaagaatgtgctttaaacaatgacagcctatactgtctgcagggcgtgcgtgctgcacactgtatgctggtatttggaagtcatgctgccattctgtactgtctctcctgtgtttgagagctcaagtagggctctcctgggactcagggggagctaattaccttgaaaaaggcatatagcacccatactatgtttctgtttcttggctgggtttgggtttaggtttttggtttgtttcttgcagtgccatgctgaccttaggccattgttgctggggtctcctcagccagaaaccagcctgcttggagccaaggctcctgtgaggtgcctgaaagtgcccccacagctaggagacctaaagcctcttccttttcttcccattgtgttgactgggtttttccaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggtaatggcactgttacagaatttcacagatctcagctggtggttttcttcaggttccagcctctcttggcatctgctgccttgtcttaggtcctggcctcccagggacatatcttggcagctggctgtggagcttgcctcctgctgcagtgaggcacctcactgtatcccttcagatgtgggcagcagcttgagtaggacagggcagaacatcttcttgcctgagcctctgcatcctgtgctaaaccgaccatggctgcaagctgcagggtttgtagtttgtgtcctttgtgttatttgtatcatctcacttcacatcagctatgctgcaactcctacagattcgtacagcagtcgaagtgaactgccatctctgattctgtatccctgatggctctgcacagcctagtcttccctggtgggaagagtgtcccttgtccacagaggtggtggggacccacattgcttgtagctcccgtgagcatgcaaagaaggccattaccaggaggaaccgcctctcaggatctgatcttttcttccctctttcttgacttccttctatttctaatggcagtgcttatcttcttctctttgcaggttgtaacctccatttctgacatccccactggtattccagttcacctagagctggccagtatgactaacagggagctcatgagcagcattgtccatcaggtaacctcatgggaccatcgtttggccctgatcctcatagagccttgcagagaagcttttttgtgcagtgggaccatctgtttgggctcagggactggctcactgacatgtaggtttgtgtcactcagacccaagtccatggagatccaaataaggatccaggactgttctgaaacagcagtatctcctactaggttaaagttatggcagtgtaactgacagattgttgatcatatttctcctctggaatggaaaagttgaaagtgaatggaaaaaactgaaagcccagctcagctgctttcagttgaacttcaagaagctcaaagcaaagaaactttgagggaacctccctccttcctcaggcatctgggtgttcagtgcctgcctctgggcagcagcattgactagtataaatctgagcaggtgaagcttcagaacacaagctctggagacctgggttcgcatgccagccttgcactcacgggcttcatgaactcaggcaagttacctcacctggcaatctagtgttacctaattttaattggtaatatattcatttggttaaaaaatacccaaaaactatgaaaagatatacaatgaagtctcccttctacttcctccccttccctacttgcacccttcatcagtttatttccagagttcttttgtacaagtataagaaaatacagaaatatatcctgattttgttttccatccctttttacccaaaaagatagcatagcctactgaatactctgttcttcactttgctctttttttcactaaatatatcttggagatcttcctgcatcactaacatggagagtatcctctgtcttttcatagccatatggttaaaatgaatgtgtagatgtacctccgtttacttaacctgaaccttctggatggacatattggttatttactgccctttgctgttacacacagtgctgcagtgaacaacttgatacatgattttgttttgcctgtgaacaagtccatatttaggagaaagtctcagaagtagaacagctggactggagcataaaaaagcacttgtaattttgagattgccagattgccctccataagaattataccagtttacttcccactggcaataattacaaatacttgttccctcatatccttgctaccagaatgttaaaatttgcatttatatcagtctgacagatgaaaaaatggtatttcagtatacagtcatccctcgtcatcagcggtgtgtggggcggcgggggcggttccagaacccttcccagatactagaatctgcagatggttaagtcctgcagttggccctgtggaatctgtggattagacaagttggccctccctatctgcaggttccacatccttgaatactctgttttccatctgaagttggttgaagccatggatatggagggctgactgtcgttggttttgttttttttttttttgatagacttcattttttttttatggtaatattaggtgcatagcaaaatagagcagaatccaagagagttcccatatacttccagtcccctcacacacaagcctccccaactaccagcagcctgcaccagagtggtacatttgttaagctagtgagcctacacaggcacgtcatcagcacccaaagtccatagtttacacttgggttcactcttggtgtttttcagtatagcttttgtttgggtttttcttctcacctttaaaaaaatgagccatttctatttcattttctctgtaactgtctacttaacccttctgaggcttagtctgtacaatggaggcagtccctccttccctcagaagattacagtaagaattggatgaaataaagcctttagctcagtgcctgacacagaagaacatgcagtgaaggaaagctgctattgctccaacaaagatgtaggccattaaatttttaaaaccattttatacatgcacacatacatacaaggactcctctctcctgcaaaaattgttaccttaagtgtggttctctggttctaaggagggaagtgctaagtaagaaagacagggaggtggatattgtggttccccatcagacagaaaacacgggcacctgtttggtaatctttttcttacagtgttattgctaaattcagacagtcttcctaacccacacctgcttttaaaaagcttagctctaacatgaaactgtatgctttttgcttcttggtgttttgtataaaaaaaatcattataaccctgacagtatgttgcttgaggtctccattttactggtctaatactgctgacattcaggaactgagagccatgccccatcagtggtaagagtatctcctatgtgtgcagtggcaaaagctagggaccatggaaagaaacacaaaatatagacacctctgccttttgtcttacagtggcatatcacaaaagactgcatctgaaacaatgttactgcagctttccagtttctcccaaatgatgatgaaggtgaagataggggtgtgatagctaaaacagtgacttcagggccagggagtcctgtatcaaggaagaaagctgcctgcctgtgttccctgtcatttagtcactggctgtgtcataagacatcttaggagccaggttatctccatcagaaagatacctgttgttgtttttgttagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaactgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttcagg

SEQ ID NO: 38641 - DNA, 6868 bp, Homo sapiens
aaagtgccacggtggcggtggtggcggccgcgaggccgagtgtctccggccctgccagcctcgcaaccgtaacctgtaatcccgacccgagggacgcccgccggggaggcgccagcccgcctctccctgcggccgctggtcggctccgacctcgaatcacccggctcacccgcgggtcgcagcacctgccggatgtggggaggaagaaggaggccagatgagggaaggcggatgtaggcgcccagtctgtccgcgccttggtggggcagctgggtgggcaagcctgcggtcgctcccgggaaccagccctgggctgcggggagacgaaggtggttggtcctgccctccaggagcgccccgacatcgacgtaaaatgacttggcaccagagctcctgccgcctcccccttatgcagctgccctcgccgacgccagggactgtaaaatcagatgggacagggcctagccgttcagccaacactttgagcttcccagccaaactcctacccccactccccgcctccggtcctcacccccttcctctctcccagcctcggtgtctggttacggctcctctgctcgcattgtgactttgggccaggctgggggaaatgacccgggagggtcccatgcggctacataaaattggcagccttagaactagtgggaaggcgggtgcgcgaagtcgaggggcggagagagggggccggaggagctgctttctgaatccaagttcgtgggctctctcagaagtcctcaggacggagcagaggtggccggcgggcccggctgactgcgcctctgctttctttccataaccttttctttcggactcgaatcacggctgctgcgaagggtctagttccggacactaggtgagcactctgtgccccaggccataagcgaggcggcatcagcccccccagttctcaccccccattagcagcttcttacttctggagccacccattctctttgggcaaggatgctcaggggccagggatcggagtcgggtggtgcacggaagtggtgctggtggtgggtgtgcgtgcgcctgagccttatcaccctttcctcacctctcttcactcccagccctcccaagaacagcccaactgattgctaactgccataactggataatccctagagggtcactaggcctgtgtgttgggggaggctacttggtagcaggggagggggcgatgctagtgtcatgctttggtacaagaagcagtgaggttggtctttcggcacaggccctgtttctgacctcctgacctggcttcccttcctggcagggtgcccgaacgcgctgatgccccgagtgctcgcagggcttcccgctaaccatgctgccgccgccgcggcccgcagctgccttggcgctgcctgtgctcctgctactgctggtggtgctgacgccgcccccgaccggcgcaaggccatccccaggcccagattacctgcggcgcggctggatgcggctgctagcggagggcgagggctgcgctccctgccggccagaagagtgcgccgcgccgcggggctgcctggcgggcagggtgcgcgacgcgtgcggctgctgctgggaatgcgccaacctcgagggccagctctgcgacctggaccccagtgctcacttctacgggcactgcggcgagcagcttgagtgccggctggacacaggcggcgacctgagccgcggagaggtgccggaacctctgtgtgcctgtcgttcgcagagtccgctctgcgggtccgacggtcacacctactcccagatctgccgcctgcaggaggcggcccgcgctcggcccgatgccaacctcactgtggcacacccggggccctgcgaatcgggtacgcatggcccggggcccccaccccagcacttaggtttcctagaggcactgctccccgacccctgacagcattggtctctggccagcagagcaaaaaagataaggctatagaggcctcgagtccagtataaaaccctgctctcgctactggttcataaaagctgccaccttaaggtgggggtggggggtggagtggagtgggagtcccgggcttcgtcagcaagctgcattcgctgaaccacgtgaaagctccagagctggctggcagggagagacaggtcctctgagggcgcaggcacataacctatggtttgctcagagacccccccgacttttcccagaccagtggagtccaggcagcaagacgggttcctgtgagatgcaatcacgtttcattcttagagcagtttgttcacccagtctccccacctctctgctttctcctgcttttagggattagtgaaggggagcgggaagttctttctctatccctggggactggggtccattcaggcctctagctttccttggtagctttagtaactttcacttcctgagcccgggctctgcgtctggctcggctggggcagccagaaaacaaacaccccgtgggggtcccagcaatttcctccactcctgcaggcttcctgcctgtcgcacaagtccagcttcaggttctctgccttgccgcaggactcccccagggggtactgaggagggaacggctgcttttcctcctttgggaactgggcctgtttagaaaaggggaagggggatctggaaggttttgattacaggcacgcaggaaaggctggggagggtgaaatgaggacaggggagcagttagggacagagtggctgccaagctacaatgtagatgtgtgtgcttgtttgtgcattgggtctgcatgaggttctatgtgcacatgtgcatgtatacctatctccacgtctgcgtggtacccttgtgtgtaccagcatccatatctgtgtgtacctgtgtgtgtcacggtgtgtttatggatgtgtatttacctcagcatatattgtgttctgccacaagcatgtccacaaaaatttgtgtatcatgtctttgccagactggatgcctttgctgggccatgctattctcagacctcccgccttcacccccagggccccagatcgtgtcacatccatatgacacttggaatgtgacagggcaggatgtgatctttggctgtgaagtgtttgcctaccccatggcctccatcgagtggaggaaggatggcttggacatccagctgccaggggatgacccccacatctctgtgcaggtagactggtgggagaggcttccctcaggcagcccagggccctccagaaggaccctgctgattccttgcctggctccagtttaggggtggaccccagaggtttgaggtgactggctggctgcagatccaggctgtgcgtcccagtgatgagggcacttaccgctgccttggccgcaatgccctgggtcaagtggaggcccctgctagcttgacagtgctcacacctggtaaggggattcctgagttctgggggttggggggatggtgctggattccagttgtgaatgtgtaagaaacagaccatgtgtctgtatacacaagcatagccttccgcagactgggctatgtgggcaccgacagcccctctctcctgttctctcttctttgcccatgtgtgtttgcagaccagctgaactctacaggcatcccccagctgcgatcactaaacctggttcctgaggaggaggctgagagtgaagagaatgacgattactactaggtccagagctctggcccatgggggtgggtgagcggctatagtgttcatccctgctcttgaaaagacctggaaaggggagcagggtcccttcatcgactgctttcatgctgtcagtagggatgatcatgggaggcctatttgactccaaggtagcagtgtggtaggatagagacaaaagctggaggagggtagggagagaagctgagaccaggaccggtggggtacaaaggggcccatgcaggagatgccctggccagtaggacctccaacaggttgtttcccaggctggggtgggggcctgagcagacacagaggtgcaggcaccaggattctccacttcttccagccctgctgggccacagttctaactgcccttcctcccaggccctggttcttgctatttcctggtccccaacgtttatctagcttgtttgccctttccccaaactcatcttccagaacttttccctctctcctaagccccagttgcacctactaactgcagtcccttttgctgtctgccgtcttttgtacaagagagagaacagcggagcatgacttagttcagtgcagagagataggtgaggccagctcgagatcttataccactctgtattggacaaaggctagcacagggctaggcaccaataaagatttctaatgatgcacagacagtttatgcagatgtgcacatgaaaactgaatatccctgggaggcctcccacactaacagaactctggcttccagaagctgcagggcctgctctctaagcacatgcctgccagatgtacaaagagaaagtttgaacttgggcctatcccgcctttgagggagggaggctggagccatatggctggagggaagttatcttccccgtctgccctccattggggctgatatacattatctgcttctttgctcatcttattccaaacccttccccaggccagaatggggaacagggctatgtgggttggcccccaaaatgaaagcataaactggatagaggagggtggaagtttggtcacctgtgtggtccatacccttccccagctcccataggaatctacccatttcctgcagaagccagagtcatggtaaggctgtttcctatctgccccaattgtgacctgtcctctctggcttggggtccccaaatctctttcctcattctccttacctatcccagggacactggtgagactcaatgtttatttaatgattggaggaaagaatgaaagcataagtcagcgaggccgaggcgctgtgtgtagatggcgacagcctcctacacgccagggctccacccggatcctggcgccactgcgggagggcctgcccttggctcagcgtcagagtttgtcctctggggcccaacgcagggagcctggccacatgggaggggtgtggtccggaactccaaccccaggtcctgcttggccgcccctcccgcggctacgcactactccatctactgctggcttgccccgggtccttaagccagcgacagtttttattgccgaacccaggctggaagcgggcggccctaggagccgcgcacaacagcgcaagcgggctggataccgggagccgattccagggcgcccacagaagcagaatcagaggggtaggcgggggtggggcgtgctgttcggcgctgtggccaaaatccgcccggcgctgaaagaggggacgtgggtgtgagtcccagcatcagccagggaatccgcccctagcttgttcttcgcccagctgggctccaagacgccctctgcgggcccatagctcctaccgcgtccacctgcagagcagaggctcctcaccaaaagccccaccccaccggagagggtcacgcaggtcccggggaatccgcactccttaatcgcgttagccgactttgtaggtgttcaggagcagcctcctagcagcctcagttttcccctccccgccctgctggttcaagcaccacagcctggaatgggagaactgttgtccaccgccccctccctccccgcaccccgcctctgctgcagcggacccgctttaataatgtcgctggaaagtgacacgcgatttattattaaagtaatgcgggcgcagggacgggaaaggtttaataaacgtgctgagatgccgaggattattcaccgcaaataaatgagagcgcgggcggcgttttaataaataatttcccgctgctcccgggggaaggcaggggagggggagggagggggagggaggaggagggggaggctgagccgctgccagaactcccggtttcgcctgcccacgggcttccaagccatccccgcgttttgtgtcctaggttgctcacacccgagatgtgaggttccaggagcgccgacccagagttgccaggcctgaaggcgggagaggctcagtcgcaccctacatttcccacctccaagattttaagtatagttcgcttgaaatccctggaatgcgctttcttctggctcctacccggagatccggagtccggacaaaccggggcaggaagggtccgtcggaccagctcctcccaagccgaggcttccaggtctcggccgggctcttctccctgcttttagctgagccgggctgggcgtacctctctcctccatctagagcagggtgtgaagaggaagccagagggggctgtctgaaaatgaccctgaccccctcctcgggctgtcgtgaggaggagggccgcttcgcccggctgctcgtcaccgcgaaggctccaaagaagtgttgcgcagccgtgctggtataactgagggtgtcctggcgaagcccagcccctggcgccctggtgaccgggggggtcgatgtgcggactgggcagaactggagcccgaagctggagagcgcccctcaaaaagaagcctggaagcccgagagatgaacccgactcagagagggccaagactgcagaccttggggaccgaggacaccctcaccacgctggtgggggctggggggatggcgcgggcggtggcgtgcggggaagcgcctggggaacacctggctctgcaagttttgtgccttagcggaaagaggcgacatctctggcaagttgggagtacaggaagtagcgaaggagtgccatctggtggatccttctggtagtgacactcagacctgggccaggggccttgagacaatttacttgactggaaaaatct

SEQ ID NO: 38642 - DNA, 176771 bp, Homo sapiens
gcgccgggccgggccgggcagggcgcgggcggctaggggctccgagagcggcggccccggcccgcggccccaccatgccccagctcggcggcgggggcggcggcggcggcggcggcagcgggggaggcggcggctccagcgccggggcggccggcggaggggacgacctcggggcgaacgacgagctgatccccttccaggacgaggggggcgaggagcaggagccgagcagcgatagcgcctcggcgcagcgggacctagacgaggtcaagtcgtccctggtcaacgagtcggagaaccagagcagcagctcggactcggaggtaaggaagcaccgcggccacccccgggggatcccggccctgcgtccgctcacccgctcttgcctttgtgtctcctccgcaggcggagaggcgcccgcagcccgtccgggacactttccagaagccgcgggactatttcgccgaaggtatgtgcccgctgggacagccccccactctcgattcccgctgcgctccgctgctcagcccgggcggcccaccgtcccccttgcttgggtggacgcacccttgccctccgcctttattggcggcagcccccgtggggcgcgcgtggggggcgctggggtccccagctcccgcctcgagccccctgccgcggcgctgtcagtcccgggggcctgggcctcacctcgccttggtcttgttcgcagtgagaaggcctcaggacagcgcgttctttaaaggacccccgtaccctgggtaccccttcctgatgatcccggacctgagcagcccgtacctctccaacggacccctgtctcccggaggagcgcgcaccgtgagtgcccgtcgggcgcgccggggagggtgggaggccgcggcccgcaggatgcgcccccgggcttggccatggagtgggggatggggccttctgcgccgatcccaagcagaacttgtttgcggagttgaactactctctggcggccgagcgcgaggctgcgctggccagtgcctggatgaaagtaaagttactttaacttttcccctcttgcgggttgaggttttggagtccacctctgggatcttccttggcctccagaattcttcgcctgcaccgaaggaaacttggatttgtgcccgctttgggggggtctcgctttccttcttggaaatcggtcagctttctctggcagtggggcaaggggcctagggagctgggttggcgacgttgtcctccgactccgggttcactgggcggctgcaggctggttcctaagaaacccagttttcgtggcgggttattcacagcccccgttcccacccccagccctcgcaccggggcctcagcttttctgcggagctagctccgaattttaaactcgcgtagatgatttcgaggcgacccaaggcattcttcaagttgaggaacttggctttttcccccttttgtcgcctgcttttctcatttaaagcgagcgctgcgacactttaaacctgttaatgggcgcgtattgtgtgctgcccgctggcatttagagcggtgattaagcaaattgaccgggccccagacgacgtgcaaatgagggcggattccttcgccccctctctctggctctaaactcccgccccccgcgttgcgaggggcgcagctgggggctggcgaggcctttgtgtcccccaagccgccactccacccctaggctccctgcccaggtgctgggtccgatgacagatgttgggtgaacgcctacctactgtgtgccaggttcccgcgtgctgctgcttgggcgcgatgtgaatcgtagtagttctttgcttcccgcccagattcccattgcctgccacttcgctgtcgacggtgggtaagggggcagggagtgttagcctcttaggagcagggtcccagcaacacactttatgctaagactgccctaaaataacgacgataattaaagggtgctagagaaaggctaggtgctgaatggccattcctgctgtcattgtacagcggtcggtggagagccaagtcctccacatttggttcagcgggggcgctaccatcaccagatgggttggagggggattgacggggggcggtggaagagactctgactgagagagaggggaatggggagtgggactacacagacctcacagttttgccccgagagggagggaggtcttgcagctttggccctgctggcctggagcaccccaggaagtcctgaatgtaagtgtcagttttgcagtgaaaactggatgtgggtctatggctgttgctttttctcattaaaagaaaagaggtgcgtgccaatcaaagggggggggggatcaacgagctgctgcggtcttatttaggttttcagtgattcccaccagtgcccacacatgtagcttagttctgcaagttttgttgggattcgtgtaactttgcgtatgggggagagttaatgccgctaaagtctcaggtttccatttactattaggatatctagagagaggggtctgggaggcactagcatctgtgcatcagccctcagccaagtcctgatgcagttaaagtcaccagaaatgactatttcaccatcaaatatgactatggctccctcaaggctatttctccatgcacccatttctctttagggcattttgattcatccaggctctgctgtctgctctctctgacagtccaagtgagacagatttttgttagtgtcccctccttccttccttctatcacattatgtgttctttcgcctaagaacttccaaaggctgattcttgctgatcctggagattcctgattactaaatccaggcccgtgtgggattttggagcccctccttgaggcagccaacctttcgtctctgcatgcctctctgactgtccttgttcatctctgcagttgttccctgccctggcccaggcaccagcctcctttcaagcctcctaggacatgtactttcttggggacttagtatgtcccatcccacccccatacctacatcttgtctccctggtgacttgcccttacagaagttagttcagttcccagtgtttctgtgtctctgtgtgcctttcgctgtgttagttcacggatatactggggaagtgtcctgcccttaggtcagcacagttaaacctaatttgaccctgttcgtttgctgccagtaagtaaagcaagtgaggaaacacttaagcacttggttgtctggactatagggtggagatgatggttttctgctgaacgattctattaatataattaagataattgtcactgtaggcaaatggtaggtacagacaaagtggccctctgttggtttcccagcctggtaaaatgaatgtggatagatacgagtggggagggaggagggaggaaagtgcctgggatatatgatccgatctctctgacatcttaggtcttttttattgtttggcctctaaactgcaccactttaggctttgctgctctaaggcctagaggtagtataaaattaggtgaccccagttatctgctgctctaacacttcctctggaaataccaagccagatgcagaagtgggaattgtctggattgttttcagggtgttaatgaaccctaggaatagcaggcaggaggcttcagcagcctcacccactggcataattcctgctgagaccactgggggctggcccatcctacagtctggccatctctccccatgagccatcacccttgccctccactctggtttggctgggatgctgggaagtggctttttcctgaggctctttagagaagaggtcccctcagcatgggatgtgggccaagtctctgtgagctgcaattgcttcttgtctggaggccctgggaccctgtgaagagaggaataactgccacaaaccatttttcaaataatcacctcaaaattatacattcatttctgaaaaggcttcacggtttactaaactactttggggctgttgcctagaattttgttaggaaaatgtaagttggctgggtgcggtggcttaggcctgtaatcccagcactttgggaggccaaggcgggcggatcacctgaggtcgggagttcgagaccagcctggccaacatggtgaaaccccatctgtactaaaaatacaaaaattagccaggcgtgctggcgagcacctgcaattccagctacattggagactgaggcatgagaatctcttaaacccgggaggcagaggttgcaatgagctgagattgtgccacttcactccagtctgggcaacagagtgagactctgcctcaaaaaaaaaaaaaaaaagaaagaaagaaaatgtaagtcaacacattagaaagtgaatgccaaaaatggtttaagacaaagaagagccaaaaagaaaatgttgaatgtggttcagcaagccagctacaatgtgatagaaagtaatttgactgtgaccatgaagtgagggctgatgacattttggaaagaaacacttctaggtagtattgctgagggagtctgtggtttttgtgtccatcttataaattacagaacctctttcgttcagcacaagcacacgaaaggctttgctttattatttctcagaccatctcatctcaggcttgtgtatgaaattgtcctggtcctcaaacgcgtgctcatttttaagtcctttatatcccactgcttcccatgggcagtcttgctcatatcctgggagctcctgttctttcagacccaaaggaacccaagcagaaatctttgtatgtatatgtatgaagaagttgtctgtttttaggagttgtatgtaaaagctaaggaaaccttttcttttggaagatcagtataaacatgctgcttttggtaaaattcttttgagccatttcatctaaatataacttctgtttcatttttttttctaaatataactcagagtttaatgagggcttttcacatggaacaagcttttgagagggcctgtgttgctgaagttttcgcccttggattgctggggtgatattggtgacaaactctgtagggaaggactgggaacctgtcaatcttttttctttggttgggtggattgggcagggaatagctgacttgatttgttataagtttggaaggttatagtttggtcacattcttcattgatcacacttttagggattcttgaagaaaagggaagcaaaacatacacacacacccccacccaatctaacagcgtattccagcctttacagtgatgtgcagtgttactaaaataattgggaaataaaaaagagtataaatgattaactcgctggaaaatcttttaaatcttctataataggaaggccctacttacattctaatttagagacaccttttacatgccaacctagggaaatttagatttacacttttctttttttttttcttttctttctttttttagacagggtctcactctgtcgcccaggctggagtgtagtggtgtgatcttggctcactgcaacctccacctcctgggttcaagtgattctcctgcctcagcctcctgagtagctgggattacaggtgcgtgccaccacgcccagccaatttttgtatttttagtagagacagggtttcaccatgttggccaggctggtctcgaactcctgacctcgtgatccacctgtctcggcctcccaaagtgctgggattacaggcgtgagccactgcgcccagcctagatttgcactcttaaaactaattcctaactcttaaacttcttcaactgaagtctattggatacctatcatgggcaatggctaagggaccatgggaaacaagataagacccaggctttgccctaaaggatttaaaaattaagtaggaaagaagtcatggtagcactgtaataagaagttaagaggtagtaaagtctggagaagcattttcataatagaaattgagaaaaattacttcctgggtgatccaagaaggcaggtcgaagaagtaggtttaaactggtccttaaaactcagtcattctttaatccaggtaattcttgttaatttagaagaatgtaaatagtaagaggaggcatttagagtgaaaaagtggaagtcttccttcactctcatcttgaggtgggagccaggaccaggagagtgaagacatggaggaaggaaaagttcagggcgatttgggggtaatgcagcttatttcagttccatttgcctggaaggagaaggggccaggacatgggctaggggacctagaatgccatggaaggaatctgatcttatttaagaggcagcagagaaccatcagaagttaggctgggaagtgatgtgacttgtacacatggctagaaagataatggtggattggaggacgaggacctggaaggggatagagcaattagactcacaggagtcaggggtgaggtgaaaagggcttcagagtagcagagtggaaaggaaaggtgggatgggaggaaataggattcttgtctgtacctctttggggaggggaggtaccagatccagaaagtggctgatgtcacagttaattcctggtgtccaagctcaggcacctggagactgacttctgtgggtggggaggcctccccagtctctacctccccagtggtggacagatgcttactgaatattttggcgatgacagagcccacacagtctatgagaggctctcattgggaggaaccctcggtttcattggagacacgttaggtgtgaggggatgttgaggggatgattgaaactggctgatgtaagagaggtatagaagtaggagaagggatgcttagagcagggacagaagtcgttggaggaggatggaagggagcattgggtaaggtaggagaagcacttagggactcccctccccctttcttttcctccatggtggaagctggagggaaagaaagtgggaggccaggtgcagtggctcatgtctgtaatcccagctctttgggaggtcaaggcgggtggatcacctgaggtcaggagttcgagatcagcctggcaaacacagtggaaaccctgtctctactaaaaatacagaaatcagctgggcgtggtggcaggtgcctgtaatcccgggtactcaggaggctgaggtaggagaatcacttgaacccaggaggcggcacctgtatcccagctacttgggaggctgaggcaggagaattgctttaacctgggaggcagaggttgcagtgagctgagatcgcaccattgcactccaacctgggcaacaagagtgaaactccatctgaaaggaagaaagaatccagcctgggcaataagagcgaaagagagagagagacagaagagagaaagaaaagagagtgtccttggtgttagatgccacagagagagaggggacaagaagatcgaggagtcaagaggagcttttgagccagatgctgtggcttgtgcctgtaatcccagctactcaggaggctgtggcagaaggatattttgaggccagaagttcaagaccagcctgtacaacattgcaagacccaatctctaacaaaattttaaaacttgtccgggcatggtggtagctcaggagttcaaggctacagtgaactatgattgtgccactgcaccccagcttgggtgacagacagtgagaccctgtctctaagaaataaataaaaataaaaaataagaggagcttttggaattcagctattaggaagttactggtgcccatggagggaagtgttccaggcaagtggtggtgttaaaggtagagagaagagacattagctcagtgcttcccaaataggatagccaaggcgccaagctgcagactgatctcaggtgtggcccagtgcctccccctcagctggaaccccagaccagactcctgcagtttcaagcagcctcctccttctatcccggtgtaccttccatatctcagtaccaccacggggaacctcaaagactcgacaacccatttcaaaagcctggctatggaaagaagaggaaagggaggagccgcaagtttgggagaaagtgtatttgggatgctggagtgggagcctgtttgtaggagccatagggcaggcttgaagatgaatgggaaagaagatgagaggaagaggaggtgagactgagagcttcaaaagcaggtaggcttcttacttcatccgtggagggtgctgtatagtaggtgtccccccagctttaaagacgagcccaagacttgaagatgaggttgtaggggaatgcagaggtgagttggcagaaatggatagtgtgcattggaggaccagatggcttcttggtattctcaggaaaaccaagggcaagttggctagagtgggggccttggaattttgttggcagtagggagactgcaggaacttcctctccatcctctcataaagcccaaaatgttgggaaccttttagctacatgttagataatgaaatgtttgtgtattgattgaaaggaagacatggcacacctgggaaattttccctccttttattatctggagctggctgatgttgaagagggatagagcatcaaaatacgctttgtgtcctggtgtggtggctcatgcctgtaatcccaacactttgggaggccaaggcgggcagattgcttgagctcacgagttcgagagcagcctgggcaatatggcgaaaccccattgctacaaaacatacacaaacttagctgggcatggtggtgggcaccagcttcttggaaggctgaggtgggaggatcacttgagcctgggcatggaggttgtagtgagccatgatcacgccactgcactccagcctgaatgacagagtgagaccctgtttccaaaaaaaaaaaaaatgtgtgtgtgtgtgtgtgtgtgtgtgtgtgtgttgtgtgtatatatataatatatatatatatatacacacacacacaacacagacacaatttgtgtgtagctaggggcagatattgagatattgaagtgataagtaactggggatggggaagtactggtcacttaagagcatatagaaaaccgtcccagattgtcttttctaatctatttttggaggaggtttttatatatcccatgttttatattatttctcccaaaccggattagatatagtgaacaataaaataaatgcagtttccaaaaccttggtgttcagaaatgaagggaaccatgaggggagtgaaggggacttgccctttgctctgtgctgtatgcactgcccagggaacagccccaggacacttctatagtttctttctgagactcacaaggtgttagcaatgctctgagctcactcaattgacagatacgtttaaggttctcaaataaatttcaaacttctaaatttttccttttcattgtgtgcataatgtacagattaggaaaatgatcttctaattgagaagtatacttcaaagtttggaaataaaatcataaaaatgttttcctaaacatagcctttttcaggagtttttgtggatatggtcaaaggcaatagctctaattatctggggtcctcaggacaggaaatgagctcacactcatgctctcaaactgtgtcacagcatttttggaaatattttcatttctattcaagaggaggaacaaggccccaagtgttcaccctaattgtagaaaataaacataaacatgaaattcacaaaagaacaactataaatggctgcaaatatgtgaaactatgtttaacttcccagggagtcaaaaaatactaattaatacaagaatcatctttggcccaccacattatgattttgtctgaataagcctcttcaatgctggcaaatatgaggtaaaatggctgctccggctgctctttttggctggtcttaaggggcgcaaatagctccaccccatttggaaagcacttggcaatggctgctaagactttagtgtttttcatagcttctaacctgctaagaagtagatacttgttcccattttgctgctgtgcaaacagacttgtagaggtcaagtatctcgtacaaggttacattgatggtgattgatggcgccaagatttgaacttggttgtgagtccaaagtctaggtctcccattctacccatgtgattttacacacatgcctgatataattagctcctcctcctctccagagaagggcagctgacctttgtttcccagttcagaaatcctggtgtgagttatcagctggggttgagggtggatagatttgttccaactttacacattggacctgagaatgtactttcctgaataaacagttgtagaagcgagtgacagttgtggttgaagttgttcccccagtgcagtgccccagaggggttaatgacctttcgtgggctgtcccaggaacttcatccgaggaaaaggtgcttacctgctaacatttgacctgtttggaaattggggattgtttttcctcattgaaattggtgagggttggaagaatacgcaaacgaatgtttggtgtggaagaacgctggaggagtaaacttactatactcacaatttggattacaacatagtttggttaacccagctctggtgaaccaaatgtacaagtattatttccttatggttcatcttataaaatattttataaattggttgctttctttaagctctccacaaatgaaaaatcagtcccaaaaatctataaaagactatttcagcgttaattgaccattaaggaaatacatactaggctgcatgtggtagctcacgcctgtaatccccacactttgggaggctgaggcagacagatagcctgagctcaggagttcgagaccagcctgggtaacttggcaaaaccctgtctctacaaaaaaaaaaaaaaaaacaaaaaccaaaaaaaacattagccaggagtggtaacgtgtgcctgtaatcgcagctactcaggaagctgaggtgggaggattgcttgagcccaggctgttgaggctgcagtaagccaagattaccccactgtactccagcctgggtgacagagtaagaccctgtctcaaaaaaaaaattttttttgaacaataaagaaatacatactaaacatttacacagttattttgggaattgcagaggggatatttgtcttctttcccatccccctttctctctctctctctgtgtgtgtgtgtgtgtgtgtgtgtgtgtgtatgtgtgtgtgtgtgtatgtatgtttaagatggttagaaatcatgaaactccaccgggcacagtggctccctcctgtaatcccagcactttgggaggccgaggcgggaggatcacttgaggtcatgatttcaagactagcttggccaccatggtgaaaccccgtctctactaaaaatacaaaaaattagctgggtgtggtagcacacacctataatcccagctactcgggaggctgaggcgggagaattgcttggacccgggaggcagaggctgcagtgagccaagactgggcaaaaaagcgagactttgtttcaaaaaaaaaaaaaaaagaaatcatgacattccatactttttcctttacttcccaaattactttccaataatagcatggtggaaagattaacaaagggggcttatgatatggttgacagaagttgggaggcttttggggtcctacctaagccatcctagagacctgggtattgcaaggcactaaatcttagataaatatcttagacctcattaaagtgaatggggctattatatgtaggaatgtccatagagaatgtgtggagaaagcagaaaggtgtaagtttgagagatggcaactgtgattaaggaacagatggatctcattgataatgaggaagaaaaatgaagtaggaatgagtggtatgaaaagcagatcaatttacaagtccagatttgttggcagtagtgctttctgatgtttgggactacactcccctctgtaaattccaaaaaaggatatgtcagggtcattaaactcagccggatttgcaagacataccttctagaggtggttgggtgttagtccctgagattcttatcaaggaccctgcgggagtgtcctctagccctctgagctaggtggaaccatcccgcccacccaacaggtgaggagcacaagctcagggcagttgttgacctgcccaagggcaaacaattaggagtgatggaaacaggactagggtccagctgcactctacagtggtaaagcttcatcttctaccactcagggaagtacacagccagcagtgctccggagatgatgcacatctttttgctatgtttttattttattttattttattttattttttgtttatttaaaaaaaaatagagacagggtctcactatgttgcccaggctggtctcgaatgcctgggctcaagtgatccttccacctcgacctcccaaagtgctgggattacaggcatgagccactgagcccagctgagatgatgcaccttgaaatacttctttatctaaaacctaacacctgactcataataagcgattcacttgttgattgttgacaacatgaatatttaaacatcaatattaaaaaatagccccataagcacctttagtgttccagggcactatatcacgctgttctaactcttcctacactgaattcttgtgcatctgatattatcacctcgattttatccttgaggaagccaagactttgacagtaaaccagaggcccagagtcacctccccagaaggtgatagagccagcattccagctgtgggggattctggttccactgggctgcaatttccctccactgaaaattgagagccaaattgacgtgacaatgcatgaaaatgccatttggggcaagattcaaagaaatggtgtgtagaagtaaaagatgagtaacatccctcagcatatattcttttcagtggcatttcttttcttttctttctttctttttttttttttttttttttgagatggagtttcgctcttgttgcccaggctggagtgcaatggcacgatctcggctcactgcaacctccgtctcctgggttcaagcgattctcctgcctcagcctcctgagtagctgggactacaggcgcctgccaccacgcctggctaatttttttgtatttttagtagagacgagatttcactgtgttagccaggatggtcttgatgttctgacctcaggtgatctgcctgcgtcggcctcccaaagtgctgggatcataggtgtgagccactgtgcctggcttcagtggcatttctatccctttcacttaggaggcatttttagtacctgacgtagaatcagagccttaatagctggttgatttacagtctcagaggtggtgttaattgctatcttaatctttctttgcttttctgcactgtgcagctctattgattctgtttttcccaatctccaaattcccttgtgtttttcttatgatattttgaggtggtacacttggttccttaaatatcataggtgagatgttaacagttctaggtggagatacacgggcaatcaatctattcacccaacttctctgtatgtttggaaaagttcggaattaaaaacccaggataaataaactaaggcctatttcttcagccacattcaaagtccctgtagtctcacatctggaaaccctgcagtctgcctaggccgtgtcctccacctcaggccaaggttgcagcaggtccttattctcttgtccatgatgaagcttttcgtggggggtccgggtagcaaaatactctcaccctgtcctcactctgtggaatcttccatacaacccgaactagggattgcttgtgtgtccccctcccacctgtcactctttccccacccctccccacgtgatgctgtgggaacccaaaccccagcacctcctagatgagggcagtggtagggcgctaggtggagatggggagaggaggaaagacagggaggggactcctggctcttggggtccaaggggattccagagaaagtgagggaggggagccccagtcccagagattgaggaggacaggatcttggtggtcccagctgggccaggggccccaggaccctagcattaaggtgtagcccctgtgccacttgtggatgaagctgcccttggggatccactcactggcagacgtggtggtgtctgggtgttaaatctatacaccatatgtaataatggtgggcatctgtttggtgccttagtttgttgcctcgctcatactcctgaccagccccacatcctcgtgcatgtgtgggtgtaactttacattggatatacagatgcgactggactttaaatgggcttacatctggataaacccatcgtaaagtcaaaaaaatattaagttggaccatcataggttagggactgtctgtagtttttacttattaattatgttattgacttaaactatgttctgggtgggatgcatagaggagagttaccatgggagggtaagagtatagtaggagtattagagtgcatgagctgaaaacactttgctttctactttacaacataagctttttttgttataaaatccttgttagggagagtgagacgctggtgctgaagctttggagtggaaaatgggtcatcttcacaagggtgttcccagatgatgcaaaggagagttaatgcaggaaggggctgggatggggagagtctgtggagtctgagacagccctttaataagcagttccttggaccttgcatggaaagagaggagaggaacttgtgtggaaagaaagaagcccaaggcttgagggatggagaatattctactaacaggccaccccttgtccctccaggtggcagtgtgtctaggggggtctggaacttgggttttgaccagggtttgcagagcactgaatcccagccgcgtcatgagttggctgtgtccctatgccccagggcccccctcagggagaatggggataatgatagtcataatgataaatggggacagataatgctttgagaagcactgaagtaacattttgtctgaatggactgtgttttaaaatcaggagttgttcgaggctgaaatgaaatatcagcatcatagaatctccaggatataaaaagaaattagaaatgttaccaaaataatatacagtattatcacaactttattaagatgtttagtagccaaatattttaaccagcatcttaacaagtggatcttttcttacagtatttaattttttttttttttttttttgagacggagttttgctcttttgtccgggctgaagtgaagtggcgcgatcttggctcactgcaacctctgcccccccaggttcaagcgattctctctcctgcctcagcctcctgagtagatggaattataggcgcctgccaccacacccagctaatttttgtatttttagtagagatggggtttcaccatgttggccaggctggtcttgaactcctgacctcaggtgatccacccgccttggcctcccaaagtgctaggattacaggtgtcagccaccgcgcccagcccttaaaattttttttataggaaatgactaaatggagtcaggggagaggccagaaatgcataaacaaaagcaattagtatttagtgcgggttttgaatttacatggttgtcaattccctttgcaaaaacttaacaaattactttaacataattgccagtttgtgtgagttcttgatcaaatagctatcaacaagataatgtgcatatatatgtgtgtatatgtgtatatatgtatatacacatatacacatatgtgtgtatatgtgtatacacacacacactaactttataaataagttgaaatttatatgtaggatatatgtaagcagtatagtatataaatataaattacattttaacttttaattttataataatttcagtcacagaaaatatacaaaaatagcacaaataattcccttgtactttcccctaaatttgccttctttctgtaacttttttttttgagatagagtctggctgcaacgcccaggctggagtcagtggcgccatctcagctcactgcagcctccgcctcccgggttcacgccattctcccacctcagcctcccaagtagctgtgattacaggcacctgtcattacacctggctaatttttgtgtttttagtagagacagggtttcactatgttggccaggctggtctcaaactcctgacctcaagtgatctgcctgcctcagcctcccaaagtgctgggattacaggcgtgagccaccgcgcccggctctgtaacttttttctgagccatttgcaagtaagttgcaggcgtaatgtccctttacttaagggggcataatttgttagattgcatctctgatactatagagcatatttgtgactctaaataagatgaagggacaagatacgttctaaaaacaaggacattcgccaaagtgtaattactgaaatcgggaaattaacatagagacagtacaattgtctcatctatggaacttattaagattttgccagttgtcttactgatagatgtcttttgtagaagaggaaaacatttttacttttatttattcattttttttggctttaggatgagttcaacatcacatcttatgcttaattgtctcttagtctcctttagtctggaagttcttcggcctgtctctcatgttcttgactctttttttttttttttgagacggagtctcgctctgtcgcccgggctggagtgcagtgaagcgatctcagctcactgcaacctccacctcccgggttcacgccgttctcctgcctcagcctcctgagtagctgagactacaggcgcccgccaccacgcctggctaattatttgtattttagtagagacgggatttcaccgtgttagacaggatggtctcgatctcctgacctcgtgatccacccgccttggcctcccaaagtgctggtattacaggcgtgagccaccgcgcccggccatgttcttgactctttaaagattacaggccatttattttgcagaagaaccttgacttttttttttttttctggtgtttcttcatgagtagctttaggttgtacattttgggcaggaaagatagggtgttcttattgtatctcctcaggaacgttatctatttttcccattataggtgatactaattttgttttcttggttaaaatcatgtgttccagctttctccaagaaagttactacttttcttctttgtaattaatcagtactttatgggacatactttgagactatgtaaatatcccatttctcatcaaacctttacccaatggttttagtggccattgatgattcttgccagaaacaatttccactgtgacagttgccaaattgatgatcagtttttaaaaattgacagtgtagggcaggagcaataattttttcagttgctagattgtttctgtgacactatagaacatatttgtgcatactaaataaggtgaaagtatgagatatcttggggtctctcatttttaaaaaataacaggtttattttctctgaagcttttatagtctttattatgtctggatcaaagatgatttatcaagaaactatactgcaagattttggagttttttccttacgaaatgttgagatagcaaagttgacattctgctcagcatttttcataggatgtgagtaacttcctaattaggtttttatcttgatgactcctgtggagtttttcacagtctggattttgctaagtgcaacctcatgatatcttttaacatgttgctctatccactgaagttcttgaaaattattagatttagatttttggtcaagattcagagtgtttctctctctctcccattccctctctccttttttaacttatttttgcaagactgcttcatataatagatgttgttttccatcagagatactgattatctctctgtgatgtcagcagctactaattatcagcacccacatcctttacctcatttgcagtttcaaaatggtgatagtctatttgtatcattcccttgtctatcagttataatatttttaaaaagagaaactacccctcaccaactctttagttacctcagatcagaggtcagcaaactagagtctacaggctgagaccagtttgccacttactttgataaataaagttttattagaacacagctatattcatgcatttgcatattgtttagggcagctttggggcactacaaggtgcccagttaattagctgtgattgaagccatatgtggcccaccgagctggaaagattttctgtcaggccctttgcagtaaaaatttgctgacccttgttttagatcatatggggaaagcaatttaaatgcctcattctttccctttatataccagtttcctcctggtttcatggcaccctgtaaaggtgaccaatgaagcttaaaatattatgaaatagatttaaacctacttaatgtctttcaatccatttgcaattattatccttattgatacccaaactgtcccatctttagccagggggagcctcttcaggctggcttctgagtccttgtgacacaatcctggtggtcttggatgcttctctgcttactggtctggcaggatactccagcacaccttgtacatttcttgtcccaggccaggagctggccatttctagaagaagctctgtcttcttttagtggagaatgttacttacagaccactgtctgaaccctagggttgcatatatagctactaaaggttattgtgtttaatgttatgagtgcactaagcagttctgtagcgactagaggtagaatataatatgcctattgtaattttaaaacaataagcatttatttgctctaaaaggatataccattctctctctctctttttttttttttttgagacagagtctcactctgtcaccgaggctggagtgcaggggcgcgatcttggctcactgcaaccccagcctcccaagttcaagcaattctcctgcctcagcctcccaagtagctgagattacaggcacgtgccaccatgcccggctaattttcgtagttttagtagagacagggtttcaccatgttggccaggctggtcttaaactctagacctcgggttatctgcccatctcggcctcccaaagtgctgggattacaggtgtgagccaccacgtccagcctagtctctttttttaaatgtactcttaatattggtgattctgttcatcaatccccctacttaatagttgtataattttacatgataattgctttctacataaaattaatatttttcatgcttatattttactctttcaacaaaaaataagcatatatatatttctaccaactgatacatttcaagagataagggtcacaaggagattttcactcaagttgcacgtggaatgtttacctgtttttgaaagggcatgctcagataatgacagcagatttgaacaatgcttcgtttccttagttctcacattgctacatggatgggatatgttggtcacctatgtgattacatcatcatcaatcaggcagaagttcagtccttctgaagattcatgctaaagctggataacagatttccattgactagtataggctgaagccatactttgatgtattcccaggatctacctcatagttgcaaagattaaataaggttgcatataagcatgtagaacagtgcctggcacacacagcaagggttttgttaagataaactcattatctgttttagtggtcctgggtttcatgatcttgctagcctttataaatttttttttttttttttttgagatggagtcttgctctgtcacccaggctggagtacagtggcacgatcttggctcattgcaagctccgcctcccgggttcacgccattctcctgcctcagcctcccaagtagctgggactataggtgcccaccaccacgcccggctaattttttgtatttttagtaaagatgggatttcaccgtgttagccaggttggtctcgatctcctgaccttgtgatccacccacctcggcctcccaaagtcctgggattacaggcgtgagccactgcacccggctagcctctataaaatttaatctctacactgcactattcctaggacactaacttatgtttaattttggattgctagttttctagaatacatattcttaagtatgttggctgtcatatttctcttttgatgatcattgtcgctaacaccattctttgcacacaaagtctgccttctttctgcatatgtgtgaatatctgttactgttgatttacatttccctcttttttatgcacagtatgtaataaaataaacagcaaaagctgtcttcctcttagacattttaggttaacaagggaaatcattgttcacttcgggtatctttccatgtgtaatttttgataagttgattactggtggttgttcatttttattttgctttttatggaagttttctcaattcgtcccagaattgaggctgtacatcctttaaaaataaataaagccgaggtctgtgctagagttagaacattgaatctggctcgctggtttgtgctatggactttccttcatctgtgttactgggagtatgtgagcagttgtagaggccatatcgttttataggcctgtgccaaggaaaatacttgagaattacattagcaactccaaggtattttggctgctctgagaggacacatgatagttttccagttatatgaacaagagcttttgttttatactgaagtttcttataggctatgagaacaatagtgcctctttaagtacttcccagagtaacatccttgggatgttattaggtagaacgtgctgggcttcatttctgcaggacttctcaggcctttaacatgccagtgaatctcacagaagggagtgtattatgcaggattccttgggtttgtttgaccaaggctttccttgtgtttggaatactacccctccacctactccccgtcaccccatgcgtaagtctcacctcatacttccctgcctcccagccttagatgtggtttccctgctgtaagttctcagctctctgtacttgagcacatttcactgtcggtaaatatgtggcctaataatgatctgatcctctggatcttaaactcactgaagaaggcaggcagtggatttgttttgttccttccctcctgtgttctcagcaccagatataaggaaggccgtcaaacaagtatttgccgtccaagtgagtgaggcacccatagaactttttttttttttgagacagttttgttctgttgcttaggccagagtgcggtagcacaatttcagctcactgcaacctctgcctcccgggttcaagcaactctcctgcctcagccttctgagtagctgggactacaggtgcgtgccaccatgcctggctaatttttgtatttttagtaaagacggggtttcaccatgttggccaggctagtctcaaactcctgaccttgtgatcctcctgccctggcctcccaaagtactgggattacaggtctgaggcaccacacccagcagaacattttttctccaagtagcatctcatggtgagaggtgaagccagctggacttccttggtcgaatgggtacttggagaacttttctgtcttacgagaggtttgtaaaatgcaccaatcagcactctgtaaaatggaccaatcagcactctgtaaaatggaccaatcagcaggacatgggcggggacaaataagggaataaaagctggccaccccagccagcagcagcagcaacgctctgtggaagctttgttctttcggtcttcacaataaatcttgctgctgttcactctttgggtccgtgccacctttaagagctgtaacgctcactgtgaaggtccacagcttcattcttgaagtcagcgagaccatgaacccactggaaggaaccaattctggacacagtgggacttgtgctccacagaacccactttgagaaccatagattggtctatggaactgctctagtcttcgtacttcattttcaagtacaaatcactagaatactatagatcttcataattctagttaatttacttcatgttttcagctaacagggaactgttaactaatttaaagatgaggctcagcacttgaaatagattgtcttagtggcccacagagaatcagccaggattaggacgttaatttcctgatacctgtcctagggccagttacccaccaggcccgtctgcaccccactctaacattgttagttacataaataggaaccagtgttttagactgttgggggaggggggaaatcagatgcccctttgtacactaattaacgcaggcagaacaaaaggcccagcttggttttcaagttcaagtttggctcatatgtggtcctcagtgaagattatgatcttgaataaattaaaaacaaatgttaaagaagtcataatgaggtaaaaaaaggagttcaggattctggcctttaaagactcagggtaaacagacttctctttaaagctgatgttcacctcccctcctccactttaccagtccctctttggaacttctgtgttccgtcttcgtgataattgttcatttttacttcagtgagccaagtgggtaggtatgtacgtctatggtctcatgtcggtgagcacaagcctcattcaccaagctctgctgaactaggaaaatagtacattgagaagtctggtcaaatccactaagtcaaagggatttgcacatttggcaaaatgccctcttcctcaggaatgaccaccgcagcctgctgccccagtccagcttcagcttccttttcctccagggtgctcaaggcgagtgttcaggaagggagcacacagaatccccctgtgttcgtctcccccaggccaagttcccagtacattcttgaccagggcagaccagatgtggggagctctggggccagtgcgtttatgcactaaatgggactctgtatgtatatgccaaattaagtctgcaggcagtctttacgagcacagtaaccgttttacagatgtaaagaagctcaaaagtcctgtgtatgtttgtagtctcattccctgtaaagtttccatgagcacatttcaaggcctctgtacacagaaattgagttcctctgctctcaccagcttacctcttcactgtatcaaagttcgcatcttattattctgtgtgtgtatgtgtatacgcgcatgcatgcacatgtgtgcatgatgaataagttctcagcttggggcagcattgctgcccaggagacatttggcaatgcctggagatattttggttagaaatattttggttagaaatattttggttagacttgggtggggctgggggcacattctactagcatctagagggtaaaggtcagggatgttgctaaccatcttacaatgcataggatggttcctcacaacaaagaattatctggccccaaatgtccatagccgaggctgagaatccctggtgtacatatacacatattatatatacacacaaataaaaacatattcagtatatatttatttactggaagaggccttagagacccatttgaattttagttatagttgaggaaactgaggctcagagaggtgaacagtgttcctaatgtcacaaagctcttgagaagcatagcaggcccagaacttgggcttctggcttctctgaacagtgctttttgcagtgataatagttctttccgaactactgctagattgagaaccctcattctttgggtgttctctgtgtcccagaggaatattgcatgcattactttgtttagtcctcagaatgaccctgcaagtaggaactggttattcatcctttactcaagaggaaatcaaggcccagagaggtcaagatccttgcctgaggccattcagcaagcctggggcagggactggcttggaaaccagattcacccagcccctgccatgtggcaccacctcccccagggccatgctgacagcttgtgtaagcctgagggacaaggcagtgaagatgctgaactggggacccatggggttccttccaatagttgcattctgaaactccagtttggaaatggttaataatgcctgaaccttgtccctaagaggccctgagctattgaacccatggggttttcgggtctgcagccattgcttaggaggcctctgggtgaagagcaagaatgatggtggccaatctacctgcaaggaccaggggagctgggtaggggcaggatggaggggccctgactggctctcctgccttcccctcccctcctctccctccttccctccttaagggaggtctcggggttaatgcgaggtgaggggcagttagtggtaattgttcatcatttgtgcagatgggggcatggcttttagaggtgccttctgggatggagagagcctgggaactcagaatgctacatggcggacagaggaaagcaggcatttccagggaaggaggaaggactggagttgctcctgggaaggtcagctttacagactcctggccatagtggtgtaaggtgctagctgagtgggcagaaggcggggcaggggctaggagagctgacagcaagtgtggtgcatggccctcaacgtccaccccagtctagtccaggactcctgctctggcttctgcagccaaacccaaacggactggtaaatgacttcatttaacttcccgtgcccaccagcatggcactttagaacataggagacccagtcccctctgggagtcctctctctcccctctccttttgggtctggtgtccaggagaccatgcacatgactccgtgtgaagctgaagccagtccagaactccgaggcccaaacccctgcaggctgtcttagtgcttattcaatgtattttgtcttggggtgatatgagcctgtttaaaaataatgtctgcccaaactcttgcctgagagaggttgggggcagaaagaaagctcacatttgagtcctaagaaaagtcattgtgtctctattgccaaaatcatgatagctcaggtcaggttagtttcggaggtgtgataaagtttttatctcttttggaaaaaaactcccgggattttctatcgtggacatatctttcatctacatgtccagctttaagaaaatgtgattatgcctctctgtaagtggataattgagcagaacagcatgctaatttctctctgtcaggccttggttgaaggccggccctttggaggtggtccaggccctgtggccacagctcacctactgaagggcctcctggtactgccacaagctgggacccagccacactttctgtttgtcctcggaaggtttgctccaccctaaggtagatctctgttactgaagaatgtgtctttaaatctacctgcatttccatgtctggttacaaattgtcttaaccccaggcaagttgctgtctcagagttggctgcgaggatgttgaagcataacccggctttgtggtagaggagggctttgtagcaccgtggacagtgcggttcagccttcgatcaataaatagaagcaggctccagcttcaggaaaaggggagtcttggaccgagagagattggcgtttgagacaggaaacacttcctggtgttcctgcagtgtctgcggcttcttcccagccttttaggcctttcctagggtttacagaccacccctcgagcctgtgttctcctcctgatggtgcccaggcgcccggggctccctgggcagaccattcacttcgggaacctggtctcctgctcagcctgcagcttctgtaggtttagctgtctgttggttgctctgggctactcagggaccagttgtgcaggcactgtcctcttttggcctttcttccggccttaccaagttgtggtggttgtctgcatgcccagtgaaaccttctgcagaaaggaccaggaagggcacacattggctgcctgcacttgggaagatctgagggaatgtgaaaggaaacaggttggcagttcctggtgccttccagaccagtgcctgccctctcctttgcttgtggtactggccctttgacctactggagatgggagaagccccagagaaattcaagatcgccttcaggcttccttgacccaaggcctgtgggaaggcttgcgccctgggatgcttagggtgaagtgtaacatctggccttctccaagtccctctcacagcaggcctggcctgacatcctgccggccttgctggtttccttctgcccttcacaaagtccctccttgctggctttctcgtgtgccagggggacccagcttcctccacaagcgtctctgttgcttccccctttgtttggccccctcctgtccccaggctccctgaccgatgcccactggctctgtaggtttcacaggcacctgggacactgtcacatggtgggggagttcacgccatgtcccatctccagccagtgcttttctcactctacctaaaggcttttttcctttcaaaaattttaaattagcatacagaaagattgagtctttgggtatacagtttacgagttttaacacatgtacagattcatgtaaccactgctatagttccaaattcctaaaatctcctgtgccacccctttgtagtcatgcctccttccccctggcagccactgctctgttctccaacactccaacagagatttgttggccgcattgtgtgcatcttctgagaaatgtccttggtaccttctgatgtaggataaagacatgcaaatcacctccactctcctgtagcctcccatcttccttgggatcacaggcatgtgtcaccacgcccagcaaattttcgtatttttagtagagatggggtttcaccatgttggccaggctggtctcgaactcctgacctcaggtgatcagcccacctcagcctcccaaagtgccgggattgcaggtgtgagctactgcgctcggccttattttttgaagtcttggtacacctttttttaaaaaaagaagcaggctgggtgcagtggctcacacctgtaatcctagcactttcggaggccgaggtgggaggctccttgcttgagcccaggagttccagaccagtctgagcaacagggcgaaaccccatctctacaaaaaatacaaaaattagccaggtgtggtagcaagcccctgtcccaactactcaggaggccgaggtgggaggatcactttagcttgggaagcagaggttgcagtgagcctagatgcgccactgcactccagcctgggggacagagcaggactctgtctcaaaaagaaaagaaaaaagaagccgcttagttttgttccagaagatcatttgcaatcatcaatgagaacccgcacatcattcctgtttaattggtgtaaaacaggggtggctgtcggggtctgtccgtgtggaggaatgaggaccacagtccactggcccacaggtacatgcatgcccttagtgggccgacttctgggaatacaccagcatccgtagagctaaggatttaccgtatgccttgtcctcagaaaaatcgcttcccctgcccatgtcgccctgattactgtaacagcttcaacgcatgaaccagattgttctcatttaatgaagtgttgactctggagtctccaggataacttgcagttgcccaatttcctggtgaattttcaggttctctagtggtttggagacatgaatgaactcaggaattttttaaggtaaataaagtctatgaagtgtgatttactttcttggtttttggcgcctgaacttgaagtgatgggccctagctagaggggcatggaagtcagtctgaaggctgcagttatctttgcagcagggagaagctgggctctgagctgtgagcaagggaggtgcttcggggccggtggagctgcttcactgagctgggagctctcctgccctccccgggcttgcttcccctgcctcctgggatggggatggctggcctcagaggaagggaaagattgctgttggcagaggatgaactcacccctgcggtgttggtctttggtctggggagccaggttaacacgtgaagctcaaggagcacagaagtccctgtttctatctttgtgcagttttggtccagggtaaaaggatgagagtgcctttccacactgtggcctgcgggtttgtggtgattaacttgtggtggggcctgcactctagggtcatccacttggtcaggttggtgccaggatgctggcctgagagcaggagccagggctggaagcagggctgggcgtggctgggtctttcgaggcagagctcagaggcttgtggtgatcaaacagagccggagggggagccaggggaacagtcccacatgggaaacagaggctgagggtctagcgaggcaggcccagcaaggcaagccaggtgttgggccacaggcctggtggtctgccctcaagatagaggtttggagagcagtgccctgaagttcccccaaaagttgagatttaaaaaaaaaaaaatcagaatacacatgcctggctgggtgtggtgatgcatgcctgtagtcccagctactctggaggctgaggcaggagggttgcttgagcccaggagtttgaggctgcagtgaagtatgattacgccactgcaccccaccctgagcaacagagggagacccttctctctcaaaaaaaataaataaataattttaaaaaaagaaagtccgcatgcctgacttctgtgcccagaatctctggacatggggccctggaacatacatttattcaaagctcacttttaaaagttggtacacaggtagggtggccacagtgggatcccaggctgctctgtggatccaggtagaaggcagcccctgctggaaggtcaggcactactttacccaagccaggccaccccttattaaacaccagcttcactcgagcagtggttcccaaattttcttggtctgtgaagacgtattttctctatttttagccaaacagaatgattttagtccatcatgggtcaaaccttctgatattctttagtccccatggaagacattcttgtttctcctttaagaccatctctggggtcaccttcggttgccttgggggtgtttgagcctctgccgcagggacactgataaggacatgagttgtggtacgccccgttttgtgtagcagctgtcagtttgtttctggaatgagactgagcttctagaagtctgggcatttggttctggttcacctttgagctgctggcacggaggagctttgtaacacaagcttactgaattgatgttttagtgaaagggagaaaagtccttttcagctccctttttcccaccattccccgctgttcatccgaattactcatccacacatagccagtaaagggcgccgtagactgaacctgtaggaaaccagactccaggcagccccagagcacactccccagaaccactaaaataaacacaaaatgcactctcgccggattctgagaaggaaaggccctccaaggtcgtagggtccagtggctctcaaccctggctgcacatttgaatcatctggggagctttttagaaatggtcatgcccagcctccacccacaaagattttgattcaactggtctggggtggggctcaggctttgctggaattttctaaaagctccccaggggcttctaatatgcagccaagtttgcaaaccactgctctagttgaaagctcctcactgaatatctgaatgaaaggattaaacagatccctgcctagtgaggtattggcccccctcccccataagaccatgggctggtggtagagttgccagcagttctttcctggattccctatgcccctccatcacccagtcacatcatccaacagacctacctcggaccatccctcctgcccgaccagaagcagactccgaacagaatctaatttcagatcgatcagtgggcaaacataaaggatgtgataagctccaaagtaagatttccttgtttcaggccatacgtttgattttgaatgttgtatttttgtattaatttgttagggctgccataacaaagtaccgcatgctaggaggcttaaacaacagaaagagtcattgtctcacagctctggaggctggaagtctgagatcaaggtgtcggcagggttggttccctctgaggctgtgcgggagggatctgctccaggcctctctccttggcttgtagggggctgccttctccctgtgtattcaaacagtcttccctctgtggatgtctgtctctgttcctgctttttataaggatagcagtccaattggattagggcttactgtaatgacctcatttaacttgattatctccttatgtggagacagggtctccacatagtacacatacatagtacaccctgtctccacataaggtcaccgtctgagatgtactgggggttaggactccaacataactttttttgttgggggtgtatgagggggattcaattcaacccataacaaatatcttccaagccggccactttgactgcagcctttaacgggtagctgcatatttttttttctttacacccactctcaccctcaaattgctcaaaacaccggagcccagggctggttgcctgtcagcgttcagcacgaacctgcccactgactggcgtctgctccctggcttctgggtacactcagaggatgattgtttgcattcaggctcctccagagatgaatataattcccctaatttcctcacagtggcagcagtggctgaagggagaggtgaactgtgagagatgggcccctcttgcctaagatgaaggctggggtcaggggcagtgttaaacatcagctggagaggattgtgaaaactctttggacaagaggggtttgttttaaagcgaggctactttggaatggacatctcattagtgaacaggttggggagtggcagggttatggagaggaggaggcgttccattcccgtagctattctgtatcaaccgctggggtcagaggctctcagctggagtccacccacagacagaattcagggaagctccaaaaacctgaatggaaagaaattacattttattttcactaactgaaaattggcattttcttcaattatgaatgtagactataaaccacagggacattaacagttctcatgactgtcaccagtagcaattgcaaagtgcatttttaaaaaatgtttgtgggtacatagtacaccgatgtatttataggtacatgaaagcaaagttaattttttacagtgtggtagagtcattgtaaatgtcttgatatactgttatccttagcaattcttaatacttcagaattaaggttgttatgagattcgctgctaggtcttatttaatatgttaattaaatattaccatggtggaaaatataaaatattttgataactgcattttactgtaattggtttcctttgcaatgctgtgtatttaatttgtgcatttagcatcattctgtggaggcctctgtgggcttccctagcctaccaaggagtggtctgtggcattgaagaggatagggatccttggtttgcatttatagtaactgtttcctgttcccagtcagtgaataaatcctgtaagtggagataactctagattacagtcttgaccatcgcttgatttattaatagttaaatttacagctcctctttttggctccttgaggctgccgtgtgtgtgcacacatgtgcgcctgtgtagactacggcttgccttcttttcaaagacatcagagattaggtgattaggtagaagcttttgaacaagcccagccttaaatctgccctccagtcctgttagatccttcttgggaagctggtccctgtccctggccagtcagtctcaagtgagtggggctgagaggagctgcaggcaaaataaatacccactccttccagagttacttgccttgagacgtgaccttctgggtcactctggaaatgtgcaaagttccagtgcccgagtggcgtgtgttggagacgctgaggctggttggatgacaacactaaagctggggttggaagacctgtttggggcggcctggaaaaacatgtatggtgccagatcatgggccctggttgatgtgaaaataatctgctgtagatcattaggtttatggaacttggtttgttttttgttttaattcttatttttaaataatgatagacttaggttgcaaaaataggacataagattcgggagaacttcctccagcttccccagtggtgtcatcttatgtagctgaagttcaatatcaaaactagaacatcaacactgacacattactgttaactagactacagaccttcagccctcaccattcttcatgttttgtgtgtgtgtgtagtttgtgtggacaggtctatgcagttttatcccatgtataaatttgtgtaactaacaccacaatcagatacagagctgttttatggaacttattttaaaacttgatcgggaggcaaatggcagtgagtttgcatcagttctgttaaattgtcctttagcctcaggtcacagtggtggttgtaacatctgcctcctgagtcacctgtctggtcagccttggggctggaggtagagatttgactgtagggctgagccccagagtatttggagtccagtgctaggtgggctattatttacagggctcagcctggatctggagcactgcagcaggagtcttgggtgccagtggcctcttgcttcacaggcacaagcactctggggctagaccttgggagcagagtatgtttctctgggctggagagcaggaataatgtgagtgaggggcagggcacaagggcaccagctgagtcctcaggggttcagagaagagctccaggcctcataggcaatgaggggacaggtcaggaataaatagagatgccctgactagacctgggtggcgtggtaagggttgtagggtaaggtcttagcctggtgggcatgggggtacccaggagccctgccctatccttcccatgcacactggaactgactgtgctgagtacagtcagatcggacatcactgctgggcatggcttcctacagcctataatgtgagatccgattaccacagtagatgggaaggcatttgatacaaatcccagagcacactcaaaaactaaggtggtggttttgtcccaaagctggtcatgggttgattgtctctttagcacctctcagttgaccaggacatctgattaagtggaaagctacattctccaaccacaaaagataataatgttcatactgtgtctgggttttatggttttagatatctggcaatgctggtgcgtgtatttttttcttttttcagacggagtcttgctctgtcgcccaggctggagtgcactgacgtgatctcggctcactgcaagctctgcctcctgggttcacgccattctcccgcctcagcctcccgagtagctgggactacaggcgccggccaccacacccggctaattttggtgcatgtatttctatttttatttttcgtttgccatttcttccagtttccttggttaaagttttcagctaagtacttacctttatagtcagagataacgcctactctacacctgcaagtatcattctcccaccctaccttttctcctggctgattccagcaatgtgggactggctggggggtaaggggctagcacatggtacaagaccagctcccaagagcaagtgttgagtgcaaccactatggaaaacagtatagaggttcttcaaaaaacaaaaaattaattaaaaattaaagaattatatgattcagcaatctcattactgggtatatatccaaaaaaattgtgaaatcactgtcaaagagacgatctgtacccccacattcactgcagcactattcacaatagccaagttacagaaacaacctgagtatccgtcgacagatggatggctaaaggaaatgtgggctctgcacgcaatggaatatcattcagctttttaaaagaaggagccaggcatggtggttcatgcctgtattccccagcactttgggaggttgaggcaggaagatcacttgagcccagaagttcgagaccagcctggccaacacagtgagaccccgtgtctaagaaaaatacaaaaataagctgagcatggtggcacatgcccgtagtttcggctactcgggagactgaggtgggaggatcgcttgagcccaggaggtcgaggctgcagtgagccaagatcccaccactgtactccagcttgggcaacagaacaagaccctatttcaaaaaaataaacaaggagaaggaaatcctgccgtttgtgacaacaaatggatggacctggaggacatcatgctaagtgaaataagctagtcacaggacaaatattgtatgattctgcctgtatgtgggatcgaaaatagtcaaacttaaagaacgctggttgccagggaatgggggaagagggaaatgtgttgttcggtgggtgtaaagttacagatatgagatgagtaagctctgcagctccgctgtacaacatagtgcccatggtttagagttgggcacttacaactttattaagagggtcaatctcatgttaagtgttcttaccaaacacacacacacacacacacacacacacacaaagggacacaaggaagcttttggaggtgatgatgtgtttattaccctgaccatggtgatggtattatggatgtatgcacgtgttcaaactcatgaaattatctatattaaatatgtgcagttttttggtatatcaatcatacctcaacaaaattgtaaaaaacaaaaaaagagtaagtgtgggaacagtgaagatggagaaggaggggtaggggtggtttaaccaggcaggccctacactgtccctgagggggacacctcaggtggtgtgggggtgtcggggagtcatggagctgggtgctgccgagtctgagcaccatccacccaccgcctggtagagctgcgtggactgaacctgggacaggctatcagaggagggccacaggtccatctgtaaatacgactttttttttttttgagacagagcctcactctgtcacccaggctggagtgcagtggtgcaatcttggctcactgcaacctccgcctcccggaatcaagtgattctcatgcctcagccttctgcgtagctgggactacaggcacccgctaccacacccggctaatttttgtattttagtagagatggagtttcaccatattggccaggctggtctcaaactcctgacctcatgtgatccacccacctcggcctcccaaagtgctgggattacaggtgtgaaacaccgcacccagtctaaatatgatttttgaaactaaacttgtggcaggaggacagggttgctgcaatcccaggacagaataaatctgagaacctcctgcctctatttcctccattcaacttcccttgcccattagtgtcagtttcatcttccaaaaaacaccatcatttcataacttcatttctaggaaagccacaattgctccttttcacttcacacaccaagtctaaacttccctgtgtaactctcaaggctttccccatctgacctcactcggtcaggtcagccttccttctcatcagtccttcattcagcagtctctgaaccttccccactgaacacacctagtgcgcttctacctccttccagactctaccccctagcatgctggcctaacaacattggctttgatgacctgaactccagattcgcctgctgtccacagtttctttctttctttttttttttttaatgagatggagtttcgctctgttgcccaggctggagtacagtggtgcagtcatagctcactgcaacctcgaactcctgggctcaagtgatcctcccacctcagcctcccaaagtgcacattttctcatatgtacctcacaatcaaacacaattgcctttttataggatgtattatcttataacttctacctgtcatttatctatgtgtgattggtgaacaagacaaagcatattgtgttgttccctaattgtttcagtgcagaggccttgtctccctagccaacgggaggggagggatttttaaccaaggctgtattttttggtctgctctgggcacccgtgctgccatgtacctgcatctgtgcttgctaggtgacagtacaaccagctcccatgatgcagggccacacagccctggtctgggttcttccttggcagactcgtccagcacagactggagtttataattacagtagtcattagcctggaatgcaagggcctggcaatcaggattttttaagataatgtttaggttttacttgggcacaagatagttaaactcattttgagataattgtgaaagatccaaattgaaaaagaagagccaacaatactttcttgttactaaaagttgatatcgcataaacctgcgttctgcaaacttggatctagagcatgacaagatagccttgaaagatgaatatttcagagagaggaggatgagatcccaagggccagcagtgtgctcactctctggaatagctcctgcagcccagtgagtagagttgtgtaccccaccttcccttctttgtggagactggagctgactttgctctgctgggtcatcttagggttggggcagagactgtatcttccataggtggatttcattttcagaagcatcaagcctggcattttcaacaaagtgagcaatctcactttgtaaaatcaagtcaattttggaggagtaaaagtcatacatattcatcaaaagaaaattgagcaatatagaaaattgagatataaaaaaatttaaggagcaaatagctatgctcagggtttggagtgccaaatcatgggtttgttcctggtgccatgccactgtgttctaaaacaagccagagcctccaattataatcagtagctcttccttggttccttttgccactgccttcctgctgttatccaaagacttcttcccttattgtaaagggggagagttctctctgattcttcttcctctctctctctcgctctctctctttctgctaattggagaaacttctgtctcataaagatcttagtacccggacatcccaggaaagaaaaatggtgcccaggaaacccactcagagtggagttttgaaagtgattttttcccgtctgcccaggaagccagcacatagtaggtgtgatgcagtctcccttgctgcagccattccccgactggaaccacaacagaaagacaacagatgggctgtggacaaaagaatttccttggattttcctgcctagggacatcttggaaaatgcatatcttgaaattagttctgtagccgcttgtcaaaggaataatgaggctgttggttttttagactttgggaaggtgcctgttctcatgctgctaataaagccatacctgagactgggtaatttataaagaaaaaaaggttaatgaactcacagttccacatggctggggaggcctcacagcagaagggaaaggagaagcagaggcacgtcttacatggtggcaggcaagagagcatgtgcaggggaactcccctttataaaaccatcagctctcatgagacttattcactgtcacgtgaacagcatgggaaagacctgccatcatgattcagttacctcccaccgggtcccttccatgactcgtgggaattgtgggagctacaattcgagatttaggtggggtcagagccaaaccacatgagaaggattatgtcagaatgatttgggggtgctgttttaaaatgcacatcctgggcttcacccctgtaatttccgctccagataggacagaactgggaatccacaacaacttctagggtgattctgaccacagccaggcttgagagctttgtggtgtgtactgctactcacaggactgggcagtagacatgaatgagatgatctgcctttgtcagagtccttcagagcttctgttgtgggtaaatattgggaaagccaatcctcttcaatagggttcatatgaaattttataagccatttttataagtcagaaatagttgatggttagcaattctatgcagtttcactgatagagccaggaagtgaggctggttggggcttggagttgaccatctcctgcctgctagctttgccgccttggccaaataatttggactctccaagcctccatcttgcatctccagaatggggattgtgacatctcctttgccagattcttgtaaaatgtagagtttaccgtgtacatgtcaagtgtccctggtacctcagtagctactgtttttatcctattgtgataaccattcccatcttcccccctccccccacactgccctaaacacatcccgggttactgcctgagtcctcgtagaccttggggagaccagtttctcagtcttcactgctcctaggtgttctcccgcaccgtccaatgagatgtgcagtgtcctccccgaggcctgtttgaaatatgtccttgatgttgccaccagaaggccctgattgcagccacgtgtccaccaggggagccccgcagtgcttcccacctcacatcccactcagccacgtccagcttggtataccaacaagcatcagacaatgatgttagggccatggggtgccattgaggtaatggtcggccctcctctcccttggagagaaggcagaattcttcccactgagctgacctccccgtggcccctgtggccaccacccccacaccaactttgtttgatccatacttcttattcccaaactcacttggcacactcttgtcacacagcctttcacttgttctgtgcctccttcacctagaacattcttgtttgtttgattgtttgagacagtctcgctctgtcgcccaggctggagtgcagtggcgcgatctcggctcacagcaacctctgcctcccaggttcaagcgattctcctgcctcagcctcctgagtagctgggattataggcaggtgccaccacgcctggctagttttgtatttttagtagagacggggtttcactatgttggtcaggctggtctcgaactcctgacctcaggtgatctgcccgccttggcctcccaaagtgctagatttataggcgtgagccaccgcgcccggccacctagaacattctttatcctttcacaactgcaggcttgctccccacttcttccctcctttagtttaaccgtcacctcctcagtgaggcctcccctgaccaccctatttacaattgcagcgtccgccccacctccagccctcttcacccctctcctggatttatttgagtccagagcacccctgccatcattggtcattgcccgtctccactcgctaccacagcagcgccacaagggcttgttcactggtctaccccagcacccggacagtgtcagcacaccggaggtgcccaagaaacgtttctaaaagaacgaataaatgagtggcagcagtattttaaaagatcgaaatttcccgcctttgcccacacacaccttatttcctgagaaaagttaaacttgccaaataaatattcctttcaaaaggaaaatgaagataacaagcttgtcttctccccatcttttcctgctctgtctgagcagaggggcctcaccgggtgactgattgaaactattcattctgagcattggcacaagcacagacctgcccttgcacagttgagctgcaggggtgtggaggagcaggggagtgggtacggagggggtggggggctccaaacagcaggtaggtgttggcccacagcctgacagggagcactggagacaggcaggaggcagaaaaacagaaacagcaccatggggggatatatagaagcactctgcggggaggaggggcgcatgattttgattacagcacagggtacctattgattgaattattaataaagattaaattgaatcacacatatcctatatatgaaggcaggggaatcgcaaatacatttatgccagtttttgtttttcaagagacagggatatcgaagtctcctaaactcaaggggtcctctggcctcagcctcctgagcagttggaactataggcacatactacggtgcctggtttaagccagtttttaaacaacagctttactgagatttgcattccatagaattcattctttttttttctgagacggagtctgtctctgttgcctaggctggagtgcaatggcgcgatctcggctcactgcaacctctgcctcttgggtttaagcgattctcctgcctcggcctcctgagtagctaggattacagacccgcaccaccacgcctggctaatttttgtatttttagtagagacaaggtttcaccatgttggtcaggctggtctcgaactcctgaccttgtgatccgcccgcctcagcctcacaaagtgctgggattacatgcgtgagccaccgcgcccggccagaattcattcttataaagggtacaattcagcagttttcaatatattcacaggattgtgcaaccatcaccactatctaaatttagaatattttcatcactgcattagcagtcactttgttctcctctcccccaacctttggcagccaccggccttctttttctatgttctggacctgtcatataaagggaatcgtacagtgtgtggtctttgtgattggtgtctttcacttagcctggtgttttcaaggttcctctgtgtcatggtgtgtatcagcacttcctccgtttttgttgccaaatactgtactgcattatatggatatactacattttgtatatccattcatcatttgggttcgttctacttcatggctaccactgagtcatttggaaatgtgatgcaaggctcaaggctaatggggtttcctcgcttccaaaaaagaggtgatgttgcccacctggcaggtgggtatgaggctcagcaatggtacatgcatctcatttaactggtcactgtcaactccaaaaatgggccttcccccatttctgtggctgttctgtgctggtgtgcagtgtgtaagatggtcagtgttcctgtgttttgactggtgagtcaagtctgaactcactagcctagcacctgagagcctcctcatgggatagcatccccctgactccgcctgacaaccatcatttctcttcagttttcactcctgcccaactggtttcttcgcagtctatgcccagggcctccagctttctcacacttgggccctgctggggcatccagcctctgctcctacatccttgggtcactgcaggtccctgcccgaccctacctttcttcctccggacctcatattagaccagctcctcaggcctttttggacatgaccgtctcaaagtgttactatgtttaagtgtgtggttttttgtttatgtgtgtggttttgtgtctttgatatcgttgatttgccttatggcctcaaccaaaccctcactgtaacatggcacaggcagcgccatgtgacatccttgtccctggcccgcccggcgcagctcacagtgggctctctgtgaatgctggctggctgagtgtctgggagttgtgagccctttgccatgtaactggagagggtggaagtgtgaatggagacacctgctcagttgtacaatgctctttggacaggggatcaggtttaaatcagtttgaagcctgctttaccaccccctgcccccacaattgttatttcctgaaagcatatggttggctgagctagctgaaaaattacccgaattttgataaaaatttgaaccatggatttcctttctgaccatgcctagctgtgtaaattccacaggatagtaacaggtgcctggccaccatccagcaagacccctgataacgtccatgcagtggggagccacgggggcaagtgcttcccctccctcctggtcataggcttgagcatgggtagccaggatggggggtgggtgcaacttgagataagcaaatcgacaacaatgaggtacaccctgttctttgtcctcttgtcaacttgtgatttcccgatggatcaggtaatccccagtagcagataactcagttgaattttttcactgtcgctgttatctgtattcattgtctgcctaaatagtagtgaacagagaaaaaaagaacattaaaataggaagctgggaatgacaggaagagggactgtaggcctggtaaacaaaagttggctgtaacatgagccaggatatggaagcgtgaccaatactttggactctctcaatgctggccctctgcggttcatggctctcctccctttctcgctgtcaccagccacgtttaggtcagtctttgtttttggctgttgttcctgaagacgcatttatcaggtggatctcttaaaatcagggttagggattggaagtctagctgggacaattcctgtgaagacagacttccttctgatgaaatatttactagcttttgtaggaagccatctcctcctctttgctgtgataagaggtactccccacctttctgtctcatggcaagggtggaaactgatgatatttgtagggcatactggggtgagccaacaggctggaggcagccaaccctgggcatgcaaagaagcaccgtttggaagctctggtgtagctctcgtgcagcagcagtccaggccctgggacatctgagtttgaggcttcagtcctccgctgactgaccatatgtttacactgcagcctgttgtggtatgaaatgagatctggaagcacctgagctccccagtgtctgcaggtagatgattatttaataccctcttcccatacatcttcatggtcaggagactggaccttggcaattctgttattagacagctccactcgtagggaatttctcccttatatttagctgttgttttctcctccattccactgtctggagtccccatggcaagttcgcatcctctttcatgtccctggctccaaaggctttggtgtctccaggtaagtagttctcacatgggctatgacccctcatccttcattatcctagaaaaataatgcttttctgaaaattgtatattccatgggaaaatcagtagattttggaagcctgacatcttagtccgttctggctgctataacaaagtgctggccaggcacagtggttcacgcctgtaatcccaggacttcaggaggctgaagcaggtggatcagttgaagtcaggagttcaggaccagcctggccaacatggtgaaaccttgtctctactaaaaatacaaaaattagcctggtgtggtggcaggcacctgtaatccaagctactcaggaggctgaggcaggagaatcgcttaaacccaggaggtggaggtttcagtgagccgagatcgcaccactgcactccagcctgggtgacagagcgagactctgtctcaaaaaaaaaaaaaaaaaaaaaaatccaaccacaaagtgccagagggtgagtggactataaactgcagacatttattctcatagtttgggaggatagagggtgagatcagggtggtggcactgtcgggttttggtgaggaccctcttccaagttgcagactgctgacttcttgcattcctcatacagtggaaagagaacaagccagctctctggcctcttcttataagggcactaatcccattcatcagggctccaccctcatgacctaattaccacccaaaggccccacctccaaataccatcacattggggattggatttcaacacaggaatttggtggcaggggtgtggggcacaaacaccttataatatttgccatatgttttaaaaaaattttaagtataaagtcaacatccaccacactatataaaagagagacctggagtggtggctcatgcctgtattcccagcactttgggaggtcgaggaagaaggatcacttgagcccaggcatttgaaagtggcctgggcaagaaaacaagaccccatctctacaaaataataaaaaactagccaggtgtggtggcgcatgcctgtagtcccagctactcgggagtccgaggcagtaggattgcttgagcccaggagtttgaggctgcagtgagccatgattgcgccactgcactccagcctgggcaacagagcaagaccctgtctctaaaaaataaaaataaaaaaatgaaaaaagggaaaagacgattataatcctaccacctaacaaactgttttcatttgagtcttatctttgtctttattctgatgaattcatattttatatagttaaaatcaaagcataggtacacagtttttggtggtttcttcatttcattatataatgatttccctcaaagttctaggcattataagatgaagacgacagaacacagatatcatgtagctgcagtaagcattgggatggctgcacaccattctgtggaacggatatagagtcatttgttaaccagtgatactgacagagagcaagcagatcagtgaagacaggagcagggcccccgagccctgagaaaaagcagggaccttgccaggtgaggaaaaaaatggtatgaggtagggctacactacgctcccagagacgtctccatggacagtgagctctttagaggggaaaggagtaagcttttgaaccatttgaattatttagaagaaaaaaacacagtgcctttcttacacacttttcagaatttcctgtgttttcacctgccattagctggttactgtttgggcttcctttcatggtggtaaacacagtttgttttgtttagccatttccttccccctcaaataccaacacagatcaattcagtctttgcctgagtcatacatggttcatgtgtctctttccttccatctatctccccttaattcacactatttactgaactcctcctgtgcacccaagtctccagaaggagctggagaaggagcagggtggcaggggtgggaaggggacagctgtgtggaaggcagcggggctggaatcctggcatctaggccctttcacgctcccactcagagggctctctcttcaggccagaaatgctgatatttaatgagcacttactagatggttatttgtccattttatagacagggaaattgaggcctgccagtgttaattgacctttctacggcctagaatctgaagttggtgcagcctcactgaagccctggctcagccatggttgccacccatcctgtctgagctttgagaaccacagagacaagacaggcggcagggctgtgattttagacactcttgtcttaggtgtctcaaggtgggggtcactttggagcctcagccaaccccactgtgattggatctcctgcctacagcctgtttcaaagggaagtggagtttagggagacagtcaagaggatggatggaagaaaggggctggttaacctgagaggagagaaagtaactacccacccgtcagagcctggggctgataagggagggctcctggaagacagagctggtgcttctctccacctctgagctgctttccctccagggccactggcttctgcaggcgttgttgtcttttgctcctaaacagcaaaaagagactaattgcctttattgccatgttaaaatcaatagagccactcaccctgagttcaaaatgatacgacctagggaatgaaattgggaccacctgtggtttgtttcctattagccaggcacagaacagtttcttgtttcccttggaatgaaacacaacctgagtcctggaggaatagttctcaaatgcatccggatctcctggagagcctgttaacacacaagctgagctccattcccagagtgtttgattcggggattctggggtggggccctgagaatttgtatttctaagttctcaggtgatgcagatgctgctggtcccagatgggactctgagaacctctatactaggtcatctctcagacttgggcctttgttctcatcttccccctccaaaacctaacataatccactacatgtggtagagagccatcaaaaagagagtttcagtcaaggggctctggctaagtcctggagctgagctgccccctcccttgctctgctcacacctttcacccctcagactgaaaccctccgttacctgctgctatgcagggattaggattagaacagggctgagtgggctggtacggggagggccctgctgtggtgttggtttagctccttttagcacaaggaatttgatgagctaagcattttccacggcaagtgcataaaaaagatttcttaccattttttgaaagaaagaaatatatcctttctcttgagtcatcactattgttagttgctgaatgaaaaaaaaagacttaaagctctgttctttgaacacttttctctgggtgcctttctgtagctgtagaagatctcttgggttaaattttaataattgttaatggcttcacacatagggggtgtcttgccctcctgtgtagggtgtcactgcccaggacgtggcttagccgggtcctgggaacagctgcaaggactgttggagaaaggggcagggggcactggctggggagagggccgagaagatctcctttgagagatggggagggagatgtgaggctgagaatctagtattgagtttctaaacttctgatctgcaaagtggtttttttttttgtttttgtttttgtttttttttttggtagagacagggtcttgctatgttgtatgttacccaggctggtcttgagctcctggcctcaagtgattgtcccgccttggcctcccataatgttgggattacagatgtgagctacggtgccccaaagtgctctttttgttgaacagtgtgtgagcccagctacctggagggtgtgtctacctgcctgaccctcagccatcgcagcctcatgacggctacaccccgcacattatcatacccctcaaatgtgccttccaaccccacacagatttcttgtggttcccatcctggtgaatcttctcagttatccacattacagacctcagtggaatcttccacaccacctggctcatgatggtctctgctccttgcctttcacgttcttcagaggctagtgacttcctaaagtgaggattgaggaaataacaaccacgataagagttacagctgaccctggagtgtttcctgtgcaccaggagcccgttccaagtatctgtatttattcactcgtgtcatctgtagcagccccaacacataggttaggacctgtcactagtcccatttataggtaaggaagctgaggtgctgggaggttgcatgatgtgccgagcatctcacagccagcaaatagcaagtagctagaccgcttcctccctggcaggtctgaagcacatgattcctagccccagccttcctaagggcccctaacagacggtggccttcccctggcatccagagtggctctgctgactggagcagtcaactgtttctcctctgcagttcctgaaggaaggagaaaagggggaggctggtgggttcaggtttcgtagacctaagaggccagctgccctgtgacccctcctgagttggggcttctttttgggggattagggaggagagttataagagaaagaggtgcggagagcagggagcacctgagagagggctggaagaagtggtaaatagatggacctgcccaatgagagtagccagcgtgtgcatgtgaggggcaggtagcacagagggaatgtattccttgtctaacttggcatatagccaaaagctaggtgtaagttagtaaactacagccttcaaaacagcccctgggaaaggccctgctttggagggtagaaggacatataggaggctcccagaggtacgggtgtgcctccctgctgggcatgggcccgcctgctgggggcagcagcaaaaggaagcaagtagcccggaggaaaaaaagaactatgtgtgtgactgtgtggtggccaggagagagggagagggttcagcacacacagggaaccccaggcagctcccagagcccaggggaagcattcctttttgtagttgaatgatcccaggggagcaaaaggctggctggaggagagggagaggaattctgcttggaggagaaggtctggggccaaactgccccagctaaggtgactggtccgtgtgtctgcatcttaaatctgagaccattggttcctttgcacctgtgtagtatcctcagggagggttcccagggcgctcgtctggtgttgcccctctttgaggcacctcactcattgaccattaagcaagcatcgagtgggtgtcagtttaacaagtgtcttgtgttcagtgccaaggccaggggcaggtacaaggcatgctgaatgcagcccctgccacaggatccatgtttcaatagggagggagacgcagaactttgcgtaaaactgaaaccttatggggcgggccctgtggtgtctaaggccacactgggagtctcagatcctgccaaaggacaggggaaaagggagcagctggtggacatggggaggaggcaggatggacggggcgcctgaaggaattaagtgggatttcggttggagaggaaaagcaaagatggcagggagagacgaggccctcaaaactgagcttgttcgtcagatgggagatggacatccaagcctctccatgaggtctggcacgtgatctggggcacggtctgttctgcagtcatagctgctggcctgcgggacctgcaggcagagtccctgatactcactctctgtgagttaaggccagatgcaggcttcagacacctttaactgagaagcaggtgggtgctggcctggggtgccagggagctgagggtagaaggaatgtattaatgccagcagctgctctctgatcctggccctctgtgacttcctcttcacccattgtagcataccagccagactgtgaaggaatgaatgaagtgggtagagaggttcccggtcaggctgttccaggcaggataagataaccctggttctctgcactccagagagcttgtgctaccagcttttgatgctagaaaaccccaggtgggaaatggccctctgagtagactggacatgaagctggtgatgattactgcttcagcagggacagaataaccactttcaaaataacaccccgaatggcttagcacaatacaagttgatttctctccccatcacggtccaatgcaagtctgcatcagcactgcctgttcattcaggaacccagatctccctgtctaagagctctgctgtcttcctgagtggtggctcccacttggagtgtcagaatcacctgaggacttgtgaaaatacattgctgggtccccacctccagaggaaaggtcctgagaatctgcattgccaacaagttctcagaggatgccgatgctgctggtccagggagcgcactgagaatccccgctctagggcttcgtggttcctcactagagcttctgcttcaaggggtgagagagcagaagtcagacacaatggccccacttcactccaaggaagcctgagaaatgtagtccttttgtgcacccaggaggaaaatcaaatggtattgtctgtgccacagtgaaaaggggcagcacagagccgggtttaacctggtatctgcctgaaatactagatatcaaaatgcatttcaaatggatgggcaagtcagccaagagtgtcactgactcataggcatacatgcctttcaagaaggcagatcatgaatggaggtcattactaatgtataacttgtcctattgtgctagcaccaaggggagtcacctaggacttgggttcctaggatggatggcccgtggtgtccctagtccaagctttatatcctaggcctagggaagaatgcgtcagacagtagtcagatcatcattggacctgatggactttgcttctgacatttccatgattttgacatgtctttcttggtgtctttgctgcctggtgtctctcagagcccataaccctgctggcttgaataaggcagtaggtgttttatattcagaatcttagccatggtgaataagcatgtcatatatagttcagccctgattttggggaaaatcatcgggcgagtcagcaagtttatgtctgtgccgagcattctggaggatgtaagagaacatgactccaggctgtttggagaggcaaaagcaacccaaataaagtaagtgaggacttagtgcagactgcaagtgtattagccagaggtggcattacagagcccagctcaggatacggaatggctccagcaactctgtactgctcaacccacttctggagcttcaggcttagttctaggagctgcagtttcaccaggacttagacaaacagatgatagcaagggtctgggaggcctctgcctggagaagagggaaagtcaaggggcatttcagccattgaaatctttgtaaagttgggtcgtggttgtgggaagagaggtgatacaaggtgtcattccaggaaggaaagctaggcctaagttctctcctcttctcagtggagtgaggttgttttttgtcttggggtatgtaggcaccagaactgttcacacagtttggcagatttcatgttaaggaaatgactttgggaagaaaaggaggtgtccatgtgggttagaaatctggaagggcattttccatggagcgagcctttagccaagctctaaaggccaggtaggatttgggtgagcaggaggagaggacgctgcagtcagcagatgggcagtgaggcggggaagaaaggcggaaccaggcctggtatcagagctggggctggcaggggagaggcagtgttcgggaaagtggagtccgcctgaagattgtgggaccttccgtggggaaggtaacccggaagcagtttcagattgggtattggaggagaatgagcggacaaggagcaaatttaagagccagctttcaggaaataggtctatagtccttggtggttctggtgtctagatgatgctggtgattatgaagtctctttgcagccccagcccttggagcatgcaggtggaaggccagattcctcacctggagagctccgcagaagatgatctcatcaacctacccttttcttggcccatcttcatggtgtgtaaggacaaggctgcagcacttggaccctctctcaggggatgctgctgtgcttagactgaggtggccctgctgatgttccctgcccttggtataggggcgggacaaggctagggaaactaacggctgtgctcccctctcttctacctgggctaggtctttgctgttcagtttggccaggcgggctgggctgtcacatgagtgatcccttctgatcctcacagcacccttacaaggcaaagactcttagcagccaatctgttttgtttctgactgaaacaagctcagagagtcaagggcctggcccagggtgtcacagcaaagttcagtgacaggttctacctgtgtcttagttctctgactccacatctagagcttgttctcttccaccattcaagatcttttatagccccagatgaagaatttcatgtttcttaggaaagtgactacctgggcaaggacttagcgacgcctgagaaattagcttcaggagagtgtgccctagtaatgataagtgacgtaataaccagcctgtattgagggtctactctgtgccaggccagcgtttgaactcatgaatctgcatcacagcatttttttttttaagagatggtgtgttgctctgtcacccaggctggagtgcagtggtgctatcgtagctcactgtagcctcaaactcctaggctaaagcgatccccctgcctcagccaccccattagctgggactacaagcaagtgccaccacactcagcaacatcacgtcttacagaagaggaaatgggaggcacagagaagagagaggttaaatgagctgtctggggtcacacaggtagagccagtctcaagcaggagccagccgatagtctcacactgaaccacagggcagccagagctcctcatggaagctcgcttgtttatgtggcccagctccagagagggttgtcctgtctatctctgcttgtgggttttctggggaggctgcattggagagagaggatgtgtctcagcctgacacaccacactctgctgaggttgtggcagtccctggcttggggttaggacatcttaggaagtggcagctcacgcctgtggcgggtttttgtgatgggctgatagagaggaaggtggtcagaactgggagggccctcactgtgcgggtagccccatgttggtggaggcctcctagtctgtttgtatgcactgctgcctcatttaacttgagacttagatcctcggagcagcctgccaggagatacgagtttacctcccagtcaggagacaacacaggggattttttttttttttttttttttttgagacggagtctcgctctgtcgcctaggctggagtgcagtggtgcaatctcggctcactgcaagctctgcctcccaggttcactccgttctcctgcctcagcctcccgagtagctgggactacaggtgcctgccaccacgcctggctagttttttgtattttttagtagagacggggtttcatcgtgttagccaggatggtctcaatctcctgacctcgtgatccgcctgcctcggcctcccagagtgctgggattacaagcgtgagccaccgcgcccggccgcaggggactttattttagagcccgatcaaagtaacatggaaaagctaaaggttctctgagctgcagtggctcctcctttccatgagggggcgccatccagagtcagcgcttcctctgaacacatcccacttgaatgggacaggcagccatggtagccatagagcatatgggcccacactgcttgcatttaaattttcactcctgttgtttccatgatgagcattcctcaggttctatgccataaatttataatttgggaaatatggtcaccattaccatatggctcccattgtgtcttctaatttagcaaagatgataaatttgtttcctgaaaattttagggttaaaagcattcaattggatttgattcgttgggagttggtgatgtgcctgatgtatctgtaacaggaatatcccattcttcaaccatgctgcacacagagttaggagtcccaaagaaggcatttgcctgaataattccataaaacgtgtatgtaaaagaagtcataaacggaggaaggaaaatactaggtaggtaataaagacatttttcatacttttatcctgtttggaatataaattctttgttctcagctagatttgtactgtactaatgaggaaaggtaaacaacaacgaactgccaccctttgacatgtatatacactccttttctttgcatgtgagttggtggataccatgtataaatgtctgcacatgttggctgagtgtagtttggtgaacatactccgtcccctgcccccagccctgactaagatgcagcaccagatacacattttggaagaactgaccttattgttgtcaagtaggtggaacttgtcagaacgtcatctttttcctcttacccctcccaccctcattcattctccaagtgcccttttcatttcacttccttttagatcctcctctcagctgtcagctaaagaagacctgatactctgattcaccccaagattcaaagctctcatttcttatctctcccagaagaattttctggatgagcctttaagccaaaggtatgactgtctaatagcggaatttcagtcatctgggacagactagatggggagatgttaaggaaagagactcttcctggtgtacccagaattatagaactcagatgtcctcatgtgccctgtgtttcttgctaaaagttgtatagttttgtgttttacattgaagtcttaagtcttacatttaagatccattttgagttacttttcatataaggtgtaatgtttaggttgaggttgatttttttccccctcctgtagatgtccacttgctgtagcacactttgttgaaaggactacctctcaccattgaattgtttttacacctttgtaaaaaagcaagtgggcaatttgtgttctctattgtgttccattgatctccatgtctagccctctaccaagaccatgctgtcacagttactggagctatatagtaagccttaacactgggaagagagattcctttattctttttcaaaatagttttggctcttctagggcctttctcttatgttcacaaggaaacttatacatgtgaatgttcataacaccttcattcaaaatagcctcaatctggaaactatccagatgttcttcagtggtgtatggttgaccaaactgtggtatatctataccatggaatacagcaataaaaaagaaaaaattattgatcacatgcaacaatataggcgagcctcaaggaaatgatgctgaacgaaaaagtcagtctccaaaggttatatactgcatttgccatttatataacattcgtgaaatgacaaaattatagcgagggggaacagatgagtggttgccaggtgctagggatgaggggaataagggataggtgttgctcaaaaggggtagcatgagagaatctggtggtaatggtacagtttagtattttgattgtggttgttacacaaagctacacatgtgacaaaattacatagggctacacatacacacacacacacgagtgtttgtaaaactggtgaaatctgagaaagttctgtggagtgtgccaatctcaatatcctagttttgatagcatgctagttagctatgcaagacgttaacatcgggggaggctaggctagatgcttggaacctccctgtacactttttttccaacttcctatgaatctataatcattttgaaataaaaagttaaaacaatattacattctgtttatgtcacatcaagaatggcaaacctgtaaaaatatggacatacagttgcctctgcaaaaggaggcttcatctgatttcataacattttatttgtttagaaaaacctggtcttgaagcaaacataacaaaatgttaacatttgtgaatttaggatgatggattttatttgttgtgtttttccctgtcctttattatgtgtttgaatcattccattatttaaaaaataaaataaatgtaaacaaaagcaataattatgccagggtatgtatctccctggtatcttggtccactcacaaaagtggtctgaatgtttaatatttccttagtaaaactgctacttggtcacaggcttctctccatgaattactaactccgggttgggaagcctaagaacataatccatcttttttattatgacaagctaatttaattttaattgctccttatagtattgcattatgaggaggaactatctttaattatctttttgggggggtgtttctaaagtaatgtgatctcagaagcagagcatcgtcccttccaaagtagccacctgactgtgaacttaaaatatttgtgtgcaacagtgtaaatagacttctctgctcctccaactggtggaggctgcccttccccccgaagcaattaaaagaattccagatgggtgattctccccttcctggtcctatttaaaaatacaagtgtcgcttcggggattttttttttcctggaatataccaagtgagtgacacaagaattgggactctccattcctgatttaaatattggccgtgtcctttcgagatcatttttcttggtgacatgttagacaatctcaggtcagtctgtgtccttaaagatcactgtgggtgtcaggaatgctgcttacagatgtacatgatgggcacatggaggcgcccttcagggcctttggctcagatccccatcctgctcttaaagaaaagggcattctgttatttatttgttggattttaatttctgcctctagccctctaaggcttctccatgtagtgccatcctctgctgctgttaccaccatcaggggtgggggtaggggtgctgtacagttggcggccagaggatgccattgaaaagtggagaagtcttcacactgctctttgtggaaggacggcctcccttcccgtgggcaaaccccggggctggagccctcccagctgcccagtggcttttgtgtgtgtgcagctttcagctcctgtccatcaggctgaaagggcccattcaggggcattcatgcgcctccgagaccccggccgcctggacacaatcagctgagaggggcgctgcgagccttgcacatgagaatgcgcccactcggcctgcctccaattgtttggagaagcccagggcccgggagtgagcccagaggaatgacactggacagccacttggggttcattcattctgtgcacttggagcctctggaagggaggggtgggaataccttgcagtgagctgggaatgagcaagttcagggctgctagggcttatctttggtcctgaccttcagcttttatctttgtgtacacctcttggagcccctgcttaagggtagagaccttgtcttctttatctttatagtcccacatacctgaggcactcagtaagtccttgttgaaggagtgaactacattgctgctcctttcatatagccccaggcacactgatgtactttactgtcctttgaagaggccacagaatattttgcctcttggggtgtgatcaccttactgaaaagactgggctcacctcttaggtcaaggagagtagactttgagatcttggagggacgaaggacattttcaaggtgggaagttgccgtagaacagagtgctgatggccagggatctgcatttggaatttgagaggctgagtaaggagcaccataggcctctgcagaggccagtcttgggtggctggtttgcaggaaagggcaggacctggtgctgacttggaaccagttggtggtagatgtggagatgggagaatggacttcatggacacttaccatatggcagccaacaccctgggaacctctggcacctgatgactgacctaggaacatgggggaatgaaaagcacaggccaagatgctaaggagcctttgtgtttcttagttttacaaaattgtgtttaaggatcacagcagcagcagtcacagtagtagccaaagagatagtagaatcttctatttattgggaacttactggactaagagctttgtacataatacttcactgacttaagctgttctgttgttatatacacccacgtatgagtggtaagtgctgcaggcattttaaggtaggaaaggttattattcccatttatggacgcaatacctgaggctcagaaatattaagtggcttcccaaggtgagtggcagagcttcagtggaaacgggggcttaggctcttagcaactgaggcgagggctgctgccagcattaatgactctggtgcagtgaactgagttatctttataatttctccttcaattttaagtgttaagaaagaaggaagaaaaggaaaaatacctctactagtctttaagagccttataacttatttggagaaacgcagcacacaatatagaaacacttgccaagctgccagtgccgagtggtggtatcagtgctgaggacagatagggaaaagctttcctacttgtcacataccctggggaggtgatcacaaacccactgcatggccttcctcccaaggaaggagttaggttgccccatggctaagggagggatgtagaaccacttaacatgacattggtttcaaaccctctggtcccgccagcttcttctgttaggcacaggtgctatgtgacatctcacagaccctgatctggtgccagcccaggccagatcaccaaaccctgcctggcctcagctccctgcactatgcaatggtatagaagtgggatggcacctctcatagggttagttagtatttgcatgctgtgtgctctgtactactctgtttagtgcatttagaagttgatttccttggcacgtgactcatgcctgtaatcccagcactttcggaggctgaggagggcagatcacgaggtcaggagttcgagaccagcctgatcaacgtggtgaaactctgtctctactaaaaatacaaagattaggtgggtgtggtggcaggtgcctgtaatcccagctactcggaaggctgaggcaggagaatcgcttgcagctggaaggcagaggttgcagtgagctgagattttgtcactgcactccagcctgggcaacaagagtgaaactccatctcaaaaaaaaaaaaaaaagaagtttattttatttcctcattggatgtgaccaacttcctacaaagggaagaaacttcatcttcaagtccctaggataaagcttttcatagggaggggacaaaaatttaactccaggtcaccaagagaagtcattttgcagcatggaacttagtgcacttttgttttcactatggtcccagaatccatttgtcctctgacaaggggactctgtgctgcatagggctgggtgttccagctatgtagccctgtgcctgatggcaggtgcagccacagttagctgaggggcagtggtctccattcagaggtctgcttccttctaccctatttcaccctaatgaagatatgtcatcttgcaaatgactacatgttttctatcctcctcatttctaatcctgaatttaagcattggaaagagcttgagcaaatcagtcagctaccgcccctctcccccaaactcagtctagtcatctgcaaaatggagctagcagtgaaaacagtatgtattaaatgagatgatacatgtgaaacatgtagagctctaattttattttttttttatttatttttttgagacagagtcccgatctgttgcccaggcagtggtgtgatgttggctcactgcaacctccgcctcccggattcaagcgattctcatgcgtcagcctcctgggtagttgagattacaggcatgtatgcccaactgatttttgtatttttagtagagatggggttttcagcatgttgttcaggctggtctcgaactcctggcctcaggtgatccatctgcctcggcctcccagagtgctgggattacacgtgtgagccgtggcacctggcctaactaatctttttttttttttttttaagtgcactgcactgaagtgcagtggtgtgatcacagctcattgcaaccttgaactcctgggctcaagtgatcctcctgcctcagcctcccgagtaagtgggatacaggcatgcactaccatccttggctaattttttttaaattttttgtagagaaatttttgtttctctaccaagtttttgttgcccaggctggtcttgaactcatggcctcaagcaatcctcccacctcagcctcataaagcaccaggattacaggcataagccactgtgcccgctctgtcttatctaactgggtaatcactcaataaaattaagttcttattttttcatttgaatgaattgtatcgatacctgggagaagccaaaggttgctttgttagttgtaactccgctgactgaccacctttgctgtgcttgatatttatgtagagcactcaggctaaaatgcccatggcttccctgtccttttattctcgtgggtgatggcgagtagagcacagagggccaagtgacttgtccaatctgcgtagacagtaacagttccccatccatggctctttccacagctgaggagccaaagtctcaggcaggtctcaaagctggcaagtttaaactaagtgatatttagtctgggtgggatactgatcatgcatttttctttcttttttcttgctctaaagggcattattagggccgggtgcagtggctcatgcctgtaatcttagcactttgggaggccaaggtggcaggattgcttgaacccaggagttcaagaccagcctaggcaacaaagcgagacctcatgtctatatttaaaaataaataagtaaataaatagagggcattatcaggacagctggcagcatttgaataaagtctgtggattgagtgatagtattctaccagcggtagttttctgttctttgttccttctcctctaccactgctccacttgactagccttaaaaaataaaaagcaattaaaataaataagatggcaattttatgactaggtaaactggtattgtaagaaaatgtcttttttgggaaatacagaagtatttagacaaaaggggacatcatgtgtgcatcttactctaaaatggtttggggaaaaatgcatatagagagagagataaagtaagtgtagttaaatgttaacatttggggtatgtaggtgagtggtatgtggaagttcattttactattcttgcaacttttgtataagtctgaaattattttagtatttaaaagtttaaaaaaaaaaaggccctcctgtggctgaggtggtaggagggttagtgtgaaaagatgggagaggggctatgggatggagaggggtggggcagaaccctggaaggtgaccccctgggagtggatggctgaagacatgtgaatgaagagaggagaaggggggaataaactgaataagaaaagtcccccaaacagagcaccttcccaccgaaacaggagggattaccttcgggaaatgatgtgggcagactctaaggcattgccaagttggaattacagaattcaggagtggtggctcacacctgtaatcccagcactttggggaggccaaggcgggtggattacttgaggccaggagttcgagaccagcctggtcaacatggcaaaaccccatctctactaaaaatacaaaaattagccgggtgtggtggcgcacgcctgtaatcccagctacttgggaggctgaggcaggagaatcaggctgataatgagccaagagaagaggagaaaccaagtctgccaggagaaatatgaatttggaccttggagaatgaaaattgtaggaaaagtaggcagggtagatgggcagggaaacccaaagcatggtcagggcatcttctgaggatgatggggatcctgcaactaagccagccaaacttgagtctagaattgtgtgcccccaggtgcccttgagcccagggtaaatagctggtgtgattacagcaaccagcagtgtgtgccatatcacagtaaacactccaggagtgggttctcacagaagaatcaggaggaaacccctggcatgagattcagagcagaatccccctcaagttcttggatggtggcagcagctgctgtggagtctctgttgcaagcttttagttcgcaggcacactggttcaagtttaatcaccacaaaaatactgctttgtgtgaaaataatacatgagtagtccttattgcaaaaggttcaaagcaaacagaaggaatacatcagaggcctctttcagctccaccccccagtcccacccccgaggtaacaggtgtggacagttcgtctccctacagtcctttttcgcagcatttgccctatggcgtagtggctgggactgtgggctttgaagcaagatcatctgggttcaccaactacctccactacctacaaaccttgtaaccttgagcaagttacctacccttttctctgcctacattttctcatctgtaaagtcaggataataacagtctagacctaatagggttgtcatggagactgaatgagttggtaggtgaaaagaaccagcacctggcacagtcagtgctcaagaaatgttaacgtgcatgggacgtggtggcttatgcctgtaattgcaacactttgggaggctgaggcaagaggatcactggagcccaaaaggtcaagggtgcagtgagttgtgattgtgccactgcacttcatgctgggtgacagagcgaggagacactgtctcaaaaataaatcaataaataagatctcattacatatgaagaccgattttcttgcttgcttgctttttgcttgcttttttgctttcctttctttttttccttctttctttttttgagacagggtctcactctgttgcccaagctagagtgcagtgatgggatcatggctcactgcagcctcaacctcccaggctcaggagatcctctcactgcagcctcccgagtagctgggactagaggggcacgccaccacccccggccaatttttgtattttttgtagagatggggtctcgccatgttgcccagactggtctcataatcctgggctcaagccatcctcctgcctcggcctcccaaagtgctgggattacaggtgtgagccaccatacctggccctattttctttcttaaaaaccataaaaagagtcctactctgaatatttttatcagtagcattcttagttttgagcagtaggtatcagctgactgagatcagaaaaaggatttctttaaaggacattggggtggttcccagtcttgctgggatggctgtggactcaaaccatggagaccaggcagcagcccagtctgcacccacaatagtcacaaaaccagagtggtgaggacactgtgctgttgatgttgctggcatttccagcttccagagtgggaggtgaaccctgcgtcctgccaggactcatacgagaagcagggattcctaaactcgggacaggagttcagatgccaggggcaagtgtatccctgaatagtttatgattcatttgagccttttgtgcccacataaacgatgtcattcttcttctcttaaagacaaacttcgctatattgcttaggctggactcaaactcctgggctcaagggatcctcccacctcaacatcctgagtagctaggactataggcgcaggccactgcacccagcacatgttattctgcacatttacctgtgccaggtgctgtgcagcagtgattctcagcccagcagcacattggaattacctggggagcttggatgatttggaatgtccaggccgggcctggtggtaggtcccagccatcaggactattttttttttttttaagagacagggtctcactatgttgcccaggctggtattaaacgtttgaccccaagtgatgctcccaccttgacctcctaaagtgctgggattacaggtgcaagccaccacacccagcccggactttataaggttccaggtgattccaatgtgtagtcaaggttaataaccacagcttctagaggatagtgcatttaataatcacctctatattgggtaggtgatgtttttctgaatttatacatgggaaaccaagcctgagaaagcattcctgccttgctttatgtcacccagtaagtgaggcattcccactgcccaaccccttcccctgactgcagtgactgctgctgcttgcctggatggggaggaggagcaagcctcttcctcagcccccggcactccccagccacaccaacctgccgcaggccatccaaactccacggtttcagggccttgcgtgcaggtttctctgcctaggttggtgttacctcacttctcacttggacagtttccacttaccacccccagcctaagtaagtcctcctcttctttttcctttgtgttactaaaacagtatgtgattgtatatgtattaatatgtattaatccgagcactttgcagggccgaggaaggtagatcacctgaggtcaggagttcgagaccagcctggccgacacggtgaaacccagtctgtactaaaaatacaaaaattagccaggtgcggtggcaaacgcctgtaatcccagctatttgggaggctgaggcaggagaatcgcttgaacccgggaggcagaggttacagtgcaccactgcactctagcctgggcaacaagagcgaaactctgtctcaaaaaatatatatatatttcgggagtggggtggcacaaataggcagaatgtctgctaaggctccttgtgggacagtgatgaaagaaacaccaacaaacactgatgcgactaaaggctatcctaggatcaaaaggcagtctactaaaagtccattaattagcatttgctaccacttatctgtggaaattaagatttttttttggttctctgcaatcaaaacaaaattcaaaaataaaatattagctgatgtggctgatataagacaactgtcaatcgtcaccctgccttttaggatgcagcaaaacacctttgttcttcttacagattcatctgatttttgtgttggagatttgagattttgctcgttactgaaaatgtttcctctgctgagagtttgagcagcctcctggttgtgcagagtggccagggttgggctcagctggccaggtggcaggtgcaaagcagggttctagaagagagtctgcctgtggcctcataggggtaacttacttcagtgagcagtgttgggtgcctgagtgaggaagtagaggtggcagaggaggggtccagtgggctgtctgggccatgtgaggctgtctgcaggactcctcagaaaggttcaggactcacgttcagtgcaagggaagacaaagacctttattgctacaaagttgggtgggagactgaagtcctcagatggtctacaagcttgaaaaccaaatcaagttgaccaacaaccttcagttacagtcatgtggtattgctgcgacttctgaatttcccatttggggttttattagcttttagtaaaaggcgacattgtgaagaaacccagattagaattcagtttataaaacagctgagtgagaaagtgggataggggagccagggaactacatagaaaatcattgagcaattactcaacacaattagagcccaaacaccaccatctcatgtgcactccttgagctggcaagtagggaagggggtgcagagccggagctcagggagaggtgtccgtggctccctcacttctggtctcagaggcctggagtgtcctctgttctgagcattttccacaggcaggggctggtttcaggcccagacagactcccaaagctaaacaaatgagcagccctcgctggccatgactttgccatttagaagtggctttggggctccagaatgaatggggagcctaatgcagacccaactgaccaacttcggcagctttggggaaagtaataaaaatgagcccaggggtttgagacaagcctgggcaacaaagtgagatcccgtctctacaaaaaattagctgggtgtggtggcacacgcctgtggtcctagctactctggaggctgtggcaggaagatcgcatgagcccaagaggttgaggctgcagtaagctgtgtttgtgacactacactctagcctgggtgacagaatgagaccctttctccaaaataaaaagaaaaaagaaaatgagaccagtagtgatctaaataagtgagcactttgggatggcttcccagagataagtaggtgatgtaaacctcatcttcccagccctgtaaagaaaaaaggttttttgtgggggtaggaggaggctccatttcatcaaatctgaaggtggacttgagagtttatagttttcccagactgtgaggctccacccaggctttctgtctctgccagtgccaagatgctgcctgtcctaccacctgtgctgagagggtgtccctaatgtccatgatggttcaggctggagtaactagaaaaagaactcagtttccttcccaaggaagaaactgtaattcagtccctgcccagctcacaatggtgatctcagtatgtctcttagccattttgcatttaagattctctgtctataaaatggcaatctgctgatcttaaaaaaaatgtggaagagacaataaaataaaatcccagttctactgagttctaacagccagaaaccgtgagccatttaaaattttgtttgtctcatgtttatgagaaaggataaaataacagatatctaaaccaacaccagggactcttttaaaagctcaaattctagggcagtggttctcaactcaggctgcacattagagtcaactggggagcttttgaaaacaccagtccccaaactccaccccagaccaattaaatcataatctctaggaaggaggtccaagcgtctgtatgtctttaaaagctccccgagtgattctaatgggctgccagggttgggagtcattgttggggtatgccagttggatataaagattcagatttatttccagaaatattatacaagataatttttttatttctctaatagctgaaaaatatatcttatttatttattttattgagatataaatcacataccatgaaattcatcctcttattaaagtatgcagttcagtggctttagtatactcacggagttgtgcaaccatcaccactctctaattccagaaaaaacccttagctgttagcagtcactctcctttatctcctgacaaccactcctctactttctgtctccatggagttgcccattctaggcatttcgtcagatggagtcatacaacatgtggccttttatgtccagcttttttcacttagtctaatgctttcagggttcacctatattgtagcgtgtatctgtacttcattccattttatttttggataatatcccatcgtgtggatatcccacattttgtttgtcgattcatccattggtggacgttggggttgtttccactttttggctattgtggacagtgctgctgtgagcattcttgtacaggtttttgtaaggacatatggtttcagttatattgggtatacagttgacctttgaactatgcaggggttaggacgccaacccctcatgcagtcgaaaatccatgtataacttttggctccacaaaacttaactactaatagcctactctcgattaacaacttattttgtaggctatatgtattatatactgtattcttacaataaagtaagctaaagaaaaggaaatgttattatgaaaaccataaggaagagaaaatactgtattaataccataagtttacattgtctgtctacaagaggaattgtttgtctgaaatgacaggcaactacacagctgcagacctcaatttctggtacatatcaagcaattcaactttttcctgtaatgtcatgactcttctcttttcttgggagcactttcagcatcactagtggcacttcatatggggctcatggtattattcagggtttatggtattgcactaaacacgatgaaaactacatgagaaccgcaagagatcactttttactggaataagcagtttactggagagatgagcagctcacatagagatcactagcatctagctgttggatacctgcgacacttgagttacctgcgacacttgagttacctgcgacacttgagttcacggcaatagcaacaggaggtggctgtgaaattattacaatagtggccaggcacggtggctcacgtctgtaatcctagcattttgggaggccgaggtgggtggattacctgaggtcgggagttcaagtctagcctggccaacatggtgaaaccctgtctctactaaaaaatataaaaaattagctggtgcagtggtgtgcgcctgtaattccagctactcaggaggccgaggcacaagaattcgcttgaacctgggaggcggaggttgcagtgagccaagatcacactactgcactctagcctgggctacagagagagacttcgtctcaagaaaacaaaaacaaaaacaaaaaaattattacagtcatacagtatgcactgtatttaattttatgcagtgattatattgcatctttatgtttgtttacatttctctgactataaatggtgccatgtacagtctgtgtgtgcaaaagttttgataaattttaatgttttatgatagatttatggatatttgtggtagtaaatgataaaatagactagtatctacgtagatttgatgcattcatgacatacctttttcttaattttttcagcatttctaggctacatagtttacaagtttttccaaattgtcacaaatctccaaaaaatgttccaatatatttattgaaataaattcacatgtaagtggatctacaaagttcaaacctgttttgttcaagggtcaactgtatatctaggagtggaattgctgggttgcgtggtcactttatgtttaaccatttgaggagccgccagcctgttttccaaaatggctacaccattttacattgccatcagcagtgtatgagggttccggtttctctacatcctcatcaacacttggcattattttctgtccttttgactatagctatcctaatggatgtgaagtggtatgtcattgtagtttggtttaccttttcctgatggctaatgaagttgggtaccctttaatgtatttattggccattgttaagtcttctctggagaaatgtctattcaagtcttttgactttttatttatttatttatttatttatttattttattttatttttttgagatggagtctcactgtcacccaggctgaagtgcagtggtgcgatctcagctcactgtaacctccaccttgcaaattcaagtgattctcctgccttagccttctgagtagctgggactacaggcacatgtcaccatgcccagttaatgttttgtatttttagtagagatggggtttcaccgtgttggccaggctggtctctaatcctgacctcaagtgatctgcctgccttggaccccccaaagtgctgggattacaggcatgagccaccatgcccgggctcttttgaccttttaaaattgagttatttgtctttttattgttgagttgcaagagctctttctttatgtattctgggtactagatccttattaaatacattatttgcaaatattttctctcattctgtgggttgtcttttcactttctttgtagtattctttgaagcacaaaagtttttaattttgatgaagtctaatttagctatattttctgttatcatttgtgctttaggtgtcatatctaagcaaccactgcctagtcctaggtcataaaaaatatgtctttaatttattctaagatatttataatttcagttcttagaggtctttgatcaattctgagttaatttttacatacagtgttaggcagattttatcactccaaaaaggtaggagtacagcttcattctgtgcaagataagttgatcatattagaatattagagcaggccacggggcttgggagctctagtcccttattgtaatggtgaggcacgtaaggtactgtgaggttcaattgagagataaacactgactctaaaggcctatttgaacctaaagtacctccgaactctttttctttttttttgagacagagtctcgctctttcgcccaggctggagtgcagtggtgccatctaggctcactgcaagctccacctcctgggttcacgccattctcctgcctcagcctcccaagtagctgggactacaggcacccgccaccacgcccggctaattttttgtatttttttggtagagacggggtttcaccatgttagccaggatggtcttgatctcctgacctcgtgatccgcccgccttggcctctcaaagtactgggattacaggcatgagccaccgcgcccgcccagtacctcctaactcttatgaaaggttaaagtgtattctccatagtttctctgttcagtcaattttaatagcatttctaacattgggaagctataacttatttctgaggtattatgtgtatcttaacaccagaacatgaccagaacattgcatggctctgtcacaggtgagttgccaaactcactgtcatatttttaaagatcttaattctttggtagataaccaagattagttgaaatgcatgttcagattatggatacatcagactcagctaaatggaaaatgtataccatagaagaaaatatattccaatcagacatggtggctcacgcctgtaattccagcactttgggaggccaagatggaaggatcacttaaggccaggagttcaagaccagcctgagcaacatagcaagaccctgtctctacaaaaaaaaattttaaattagccaggcgtggtggtgtgtgcctgtagtcacagctactcaggaggctgaggtgggaggatcacttgagcccaggaggtcgaggctgcagtgagccatgttcacaccactgcactccagcctgggtgacagagtgagaccctatctcaaaaaaagaaaaaagaaaaaaaaaggaaagaaagaaagaaaaggaaggaagggaagaagggaagaaaataaattctaaatagattaaaaagaagtttaaaaaacttaaaagatacctttaacagtattgaaaacgatgttgaagcatcctataaaagccacagcaagtgataatgatgtgataatagatgaaaagaacgcaagggaaatctcctaaacgactcaaactatacagggaggggcggtttggaagggggagttagatccctacctcatgccacactcaaatatatcaactgaatgaaagatttatttcattattctttttatatttaataaagagatgcttgctaatggaggtaaaaaaaatcaaacagtacaagtaaaatgaaattcttccttgattttcttttcccctctctgcctagctccacttcactcactgctatttggtgtgtgttcttcctggctggtttgaatatatacatatacaactactatgtattattttgtggattttttaacacaaagaggattctgttatttctatttgataacttgcttccccccccccccccacttaatagggtatctcagagacctttcgatgtcagtacatacgcgcttacctcattctaattagccactgtgtggtattccatagtagagatgtaccttgtaagcattcccatgttggtaggcatgttaagaagaaaaaaagaacatacttgaacacacctttgtgtgcccaaactagtctttctccagcatagattgctagtagtagatttactgggtctgatagtatttgtgcattttattttattttattttgtagaggcggggtcttactatgttgcccaggctggacttgaactcctgggcttaagcaaacctcccacttcagcctaccaagtagttggaactgtaggcacgtgcaccacgcccagctagcattttaaattttaataaattctgccaaaataccatccaaaaaaaggctttgtgaaattacactgtaatgaatagtatgggagtgatacccttgccaactttttaaaaatttaaattaatccaatgggcagaaattatacctcatttaaatttttttttttaataagcagagaaaatacttgtagaaggtattacttagttttgtttgttttttttctttagtctatacacagaaaactacctggggctctctttgacagcacataaactaaaattggaacagtacagagaagagtagcatggctcctgtgcaagaatgatgcacacatttgtgaagcgtttcatattttaaacaacatatttagagatagaaaagggaaaactacctagaagtggaatgagattaggagaattaggaggattagttagaattttttctggttagaatttttattttctaaattgaaattctagtttcaagttgttttaaaataatacaattttagtttcaagttgttttaaaataataaatgtatattgcttttggaacttgaaaaagaataaagatattttttaaaagaaaaataaagccctcttgcagcataatttacgttgcattttctctctcagtgctgagcaggcctagagttgaaggtcgtgagtgaactgtatattaaaagcctttgtcttccggctgtagcaataccatacttctgtatggccaattgtcaactaaagcctgtatcttgaaatgatggactcatgtgcagatagattgttgtgtgcatctacactcccggcctgttcatagaagacttccggggcagcaagcagaaatgcttgtcagcccacattgtttttttttttttttcaatacagagtctctgttacccagtctggagtacagtggtgtaatcttggctcgctgcagcctctgcctcccaggttcaagcgatcctcccacctcagcctcccaagtagcttggattacaagcctgctaatttttgtatttttttttagtagagaaggggtttcaccatgtaggccaggctggtttcgaactcctgacctcaagtgatctacctgccttggcctcccaaagtgttgggattacaggcgtgagccgctgcacccagcctccatattctttattctagctgctcaagcagttttctccacacctgtgcttctttaaaacagtggacttgatggaaaaattgaatgttaccactttagttggatcctggagatggataattcattgataaggactgccatccacttggatgctttcttcagagccctgtcaccaagaacagattggcagtccattctgtaattcacagcatacctttattgctgacaaagttccaagtgaaggtacctgttagctggggctattaactccctcttgttgggctcctgtaccctgtctgcaggggctagggccagtggccatgatgagaaatgagcacacgtggctcaagaacagagcctgtgatttgcccattggtactgagtccaccttggtgggaagtcagtggcaattcttccacccacacaccactgaccttgccttgttggtggccatcttgtgtgttggctcttgaccagagacgctctgcagtcactctgtggggctgtttgaccacaaaatgtgtcactgggttagtggttttatgccaaggtaagattctgatagaaggcagttaaggtggtagtgtaaaagctgcatgaacaatcatggttcttcttgaatacaaaacagtaatctctgccactaattcattgactgccaagtcccaggctctgggatgggtactctttgtaagtcatgatttcatttaatttcccaaaaagtccatcccatcacctgtaatctcacagctagcatgtggccgacactatattgagagtggggtttgtgctaatccagactcagcaaaatcttgactactgggaccctttcatctcatccaacatatttgagggatctcctgtgggccaggcactgatcctagtgctggaagtccagagataatgcctcccttcaaagagtttctagttcaataaagagagcctcatttaatcaaaagtgttgcacatactataattttaggagaaaattaatcccaggaaacaaacgtcttaggagatattttactctaggaaaaaaagataatccaatcttttaaggatttgtttttaggacaatacacattaaatcattctcctgaatgtgaatgttgacaccactctctggtcagaaatgtcattcagaacaacagtgttaaggcgcgtgcgtggtattctgtcacccaaaatgtgttagctatgtttactcctcataccaagatttttctcagacactcaagaagcatcttcactgatgcagaacaaataggaatttaaacccacattttcataattgattttagtactcttttataatcagtgtaggggcaaacattttaagtttgttcatcccttctataaatcttgtaaataaagttaatacttgcatgtcactgatgaattcacttccaagttactgcctgtgacctaccatgcacacaaagcagtggttgctggcaggtgtggcctgacccttgttgtctttcacaccactttgtccctcagtcacaaccaccaagctccgtccactgcacctgcccacgtcctgtgtgctctgcacatccctgattccctaatcatacacaggttcctcctttttcctttctcacagcacccttggcacttatctgaaacatagctttgtatttttttgtacacacagctgccggctagctatccctccaagagcaaatactgtgtctgttctcttcacccatttataaaatggtcatcatggtgcctcactcatcattagcttttactaaagggtgggtagatggaacgtgaaagggtaggtgggtggatggatggacagctggaatagttctttcaccaagcagagatggcccctaacttatgatggtttgactgaacaattttttgattttatggtggtgcaaaagtgatacacgttcagtagaaaccgtacttcagtgctgtattcaacagattacattagatattcaacactgttattaaaaaggctttgcgttaggtgtttttgcccaactgtaggctaatgtaagtattctgagtgtaaggtaggctaggctaagcattgatgttcagtagattacgtctattaaatgcattttttttggggggcggggacagagtcttgctctgtcgcccaggctggagttcagtggcgccatctcggcccactgcaagctctgcctcccgggttcacgccattctcctgcctcagcctcctgagtagctgggactacaggcgcccgccaccacacatggccaattttttgtgtttttagtagagacagggtttcaccgtgttagccaggatggtctcgatctcctgaccttgtgatccaccagcctcggcctcccaaagtgctgggattacaagtgtgagccaccacacctggcctattaaatgcatttttgacttagtatattttcagcctacaatgggtttatcaggatataaccccgttgtaagtggaggaacatctgtacttgagtatggggtactttctagtactggcctgttgcagtgaatcagatgtcacctctcaagtcaccttctggcaggagagagagacatacgtatacagcgtgtcaggtgggaaagggcactatgagcaaatagagcagataaagcagagtaaggcaggtagagagaagaggtggggatgttgttgtccgtgtgtgtcaccgcatggagaaggtgatatataagcagagacccgaaggaagtgaagggatgaaccgtatccagttcatggctaaattctcaccattccatgttttcagagtgaattctatctgtgtgtctatcttgtctcatggtgcagttttagtttttgccacacatctaaagctaaatacaccaggtttagtggaagagggcctctggaaggatggaaatgggagctgcctctttttgtggaagggacaattccagggtgggaaaaagatatttatgggccacattttttatatcttcaatttactttttattatcttgaggaagtaatagatcattgaaaatgtgaatttttttacttctcctgttgagagacaatatgaagttaataagaacaagattactttacaaaacattctgggcttggcaggttcagcctcatttgtatgtcattgatttctttacatttttctctgcatctgttgtaggattttacaggagtcatagaataacggggtcaaatatttctcttaatctgaaaggcgccacattaaaacagggtggtctggttgtaagcgtttcctccgagtgggacagacgaatgttacatatccagttcaggtagcaggcaagctgtttccgattgccaggaaggcccttagaaccagctggccttcgttaagttaggctagagagcgaataaggcagtatatctctaagcagtagcccaaagaggaaagtgattgctgtctccaatggagggatcacaaaggtgtggaggcctgagtgacctgttcaccttcctttgcctgcaactgtggacacagttatatgtgaggtggtggcacttgtcctattcgggtacatgcatgagatggaaaggcttagctgaccattctgcagccctttccaaactaggtgtttcagtggcagtgccagtacttgctgggaatcctgctgcttttcctgtggtctgcccgttgcttatgctctgaaaaggcactgtttgaaacctcaatgccctaaggagcatcttgggtgagaagagagattgggaaactacacagaggatgctcaggaacttcaaacctggaaaatgccagggcagtaattctcagagtgtggtccacagacccctgcttcagaatcatcacaggtgcttgtcgaaatgcagactcctgggcccattccaaagcgcagaaggtgcagcactggaattaaggggctgtctcccaggggtgacaggcacatacacccaggcaatggggagcgacacctttgcacagaaacccaccgaggcagctattgcatttcctgattatgaggtgatttatttcctctaaaaatgtatcctatagccctttcccagggagtctaatttagcagatctggggtggttccagacagggaaatcagttagaatattaatgaattaggaaactgttttcattttttagcagggatctctgtttgagacatgggtgtctcttggtaaactctaaggcaattggatctccatattcttagaatcctggcaaaggggagaattcagaagggccccacctaggctgtgcccatgatgaactggatatagtcttcacaggtcagtgttgattcagcagtatttcttgagaccagccctgggtgaggccccatggggaacactcccagccatgttaccattaactggctccttatagtaacccagctgtgcctttccccttgcctcctctgagaggcctcgctcctgcctggccccttccccacacacatgggcatccccatcttcattctaccttctgccctgctggggaggctgagggcccagcacagctatggcccctggctggagccctgtagtttctccccttggcaggcatctccactagtgccatagggttggtgctaggtagacaagtgtgaagggctaggagaggaggacaggggttttgcattggcacagtagccaagacagcaaaggttggaaaagaacaggtaaaactatcacagtttgcagattgtctacctggaaaacccaagagagtcaagtgaaaacaccatagccaagatttgtccaggggaggaagaggtttcaccaggccattgaaggaagtttcagacaacagtgcggagggagggctgggttcatccaggttgttcccagccctttgtccttgtctgttagggcctctttcttccatggggcgtggcaagggaatagcgacttagtgttctaaataataacatggtcatttccggagtacttgccatgtgccaggcatcattctaaacatgtatgttaactaatttaatcctcacaacagccctgtgaggtggcgatttcggtcagcatcatctcattacctccacatgcagggagggaaaatgaagtgtggagaatcgcagcaacctgcctaagggtcacatagctaacaagtggcagagcccaggaacctgcgcgaggcaccacccactctgcactgcctcccgtcacacagcaagatgggtctatctcccagaggcaccttgacttctgcactcataaaataggccacacagtagagattcagtacgcattgttgaatagctttcatctctagggcagttttctgtcttcaagacaaacagtggcctgagagctctgagaatttaggtatccagggatccaattgctttcttatttactgagagataggcatgtctctggtgagatcctgccaaacataaactcctccttattaataaatttaggaattgtctggaaccaccacgatggagactatcaacaatatgtacatcagttctctgagttgaaaggtgtgtgcacagcactgcccctgatgtctgtgactttcggtcagagacttaacctctctgatctttagatcttcactggtttaaaaagaaagagctgggtcagtattaccaacctcaacaggtcattatgaggattaaatgagacaacacatgggaagggtctcatccagtgctggctcgtagtgggatctccatgaaggtaagtctatccctgtgccttccaggaggggcaacagctatgtgggatttcataaaacgatgcattataggacctgctccctgccctcacctagcttataatttaggcaagaagagtttctgaaaccacagacatagaaatcataattccaggccacagcaggggagaccccacatggcagtgcctggtctggtctttagagcaggcatgacctatgcccgtgggcccacatcccttgtagctgtgatttggggcaggaacagtgattttacaaagttaaaaaaggcatgtaaaaatccagactttcggccaggaatggtagctcatgcctgtaatcccagcactctgggaggccgaggcgggtgggtcacctgaggtcaggaattcaagaccagcctggccaacatgatgaaaccccatctctagtaaaaatacaaaaatcagtcggatgtggtggcacgcgcctgtaatcccagctactcgggatgctgaggcaggagaatcgcttgaacctgggaggcagaggttgcagtgagctgagatcacgccgctgcactccagcctgggcgacagagcaagactccatctcaaaaaaaaaaaaaaaaaaaaaaaaaaattccagacttctagcctgtctcaaaaaatcaggaggtatggcaagaatgggctcaaattcctacacggtaacagtcagcagcccccagatgggctgtggccacccctcctgcagagctctgtggtgtgtctgggctgagtggggctgggttcaaaccctggacccaccacttaccagctggcatgacctcaagcaggttacctgacctcttctgtacatctgggcagtggcagtacctgcgtcctgatcttgttgtggggatttgctgagcttcagtctgtgtaaaagcccagaagcacctgataattattattgtggctgctgttattatcttgactcctctatgcccaaccctgggaagcattcatgtgcttgctctgtgggtcggaagaaggaaaactcatcacagcctggggattgatggactttttagaggacctgtcttttgaattgggcctgaactgcgagagggaagagccatgctaggcagggggacagcaagagtaaaagcgcagaggtggaaagtgtgcaccgtgtcaagtggctgtcagcagggtccttttatgactgatgagttttcttttgtttctgtgtgagttgcaaatgggtttgggtcttggtgcacgtcagtatcttggacccctgaggaaggatgtcatcacccccaggttgagcatgcacagccttcttcaggacggtgagacgaacccgctgagcaggctgtgggcaaggtcactgtggggtccaaacagagacatggggagggtcagaggacccttctgtgtcattacgggattgggaagtggaatggccctaagatgtcccctgggactcgaatgtgacaaaaccttgtccctcagcagaagagaatctagaaaatctgtctggtggagtcctggaagtgggtgaggtgtggggtggggtgagaaggggttgtgcaagactggactggtgacccaagggaggcccagaaaacgccttgaaggggagcacaaagatgggcaggagaaacctccagtttccctgtggctggggtggggggagggtttgggggccaggtgcatgaatggaccccagctcctttttgggtgggagcagccatgacaaggaactgtattaaacttcgaaatgcagaactctagagtagcctgtgtctacactgattttaagttatgaattttctagtggttcttattataggtaatgagacatattccctacaaatcaggaatatcctataattctatggtttccacctcccaatgacacctctctgattgtctcacacttagaagtaatacccaaaaatagcctttgaggaatcctatgccccagtgttttatttggaaggtaaggtcactgtatttatgtatcagccataaatacttgaatgagagtgaaaattcctaaggatttgccatttccggctgatggcactagatcccttggaagtgtcccatgtcataatatgccaacacatttagaattttcaacagtcatggaaacaaacaggtgcttggggcagctaaaaataaccaccctgggaagtgaaactgtggcagtgccaaggagctaaggtgggcagtactgcgcttttgggtgaggtcaaaactctggagggaaggccaagaaaagaaaattctgcccatgcccctcctcccagcacccaggagtgtgttttctcttctcagaatctctgtctgatgtgctagcctttttgtgtcatttcgactgaaacgtctcacagctccaacccactgcccccatatcttgcatagctttctgtccagatttctgaattaaaggctggatccagagggtgtcccactgtgcatggatggggggcttcctcccaccccagtgggatgctcctgctgccattctcaccccggaacgcccctgactcagccacctccggggcggtgagaggtgtgagggatgatcggggagtgccatgctcagcagcctgaaccgtgtcagggaacccaggcattccagcctgtgtcatcctccccctcccgtgaagagccacagccacatcctccatgccctgctgcacttcctgaggagtgaaagatggtggctgtcagcgtgtcaaggatgacgggtggcaagaggggtaaacacagcttgttactaccagattcgattaccgggtgatgctcgaagacaaatggcctggggcctttctgccccttgagggcaggggcagtcttagtcaccaggagcagggtcctatgaggaggagttagggatgttgtggaattgtctcccaaagccagtgccagccgataggactagttgtgttatctcgagttttcgttgttggtagttttgaattgggagccttgatttgaccctgagaataaccaaaactgtacaaaagacatgtgtattcaaaacaagacacaataaggctcaaaaacaaaactgtctatggtgataaaggttagagtaggagttaccttgggggcagaggaatgttggctgggacaggatatgcaagaacctctagaatggttctggaatgttctgtatcttgatctggtggtggtgacacaagtttatacagatgtattaattgagctgtacatttaagatgtggggaatcgctctgaacctattctggtaacaggggctccccgagttttaaaaaagatgtgtacattttactgtatatatgctatatctcagtgaataagtaacaataaagaaaaatatgcataaaggtggactgtgaacagaaacaccttggcaacatttgaataacctagcttttaccatatttggagtttgctgtcccctggtcctaggtgctaaaaacctgatttggttcagtccagacatttaaaacaccagccagctatggagagtaaaataatggcaagtctcttcctagtttgaccatcaagagagtaatttggaaactccagccctgtgccctgaaaccagagtctgtccatccctctacaattagatgagattcctggggcatcaaggtcaagcagatccagctttgaattgctgttctgccactttaacaccgggaccttctgaaaaacagttgccctctctcaggttccgtttctttgtgaattgggtgaactcttgagtgttctttagcaaaggagtacctgtaacgtgctccacccagtggtgagtccgtagcaggtgatcaataaatgctaaagatgctgattgtcattgtcaccactatcacgaaattgtgcagcgttcgagggaactccagggagccacataccctcgccagtgatgtacctctacaatggcttcaacaaacagttcccacacaacgcaacttttcctacagttgggtgggctccagggtgcagaggccccccgccttgcttggcaggttggcttggctggagcctttgctggttctcagagcgggaacatggtcgagttggccaacagtgtacccacgttgaagcagctgtgccgaacatctggctctgattatctggctgggaatggccgggggtgggagcactgtgatttatagattgctcctttggctgtaaatcccatctgtaattgtgacttctctgtccctaattgtttgcagagaagagaggagctcaatggcttacaatccctggcagagcccaaggctgctggggtgggggtgggggggggtgaggggggtggtgaggtttgttgctaggacacggctgtctttgttttggtccctgctcagcagtgtttttaaggccctgtatacatttctctgtattgttaatgtaatttgttcaggcagtgaacagccaagttcagccgaaggaatccgatactcataacagaaacaccagaggccaggtttttgtggtcaaattagggttttgaggcctctgaagagaatgaaatgttggcgctgggcgggggacaatctccctttctcctcttgtggtgatgctggcctgggttcagcttccttgaggagcttggctttggggcaccaagtccactgcattcagggctgtgttaggtggggagcccggctgcccttctccgagaaagggaatgcagattttattcaaaagggaagaaaaggcactaacaaagtatgagcaagtttgggccctgcctgcccagcctttccttccccgtggctccgggcagcttttttccccccatcccccaccctgcattacttgactggtgaggaaataatagttgggctctgctgagaaggtatgtgactgtgcaaaatgcaatttgcccgtttccgctgcccatgaagacccgacagcccacttgccatctgggaacctcgcgccctgctgtgcttggagttttcggaaacgatggattccaaacaacttccagtgagcaattggtgatattaagttaactgagttcatcttaccctttttattttgcctcagagagtaaaataagatagaagcaaacataccagcccacaaacatgtccatgcttccttttgcttctagaaggcgtatgttgggaaattaatcagaccaacgttagccccttcctcccggccctggaagaatgcctggtgtgtgtgcatccccctctccagttagcaattaccgaacaacttctgtggctaccaaggagagcatgatagggtcccagccctccagagcttacaatgtaagagaacaaacaggaacatgagtctttacaatacctgcagtgagcgccaacaaagtggaataaaatgtcacctgaaatacctgagaaaggggcttctcaagcttggagaaggcagaggctttggagagatgtttgatctgagccttgcaggagaccgtccaagtgtgggttctagtactacctggatgcaagccttcctccgcctgtgtcccagcaaggaagagttgccttcttaatgaccccattcattgtccctagaacgtggtgatttaccagaagtcttcagaggcaagccatcttcaattcagaaggggaatcccacatgtgtgttgaatatgaggcattgtttaagacacctcctgccctcaccacattggcaaactgacagcgtcaacttgaaacaagtctgcacattgtggccattttcactccacaacaaatgtttgtaagtggccacctaagcctgtgaacttcctaactttgataattacaaacacgaggtagataagattgaagcaaacctggcaagttatactgacttgcagctgaagcactctgagaaacagaacaatttgttcacagaaaaaggaaattaaggtgtttctacactctttaatttccaaggtctttgtttaaagtgaatgagttcaaatgagggaagacacattctgctcacgtttgatgtcactcactactcatgtcgcagcatagggtgtcacagcctgtgtcccagcttcttcccatgggcaccatgctcttcagccatacagactcggacattccactgccaaccagtatcctcaccaatgaccccaaggtgctgttgaggcacttttctttttcagagtttactgacatcctacccaccactgagtagcatgttccttgcccatgattcccttctgtactccctcccccaataccctgtataggccaagtatcccttatccaaaatgtttggggccagaagtgtttcgcagttttggaactcttattggatttgggaatatttgcattatactgaccagctgagcatctgtaattggaaaatctgacatgccccagtcagcatctcatttgagtgtcatgttggcactcaagaagtttcagatttttgagcattttggattttgtattttcgattttggggttagggatgctcaacttgtactagcattaaattaggtctaatcagtttttatcaaaataatttttttcttttttgtctccttcactagaccatggaattccttggaatcaaaaatcatgtcctcttctcccgtgcctagaagaatgcccgagaggtgttcactatgtatttatagggtgaaattttcctatatatgtcttatatcccttaagaaatttttttccagacaataaatgctcccttttcaaagcactataattaactctaggtgtttttgatttaaaatgttctgaaatgcatcccacacttttctaactttacttattttatttatttatttatttatttatttatttatttttgagacaagatcttgctctgtcacccaggcctggagtgcagtggcacgatcttggctcactgcaattccgcctcctgggctcaagcaatccttctgcctcagcctcctgaataactgggactataagcacatgccaccatgcctggctaatttttgtattttttgaagagatggggtttcaccatgttgcccaggttggtcttgaactcctaggttcaagggatttgcctgccttggcctcccaaagttctgggattacaggcgtgagctaccacgcccagcgttatctgacttctagtggttccaaacatctatattaaaatcatgaactaggaaatatttagttaaaatatctttttattccaatgggggggggaaaactggtgatagtgttctttcctaaagcttttgcattttttcctctaggagaggtccttggatatttacccaggctttcctgacttgataaaagaacactgcttgattatatagtgcagtcatctgcagattaagtggcagctgaccatctaggcaggggaaaatatgagaagtaataatataaaaggatactctgtgatggacgggcataatggtgaataagatgttcagagccaggagcactgggtcacacctgtaatcccaatactttgggatgctgaagcaggaggatcacttgaggccaggagttcaagaccagccaggtcaacatagccagaccctgtctctacaaaaaataaaataaaataggcacacacctgtaatcccagctactcaggaggctgaggtgagaggatggcttgagcccagaagttaggggctgcagtgagccacgcttgtgcccctgaactccagcttgggcaacagagtgaaaccccatctcaaaaaacaattttttttccccagaaaatgctgttgtatgctttccattgaaagaaagaagcaggatcagagaaatgcagactaaaacaatgagacggcaaaagttaaagtctaagcatactggtgttggcgaggatgtttgttaataaatgacacatttgcgtattatattgaggaatgatttggcaatatctagtaaaatcaaagatgcacatatcttatgacccagcaaatctactacacatgagcacaagggacatgaacaagaacgctccttgctgcattgtttacagtagcataaactagaaacaacatatgtggccatctatgtattaaataaataaatatagtcatctagtagaatatagtgaattaactcagatctacatgtattaacatgaataaattctaaaagtgtaacactcattagaaaaagtaagtggctaggctgggcacagttgctcacacctataatcccagcactttgggaggccgaggcagtgggatcacttgaacccaggagtttaagaccagcatgggcagcatagtgagacctcatctctttgaaaagaaagaaagaaaaaataaggggctaaaaaatacctaaaatgtagtgccatttataagaatgtttgtaactcccaagagaatgataattgcatttggttatacaggagaatgccctggtgtttaggagatctgggctgaggtatttgagggtaaggtgttacaatgttgacaactgactttcaaatggttctgcaaaattaaaatgtgtttgtgtgaatacatacataggggagggaggtaagcaaagccaatgtgtgaacatgttaacgatgattgatctggatgaaggacagatgggtgtttattgtacttttcctataactttcctgtaaaatggaacttttcaaaataaaaaattgaagacactcattgaacctataaattgtggataatacatatgtagtgaaatatattcaatgaaaaacatgcagaggtatgacaagcagtacctttaggacaacattacttctgggagggcagataaatgaatgacagatcggatacttgagctatatcaataacactttatttctttaagaaaaaaaagaggtggggagctctagattaatatgggaaaatgataagctattcaatctggtgtccattagtgtctctacttactttctgtacttaaaaaaaaatatatatatatgtatatatattttttgagatggagtctcactgtcacccaggctggagtacagtggcgcaatgtcagctcactgcaacctcctcccaggttgaagcgattctcctgcctcagccttccgagcagcttggactacaggcacgcgcctccatgcccagctaacttttgtatttttgatagagacagggtttcaccatgttggccaggatggtctcgatctcttgacctcgttctctacccacctcagcctcccaaagtgctgggattacaggcatgagccactgcacccagcctatagttttataactagatgatagtttattccataactataaacaacatttttaaaacttcagaaaagtgggaataaataatttagttttccttttaaaattaaagcttattttgaaagttattttggtgcttaaaagagagagaatatatattttgtagctctatccactggaaaagattagaaacaatgattatctcaatagcactgaccagctccagtgctcagattatattcaccaaatcccatttcccagttaaaataaaaccaggctcctgggagaaggagctgattcgatgtatgaagttagcctagaatatattgttatacaagaaagcatgaaagctattgaagaccattagagacccaagtctattgttacgcactcaggtactagggctgctaggtcggaaggactcagcagccaaactgagtaagacggaaaagatgaaataattagatcatcaagaatatattatatttattaaaatccttaagttcacgctgacaccaagaaaacacaacaaaataaacacaacactggtctcctttggaggacaacagggagctgagtcattattttcaatatgttaatagaaagaatcacgcatttgtcctgcctgtgctgtgtgctgtttgccactgggccactagttgaggaaagtttttctttacagaagtatttcagctaataaatgaagaagaaatagtcttgtttcctgtcttagttcattttgtgttgctgtaacagcacaccacaaactgggtaatttataaaggaaagatatttacttggctcacagttaaggaggctgggaagtccaagggcatagtgccgacatctgctcagcatctggtgcaggccttcttactgcatcgtcctatagcagaaaggcaagagagtacgcctgtgtgtgcacaagacggcagaatgggggatggggggcaaactcatactttaatcaggaacccactcccacaataagggcattaatacatttatgagggcacagccctcataacctaatcacctcttaaagtttccacttctcaacactgttgcattatgcattaagtttgcaaaacatgaactttgggggacatattcaaaccatggcattccctctcccctaaataaaataaagtaaaataacattgaacctgaatttgatcaagcctctagatctaattattaatttaccagaaatacaattcagaagaacatgttagattgacaccatgaggatatgattagcaaaatccagacttaaaaaaaaaaaaaactacaggaacaataacttggtttcctccacgaataatacaggaggcgtgggcagggtggaaatagggaaagagaaagactcctaaagattaaaaggctataaaagactaaaggtggccagatgcggtggctcatgcctataatcccagcacttctggaggccgaggagggtggatcacctgaggtcaggagttcgagaccagcctgaccaacatggtgaaacctcgtctctactaaaaatacaaaattaagcgggcgtggtggcgcacgcctgtaatcccagctacttgggaggctgaggcaggagaatcgcttgaaaccagaaggtggaggttgcagtgagccgagattggccattgcactccagcctgggcagcaagagtgagactccatctcaaaaaaaaaaacaaacaaacaaacaaaaaaaaaaacactaaaggcttggccaggcgtggtggttcacgcctgtaatcccagcactttgggaggccacggtgtggattgcttgagctcaggagttcaaggccagcctgggcaacatggtgaaatccctgtctccaccaaaaatacaaaaaattagcccggcacaggggtatgcacctgtcgtcccagctacttgggaggctgagttgtgaggattgcttgagccagggaggcagaggctgcagtgagcctagattgcactgctgcactccagcctgggtgacagagtgagaccccatctcaaaaaaaaaaaaaaaaaaaagattaaaggctttaaaaaagaataaaagacataaattgaccaatagcaaatgtatggaccatgcattggatcctgattggaataaactgtagggaaaaattatttgtaagacataatattagaaaattattgttaacccttaaaaacattttttaggattttaaaaaattttctgctttctagagataacacacagaaatatttaccaatgaagtgataggctatctgggctctgtttcgaaatagtcttgggcttaggggtggatgagcaaggagtgggtgggggatggatgaatggagacgggccatgagctagtaattgcagaacctggtggtggcttaaccagattcattatattgttctctctacttttgtgtacattggaaattttccaaaatggtttgtttttgagatggaatctcactcagtcgcctaggctagagtgcactggtgcaatcatagctcactgtagcttcaaactcctgggcccaagcaatccccccacctcagcctcctgagtagctgggactataggtgtgtgccatcacgccctgctaatttttctaaattttttgtagagacaaggtttcgaaatcctggcctcaagtgatcctcttgccttagcctcccaaagtgccgggattacaggcatgagccaccacacctggccacaaaataaaaggttttaaatatttcatttttattcacctggcagaatcccaggtagaagttagagtgtttggtggatggttgagtgtctgagcaggaccccacagccaaggggggttagagggaggggccggcaagggtagggaataaggcctgatcaagtgagctgctggaggtggatgtatggggtgtctgcttccccaggtggagctggatagatactggtgtgctgagaatgagaaggaggatgaagaaagttgcaaaacccagcaaaaagtacccaaaagcaaccactcacagcaaaaattgggggaatgagtgatttaaccccgcaaggcatacactttctaggactttacaaataagaacacctttagtccctacagcaaccctcccatgaggtatgtgcttgctgttctttgtccctattttacctttttttattatactttaagttctaggatacatgtgcacaacgtgcaggtttgttacataggtatacatgtgccatattggtttgctgcacccatcaacttgtcatttacattaggtatttctcctaacactatccctcccccagcccccactccccaacaggccctggtgtgtgatgttcctctccctgtgtccatgtgttctcattgttcaactcccacctatgagtgaggacatgcagtgtttggtttcctgtccttgtgatagtttgctgagaatgatggtttccagcttcatccatgtccctgccaaaggacatgaaatcatcgttttttatagctgcatagtattccatggtgtatatgtgccacattttctttatccagtcaattattgatggacatttgggtcggttccaagtctttgctattgtgaatagtgccacagtaaacatacatgtgcatatgtctttatagtagcatgatttataatcctttgagtatatacccagtaatgggattgctgggtcaaatggtatttctagttctagatccttgaggaattgccatactgtcttccacaatggttgaactaatttacactcccaccaacaatgtaaaagtgttcctatttctccacaccctctccagcacctgttgtttcctgactttaatgatcgccattctaactggcatgagaaatctcattgtgtttttgatttgcatttctctgatgaccagtgatgatgagtattttttcatatgtctgttggctgcataaatgtcttcatttgagaagtatctgttcatatcctttgcccactttttgatggggtcatttgtttttttcttgtaaatttgtttaagttctttgtagattctggatattagtcctttgtcagatggatagattgcaaaaattttctcctattctgtaggttgcctgttcactctgatgatagtatcttttgctgtgcagaagctctttaattagatcccatttgtcaattttggcttttgttgccattgcttttggtgttttagtcatgaagtctttgcccatgcctatgtcctgaatggtattgcctaggttttcttctagggtttttatggttttagggcttacatttaagtctttaatccatcttgagttaatttttgtgtaaggtgttaggaagggatccagttttagctttctacatatggctagccagttttcccagcaccatttattaaatagggaatcctttccccattgcttatttttgtcaggtttgtcaaagatcagatggttgtagatgtgcagtgttatttctgaggcctctattctgttccattggtctatatctctgttttggtaccagtaccatgctgttttggttactgtagccttgtagtatatttgaagtcaggtagcatgatgcctccagctttgttctttttgcttaggattttcttgcctatgccggctcttttggttccatatgaaatttaaagtagttttttccaattctgtgaagaaagtcagtggtagcttgatggggatggcattgaatctataaattaccttgggcagtatggccattttcacgatattgattcttcctatccatgagcatggaatgttcttccatttgtttgtgtcttcttttatttcgttgagcagtggtttgtagttctccttgaagaggcccttcacatcctttgtaaattggattcctaggtattttattctctttgtagtaattgtgaatgggagttcactcatgatttggctctctgtttgtctgttattggtgtatgggaatgcttgtgatttttgcacattgattttgtatcctgagactttgctgaagttgcttattagcttaaggagattttgggctgagacgatggggttttctaaatatacagtcatgtcatctgcaaacagagacaatttgacttcctcttttcctaattgaataccctttatttctttctcttgactgattgccctggccagaacttccaatactgtgttgataggagtggtgagagagggcatccctgtcttgtgccggttttcaaagggaatgcttctagtttttgctcattcagtatgatattggctgtgggtttgtcataaatagctcttattattttgagatacattccatcaatacctagtttattgagagtttttagcatgaaatgctgttgaattttgttgaaggccttttctgcgtctattgagataatcacgtggtttttgtcgttggttctgtttatgtgaaggattacatttactgatttgcatatgttgaaccagccttgcatccagggatgaagccaacttgattgtggtagataagctttctgatgtgctgctggattcggtttgctagtattttattgaggatcttcgcatcgatgttcatcagggatattagcctaaaattctctttttttgctgtgtctctgccaggctttggtatcaggatgatgctggcctcataaaatgagttagggaggatttcttctttttctattgattggaatagtttcagaaggaatggtaccagctccattttgtacctatccctattttaccattaaggaagctgacacacagataaattacttgcctaagtcagtggcaagtcccttaagtcactggcaaagccaggatttgaatctgggctagcctggaacctggcttctttgctgctgtgccacactgtgcttctctatgtcagtgcaacttccaagttttggtggaaatctaccaccataaagtagcttcctctcccaactttattctcttagttcccattctcctaatcacccaaacttggtgacttcagctcttctctccctcctgtcccataataaccactcactcctaggtcctatgtattctctaaaactgtcctgtgatcccagagccatctctcagaacacagtttgtggttttccagcctggatcactgcagtagtgcccctgactccagctcttccctttctgtttatctccccccgccttttttttttttttttttaacctcccagtgcaccactttctccatgtcattctcgtgcttgcaaaccttcaaggcatcctcattgatcataaattgaacacaaggtcttgcttctaagacagcgagaacagtcagggcttgggttcaaatagcaccgctgccgccgttttaccctgtgaccctgcaggatggggatgggactcactcagagaggctttaagatcagatgtgcaaaagcgtacatagagtggctgagaaaatacaagcacttggtctccagagtgagttggtgcttaacaaatgttcactcctatgctgttttgctgtttttccggcatctaccttgtaacaactctaccaaatccctttatctttggacttctcttcctgccctcacccctttgcacttagctccgctcactgcattgctctgctctgcttacactgtcaaaccccctctgaactcaactaaaggagcctccctctccctcaggccttggcgacctgttcttcccatgaactactagagtggttgccacttgaacaacgcctgggttttttggaccattcgaatttcagaaaacttggtggggaaaagggactgtcagagtaataccccctcttttttttttttttaaccaagtaagaatattaagagaaacaacgatcctaatttcatgtgaaaaagaatattttaataataacaaaaagggtgggtggggggacaagctcaccctagagcaaaggacagtcttttaaattatataagcttagctttagttaaaaacttgactcttcagtcttgtttctaccattctaatagaaaccagtgatgcctgccacttatttgagtgtatatggctcatttcccatcctccttataagctctggattctgggctgggcacagtggctcacacctataatcccaacactttgcggcccaaggtgggaggatctcttgaggctaggagttcaagaccaggctgggcaacagagtgagaccctgtctctacaaaaataaaaattagccaggcgtggtgccgtgcacctgtagtcccagctactcgggaggctgaggtgggaggattgcttgaacccaggagtttaaggctacagggaactatgatctccctactgcactccagcctgagtgacagagcaagaccctgtctccaaaaaaaaaaaaaaaaaaaaaaaattagtcacaaacattttcatgttgtttgggtatttgtttttccattcaacatttaatccttgagtaggtcctagcagtctgggcagtgtcttagggactaaggtattataaaaagataggagactgggtgtggtggctcatgcctataatcccaacactttgagaggccaaggcaggaggatcacttgagcccacgggttcaagatcatcttgggcaacatagcgagacccagtctctacaaataattttaaaaatcagccatgtgtggtggtgcacgcctgtagtctcagctacttggggagttgaggcaggaggatcccttgagactaggaggtcaaggctgcagtgagccgtgattgcaccactgtactcctgcctgggtaacagagtgacacaaaattctgtttaataaaaattaaatgatagggttccagccttagagggactgcgtttcaagtgagagagagggatgaatgtccagtcaccagtggggacgttgtgctgaggaagggcagcctagaccttgaaagggagcgaagaggtgggttggggctccctgcaaagtatgccacctgacttggggttcccaaggagttcagaatggttggaatttagtcacaggaagcaaggaaggagatgttgagagatgggctagggaggtaacagagaccagccctcaaagtccttctttatcattcttagaaatttgaaccttaggctgggctcggtggctcacgcctgtaatcccagcactttgggaggccgaggcgggcagatcatgaggtcaggagattgagaccatcccggctaacacggtgaaaccccatctctcctaaaaaaaaaaatacaaaaaattagccggggagggtggtgggcgcctgcagtcccagctactcgggaggctgagccaggagattggcatgaacccaggaggcggagcttgcagtgagccgagattgcgccactgcactccagcctgggcgacagagagagactctgtctcaaaaaaaaaaaaaaaaaaagaaaggaaaagaaattagaaccttgggccaggcgcggtggctcacgcctgtaatcccagcactttgggaggctgaggcgtgcggatcacaaggtcaagagattgagaccatcctggccaacatggtgaaaccctgtctctactgaaaatacaaaaaattagctgggcgtgttggcacacacctgtagtcccagctactccgggaggctgaggcaggaaaatcacttgaacccgggaggcggagcttgcagtgagctgagatcgtgccagtgcactccagctgggagacagagcgagactccgtctcaaaaaaagaaaaggaaggaaggaaggagattggaaccttattctgaaggaaacaggagctattgaaaaggtgtcctataaccccaattctgctaaagagatggagagagaaagaactggaatgataggaacatgtgtacaagtgcagctctattctgacaggacactaggaagaggcacaccagactgagttacatacagagaaggggggagcacattcagaggggtcatcacctcgtctgtcttgagctactagagagagagagaagggaaggtgaaagtgtgttgattaaagaaaatttggagattgggggaagatttttttaaattttacttaatcatccagccaccaatatatatcagttttaaaatgttggtccagtttgggtgcagtggctcacacctgtgatcccagcactttggaagactgaagtaggtggatcacttgagctcaggagtttgagaccagcctggccaacatgggaaaacctgtctctactaaaaatacaaaaaaatagccggacgtggtggcacaggcctagagtcccagctacatgggctgctgcggcaggaggatcgcttgaacctgggaggtcaaggctgcaatgagctgagatagtgccagtaacactccagcctgggtggcaaagtgagaccctgtctcaaataaataaattaaatgttggtccactttctgccagacctttcttctggcatgtaagttttctgcttctttctctttttcaaatatcgttgtcttcatactgaggtacaatttggtgtccagcttttttcacttcatactttatcctaagcactttcttcagttgactcccctgtttccttgtttttagaaactcgggtttttctggtgctttactctcataaacaatagtgcagtgcatgattcttatggattaagctttttctgaatttaggattagtaccctggagtacaatcctagatttgggctcattgagtaaaaggctagaaacatctttttttgagacagagtttcactcttgttgcccaggctggagtgcaatggtgtgatctcggctcactgcaacctccacctcctgggttcaagtgattttcatgcctcagcctcccaagtagctgtgattacaggcacccatcaccacgcccagctaatttcttgaatttttagtagagatggggtttcaccatgttggccagggtggtctcgaactcctgacctcaggttatccactcgtctcagcctctcaaagtgctgggattataggcatgagccaccacgcccaaccttagaaacatcttaaagctacatcatatcaccagatttccttgcagggggctgaatcagcttataccgggggcaaccatagagtgcccatttctcctgcatccctacgtgacactctgctttctgtggggcagccttgttattgcgaagaaccagtactactaacgtgcttttttaaaaaacaaaaattgtaatagcttcaaggctgcatacacgttgccagaggaaaagcctgaggggatgggtggatatcgccttttaatttgctgttagttttccataaaggaacaaatgcctaaaactttccaaaacttagtctaagtttggacagatccctgtgtcttgaaatcttggtcccctcaggaataatgctctatttagagaggaagaacatataaatgttcccagaaacattatagggtacttgaaaatcctttggaacatctgcaagtatcttgcagatgaacgaggttactaagctggccagcaggaacagccaggtctaatgtgcgcccccaggaagccaggcctgttgaggtgggtctgttagagagccccaggctgtagggttgcccacctgactcagctgcccaagcatctctcctctgtctggcgcttcctcctagcatcctggtttgtattcctactttgagttgaaactgggcttttcactcctgagtagctctagaagacctaagaaccacttcacatctgagaatgatcaattgttggctgagatgacagagttatctggtccaactatttgttgcctggcctctgcctgaacacctgcagtgatgggggcagcctagagcaaactgaattcctcctcgtccacgtgacagcctttcacttttcagatcaccttcctcacactgatggtctcatacaacatcattttgaatgtcctcagctctctgcaccacccacccaactccactctgggccaccgctggtgtatccaagatcaggacaccagtccctgggcaccagggagtatgctggccactgaagcagcttcgtttttccggcacccatgttgtaaaatcgactcccccaaaagttattgtccacatgtgtaactgtccctcccaccatgtccccttccacacactatttcccacccctggcatgggtataggacgtcatttctgttaaccttgtgttggtgggtttatctcttttttctagcgtagtgtagggattgagggtgcagaccctttggtcagggtaggtttagatcccaccctgggtgagtcagagagcttccctgtgcctccgtttcttcatctgtaaaatgagaccctcaacagcccctacttcagatagtgctcaagaggattgagttaatgttagcgaaggacttcggatggtgcctggtatgctgtaagatgggtgtcatttctcattgtcacaccgttgagagtccagatcttcatcatgtttcctctgcatctgactggtgagcctcccagatcagcagcccacaaggcgatcgggtcagggctgagtagctgccagcagaggctggagacttgaggctgtcgtgcaatccattctcgcctttgtctgctttctgtcttttgttttctgctctgtgtgtgtttgtttttgtgattgttattttaagtctctctcaggaatgcttcgtgatgctcagcccggtcaagcgatctgtatacatcctccattatttcttctccatttctttttaatcatatttcctcctctgaacttctaccctcagatttattcattatctaacaaatactgatggtgcagctccatggcccaaagctgttctgggggccacagcagtgatatgagtgtcctggggaagctgacattccacggacacaagcagccattcgtctgtctcattccgccaagacctctgtgaggtcttgttgacccctttgcatgatgatcttaagtttgttcaccactgttcagcatatgggcattaaaccctatttttgcattctccttcccactattttctcctactgattaagcggtatctcctccactgttatttttcttccagtgacatattcaggaagagcaagatctcaaaaaatataaatgttgatgttccccatccaatcccggttgtcattagaatgtttatacttatccacgcagtgcttcagttctggaatatattcatctttaccttaccctggttagcaataacagcaacaggaattaaaaccagtgggctactgttacagcttggcaggtgtaacttcagagaacaaaggggattcttttttgttttttgtttgtgattttgtttattcatttatttatttttttgagacagggtctccctctgtcacccaggctagagtgcagcgaaatcacagctcactgcagcctcgacctcctgggctcaagagatcctcccacctcagccttctcagtagctgggactacaggtatgtgccaccatgcctggctaactttttgggttgttttgtagagaagaggtctccctgtgttgcccaggcaggttttgaactcctgggctcaagagatccaccctcttcagcctcccaaagtgctgggattacaggtgtgagcccccacacccatcctggagattcttcttcattttctcctgacctgaagagtcagcacactttctttttgtgttctctaaaaaggttaaattcagagatttttttttttttttttttagatggagtctcgctctgttgccaggctggaatgcaatggcgtgatttcggttcactgcaacctccgattctctggttcaagtgattctcctgcctcagtctcctgagtagctgggattacaggcacacaccaccacgcctggctaatttttgtatttttagtagagatagggtttcaccatgttggccaggatggtctcgatctcctgacctcgtgatctgcccgcctcagcctcccaaagtactgggattaccagcgtgagccactgcactcagccagagaattatttttaacatgctataaaattaacttttggggttttaacaaattgtaccaccacaatcatgatatagaacaattccacccacccccaaatttccctgggcatcccctttgtagtgagccccaaaccctggcaactgctgatccactctccatccctctggttttgccttttccaggatataagtggattcgtatggtgtgtagccttttgattctggcttcctctgctcactaatatgcacttgaaattcatccacattgctgcaggtattagtagttctttttcattaccgagcggttttccgttgtatggatgaacccgtgtttgtttattcattcatctgctgaagaacatttggattgtttctagtgtgggaagattatgtatataactgttataaatagtcacgtaaagtttttgtgtgagaatataatcttctaataaggcatttcacttttcatctctcttgttccactctgcttttttcatttcttttcttttttcttttcttttttttttttttttttttttcgagatggagcctcgctctttcgccaggctggagtgcagtggcatgatctcagctcactgcaacctctgcctcccaggttcaggcgattctcctgcctcagcctctcgagtagctgggaatacaggcacctgccaacacgctcagctaatttttgtatttttagtagagatgggttttcaccatgttggccaggatggtctcgatctcttgaccttgtggtccacccacctcggcctcccaaagtgctgggattacatgtgtgaggcaccacacctggccattccactctgattttaaaggttgtggaaattttggtagaaactctgcctggtaagttacagatggtactgcatcttttgaaggaatgcccccattctttcaaaagattgatttcacgaattcccaaacatatgccaaagaatttctcacctcttgagaagtcttggaccacattccccatctgctggaatttatgttctgcccgaagtggatcgcctacttaacttttaattttttgtctgtgggttgatacctttctaaatcacaaaatcaccatgatgctaagcaaaagatgaagacgctaaaggtggtgaggtccaggaaactcagaatagggctttgtcgtctcatggacacatgggaagaaaggtgaggtcagcttgagtgtgcagatgttggcatcattgaaggtgaaagggtggcttggattgcagaggctctgcaggagagggttgctggggatgggccgaggtttggggatttaacttgtttctgaagggtgttctcaaatcctgctctggataattccccaactaccatttaatcagctccattaaaccctgccctgtctagcgcactgtgctccagacagggctctcctgggctcccagtaatagctcaattgtgtgtaagtggctgtgaagaggctctgtgtgctggatgaataggcctcatctccatggaaaccagagcttactgaggggctgacctctgacccacttgttgccaccatactgttaaccactggtacctcttgggtggagaaagaaagcaaggaaatggctgtcagaattgttttcattttcccttagtttaggcctgggtccccactaagtacaaataacacgctcatattaatccaaagcacttggatgtgagtttggcttcattatggactttgtctgtccctaccctgtctccccgaagccatttctttatcctacaatctaggatgcagtggagtgagcagggttggtttatcaccaccctctggggatgctgggaatgtggttcctaaggggcagtgtggaaaagaggaaggccccgtgctgggagccccaccccctaggctcagggctggctcccttgtggtgtgaccatgggcacatttcctcatctgtaccatggagctaatccctacctgcagcccagaagcctcgcggagctcaactaggaagaggcagccaatgtgttatacctgtgacgctctccactagccaaggcattaggatcttaagggcaagggcaaaacaggtacctttttagcaatgacataaataaaaacttggctacaccttataaggggccaggtgcggtgtggctcatgcctgtaatcccaacactttgggaggccaaggtgggagcactgcttgagcccaggcattcaagatcagcctaggtaacatagggaaagtctgtctctaccagaaataaaaacccaccaggctgggtactgtggctcatgattgtaatcccagcactttgagaggcggaggcaagaggatcgcttgagcccaggagttcaagaccagctaagcaatatagtgagacctcgcctctacaaaaaaaatcaaaaaattagccaggcatggtggcatgccctcagctacttggggagctgaggtgagaggattgcctgagccctggaggtcaaggctgcagtgagctgtgattgcactgctgcaccccagcctgggtgacagagcaagaccttgtctcaaaccacgccatcccccccccaaaaaaaacccaaccttgagactcatgccaagatggctttaacaaccctgaagtgagttattcactcaagcccggtctgtatcagtgagtatttcagaccctatggcactctgtccatacaggcagatttttctggactctgttctttgctttgagatgacctgggtcaccatggttgtcctggactccaggagacatcacaggcaaaatcaggtccatacttcccccgtttgtctgcagagaggcctctggtgtgggtcagatccaggggctttccttctatgtttgcagctggaggcctctggatgcaattgtgtgaaccccctggtgtgtccctggagccccagaatgtaagaatgaattttcaagagaaaggtgagagacaggtgctgggcttgtcagatttctggctgggaggcatcccataaggtaagtcaggtaatttcttggaaagagagccttgccggggatcagttatatgtatctacccatgtatcatgctctgggggctgtgttgggggcaggggcaacataagaggtaaacagagtcccaagtctgagctcctgggagaaagtcagaatgcaaagtaacaatttcattttagaggagcgtcaaaagtctcatggctttctaggaattgccgagtaataggaaccaggaggagagaaggagggactgcagggtcatttgcagtgactgagatttccaaatgctttgttccctaaacctgtctaccaccacggggcgagggcatcagctctttgcatccctcagaccccaggtcactgtcgtaagctcttttcttggaactctgatctcagataacctgcattagtctgaaataggatgctgagataccaccataggctcaggagaggtgctttttagacctttctggttgggttttcccatctgccctgaagtatggtccaggaggtggtgatcatttggagcacgtcttaggactggagaggcccaaaataccttcaagccttttgttatagttctaaggtatttgttagaactcctggacagtttgtctagtggtttgttgtgttttttaaaatttccagcaacttgcccacacacttggccaagctttggactgagaaggatgcagtggtgcaatcacagctcacagttataacaaggatccttcactggatccttgttataactgtggcccctgattggagccctggtgactccgaggtctgcagtgcagccccctctcagcctgtcgcttgctgtctggggcttccacagtgtggagcagctgctcctttcctgggctacaggaaggctatgtacaacctgcacaggcatccacaggatcactcactctaagtggttcaacatgcttttccatcctcagaaaatgtcactatccatgtaccaactatttacaggagattgggttgggggcagtgttccctctgccccaagttgtggggagccagaaatacacatatattaaccctgggcttggagagtggagaagagagcatctcttcattctgcagctgtgtaaacagtggggttggggggtgggttgcaaagctaaggataatgggggagggaggaggggcatgaagaaggagggagggggctggtggggggctgccaaatcaggcagggtcagggaggagagggtaagaacaggaggcctaaagcggggttcgcgggctccctggctcttcacatatggaggacatgcctccgcagaagcgggaggcatgcaagcaaagtgtgagcggacaaagaggaaagtgacgcagggggaaggtgatgcgggcaggacccaacaggtggtggcattccaggcgaaggaggcttccgccctgggccgccagggtcagtgggaggaaaggctctccctgcctggctcagttgaagcagatgattattaggttcctgctgtatacccagagcagccctggcgcagtggcagcgagcgagggaggtggagattcagttgtgtaagacataggcactattcactaacagtccataagtgcatggggaagaaaggccagcacacagacgactccaggcttcggcactttgtgtcctgtgaagggttttggaggaaggggaggagccccgaagtcagggcaggcagcgggaggcgggcttaggagcttcagctggggcagggaaggccgttctccaggtactgggggaagggcacaagcaaacagagacacggagccttcagctgccttatctgcaaggaagatgactactcttttggggggattcagagcagcatcttatccggcacatggcacccgtggtaggaactgagtcatcccgcacagccggggccgtgattccttcattgattcttccttcaacgcttccttatggattgccttctgcctccagtcactgtcctaggagctgaggatggggcagaaaaccacacaggcaaagtctatgccctcatggatatcacattctgctggggggaaacagagagtgaacagatggaaacacccagacagtaatgatacaccatacagaggactgcgcagcacagtggggtagtatctgaggggctactttaggttggatggacagggaacaatcttttggagcattttatttatttatttatttatttatttatttatttatttatttatttatttatttttcttgagacagggtcttactctgtcgcccagactggagtgtcgtggcgcaatttccactcactgctgactccgcctcccgaggtcaagcagttcttctgcctgagccttccaagtagctgggactacaggcgtgatccaccaccacaccgactaatttttgtatttttagtagagatggagtttcatcatgttggccaaactggtattggagcattttaaacaggggtccaggggtatgactaaatctgatataaaatttaacgtaattccttaactgtgtagaatttaactgtgtagaaaagagatggaaggaagggttaagagttgggtccctgttttggagatgtatataccccacttccctcactggaccagcccgccaggctgaggctccccctgcagtccctgtatgctccttcctatgcagtcggaggccttccctgtggtcctttgccctgcttctctgctgctgtgagggttgctccctgccctccagacccctccctgccctgccacggacacagaccccaggcagcatccctccccctcatgctgggcacagtgtggactgtttctcctctatgtgcaaactcatcacagtgtggactgtttctcctctatgtgcaaactcttcccaacccatcatgccctggaagatgccatgcccccaaacgcagtgggagcagtggatttggcccaggtctgtccctggcctgctggatgactttgcaccaatctctccagggtggtactgtccaataaaaatgaaatataagctgaagcagtaattttaaattttcatgtagccacattaaaagagaatgaagatcgggcgcagtggctcatgcctgtaatccaggcaccttgggaggctgagacaggcagatcacttgaggtcaggagttcgagaccagcttgaccaacatgatgaaaccccatctctactaaaaatacaaaaaatttagccgggcatggtggcacgcacctgttaatcccacccactggggaggatgaggcaggagaatcacttgaacctgggaggcagaggttgcaatgagccaagatcgcgccactgcactccagcctgggcaacagagcgagactccatctaaaaaaaaaaaaaaaaacaaaaaaaaaacaagaatgaaaaggaagcaagtaaattaattttaatagtatatcttatgtaacccaattcatcaacagtattagcatttcaacatgtaatcaatttaaagactgattactgagacgttggatgttcttttctcgtactgagtgttccgtgtgtgtttcctgtggcctgcatgccatttccagggctccatagccacatgtggcaagtggccactgcactgcatggaccacgttgcacagagcagctctgggagcctccctttcctcctctgcacaatggagatgattatgtccctgcacctccctctctcacaaggctgttgtgaacacagaggaagccgggggactgctgtggagatgaaggatgttttaaacctcaggctgtcatcgcagagggtgtggatggcaaaccggagaggagtcaaagggctgatatgggaacttccctcctgtttctaacagttcccgtgttagaggtgaaggagataactgagaaacacacagatgataaaaccattggctgggcatggtggctcacacctgtaatcccagcactttgggaggccaaggtgggtggatcgcctgaggtcaggagtttaagaccaggctggccaacatggccaaaccccatctctactaaaaatacaaaaaaaaaaaaaaaattagctggacatggtggcgagtgcctgtaatcccagctactctgaggcaggagaatcgcttgaacccaggcggcagaggttgcagtgagccaagatcacaccagtgcactccagcctgggcaacagagcaagactcttgcctcaaaaaaaaaaaaaaaaaaatcagttgcctgaaatagtgcttgtacttacagattaagtcaccaaggggcagaattttgtgcctgctgaaatttgaaaaaatagtcttgcagccaaaagagagaaaaatgtgtttctttcctaaactatggtaatagtaaaagtatgtgatgctttttgttaagttttattttaatggaaatattaaatctgtgccttttgtttttgtttttaaggaaatggagaaaggaaggaagctggagggtttaaattcattatgctagctttagattctgcaaaatcaggaaatcagaaagtacaagttctcagagttagtgacatttaactcaattgggaagggcccgcccaaggtcacccttttaaagggtttgtcttccttttcaacattttttacacagcatgtcttttggagctcagcagtttttgctctctttctttctcagtgtgggaacagaagttggcacacgagtattttcctcatttgactcttgaaatgccctgtcctcagtgccttctacatggtggtgcacagtagaagtttgttgactgactcattgagtctagaggatgggagcaggggaacagcagggaagagcctctttgcactctttgatccagaggactggatgcactttgtttttgttttttttttttttttttttttttttttgagatggagtttcactcttgttgcttaggtgaatgcaatggcaccatcttggctcactgcaacctctgcctcccgggttcaagcgattctcctgccttagcctcctgacagctaggattacaggtgcccgccaccatgcccagctaattttatatttttagtagagacagggtttcaccatgttggtcaggttggtctcgaactcctgacctcaggtgatctgcccaccttggcctcctaaagtgctgggattataggcatgagccatcgggcccaacctgggtacactttcaagcagtccttgttcatgcatgataattcaggccccagatatatttttattttattgacttccttagaaacttaaaaaaagaaattaaatacagccactgtttatttttagtattttaactaaactgtctgttggactctatttgtatttccttaggacctggataactccgtgagtccaggaatagtttgctttttggtaaatattcctttcaggtttctctttgcttgcttgctttttttttgggcggaggggggcggtggtgcgggggggcaagaatagatttttgaatcatgagaacctaaaaacatctgtaagtctaagggaccatcttaaagaagccagtgagaacttcttctattatctggatcacttaaaatcaaaccaagcatttacctacaaggccccaggggctctgacatttgtgatctcataattcttccattgataccatgaggctggaaaccctatggttgctggcttccctgggtcacttggctgcctctgggctgccaacatagaacccacgtcacataaagccccggcccaagtaaaatgccaacatccaggccaaatccacacttttccatttgtgaacatgtcgcgcttaagaattacctcccttctttctgggatggctcaaataatggaaggaatggtcctccatcaccttgaggttttgtcagcttgacgtcctcatccaagcctgaccacagccgttatgacagcatgaatgcaaacaccacctctcctgacctagacgctgcacccggctgtgcccgcttctgctgtagggagagtcagtgaggtccatctgcagccttcctccttttccttgaatggggcttggcattgaggtttgtgcacaccctgtatagaaggcaaatgttgaggccagccttgtccccaggctcagtcttcctgaagactttgtcactcctgctcacagcacccactttctccccttccacacgggatgtgttgcttcctcctgtttcttctctttgcagatctccagttttctgtctccttcaagaaatctccccagggcctctatatccccttttctctgcctccctattgaagcagatgttttacctcagcctttcctagtacactgtactgttttaaaaactattgaatgaaagggcatgttttcctttcctttccccatttagattacacacctctggcagtggggcctccagcaagtcttaaagatctcgacgcaccgacatcttggcacatagtagttaacaataagtaactgttcaattggcttctagttgaacctcatatgtcttggttaacatgtgcaggattggtaggcattcagccccaattattccgcccttaactcatttttgcagtttattaataatcagttggcacgcagtttcgaaagaactaattctgtaataacatgttatggctactcctcggcgccattacatgcctgaggtcccttgctgtccctttgtgtttttgatgaaaggtaacagcctggtgttcccagccgtcacccagaggtgggagcagatccggctgctgcagcttattgctaggaatgggtgaggctgagtggaagctttagtaactcaggtgcggctcttaagctttgttttgagtttcaaaagggctgttttgtcccttactcgtgaagtggccttgtgtgacataatggccccctctgtgcagggttcgaggggaagggaaggggaacatgcccagcgactccacgtggggaagttgcatttccacaccattcacaggggatccagtgttttcggaattgtctgggtgtgaacagcataagaggtgctagaaactcagcaagggaagggggagctgggccaggaggagaaggctggggatgggctgaggagagagagcttcctggccagaggcagccccaggcatgggtcttgggttctgagtgggcaggattctggctcagggtgagaggtgaaacttcgttcaggagatatacgctgagccatccactacgtgccaggcaccttagaaagggccgggtattcatattgtgacttcacacggctccctgcagagttgacgttgggagctgccctgctagccacggaccacattgtgaacagcaccccctgggggtgggagatgtggtgggcggagttcaggatccagccacagggaaagaacgaacaggcaaactgtgggatcccggcctgccagggagggttcagggtaaagccttcagtttgcttgttcattcatttattcaatatttattgaaggcctcacagggaggtgacaaactctatagacacatacacgggggaagagcacgccaggcagagggaacagcaggtgcaaaggggatggcgcttggtaggttccaggagcgggcagaacagagtggctggagcagagtgggcaaggctggggggcagcactgaaggaggcacagtcagaaaggggacagggggctggtcacaggggcatgcagcccatgatgaagccttttgactgagatggggagtagagaggggtcttgagcagaaaggtgacgtgatccaacctttgttttaacgtagcgccatggctgccatgatataatcatagaccgaaggggtcaagggtagaaaatcagagacaagttgttgggccagtggggcctggatggtggcagtagaaatggggaaagttctcagattctggacccattttgaaggaggagtgacaggatttgctgatggaacaaatgtggggagcaagaggaagaagagttaggaatgtctcctgggcagtgggaaagaagaaagtgtcattgacagaaatggagaagactgtgggaggggcaggtttgggaggaaataattaggagctctgtttgggacatgttgtattggagatactttttggacatccagtggggagagtgataggtggggtaattgggtctagaagtcagggatgaggtctaggttagagacagagactttagtcatcagcatgttgatggtacttcaagccatgagactggaggagatccctgagactgaagctgagaaaaaaagaggtcaagggctgagccgtgggcactacagcttttgcacactggagagaagagcaagaactggcaaaggagactgagaaggagcagccagagaggtaggaggagacctggtgggcgccgcattcctgcagccaaggaggggagtgtacgaaggaagaggggctgctgctgaaggtcgagtgagatgagggctgagaaacaaccattaggtttagcaaatgcaggtctttgctgtcctcaaaatatagacttggcactctgcccgctagcaggacagattccagaatagaatctggtatcaagacagataccagggagaggaggctcttcaaaatcccaggcacgtctggccccctaggagactcaggaaaaagtctccagacttggaacctaagctggactgccttatctgagaagattggtgtaatcaatggtttggtgtcaggctcccatagagaatggggtgaagctgactatggctcagcacttgcttaggatagtgggccatagggggttcccttcttggatggagggccgaaggcaagcctcttcactgggcatcagtcaccagtccctcttccctctaagatggggtaggttggctgacaaggcttcccactggcacagtgcaaccagaagtcccagatggggacctggaaccatgtggctcatctttgagctacaaggtcagagccaggggcctctttaaaacagaccgggccaggcacggtggctcacatctgtaatcccagcactttgggaggccgaggcgggcagatcacgaggtcaggagatcgagaccatcctggctaacacggtgaaaccccgtctctactaaaaaaaatacaaaaaatgagctgggcatggtggtgggcgcttgtagtcccagctactcgggaggctgaggcaggagaatggcatgaacctgggaggaggagctggcagtgagccgagatcgcaccactgcattccggcctgggcaacagagcgagactccatctcaaaaaaaaattaattaattaaaaaaaaaaaaaaacagaccaacagttgcccatagaccaacagcagtttgtcagatggaaacagttaaaggatggccatgtccttcttgggcagtgcagtgccggttttggtcacccggtgactgaccagctctcctttgcccagaaagatctccaagtgaatggcagtcaggtgtcccccatgaatgtggtttaggacaggactgtccacagtgctgactcaatgcaatggtgttatttattgcttctgctagtggtggtggttggcttggttctgatctccagatgtaacagtgccatcccggcaagtgaaatcatgcattgggaaaaaatcgaggatggacatctcaacacagttgggtgtagtttccacttgcaattactcataagcttcacaggcttagtggaatcttaaactgccctcaaaggaaaactcaattagatcaaaatggatttaattacttaatgaattctaaatgtgtcaaaattgacaggcaagcttatttgggggcctgggagagggaagtactatgaagagtgtcacatgcctttcatgacagagcagaagggagctcacctcccacacagctccacccacatattcccagattgacatacttaacgactcacatccattatctcatttcatcctcaaaatagttctaagaattaagtgcagctggtataatcactcctatttaatagacagtgagttgaggcttattgaggtgatggatttgcccctggcaaggcgaggctctccacgcaggtctcctgacttctccatctggccgttgctcggtgggggaggaagcagcccctctgacaagtgtactcatggatattgccaccagcatttattaataacagatgagccaagtgctcagcagaattgcaatcctaaggactctcaagcatttctctcaagatatttttttcttatctcatgaaatcatgcagtctagtcattatctgatacatgtacccccatgatggttttgaccaccaccctccttccctcttgtccacttgtaggacaggagaattgctctgtgcctgatgtcaccataggtcctggctacccaccattctctgtaaagagtgagtgccaagagctttcagtgaggtacattccactggagtgggaggttttagcagctctttccttcataactgaaacagttgattgattgtgctgttaccaggctctgtttgtttgccccactgggtttgcatccctacaagaagccccctctgtctttttgcaggtgcttgagcaagtacaccatgctagtgagcagttcaacagaatccattttcttagagaaactggtgaagtgaacacagcttaccaggatacaatatccaaattagcacactaccttttattgttattaatatcaccatgaccgctattattaacctctccctcttatacaaacacattcactcatatgcatcctatttcagaaggtttatcttcttaaagactgatataattttcacattttactttaaacagtaaatacaagtgtaggaggccagaaagcaacagctaagttagaccctagtccgtaaattccaatcccttataagaaggaatctcttccaatgagaccttttgtttttcctgccccaaggtgaatgttttgagaacctttgcatcaaatcaattcagatacttgtctttaacttgcaaaacttaaacaaatggacttttttctgctagcactattttaggattcacagaaaatccagtctccttaagcagttgaattgaggtttttgccaaaattgtgagggtttgaaaatcggctttaaatttagagcatgcccatggtaaggttgcgcgggtgtcctatggctctgtagaattaagcattaacgttgcagctggattccatttctttgtgaacatgcaaattaacatcttcagtggcttcctctgcctgcatacttatataccagcctccaaatgtgttatttgttattaaaatcaccgtatttatgtgtgggggtttgcggtgactttcccagatgcagtgatcctaattgtaaccatacaggttattcaaacatagcttggatatttaaaacagaagcgaatctaggccagcatgcagttagttgagtgtaatgtagatgtgaaaagactccttgtggccggtagtgttcggttctgttagctccaagaatatatcttcctatggtgattgaataatgtgcaactgacctgggtccttccaggtacctacttttaaaccaggagttataatagatttataaatctttaggctttactggtatttgctttctgtgaacaggaaatctagggagctaactgcccccctgcaatatgaaaggcacatgttccccaaatgtgactttgggggctctctggggtttaataacaaacacttgcttggtttttgggactggcgtttcttcaactcacccatgcatgggaaccgtctgaagagattgtgtaaacgcagattctacttcagtagggctgtcgtggggcctggaactctgcatttctaacacaattccacatagtgctgatggtactggtccagggaacacacttggagtagcaggatctgcagccaaataaatacaacccagtctccaaactagagcggacaggcccccaggaggctgtttccatgggccctgggttttgctagccttcccgtcccacttatacacacttacatttgcagaggagaaatggtgaacacctgacaacatttgtttaatttttatcgttgtggggccttttgggagggaggaagaagagtatctcagccaaccaccaactcccaccccctaaaccatcaagattgctagcgttgtgcttgtagttttccaaaaatgtacatgaacatagctgatccacccactttggtggataaccttgccaataacagaggcagctcagccaggagtgagtgattggtccagaataaacccacccaggtggcagtcagttcttcactgccctgtttagacctggcctgaggattgacatttcctttaactgtctcaaatgagagctatcctgggcttcttccagcaacccgtgcctcctcccagactctgcaatcctgtgggtgctccataaatacttgttgactgacttgactcattcccttggggagggaaaaaaaaaacaggaggaagtagggaaagggggagtgaacttggttttccgtctcttgtaagtatcataaggaaatacctagcctaatgtctgttggcagactatgactgtttgcattctacaaagtagcatttgaaattttagtttttgcttttcactagttgcagtttttctctgtgtgctgaatgcagaaagtagttccctttggaatttccatctgggaacccagcaggagaaccagctgctgccactgccgctactgctaaggaaaaagtggtccctcgctggcctgtgctggtgtgggccccgattctcgtgcagttacccttgcatgggtgagcagagtcctgggtatttgctctggcgacaccagtttttgattgtttacaggctgggttttccctagttgttcagctgtgagaatctgaggatatgtttgttctttcctaattgcatcctgtgcctctttcctttttttccctccagaagtggaaggcatttttctgccttgataaagtgtaccaggccaaggggcctgttgtactccaaaacccctcttctcaaggtgaccccagttgccactcacctgcttttctgggggtctgcggaaccttcctcacagcctgcacaactgtctcccttaagaacccttcctggtacaaagcctccataaaactcatttgctcttgagtcttagttctggtggaacatatccctgagtttttgcacactgggcctccatccaggccttttcctgggagagtagaaaacccatgggctctgtggggtggggaaaagccctcagttctgggtctggaagcatcatcagttgcagccatgagcaaggttttgccattctgtgcctcagtttcctcatctgtgaaaaggtgataacattatttctttatcccactatgttgttctgaggattaagtgagtttgcagtgtaaagacatagacaaagacatagggacagagaaaggtaacatttgttattgttgtttttctgtagcatttgtgtctaatgcagtggactgtgtgcccaataaatgagtcctttaaattaatgatagaaagagaagtggggaaatgggttataagcagtgatgtactggtaaatatttaacagtcagctcctggtggggaggattgtgctctgattagtgtttgccaatttccatgatgtaaatactctccctgtggctgatttcaagctaccaacgtgacatcactgaacactgagtttgaaggagatgccagtacaccagtgccagctgctctggtccactactggaaggcatctgcaatagaccaaagccataaggcacccatcacccctggccttctcaccttgccacacacaggaattggtaactgggccttttaaaaaagcactcggtaatatattaaatattaaacatagactagctcaaaagtgagaattttttttttttgagacagagtctcgctctgtcgcccaggctggagtgcagtggtgctatctcggctcactgcaacctccacctcccgggttcaagcgattctcgtgcctcagcctcctgagtagctgggattacaggcgccggccaccacgcctggctgatttttgtatttttagtagagacagggtttcgccatgttggccaggctggtctcgaactcctggcctcaaatgatcacccacctcagcctcccaaagtggtaggattacaggcgtgatccaccatgcccagccgaaaaatgagatttttaataagcctggctagctttgtattacactattttgtgtttcgtgtatgttaaaagctcccaagttgtgccgtcccctgcaaagaaagccctgaatgcacagaattaggcacatcttgaggacagataacctttgagagacctttcagagccactaaagaaaggcaaaggagaaactgtagtctcggagaatgcttagtgttcagactgagcagcaaaaaggtgttaaataagtaattaacagctggattctaaatagcagctaagagttagaggcctgagaacatggcctgaggccaccagaaggtgggagagagataaaccagcctatatttaggagttaaacagatggcaggatcagggccctactttgtatttaggaggtttgtgtggtttgtttacttgggttttgttttttgctgtaactaatttaacaatttaggagtggaaagaaaaattaaccaatttatcttgctgtctgaataatgttttgcaataaccaagaataggtcagtggaccaagtgggtaggtcactgccctgcttaatgacccatatccggatattattatgtctaaatgataatcagcactcatttctatgcacacaaagagaagcttgtgaggaagaaataaaaagcctttgcctttattgtgtacagtatatagtgtaaacagtaggggtctaatacatgtttgtttccataaaggctttttctagcagctgtgatcagcaaggggaaaggacctgcctaaagtcatcacactgctaattggggtcgagttagaacccaagtctctgggccccgcttgaggctgtttacctcttcaggacagaagggaccagctggatataagagctgaaggagagagaccagaccagagcatctattcaggtcactcttgtaaatcgccgctttttgatagttccctgtgactggcatctgattgagaaaatgtgacaagaagctacctactgcttgccccttaaactagctgacagtttcccattcaaattccgattgcaattcagagacactctaggctaggtgcagtggctcacgcctgtaatcccagtattttgggaggcggaagcaggcagatcatttgagtctcaggagtctgagaccagcctgggtaacacagcaaaaccccatcactacaaacgatacaaaaaattagccaggcgtggtggcacgtacctgtaatcctagccacttgggaggctgaggtgggaggatcacttgaacccaggaggtcgagacttcagtgagctgtgattgcgccactgcactccagcctgggtaacagagtaagatcctctctcaaaacacacacactcacactccagatgcttctctgctgctgtgtgtgcattgggtggtacagtgacaagagggctgggggaggcaggtatcacagaaaggactctgagggaagtgagtggtgcacccagggaaactgaggctatgggtggtcctcccacatcctccccacaggctagctgatgcctctggcctctcagttgttttcatctaaggaaacttattttgaagccatattcatggcagctgtagtcctgagcattcgcaggacttgtagataattcacctacgtggtctcgggcagttataccctgtgataatttatagccacccgttcaggcagacaattccacatgagcatttgctatcactctactaccctgacccaagcctcggtgtgacccaagcctcggtgtgacccctctgcatggcctctccaaaagagatcccttccctgggagtttggggagcctctgactcccaggagagtagcaaagccaagaagggggaaataaaagaccacaaaagagcggtgtgttttgaaggaatgaatgttttctacagcccatttccaaagaacagtctagaaatgcttgcacacaaacagtgtcatcagagtagagtaagtgtgtggtttccaagcagcccctaccacaagctccccgaggcctgtgcctgccagggagcccaacctcagcacctagtatccagctccccagggaaactgttctgagcattagtcctcccttctctgagcccagaacggcaggctgcaacttctagggttgaatggatggcagctcaaggaaacagaatggctttctggttttaaaacctcagaaaacctaaaaacttgatctctattgctttactttaggaaattttaggccctttctcagacggcctaaaattagaccttcgccactcccaaccaaagcatgtcatgacatggaagaaggtggtccctggcctaatgacccatttctgtaaaaatgaggtaggatgtgtaaacagtgcaataagactatggaacaacagaccgtgagccagtgtcaccttaaatgtaaacgttagagatctaggcttctgaagaaatgttggaaagcctattaaaccacataggtttgggatttttcattgtgtagcagacatatggcttagtgtttgatttaaaaaataggaagttggtggccattttcatgaatagtttgacagccagtcagaagtgtgattgtcgttttacctaaacgcaactgctgttgttcgtaaggtcagaaacctgctcacaggggcgggggcggggaggtctggtctgttggctgtttgacccatttggttacgacctccatgctttgtcctgagtaggctggttcatgctggcaagtcaatgcagaaatattgatcaggttcctactaattgcaaggattgggttgaacgttgcagtaggtaagtaaaagatgagtggggccatgaccttatataggaactgtctgtttcctggtccaccagagcaacaacacaagtagtggaactgatctcaaggcagggaaaggttagtgtcacaacagaagaacagtgagctttggagcctcaaagaaagaggggccatctccctgtccttaaaagaaatcttcctcctttttactaccatcgtaagagtttacctactccaggccctgtgcatgctaagcgttcactcagttaaaccaccacacaatcttaggaactggattatactaataccttttcaacatgtgggagctgaggctcagaaagattaactttagatcaaggtaacaactggtaaggggtacagtcaggattcagtcctagctcagccagaccccactgtcatgtgtgaccttgcagtggggcagggagtggcagcaggagactgagtgggagcccttgggtctttgggatggtttcacctttggaagatccaggcccctcttgccatgagagccccatgaagggctcatggcctggagcgggtgggagggcaggaagcccagctgggcacggggcagctggaggagtgccttatttgaggctgctctcgcatcatctcattagggataatcatttgtagacttgctgccactgcaaaccatcggccccgctcaaattttccctgcagcagtgatgatgaagtgattccttagcagaactgctgggtaacacaattaattcagacttggggtggatgttagtgtgaattagggggtcttctgaattataaaacctttcaaaaggagcacaggtttattgcttctgaacttcaccaggaattgaagccagactggcaagggggctccctggacgaagtcctctgtgtgtcccttgtaggtcagtggtgctttttcctgcattgggggggcttgaaggttgtttcatagccatttagatattccccttggagtcttgcttgcaattaatctgtactgtctgtaaaaagggtttgcctagcaaaggtaaactccagcaccccgatccacattaatgagttttgcctgtgtaaaccacgttaattgtggttgttgctttttaattgtccttaagtttcttgtatgttaactgctccaggctagaactctggtttctgtttccgttgggggctctattctcactcctacccaaatagcctcgccaatctgcactgagatctgctcccctgcccccaccctgtctggcattagtactaagaagagaatgaagctcagaaaaacagcctcactggcctagatgaggaggcacaggtatgtggggaaaacacgagtggaagccacaaggtcttctgagggtctggaactaccaggtcaagagaagaaagacttcagattgtcactgttggatgtcttaatatgaggaaggactcaaacagagctgtccgcagctgcaactggctgtcttgagaggtggtgacctttctcgagaagggtggaaactgtagccagacaactacttggtgaagcagcatacagagagatcgcccttctgatgatgcgcccagtctgaggcctcactgagatggcctcaagagtgtgtcttgagctggttagaaacttaccatcctgggccccacgacacacctcttgacccagactgcatcttaacaggatcctcagctaatgcatgcgattgttcacttccagggcctctggttcaggaccagggtgcatgagcatcacctggaggagatttttaatacaaatgcaggggctgagctgctggcctaggacatagaaggaccattcccatacctcacagtccagctgtctccccattccctcccccctacatgctgttgtgtttccaagttcatgcctgtgtgcacacctgcacacaagggaataggaaaatggctttgatgtatggaatcatgtctacaagctgcttcagtcaggggcccttcttgctgagagaccaggcagctttcccagggagccccagggcaggggcctgaggcacctgcttcctgttctgtcccctgagagctccgctttgccgggagaaaggagaagcctaaacagggtgggctgggtctgcgaggcctgcctaaggctgccctctgccttcccagcccttcagtccctgatcctttcgggcccctcctaggccagaatgtcccagattagatggggtggggaggatgtcttctggttgctgtaggcctgcattaggggagtatcctctctggtcccacgtggggcaggtgcccagagccaggaatgagccgcctgtggtgattcctgtgtgtctggagtccaggagtcccttgcactgttggccagtggtcactgtgcggtgattgactgggctcagtgtctgtagcttttgtctgagccccttgcacccctccccggggatgattgtctgagttggtggatgttaatctgcagcccctgagaagctgcctggcaaatgggaggttaatgtgcaaacagcggggagcattgtccatgtgtgaggctggacagcaagtgggagggaaatagttaaaaatcctattcatggctcaggaggggaggaggggtgggcgcaggagcaggcccggccttgtgctaatcttgctggaatgtaactagttcgggcagtttctggcttcgatgtgctttggggccggttggcgtcccccccgccccaacccagtacatcgatggtgcgtccgcgcgccgaaggctgctctttgtgttctctgcagccacagcttagaagcgtccgagtcagaccgctttcagttgtaaggatggggagggaggaagctcagcgaggcagttgtgttatccaaatccacaggctctttctctgttggaggatttgggtgggggaagggaatgggcagaagagaatgttcaaggagaaagaccctaaacctgttgggtcaggctgctcagctgcctagaggcctgggaatgcctagggggaagcccctgcttccggacacacaatcaattacatataacagtggggccttgtgtgtgtaggcgggacactgggaggggtcggctcacagctcatgttttaatgctttacaaggagagtgtgttcatgcattgcttctgcaacttataatcaatttaaaacattctacatcttgatctaggctggtggttacattgatatttacatattgggccaggtttggtggctcatgcctgtaatttgggaggccgaggtgggtggatcacctgaggtgtcaggagttcgagaccagcctggccaacatggcgaaaccatctctaataaaaatacaaaaattagccgggtgtggtggcgggcatctgtaatcccagccactcgggaagctgaggcaggagaatcacttgaacctgggaagcagagtttgcactgagctgagatcgcaccattgcactccagcctgggtgacagagtgagactctgtcttaaaaaaaaaaaattacatattaaaaattcactagagcctgggcaacgtagtgagacccccatctctacaaaagttttaagaattagctggctgtagtggcacatgcctgtggtctcagctactcgagaggctgaatcaggaagattgcttgagcccaggagttcgaggctacagtgagctctgattgagccattgcaccccagcctgggcaacagaacaaaatcctgtcttaaagattcattgagccgcacacgagatttgtgtacttgcttatgtatacatattacaccttagttttaaatattttaaattaatttaaaaaaagaaaaatccctccttcctgacctaccaaggccttggctgtccagcacagctgcagggaggaagaacaggttccccggcttagctccagggcatcctcggactgcccactggagtgggcgctgagctcccacaccgctgtttggaaacagaatgaagttgcacagcagccagattctggggcttccccacccaagtttgccactttgctcatgggatttgaagaaagcatcaaaggcagcagctttagaaaatagctccaagggccccccttggagtgaggtcaccttctcagctcacagagggctgtggtgccagctgctggccacacatgcccacggggctgctctggccctgcctgaccctgactggcttccccttgcatcccctggggagcccacgcccactgcacagcatacccaccaggtgctgctgccctcctgaactctgtgggacacactgctgcccacgtggggactgccccggaatcaggaccctggatttctcctctgctacctgccccctcccgccacgtagtgagggttccacattatgaatgtcatggttccttccggctcttgattttccatgattcgggatcaggaaatgattttcctctgagtatttttaggccatgagactcagtataacagtcaaatcctggctccacaacccctagctgtgtggccttggataaattaaaatctctctaatcttagtttcctcatatgtgaaatgggaataacaacaatactaaactcagtagggctgatgaggattaagtggaaaccagactaatgttgtattcattatctgggataaaggttagcctgtatcatcataatcaaaaccacacgacacagtgtgcctcacagtccagtgagccaaatccttgcctgtgcacactgtacccttagacctgagcagggggggcctgcattggaccctactttggagggccctgctctgaccaccctgaccacttccttcctgaccaggccaggaatccacggagctgaggatccaaagaatgggatcctgaggcttgagagcctgcctgactcttccctggacgtgcaccaagccactggtgtgcacacctataggttgagatagggggctcgcgtttgcctggggctgagctttgatgggggtgctgagatgtctgggatgtttccatgtgtggtcccaagacctcataggacaagatggaactgggaatggtgggggtgccagatcaggctctcttaccaccaccgcattctggtacagaacccaggagtctgggaattctaaattcgagcctggccttttcgtagcattcatatttgtcaagggaggaggagagaatgtatttaacagtttgtcagcttgagttataacttttacatgtgtaagcgtatgggcttgcatctatgttcttgtcccaaaccctgcagatattggggttgggggggctgtctgcatgcccttccttccccagtgggtgaccatcactgacccctgagacttaagacaaattgtagccatgcccgcctccgaaggcgtctttaggaaaacagtgtcgtaggtcctttcagttcaaaacccttgcttatttattaacatgaatacgttggttctagaatagagccttgccctgtggaaattgccatctgtactcttcgaggtctacctcagatcccacctcttggcctaactctgtaatacccccacactcggtgacacccccactctatgacatttaccatttgggacagaagccctgtcctccctacctatagctgaggccacctcccaagacacattgtcattctgtcccccacagcaccacacacagtggctgcgcatggtggatgcacagtgagtatttgtggaatgagcggccgagccgctgcagactgatgagtgttctggggcctgtgtttgttttctaaaactgctctgtcagtaagcgccccgccaatccccgtgtaaacatattcagatcctaaagaagatcaggcagccaccctttaaaaagcccgataaacccaaccttcatttgtattatctttgggcagggtttgcttgggaattcgtatctgtaggaaatcttagtgctcgctgctgggaggcaaattgttcgcattcatttgttctttcagtggtttggccctataaagcagagggctggcctgagggaaaattgtgaaagaatctgagtttgtctttggggtagaaattaaacagcttctctaggccttgccctcaaacttcagccctgtttactattgaagattgtgtgtctcaaggggtaaagagagccgtgggataatggagactgaaaaaatgttgcgatttagccattttgttttcttttttccttggagaataatcttttgggaaaaacttggatagagaccctttgagccatacaattttttaaagttgaattcaagcctctagtcatggcttgattcatttttttctgaacaatgaacaaagaaatgctggtagagagccttgaaatgcggggatgttgaatgaggaaaggaaaaaggagggccgtgagtgttcctgagcactggctggaccctgcagaagcttccgatcattctggaggtctccagaacttggtggctgggacaccagatactgtgcatatgtgaggggagggcctctgagaactcccaagaggcccccagcagcctcccccacaactgacctttcacagttggcactaaactgcaggcttatctcctttctccatttccaggactgcaaattgcagcacctggaactaagacatccctggagggcaggccttccaaactcgcccccattgattaaggcaaacactgcttcatccacaatgttacagtaacatcagcaagaagaaatgatgatcatagctgatagctgtcaagtgcttacagcgaaccagatgcttctgggtgcccttctctatttaatcttggtatggcagtgtacgttggcaggggactggaatttaagcaaaagaagaaatactgatgtttccaattcatcatttaaagagaccttgtacgtggccggacgcagtggctcatgtctgtaatcccaacattttgggaggttgaggcgggcagattgcttgagcccaggagttcgagaccagcctgggcaacatagtgagacctcgtctctacaatacaggaaaaaaaaaattagcagggcatggtggtgcgtgcatgtagtcccagctacccggtggggactgaggtaggaggattacttgagccctgggaggtcaaggctgcagtgagccaagatcgtgccactgcactccaaccccggtgacagagtgagaccctatctcaaaaaaaaaaaacagacaaatagaccttgtacgtgaggcctggccatttgttaacccgtgtgaaagatgtttcggtggccatttaatgaacatatgttgaataatgtgctgtactgtgtaccacagatacaaaggggaaaaagatacagaaggaaaaaagaaaactcagtatcacatactcagccccttctgatagaacaggtgtgtccaagcagcaacatcctaaaatagttgtcctccactctgggatgtaaaagaagttcttctgggatttggttttattacaatgactgagaatttgctctccctcagttatcatatctactgtgacaggccttgcacacgtcctgtgagatcctacctgccaagaacctgtctgccatttctcattagtatctttgtggtttgcagtcacctgtgtagaatttgcacatatactcaagtgttatttgttttcaattacttcctcaattattgctggtgtgtgtgtgtgtgtgtgtgtgtgtgtgtgtgtgtgtgtgtgtgtgtggtatttcatagccaaagctataaaatgtatttccaataatattagtagaattttttcagcccctaaaacccaccataaaagttaactataataacaaggcccgtaggcctgtacacaagggcatggtttctatcgaagtgtattacacaggccagacctctggattctccacctccagtggctgctgtttaaagcaggcattaaaaggaagatcattttcatgtttgtgatttgaagcatgtgtgtgctcacgaaggatacctccctggacaatgcctggaagaggactttgtgaagtggagactgtacatgattccaccagcaagcatgtgtcttgacaaaggttgttaaggacaagaagttgtgccttagctgtaaccaaaacccagcctaagcaatcaggtgagttgaagtagatgttgtcaaagctaaaaagaagccaagcgtggtggctcacacctgtaatcccagcactttgggaggctgaggcagtgggattcttgaagccaggagtttgagaccagcctgggcaacatagcaagatcccatctgttaaaaaaaaaaattagctgggtgtggtgatgtgtgcctatagtcccagctactcaagaggttgaggtgggaggatcgcatgagcccaggaggccacagtgagccatgttcgtgccactgcactccagcctgggcaacagagcaagacagcatctctttttttgttgtaagacaaacaatcccatagcatttattgccatcttgtaataacataagggtaatcaaaacaatatgaataaatgttcatattggacaaaggacagctaaaaacaaactgtatccttctcaacaatttctcacttcattgatcatttctagctggagacactttgtagcagaggaatacctccttttagcatgatccgacccagttgttttcttgactttgttttagaatgaatctcttccgcatcatctaataacaaggttcgtatactcattaaaaccaatgatacagccttctgtccgcatattcacttgctcatagagccacacctgaatctgcgatctattttgtaagtatctgaagatgaggttgatgggcgcatcttcaccttctgcactttctggccctggccatggtatgccatggtggaatttcacaaagagcacacccgcacgctgcctctgagagcaacttccagaatcaagacaccgtctcttaaaagaaaaaaaaaaaaactaaaaagaataagatgtaggcttagggcttcctcccctgaggaattcttttggatccctctggcctctgacaagccaagcagaatatggagaaaggagtctgtagaggctgctgtcaagtccagggtaaaaacacgagcatttccaagcatttcatcaaggacttgttaaagatccaggtttgaagtctccaaggaagactttttttaaagatgttgcccaaaggaaaagagatcaaaccagcagaatgaattccccatcatatacatgggggatacccaggaactcacagggtctctccggaactctgaaagcaattagagaacaagcatatgggttgtggtccctagagttggagcctgatgccatcctccaataagttctccagcagattccctttggaaggctactcatggacccgggaagaaatgacacccaagagcggggaactagaggctaacacagggtacttgctactgcagtggcttcagataccctacccctaccccaaacttgggccaggccagtggctatggaactccagaaagaagggcctcagagagagagagggagaaggagagagtgtcatctacatcatgacagttgcaccttttccatgtgcaactggggaaagctgcggtccctcagcagccctttgccttcacttgggccaatgaccaaaggtacccagggtggtagtccagtcactggcaaaagcatggcagccttttggcaaaagacttgggggcataaatagtgaaacactcagagaatggaatgattggctggctagaaaatggatggagggtgttgttgggaataggcagttggagatgggaagggtaggccagggctttaatgcccactgagcaggcatcgggaaccgctggagcttttgttgggggtagggtggagggggggaagtaatgcaatcacaggaagggtgggctggcctggggaggggctgccggcaggagggcagctcagagtctttacagaggtccagggcagtgagcagcagagatgaaggggaacaattggagagacagtccaagttagaatgacaagacttggtcccctgtcagttgtagagagtgagggaaagagaagaggccagaatgatccccaaggtttgtacaatactcagggtgaccgcatgtcctggtttacatcatccatcataattgttaaaggtgttccctttcactttcaaaggagccttggttgataggatgtaggaaacaggatcagggctggattttgatgagtctgtgtgggattgagctgcctgtagcacggtgtcaaggaagcacttggagatgaggaggaaggctggagccagctgcagagatgagcgtgatcaccgcgtgggtgccaacctgcagggggaggaggagactacccagagaacaccagctttcgaggcataggccaaggttctgaggagcggctggaggagtaagtggaaaaccagccgaaagggtgccccagaagctgaggggcctcttaggaaaaagacctggaagatgacattgggtttggtagttaggaggtcagcagtggccttagcgaaaacagggccagtgacgtggaaggcaggtggcagtgggccgaatgattggagggagtggaggcattgacagtgggggtttgacggttttgtaaagagcttgtaagggagagacggcctcagcacagggcccatccaactgtgggtctccagccaattgcactgatttttcctgcccattcttccttctttgaagggaaaaatggaaattgaagaggaagaaatcaatgacccatttgaaccatgacttggagtttaattcagcgtgtatctgagtgactacgtgagtactcctgacctccaggaatggatagaatggaatatggaaaatcaaggtggatcaaatgagaatttggccagtggacttacaaaaaagtattcaaatgggccacacctacccagtctggtgctgtgcatgcatcacaaatcctcggacatgagatggagttgtcacctggtcagtgattgggtttcagagtctggataggaactgggggctcaggaaggaagtggcaaagatgtggaattttcaggtcatcatcaggcctgaacaagacctgatcaccacccagtctcggtcctcaaacagctgcttgtgaaagttaagttctgtaaccaacttcatgcacaggctatgcctagaattggtgttctactaggtcagtcaggaagtgacaggggatttgagaaatgtttttagagcctttgtgctctgaaatgtaccctcctccctaacccaactagcctagcctggatgcttgaaattccataaagaccaagccctggatttgattggagagttgggggaatgtgttgcagcccctctcccaacccagaaagaaggcatgtaatgtgctaacgccgttaggagtgtttatggcatatgggttatgatattgaatttgtccaataaaccatcaggaaacttgtgtgggcatttcctgtctcactttgtgatggctaatttatgagggctgctgtcaggttatagattctccatttttaccagaaacttccaccttgagccttataatggatccaccggaatgaagatatgtattctaggcaaggatttaggtaggggagaaccatgaacctggcacacagtagcactaaacagtgtttaatgggtaagtgggtggatgcttgctctgggctgtgaaagaagagtgtaaaagagacaggaccatagatccaggaaggtcatctttgaaagagaagcccaaacaatgggtagaaactacagaaagttatggaggggtaggtgtgagcatttggggaccactctgatcgcacattaatattacctgggagcttaaaaaaaaaaaaagtagatgcttaagccccaccctggaagagttaaatcataatggggaacgcagacaggaatcagtgtttttaaagctcctcccagcagccctggtgccagtgagatctgagaactagcagactgggttgtctcctctggttgaattggcgcccagaccttcccccagaggggaatccctctggaagggaaagagtggaggagagtgtccagggcggggctgtagagtggacccttcctcagccaaggaaggactcgtgcagctggcagtcacagcacttactggccccagcgtatgttgcccaggaaccattgaaggcttccaaacggctgaggtcacatttttccaggccctaatgggaacggttgggaaggttgtcaggggcaagaccccattcaaaataaaacagcactcagaagttcagaaatgagaggctgaagatttgaatatagactttactgggttttttttttttgagtgtttttatatatttaatttttttaattaaaaagtgattcccattgcatatatttgcatttaccttttaaaatcaatgtatgtttagccaaaagaataaaataaaaacacccataatcttgtctcccagagagattaagttcaactcacctcttagtgtatattcttccagatttctcaacacatacataaagatacctgttttacaaaattacaagtaaaagtaggattcaatacatgttttttctttttttaagcactccccattacacaggtggaaatacatgtttcgtatcttgctttttcacttaacagtgtaaacacctttctgtttctgtaaataaccacctactacataaattcagatatcataattgcagcataaggcatttaatatctttcagctattataaacagctcttcagtgaacatccttgcagctatattttgcttgcatccttaattatttccttaggatgcattcctagagacagtaagccttcagaagacttgatacatacttccaaattgcacaagacaggatttactaatttactttcccaccaccagggtattaaaaagtgcctgtggtaattaaagggggaaaaggccactgccaacatgagagactaaaagtagttaactcattactgagttcataacttctttatctcaaattctgcaaacaaatgggagtggaacccagagattttccttgacggcttgatgcccagcccaggaggatctttgttgtctggcccaccaggtcaccggctcctggggttttcagtgcagcaggtatccttgtccagggcctttgtttcccgctggtcattggtccagcatgcttccggtggggacttgggaaccaccagggggcagtgtggagctgttgagcatgctctgcatgccttacggcttatccatattgaaactttcaataatacaagtattcttttgttgtgttttatgacttctcagattggtatttataatattgatttgcttacattagtatttcatccccttccaattatttttatgtttatgtgttgtaaaaaaaataacctgatccatcatagctgttctgtagctggcggccaggacacctgggttgttctgatcccagctctgccagtgtcctccgtgaccttggtgggacagctcaccccatgggcctgactgcccttatctgaggagtgccaggatgggctgcaggagtggtatgttttcttctcttccagcactagcataatgaaaggattgagagttggccttggccaggtgtggtggctcatgcctgtaatcccaccactttgggaggccgaggcgggcggatcacttgaggtcaggagttcaagaccagcctggctaacgtggtgaaaccctgtctctacaaaaatacaaaaattagctgggtgtgcacctgtattccagctacttgggaggctgaggtggaagaatcacttgaacccgggaggcggaggttgcagtgaaccaagattgtgccactgcactccagcctgggcaacagagcgaggctctgtctcaaaaaaaaaaaaaaaaaaaaaaagagttggcctttggggctgggcatggtggctcacacctgtaatctcagcactttgggaggccgaggcaggtggatcacttgaggtcaggagttcaagaccaacctggccaacatggtgaacccctgtctttactaaaaatacaaaaattagctggtgtggtggcgcacacctgtaatcctagttactcaggaggctgaggcaggaaaatcacttgagcccaggaggcggaggttgcagtgagccaagatcgcaccattgcactccaacctgggcgacagaggaaagactctgtctcaaaaaaaaaaaaaaaaaagagttggcttttgggtttgggatagactggggcaagttagttaacctctttgtaccttaatccctccatctgttaaatgaggataataatagcatcaacttataaggctgtgggggttaaacgaaataacacatggagtatctggcacaaggtaacgcatcactaaatgttttctttaaagaaatctgtttatccaagatttatgcagacagtttcctgtccctggctttggcacatacttatttgcttatctgaaatgatattaatatcaaacagagtatgaatttcagaagtgctgtattccacagtggggctgaacagaagaatcccagcatcaaggcccccagctacaaaagattagaatgtttttgtttgttttttaataatgtattaactgtaggggaaaatataaaaatagaagcagatatgatattggtaaatgttttttatttgatcactttaggtaaatggagtcttactcacctgatagggtccccagtggcagcggactttcccattccctctatccatcattctcccaaaaggtgatggtttctctgttctcaccctaggtcagctaaattagggtctgtggcaacaaccccaggagtgtgaccgctaattgcctttgcagacaacatttccactagagctgcctgggaggcagcacctccagagagaaggacttgcacctctaatttggttaatcctagaacaccctgcaatagtcatcaagcacctctcacaaatgatatgctgtgcttaaggccgtggggacccaaagggcgaataagattggatgcctttttttttttttttttttgagacggagtctcgctcacgtcacccaggctggagtgcagtggcacgatttcggttcactgcaacctctgcctcgtgagtagctgggattacaggcgcccgccaccatgcccggctagtttttgtacttttcatagagacggggtttcaccatgttggccaggctggtgtcgaactcctgacctcaggtgacccaccctcctcggtttcccaaagtgctgggattacaggcgtcagccaccgtgcccagcctggatgcctttctgaagcggcaggttaaaaaaaaaaaaaaaaagattggatgcctatccccaaagagcttaggggaagctaagcgaggaaatgagcctggctgtgagctggaaagtcagcgggcagcagggtgtgtgaccgacctggaggaacgagtgtggggcaaggtgaatgttagggagccattgcaagacagtggtagttgagattgaaaaaacacaggacttgatgggctagatgacaaagtgaggaagaaggtggaggaaaagatgtctgaggttttgaccctgcaggtacatgagaagagagagatggtagatctcggtgagaagcaatttgggaagacaatagtggtgtgtcctgggatgctctgacctttgagtctgtgtgcagaacctctttctccaattcctaggggtgccctcatccacaactggcagtagcccctggatggccacaaacatgcagtcctacaaccatattccctggatgtcacttcctcacataatctttgccacataccacctatactatttacataattatttttctttgaattgattcacttttttccactttttaaaaatggagcttcactgtaagcaacagtatccaagatatcaaactttgcctgtaacatgcatgtgtaattgtgtatacgtatatacatgtgtatacacatacataaaaaatacacatacatatgtatttataattttgtttgtttggctatatatacatttttgttttgttgtgttttgtagagacagggtttcaccatgttgcccaggctactgttgaactcctgggctcaggtgagcctcccaaagtgctgggcttacaggcgtgagccaccacacccagccaaaaatactggcttaaatacttaaatattttaaatacttaaatattttaaggccgattaatgtaaatattttaggtactaaaaaataggaggtgttgtttaatagtattgagatgggaacttctcagcccttccactgtccgtcataacttcctgcaccctcccttcaatatggacataaaatcgtgttgttccctgagatatgtaagccacatgtgcacccacatttgcatacacactagtgtagggtgcaggaccccttcttcaggctcctttatcaggagcaatggccctgtatagaggtggctggtgtgacccttattctcctgtgttcttgttcacctgtggggtcggagagctctcctggaactgcccgtctatggagaggcctcctcagacatttcccatctcccggtgcccaggagttgttgactttggccagctgctgggcctgcaggagccgcggggaagggttctaagagacccttgaagctctgtggctggaaggcagctccaggctgcctggctgttcttttgtgttgagtatttcactggccccagataagcgcttcctgttcctcactgattatacacagatcctgcttcctttctcctcaatacctgggatgctttccagcttctcctcccataggggaaagtccgtaaactttagaattctcaggcctgcttttggtcaatggactttctgcaaattatgactgtttttgccatctagtcacattcttggtgaagccttcacctctgtctaggagctgagttccgctttgtgccagccaggagagatgcttctatgacctggtttctgcccctccttctcaccagacagaacatctgtatctacctcctggcgtaaatcagagagaataaatagattgcaccttacaggtcagttttaatcaactgttagtagctgcctcagtgttgaggattctgaggtcttacccacctttagcaagaaagagtgccatggtctactagcagtgtctgccacaagcacggagggatgggactgctcctgtgccccatatttgctatcccaagattccgagatcagttggaagtttctttattttttatttagagacagagtctcactctgtcacccaggctggagtgcagtggcgcaatcacagctcactgcagcctcgagctcgagggctgagtcgatcctcccagctcagcctctcgggtagctgggactacaagcgtgcgccaccacacctggctaattttttttgtatttttgtagagacggggtctcatctaactttgtttcccaggctggtcttgaactcctgggctcaagtgatccacctgcctcagcctcccaaaatgctgcgattacaagtgtgagtcccattcccaaccacaagtttctagaaggcagaaatcatgtccttgtacccttagagttacaacataaacgcccaaagtcctatattctagtgccagtgtcgaggaaatccaacagcctccagcaggctcaatttcctttgtttttttgattcagagtctccctctgtcacccaggctggagttcaatggtgcgatctcagctcactgcaacttctgcctcccagattcaagcagttctcctgcctcagcctcccaagtagctaggattacaggcacccgccaccacacccggctaatttttgtgtttttagtagagacgtggttttgccatattggccatgctggtcttgagctcctgacctcgtgatcctcctgcctcggcctccgaaagtgctgggattacaggcataagctaccgcgcccggcccagtttcccattttttaaatgaacataataatatctgctttacctatatccaggagtcagtaatatcaaatcagataattcatatggaatgctttaaaaagtaaaacaactgtagaagtatatcctgcctgcaggacccagcacagatgccacctcctctatgaagttttcagttgtaacacgataattcttgcccattgccatccctgtcttatctgaacctgtcatttataggcttatagtctagttatttatgtactttaaaaatctctcctgtggtatatcatgcatataaacagccaccttttatatgagatactcactaaactttgatggagggctctgtacagagctgtcactgcatcttgatcatctggtaggcagtcctgtaagaatgagtagcctcctgctagctttaaacagcacagttttatgttttagaaagatatttctagaggtaagtgaagggtagactggaagagatgaactgagaacaggagcactgatgactcaatggagagaggatttgggatcccttcatttctgtcaactaccctattcttggacaacagacattttgtcaatgtgaggcaaagcaacctgccgatgtggtttgcagcccactaccacccctttcaaaccgggttgccccccacccccgctgccttcctcctgggtgagaacctgcaggagctcaagcaaacccagaaggctgctgcaggggctcctcctcggaatagggttcaaaaaatgtccagaagccatataattgggtggcccagagcaggttagggaggtaactaaagtcattaaagtggattttgaggtttctggttaggtacactgaaggcacaggattgaaaataattcatctggggttacttttaatagctttgcttactgttgctatgatataagacatactgattgtaaaaatttcaagtgaagaagaaaaatatgaaaaaggaactaataaaattgcctgaaatgttaaaaatccagcgataacatttgggtgactatgcttccagattatttaattggcttttctcactgaacagtttgtccagcacactttattcaggtcaataaatgtggatgaccgggcgtggtagctcaaagctataatcccaagcactttgggaggctaaggcgaaaggatcacttaaggccaagagtttcagaccagcctgggcaacatagtgagaccctgtctctaccaaaaaaaaaaaaaattagccgggtggtgtggtgcttgcctgtagtcccagctatgcaggaggctgatgtgggaggattgcttgattccatgaagtcaaggctgcagtgagctacagtcgtgccactgcactccagcctggctgacagggcaagaccctatcaatcaatccattaaccagtatatcaatcaatcaatcaataaaaaaatcacccaaaaggcatgcagaacctgcagccacagggcaggagcggggagaggcttccccagagctgcccatgtcatgtggcagttcaaaagccagttgcctttattttcttcctaaagtcatccatggccttgcaaagacaggagagtgtctacagagacagtggagggagtggaacagaagccagccttctgggggctgagaagtacctgggaggcggggagggcatgtaagcagcctgtgtacatgcggggaagggaaagggggagaaccagaaggggcagctgcccaccagcagcttcctgggctctcctcccacctcctcctcactcacaacagcgcacagactcagcctcagctccttctctctggcctcttccacctgagtgaagatcaagtgcaggagaggttgcacaggctgtgccagctgcaaggaacccacagacccctcctgtgtttcacctgcagtgactccatattcgtcctcccccatccccgccatccagcagattatgtgccccacttcctctgtgccacacacatcttttttccctccttcaaatcatcacccatacagaggacaattcgcagcctcactcattataagagtaatggaaactccagtgagggacttttttacctgtcagtttggcaaagtttaaacagtttgataaccttgtatgggcaagggtgtggggaaataagccctctcccaggttgctgttagcagtgtcaactgggagaaatttaataacactcctcagaacttaagtgtgcatatctttgacctagtgattcccctcacagctggaaatgtgtcctcccactatagacatacatgggcgacacggtgagtgttcaagggtgttcactgcagcagaagcctgggaaacacctccatgtctgtgagcatgggccccttgagtcggttatggcacctcctgtaacccaggaggaggcagctctgtggggatggctatgggaccagccctactatgccggcgaatggagtgggggcagagtggcgtgggtgggtatgggcaggccagagaacaggctgcaggctgtgaaggagaaaggcatttgctctttcagcccagtctgagctcctggtcagaggccagcaggtggactctgcatcctgtgggggccagggcagatgttctcacctgagggcctgaggggagggaagcgtgtcagtagattcccaggcacacagcgacaggggagagacagagggaggggcccagcagggttcacctcagggaaaggaggactgggcctccaaagccagtttccacgaagacacttcctgcagcacattggtggctgggcagtgagcatagacactgcacagacactgcccaggcccagcaaacccaaggtcacagccgatgggagaggcagcttgcgactcagcaggcccagcgctccaggctgcagaaatgcggactcgaaagcaagttgaactttgacattgtttgaaagcctagggctctgtcccggggtccccctggtcagggccaccacagaatggctgtgcctagtgctctgggagcagagttttccctcctccagagcatgcagctgtcgggggacatacctagccaagtgtccggctctccatcaagacctcaagcaggcccacgtcagctgagaaccatgtgtgtctcagctttccagccatcccagcaagtcaggacacatctgagaccacccctccaacccagctcttgcccacggtcattggtgtgcctgagccagctggcacccagccaattggtagcatctcttccgcgctgagccttcagtgactcatcgtggtaccttgaaatcagcgggagtgtttacaccatgaataccagcaaatgctttggtttttcactttgttttttgcttagagagccagttgttaggcatttaccaacacaccaccgaaccagacctgtctccccaggtaaagcgcaggtcacaggctcctagaataccaataacttacacatttagtgactgaacacagatttcttacaagctccccgcatgccccacactctgcctggtcctctccagtgtgagaggacactcacacttgagtgtgacagccacacgtgagataatcactctgccaggcagtaggtgttcttattcctattttacatgtggaaaccagaggttctgaaaggtgatgtacacaggcacacagcttgtaagtggggttcagctaggacccctgattccgtatttgttgaacacctcaacacggtcggcactcccagtgccctctgtgtttagacaaacagctgaatttgatttttccttccaaaggagaccatctagtccaggcccctgcttcaggctgatgaagtaaaatattcccattttaaagatgagacgatggagtccagaaaggttagaaagagcctggaaccctgatctcttgcctcctgtgctctaaaacgaaagcttggcttctgcgggggagccagtttttaaaaacaaaccttaggtcaaatctaggaggcaaaattgccaggttctttggaatgcgaggggaagagaatagttttgagatcatccacaaaagaaagaatcatttggggaaagcagaggaaagaggtgtttatggtgaaactgacacctaattgacacactcttacttttgagtttactattcagttatgaaatgcttttggagcccctctgctaccagtgcatgggctttaaagccatttgttgactaaatgctgtgacaggtgctagagagagcaaagtcacttcattggtttaagaccagtgtaggccaggtgcggtggctcacccctgtaatgccagcagaattgggaggtgaaggcgggcagatcacttgagctcaggagttcgagaccagccagggcaacatggtgaaatcctgtctctaccaaaactacaataaattagccaggcatggtggcacatgcctgtggtcccagctacttgagaggctgagatgggaggattgcctgagcccaggaggtggaggttgcagtgatctatgattgcgccactgcactccagcctggacgacagagtgagactccatctcaaaaaaaaaaaaaaaaaatacctcaagaaagaatctaacctaccctcaggtaaaacaaaaaatgtgtttgggatttagtgccatccacaaagttaagcaaaggcataaatgactcattcttaagaaagaagggataagagtgtaaaacttcttttatacttttgcccctggaactctttgtctaatccatcttgtttgggaacaagttctttacactttcgttttctcttaccgactgctgaaaactaaaaatgttttcccaattgggaaagcttttctgtctccctattcctgagttcattgctcagtgtcagtgtattttcaaacttagatccatttgtgaactttagtacagaagatagaaacaggtctccaagaactggccaagttgggcatcccagcctccatgctacatttacgtattctcggcagactaagccagttactgtgagaagcaggcgttgcccatgagtgaaatgggctcctgtgtggcggcttcccaccacagtgacaatgacattattcaaaatgctctccttgtcctcttagaagctctatgtaacaggaacctatactataaccgtattataaatgaaaaatgtgaagaagcgatccgtgtctccccgtctccattctgccacagttgcagtcgtttctttcctggactacggcaaatcctaccagagtcagccttctaaacaccagtcacatctctcccctgctctaaaggcttcaggcagaggctgttcaacccctcgttacagatgtggaaactgggcctaagctcacggcattaatacagcatgggacagggtttcaacacatcatgattgccgggttctgggtgaggaattgaggtgcagcatgacccttgaggagcttaccgtcccaagggcagacagagtgtgcaaatggggaggagtagcctggtgagtgctatggaaacaccgtgtaccgcttctcgagagcgacagactcatggaggcttcatgccagggagggtgaccttgggaggaaatgggttttgaagaagaggggttaaagtttcccacgagtgaaggatgcagtaaaggccgtagcaggccggggagcagcagggcagcatggtgcgttcagagtgcagtgaggactctgtgcagctggggtggggggcggtgagggtggaagccagaaggatagggtggtgtgggattgctggtgagtttgggggctttatctcttgaccccagaaaccaaccagggaagtgttctgagcaggggagagatgtgactggtgtttagaaggctgactctggtaggatttgcagtagtccaggcaagaaacgactgcaactgtggcagaatggagacggggagacacggatcgcttcttcacatttttcatttatagtacggttatagtataggttcctgttacatagagtttctaagaggacaaggagagcattttgaataatgttattgtcactgtggtgggaagccacctgcacccggagtttgggtgtagccttgggttctgggtggcactgggactttacatctcccgaaaagcctgggcaacccttgcttctctatcaaaggggatcctggctctaggtccccaaagtcactgtttaccataggggtccagagaggcaggaaggaccggtcaccaaaactgggaccctttgtgtctgctgatgggcaagtggccaaaaatgggcgagaccatggggctggagcaaggggcgctttctctgcctactgggcctttcctctagaagcagcggaaggcgttctctgggctggagttttctcacctgtgcagtttttggagctgacttgttttccttgcatgcaactgtggggagctgtggattctgtaacatgaagctttgtttcctctgttgcccaggccctgcttaaaggcttttctgtgagaacgtgcgaacagggagaatgtgggcattcccccgagccctgtagagtcctgtccacactaagcaagtgtgggacagggtgaggacggctggggcggggccctccctaccttctgggagccggagggttaatctccgtagctcattggcagtcctgcctctgtacagggcatgctgggatttcctcccagctgttttacatcacgaagatttgtgtgttggggaaattccagggcacagctgcaattaatctgctccatggctccaatcaaagcaaggattctgtaggatggattctccgccttcctgcaggaaagggggctctagctctctagtgacagcatccttcagagggacccttcccgagatccacgttgagcagaaacagcccgcctggccaagtgctcgccccaaggagggctctaaggaggggcccaaaacattgagaaagagaggagcagagcccctctgaataataaagccacaaggacactgatggcaacactcgataaagatgtcacccaaagaaaagaaaactttgttcacctttacttaggaatgtaaaagtcaaaaatttaaaacatgactagcattccacaatacagcgtaagaaggaacaaaccaccatgaccaaatagggcttacctgggaaatgcaaaaatgccttcatgtaagaaaatctattgctatatatacatctcataaatgagtcaaataagagaaaccacatgaccattttggtaaatgccgagagaaaaatgcaacaactgctccaatgaaaacaatgtaaaaataggattagaatcatccttccttaatgaggtaaagacatgttttaaaccacagcctcagtctacttaactgtgaaccacagtagcagaaccccagtccccagaaaagtgtttctcagattcagtgagattggaaaactgtgtatctgtcctgtcttagatagtcacaacatatgtaaatcgaagacagtagtacctgccgtttgggtttggtgttttcctttctatttttgagcatccaaaagcgggtatttaacccatagaaagcaccccagaagtgggagcgatcgctattgccaggccatcagttgcattgatgccattcatcaccatttcaatgtgttacattccggtgggcatcccccaggagggaggtggctggaccagcccgtgtacacatcttcgctgtgggctgaagcccagccacgacacactggtcaggagctgggccttgcagagccagttaaatgtagcctagactgggcatggagaaaccagcagttttaacctgcccacataccattaccatgcaaagaatctaagcacagtcagccatcacttacttccccaaggacatgctcccacccatgagtgattgccctcagggtgatcgtggggttggccttacagctaagaagagctttattggctgggcatggtggctcacacctgtaatcccagcactttgcgagagcaaggcgggaggattgcttgagcccaggcgttgaagacgagcctgggcaacgtagcaagacccccatctctaaaaataaaaaataaaaataaataaataaacagaagcactttatttccactctagttgggctaggcctgatgctaggaattcagaactacctggccatcttcaaatgtctagtactgcagtggaagaggattacaagggttgtcactggctcctgctgccccaattcacggttctgggaagttcaactgtcctttcctcagagttgtgatgcagaggccgtccatggccaagctgtaggggctccaaagtcttagagctcttcctcctccccccgtcactcatctccaaaacttaaaaagacaaatagaaaagggaaagtcacgatcctccacactcctgcctcccagagtgagtccctccctacacaccgcccctgcaccaccccaggcatggctggagcagggtcagtcccggtgagatgctcactgttcccaggaccacctctcccttctggtcttttccctcacactgcctgacttgtctgtaaggggccaggtatcagtggtaggcacgaccagtgtggtctcctcccagcagaagccaagacttcttgttacatagataaaacaagtacatggtcagacacccaaaagagtggctgttactgaaaacccttactatgaatgtgtgtacaaaatacaagcatacataaatgtacctgtaccttgatatccccagcaccaaggcagacaaaccctcatggagcttgcagtctattgggtgccagctccttggccactagagcagtgattctcagttgcgggagggaagattctctccctcagccccaggagacatttggcaaaatctggagatatttctgatgatctatatgggagtgcatcggcatttagtattatagttagaggccaaagatgttgttaaactttccaggacagcccaccacccccaataaaaaaagtatccagcccaaaatgtcatagtgctgagcctgagaaaccctgcactacagtcctacaagccgactctgccagacaatctataaggtcacttgagaggattatttaagacccaaaactctagcaccatcccagactagggtttacatttctttggaccacccccatatgatctaaggacatccctggtaagccaacaagaatgaatgtgtgtctttgtggccctaaatagggggcagatgctggtagagttgatggatttttaggtacccatctatcctgtttaatattagggggtatagatttgggatacttctctttagcacctggtagttgttattgtagtttaatttttaaaaccagaaatgttcaagttgttgcttctagaaaaacgagtgtggtgtttaggcttcaagtgcaagctctgggcaccttcagcatccctccaggagaacactgacatgcatggacccattctgtttctgggtggccagccccgtgcaagacagagaaggagagagaaaacacatccgagcaaagagaaggctgcgggtggagagttgaggaagacagtcttaggaaaagcttcgtgacttggtcttgtgcaaggtgtgggatttgaagtccagagacctaggctccagctccagctgtcttgtatgaagttggggaagcgtttagcctttgtttatgtccattagctcctttttttttttttttttttttgagacaaggtctcactctgtcacccaggctggagtgcagtggtgtgatctcggttcactgcaacctccgcctcctgggttcaagtgattcttctgcctcagcctcccaagaaggtgggactacaggcacacgccaccatgcccagctaatttttgtatttttagtaagagacggggtttcaccatgttggccaggctggtcttgaactcttgacctcgaatgatttgcccaccttggcctcccaaagtgctgggattacaggcatagccactgcgcccggcctagctccttttaaaatttgggatagtcacccctacttgtcattgcagggttgatgtgcagattacactgggttttgtgtgtgaaaatgctttgacaagtgcaaatgtagcacaaatgttattcacagtgaaaatgagttttaactattgataccaatatttgcccagtgcttttaacttgccacaggcattgaaatcccagttaattcatgtcgggtgtgtgggctctgggtagggcaagggatgggtggtggtgggaagggaggaagaagatagggtcagcagaggacagggacagaggtgacaccccatttgagggctgaggggtgggggtacagaggtcgcaaagtgaaaagactgtcctaattcatagggcttcgttcccacttcccaccaggtctcccgcgccaggcctgcttggcccatcccatgtgctagtctggcctgtggcacgtgtgaccttaagttgttgttcctgcccatggacacctttttgaaagcccagtcagtccctgccatcttggtcaagacttatggtgaatgaagagcaaaggggccttctggggctcttcccatcgccctcctgctcctgtacacagcagagccagattgtgattgatttttcctgatattacatgaccagagtgagggatgattcaaaggcttctttttttttcttttttgagataaagtctcactctgtcgtccaggctgtagtgccatggcacgatcttggctcactgcaacctccacctcccagactcaagcgattctcctgcctcagcctcccgagtagctgggactatagtcctgcgccaccacacccagctattttttgtttttttagtagagacgaagtttcaccatgttggccaggctggtcttgaactcctgacctcaagtgatccatccaccttggcctcccaaagtgctgggattacaggcatgagccactgcacccagccaaagacttctttctgtgaaacttcctggggccaccactttccgttacagctttcattctcaaaggagtctcaagaattctgcaaagaggctgcttgcgggtctgttgcccagaagcaacctgtcagcgttgacactaagacaacatgtgtgcttttgctcctggcaaagactaatggtttgcttatggaaataataggcgtcatttatcaaatgtctcccatgtgcgaggcactgtgttcaatatgtgacaccgtccctagtccgaacaacctgtaccgtgagtgataataaccttgccttacagatgctgaaactgggactcagagttgttaatcactcattcagggtcacacagcctatgttggcagagtaagagcctgaacccatgaatgcagggctccggagcccagaagggcccttcccagtgctcctgactgctgctccactcaactcattctttctaggctcttggcaaggactgtgccatgccagagagagagagagattgtgtgtgtgtgtgtgtgtgtgtgtgtgtgtgtgtgtgtgtgtgtgtgttggggaagtactgtttggtttgggttttttgcactgacatgagaaagaatggggtgctgggtaatctttttcagggttgagagacgctataatgaaggaaagctcagcatccttgagttggggtagatgttgcccatgactctgtgtcaggcagatggcttttattcattcattcccagatacttctggatggctgtttcgtagggagcattgtgtgtggatgtcgtaagtgatggaaatggatggggcaggatggccatctgggagcctctgcctccttggtcagccctgcgtgtccatgactacagcatagggaggggacttgagcctcactagtaggttctttgaatatgttgattggttgtgctggaatggatcggttctctccaccacttaaagttcagcttagttgtcattcgtgtccccccccccaaaatgacatagggcgtggtgaggctggtagtgattgtaaatatatgctcgctcctgttataatcgtttggaaattgacccagtacagggcatgtggcatgaaaatgcaggccaccccaatggcctgccccggtgccctaacagcagagcccagcaaactttgagtacttgtgaggcctcatctcaccaacagctttttcttttctgttccctgtgcagtacctgcagatgaaatggcccctcctcgatgtcccctccagcgccacagtcaaggacacgaggtcaccatctccagcacacttggtaagtctgtttcaccttaaagcaccaaagggccactattagtggcctcatcccatgccactgccttctgccatcacgctgaagcagatggggtccaacagtgtttcctcaaatgtgtgagtacagtgaggaagagctgagtgcttggggctaacaattgggttgtgacctcaacacacacaccacaccgcctcagatgttttgtaattggaatagccgtcccccaacccccatggccctggctgctcaccctggttcatcacagaagcctgcctgcgatccttcccggctgccatctgaacccgctgcccacttcacgtgggcaagggtggcttctctgtcctgttgaggcttacccagaattgcctcctcttctccctcatagctgccaggcaatagttgaagaggctcttctgtttttgtttttgtttttgtttttgtttgttttttgagacggagtctcgctcttttgcccaggctggagtgcagtggcacaatcttggctcactgcaacctctgcctcccaggttcaagcgattctcctgcctcagcctcccaagtagctgggactacaggcatgtgccaccacgcctggctaatttttggtatttttagtagagacggtgtttcactgtgttagccaggatggtctcgatctcctgacctcgtgatccgccagccttggcctcccaaagtgctgagattacaggcatgagccaccgcgcccggccgaagaggctcttctgtacaggatgttataggaaagaattcaataggacgtatgcaaacaaatgctcctcagggcagccgagcctcttctgccaggccctgtggcaataccagctggaaaggagggtctggacaatcctgggagacaggagcagtggatccaagcagtacctctggcctcctcaggacatgcaaaggactgaaacccaaagctgataagagatgctcctggaacagaaccagatatcctactttcctgggcttttcctgggtgcttgggtcaacacttgccttaagatgcactcaccccacaagctaactggtgctcgccgactgtacagtgagcctcagaatcagggaatgcggttagaagggaccctcatcctgcatgacctatgcattttacagacgagcagacataggacttcactgttactgccctgtactaggtattaggcgttgggcttctatgatgtttattaaagtttaattacagaaaattttaaagatgtatcaaagtagagagaattacataatgaatccccatgttcccttcacccagaatttccctcctgctacataggggatttaaagtgaatcccagacattacttcatctcataggacattttaagagatactgatagctgggcgcagtggctcacgcctgtaatcccagcactttgggaggccgaggtgggcggatcacgaggtcaggagatcgataccatcctggctaacacggtgaaacaccgtctctactaaaaatacaaaaaattagccaggcgtggtggcgggcgcctgtagtcccagctactagggaggctgaggcaggagaatggtgtgaaccccggaggcggagctgatagtgagccgagatcgcgccactgcactccagcctgggtgacagagcgagactctgtctcaaaaaaaaaaaactgataattcttattcattaaaagcttagagtctagcagaagagaaagaagatatgtgcagaaagctaaataaataagggtgcagggagcctgtatgatttccagtaatcaggagacctgctcctgtggagcccttgggagtttacagtgggatctacagtgggatgccacatgcagctctcaggtgattgtcacagccatcaccagggagtcaggcaaggatgacagtggaaggaaccgtgagtgcgggaccagccatccgggaaaggcagcaggttctgcagccagtcgccaaggcacaagctgctgttgaacaagcactccacacctcaggcataagccagggtagtggctttggcccagagtcccacttgggatagccaagcacgaggcgcgggtgccctctagtggtgccagtcagccctggtggaggatgtgcggaccacatctgcccaccctagacctggctcgtgccctgcacctccccccagtgcagccatctctgtttcagatctgtgccttcctctacctctcctgtgccgtctgccagcccactcctgaagacctgagatggctgggtcctctgtcttagtttctctctgcatattgtcgcatctccatctacttttcaagaatgttatttccctttaaaaactaacacatgaggccgggcgtggtggctcacgcctgtaatcccagcactttgggaagctgaggcaggcagataacctcaggtcgagagttcgagaccagcctgaccaatgtggagaaatcctgtctctactaaaaatacaaaattagccaggcatggtggcgcatacctgtaatctcaactactcaggaggctgaggcaggagaatcgcctgaacccgggaggcagaggttgcagtgagccgagattgtgccattgaaccccagcctgggcagcaagagcaaaactccatctcaaaaaaaaaaaaaaaaaaatcggcgtggtggtacgcgcctgtaatcccagctatttgtgaggctgaggcaggagaattgcttgaacccaggaggtggaagttgcagtgagctgagattgcaccactgcactccagcctgggcaacagagcaagactctgtgactcaaaaaacaaacaaacaaaaaaaaaaactaacatatagtggccaggtatggtggctcatgcctttaatctcaacactttgggaggccaaggagggaggattgcttgaggccaggagtttgagaccagtctgggcaacatggtgagatctctacaaaaaagacggagttttgctcttgttgctcaggctggagtgcaatggcgcgatcttggctcaccacaacctctgcctcctgggttcaagcgattctcctgcctcagccttccaagtagctgggattacaggcatgtgccactatgcccggctacctttgtatttttaatagagacagggtttctccacgttggtcagactggtctcaaactcccaacctcaggtgatccaccctcctcggcctcccaaagtgctgggattacaggcgtgagccactgcgcctggccaaaatttttaaaattagccagatgcagtcattcacacctatagtcccatttactcaggaggctgagctgggagttcggagctgcagtgagccatgattgtgccactgcactctagcctgggtgacagagtgagaccctgtcgtgaacaaaaaaacaaaactaacacgtgtactctgagtttcccattcttccttttgcacagagcaatcctctgagaaatgaaagaaaaaccctgtgttcagccttcctgttcctgtgagcaccgtcctgtttcttttttattgtttaccgcctgacttcccacacctctgtcacctcctttattctgccactccactgcagcccggcttagcgcttcagtcaccatcgaataactaactccactcattttcctgcttttttgcaacacagccgacagccaaggcctgactactctctgcttcctgtaaatcttatcattgactccaagatactgtattaatacacataatcagttgtttgtctttttgaagcttccattttctttctagacttttattcaaataaatcaactcttcatcatcacttattcctctcaatgtttgtgacagaaaaaatatataaaatcccatcaagagagctgtagaactctcaagaaagttctacacccgtagttccaactgccaaacaaacatctaaccattgcagatgtgtgctctgcaaataataactcagcattgtggtggagcaggggtcccttattttgtctaagggcagagaagcatgaaccgttgccacacatggcattatagatagcaacatggatagttttctagtaaattttatattaccgtagtctatattataatatagcaaagcagacacaggcctcaaaaacttaaggaacatttatgggagaaaatcttaactgggaattcaacagatggggagaagaccatcattctcagtttttgaggcagagcatctcattccaacgagaggtgtgtacgtgcaggagcaaaacctgagacacccggggaggagggtatatgagtgggaggctgtataatacacttggttgcaatcccagatccacctctttctatttatgcagctccaagcaaattacctcatctctctttgccttggtttcctcatctattaaatggggattagaagagactgacttcatagagtcgttgtgcgaaaatgagccagtgtattgtaatgagtctagaattgtgcctctaccacaaaataagtcctcaataactattagcttactactcccagcgtcaccaccaccactaccgctacctctactattattaaatgagagggaaagaacaacgaaaatactgtttaattagcaaaactaagaggtaatgagggcctgaattaggtgccagaacaaatggacagattgcagaggtaacagagataatgagcctatagaatttagcatctaatcccccaaggatatgatttaattggtctggggtgcggctggtatcttagtttttaagctccccaggagattccaaggggcagccagagtcgaggatcattgttgtaattgcaaatcacaaaccagaggcggagtggaaggaggacctagagacatcccagtttactccatgcggctctccaggctagacgtgtgagcagaacttgaaggtttttcggagggagtcacagaggtttggacaccggcttttttgttaaaatacttgagattatgaaatgtattttagagtcaggagtaaaatatttaaggtgaggtttgccctgggagtagagcaagcgaaggaaacagcctgcatacttgcagagatttagtgagtcatgtagaagctgcctaacaaggaagtatgtctaagcaagtcacaactgggcccgggtgcgggatgaagttaagtgcttaataatttggactttacaccttcaaaacaagctctaaagactaacagtaacattgtataagcaactatttgtaagatccgatcagtgtaatttcatcacttgcagattattatccagacccctcaccatggccccacatgccaggtgcctgtcttccctccagtgtcccccaggagcactgtgtccagccacgcaaaacacatatatgcccctctagaatataagcaacacgaagacaggaatcgcatctgagcgcctgttgtaatgctcgggagcatttgttgaatgaatggaagaatgaatggtctggtaaaaagttaataccccttctctacccacatttacccaagatccaaccccttttttcattcagaactgttttttaattttaaaaaatctttttttgaaaccgtaaaagtaatgcatgcactgtgtagaactcttgggaaaatgccagaaagcacagaaaaagatctataatcccacaacccacaaacattttgttaaatagtatttcagtctggagtgtgtgtgtgtgtgtgtgtgtgtgtgtgtgtatacttataacttgctctctgatgaccaaaatgcttcctgtccaggtagatgcctaataaattctgctgagttacaggcaaatggggccagagacccagagaccaggagacaaataatccagataacttggaaatggttgcagttctccaaaactttagagtgacttaatccagctttttggaaaatggtcagatattcaggggttttttaatgcaaattttagctgttaggctgagcatccagaatcagaaaagggacctagagagtaaggagttgagggatagaggaaggtgtagagaaaaatctagatgaggttagtgcaaaggcagaaatatctaccacctttgaaactttgccacctctctcttcctggttgccttttatttaaacattttaaaaatagatagacatagatggtttccagttgtttgtttgttttgagacagtctcactgttgcccaggctggagtgcagtggcacaaactcagctcactgcaacctccacctcctgggttcaagagattctcctgcctcagcctcccgagtacctgggattacaggtattcaccaccacgcccagctaatttttttgtatttttagtagagacggggtttcatcatgttggctaggctggtctggcactcctggcctcacgggatccgcgcacctcagcctcccaaagtgctgggattacaggcacgagccaccacgcctagcccagtttttttttttttttctccgagacagagtctcactatgtcgcccaggctggagtgcagtggtgcgatctcagctcactgcaactttcacactccgggttcaagcaattctccctgcctcagcctcccaagtagctgggattacaggcgcctgccaccacacatggctaatttttgtatttttttagtagagacggggtttcaccatgatagccaggctggtcttgaactcctgacctcaggtgatctgcccgccttggcctcccaaagtgctggaattacaggcgtgagccacctcacccggccccagtttttaagctaaagttagcatcctgtgcatatatttgtatacgtgtgcgcttttccccccatttaaaaaaaattagagttagggtctcgctatgttgctcaggctggccttgcactcctggcctcaagtgatccgcctgcctcagtctccaaaagtgctaggattacaggcatgagccatcatgcccaacctccccatttttaagatataatttacatatagtgaaattcacatgagtatatagttctgtgagttttgacaaacttttgcagtcatacatgagttcaccacaatcaagatatagaacagttctcctagtcagcttagcttggtatgaaaagtaaaaataaaaaagatataggacagttctgtgttagggttctccagggaaacagaaccaaggtgatgtatgtatatatagcgagtgagtgagtgagtgtgaatgtgtagagggagaaagatttaagagggtaagctggcaggctggagactggcagggaagagttacagtctaagtctaaaggcagtctgctagcagagttctattcaatttaatgctcaagaataatcctctttggcaccattcattctctgtccttccagcccaccaggatgggagctgggagctgtgcccctgaggccctgggcggcagccacaccttgtgaatcccctcttggggtcattcttccctcttcttgaaagataacaaatgtttgcagccacatcactgtagcccattctgtagaagtctgacagccttccttccctttgtcctgtctttgtccattttaatccaaaagggcagtatttctgctgaggtggttggttgaatccatgcttcacagccccagtctcattatctgatcgtccagccacaccattggtgttctcttaggaacacaccttctcatttttttgcaatgaggctaggctgagaattttctaaattttcaagttctggttcctttttgcttaacaataatttacttctcacattttactacaagcagtaaggagaaaccaagccacaccttcagcactttgcttagaaataacttgtgctgaatatctaaattcatcactcacaagttctacctttcacaaaacactacaaaataactcagccatgtttcttcccactttgtaacaagaatcgcctttccactagttccaataacatgttccccatttccatctgaagcctcaccggaagcacctttaacatccatatttttggggttttgtttttgtgtgtatgtgtttgttttggttttagttttggttttggttttggttttggttttggttttaggacggagtttcactcttgtcacccaagcaggagtgcaatggcacatgatctcagctcactgcaacctccacctcctgggttcaagagattctcctgtctcagcctcccggattttggttttttgtgctttgttgagagacaggatctcactctgtcacctaggctgtagtgcagtggcatgatcatagctcactgcagcctaaactcaagcattcctccctcctcagcctcccaagtagctaggactacaggtgtgcaccaccacatccagctatttttattatttgttgtagagatggggttccactatatggcccaagctggtcttgacctcccaggctcaagtgatccttctgtctcagcctcccaaagtgctgagtttactggtcatatgtatttttttttttttttttttttttttttttttttttttttttttttgagacggagtctcgctctgtcgcccaggctggagtgcagtggcacgatctcggctcactgcaagctccgcctcccgggttcacgccattctcccgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccggtcatatgtatttttaagggagaatgggaacatttcaatggtagctgcctttgggaagtggggaggagcataagactggtggagtgtttaagaggatttaactttctgtgatgttttatttaagaaaaaaagaacaaaatttaaaagctataaaaacaatcccacatggcaggttttgggtgtggtatcattctttatacttttctgtatttctcaaaaaatatttttgtagactttatgtcttaagttagctatttctctctttttgttttttaagacagggtcttgctctgtcacccaggctggagtgcagtggcacaatcttggctcacttcaacctccacctcctgggctcaagtgatcctcccacctcagcctcccaagtagctggaaccacaggtgtgcaccatcatgcccagctaattttttgtatttcttatagagacggggtttcggcatgtttgccaggctggtctcaaactcctgggctcacccaatctggctgccttagcctcccaaagtgctgggaatacaggcatgagccaccacacccagcccaagtcaactatttctttcataatgctgtgtaacaaacaattcagtggcttacattagtaaacatttctttttccactgatggacctgtgggtcacttggagtggctgttttagcttgttaagggggaggttcaggtcttctccacatggctcttatcccaggaccagtggctatccaggtcatgtccttctcatggcatgtggcagatacaaaagaagggaagcagattgaaagcttcctttcacttcatttcatgtccactaatattccattggtcagagcaagtcataaggtgatatggtgtggatctgtatccccacccaaatcttgtgtctaactgtaatccccaatgttagaggtagggcctggtggaaggtgactgaatcacgggagtggtccttcatgaatggtttagcaccatctcctggtgccattcttgtgatggcgagcaagtttttataagatctggtcatttaaaagtgtgcaggacctccccccactctttctgtcttgttcctcctccaccaagtaagatgcgcctgcttcccttcacctttctccatgattaaaagtttcctgaggcctccccaggagccgagcaggtgccagcatcatgctttctgtacagcctgcttaactgtgagccaattaaacctcttttctttataaattacccagtctcaggtatttctttatagcaatgcaagaacagactaatacgtaggggcaagtctaatactgatggggcaagggaaggaaagagaattataaataaatagtaaaagcaaacacatggctacatcctgacctattgatcttgtttagcatttgagattcaagaatgtagaacatactctaaacagaaataaattattgcaagtgttaacagtctcgtgtccaagtacttcctgtcagagtttagcatcttcagtaggatcaaaattagaatttctcttggttgtcgtcttctcagtattagaaggaccctaccaatactgtttagacactggcagcatcttccttatcatccggttggtgggtctcttgagcaggcatcggagtcatctggggaacttgttaaaacaaagattgctgaaccccacccctagagtttctgatggaatttaggtgtggcctgaacactgggattttttttttttttttttttttttttttgagatggggtctccctctgtcgcccaggctggagtgcagtggcacgatcttggctcactgcaagctccacttcccggattcacgccattcgcctgcctcagcctcctgagtagctgggactacaggcacccgccaccacgcccggctaattttttgtgtttttagtaaagacggggtttcaccatgttagccaggacagtctcgatctcctgaccttgtgacgtgcccgcctcggcctcccaaagtgctgggattacaggcgtgagccaccacgcctggccgagcattgggaattttaaaagctctctggatgatttcaactctgggtgaatcacactttgcagagtttgattcagtgggtcgcggtaggtcgagcctgagaatttgcattctaacaagtttccaggtgatgcttatgctgctggtctggggactgagctttgagaaccactggcatagggacattgtctgcactagtaatggtaaacacccagttttagcattgcaaattgggtcactctcagaagcaaactggagagtttcatgtcaaattattgattgctgagccagtgctggatgctctctgaaagaacatcaatagctctgccccagctttgagctgagaaacctgacgctgcttaacatgccaattctcaaaaatattcattggaatttcccttttacaactgtacatacagccaggcacggtgactcacacctgtaatcccagcactttgggaatctgaggtgggaggatcacttgagctcaggagttcgggaccagcctgggcaacatagtgcgacctcacctttactaaaaataaaaaaaattagccgggcatggtggcacatacctgcagtcccagctactcgggaggctgaggtaggaggattgcttgagcccaggaagttgaagctgcagtgagccatgatcaggccactgcactccagcctgggtgactgagaccctgtctgaaaaaaaaaatttttttaaataaaattctacataacttctccatcttcttaccagtatacctgtgtagatgcagaaaactccaaaacccatagcatatcctgttggtgctctgtactaccctcaatactgattgtaattcttaatacacagtaataacttttgttttgttttgctttgttttgttttttgagacggagtattgctcttgtcacccaggctggagtgcaatgacgcgatcttggctcaccgcaacctttgcctcccaggttcaagcgattctcctgtctcagcctccctagtagctgggattacaggcatgtgcccgcatgcccggctaattttgtatttttagtagaaacagggtttctccatgttggtcaggctggtctcgaactcccgacctcaggtgatctgcccgcctcggcctcccaaagtgctgggattacaggcatgagccaccgtgcctggccacttttgggtattattttaactcccagaaaagtttcaagaataatacaaggaactcccatataacctttatccagattcacacatttttcccctgggctttgtgcttctctttctctctctctctctctgttttttcttttctgaaaagtttgagagtaacttggaaacattgtgaccctttacccttaaatattttagctatattatctaagaacaaaggcattctcttaaataatcacagtacagtcctcaaaatgaagaaagtaacatttacttttttttttttttttttttttgagaccgtctcgttctgtcgcccaggctggagtgcagcggcacgatctcggctcactgcagcctccgcctcctgggttcaagtgattctcctgcctcagcctcctgagtagctgggattacaggtgcccaccaccacgcccagctaatttttgtatttttagttgacacaggatttcgccatgttggccaggctggtctcaaactcctgacctcaaatgatccacctgcctcggcctcccaaaatgctgggaccataggcttgagccatcatacccagccagtaacattaacttttcatgtcattatcttactcacaatatagattgaacttttggccgtgtcccaataatgtccatgatagcccatgtgtttctcctggtcccaggttccacctggcatcatggattacatgtagccctcatgtctctttagttccctcgaatccagcagaggtccttagcctgtctttgtctttcttgaccttcacattttttgagaagtacaggccagctgttttgtagaatgtcccttagtttgggtttgtctgatgtttcgtcatggttagattcagattgtgcatttttggccagaatgtcactgcactaaagttgcatcctcgttacctcatttcaggaggtagccctacagtctgcctttgtcccagtattagtgatgttagcatcaactgtttggattaggtggtatctgacaaacgtttccaccctagggtaacaatttttccctttgtaattaataagtgttttgtagggagaggctccaaggctatgccaatgccctatttctcatcaatttttcacccactagttttagcaggcagtgatggttttccacctgcatcgttccttctgttcatttctgctgttgagcttcagcgtctttgaaattcttactcatgtctcccagcccattcgtctttgtatagactggagttgacattgtggcaagtcacatttgtgccatttgtaactgtgatgagaaagtcgctgatagatacagagaaaaaaaattaaaaaccattctacaaatagtgtttctaaagaagagaccaaactgaaggaaaagaggcaattaagaaagttaaaatgggctctaaaaacaaaaacttgaatttatggattgaaagagctcctttgaattctataaaactcaatgaaaattgacattcacctagacatatcctaaaaacagttcaaattgcaagggtttagaaatgttttccttcaagcacccatgcagaagagaaaaaaaggcaaatgccaaaggaacaaaaataaaggtaaccttagggctgtcttttgccacccttaatgccagcaaacagtgggaaaagaagagtttgggtaaggaaaggcttatcccaagaatgacaaatcctgtcctacttgcaaagacctcagaaacataccattgctcagaaggacctgaaagcacattccaggtcccagagtcttttctctctcctattgccctgcagagactcttgacttaccttcacatttttcgtagcctgcagcacaccactttcaggagctcagaaagtatttgttgacccatccgtacagaccctcattctcctctctgctgcagcccactggcctgccgtgggtcctcacacgtgctatgccaggcatactacactagtgtttctttggccaaaatgtccttccccacaatcaacgtgtccagctccccacttctttcaaaatgtgaaagtcatgctctcaggccaggcgcagtgcctcacacctgtaatcccagcattttgtggggcccagacaggcagattgcttagtccaggagctcaagaccagcctgggtaacatggcaaacccccatctctacaaaaaatacaaaagttagcccggcatggtgggaagatcccgtgagcccaggaggcagaagctgcagtgagctgaggtcacaccactacactccagcctggggggacacagtgagactgtgtctccaaaaaaaagtcattttctcattgacaccttccctggtcatcctgggaaacatcctgtttaacctgctcaccccctctatatttcttttctactttctcttagtttttcttcttagcattttaacactgtattaaaatattttaataaacttatttatctaatattttttattttattttatttttgtttgagacagagtctccctctgtcgctcaggatggagtgcagtggtgcgatctcggctcactgaaacctccacctcccaggttcaagcgattctcctgcctcagcctcccgagtagctgggattataggcatgtgccaccacgcctggctaatttttatatttttaccgagatcatgccactgcactccagcctgggtgacagagtgagactccatctcaaaaaaaaaaaaaaagtgcaggccgggcgcggtggctcacgcctgtatcccagcactttgggaggttgaggtgggcagatcacgaggtcgagagatcgagaccatcctggccaacatggtgaaaccccgtctctactaaaaatacaaaaattagctgggcatggtggcgggtgcacgtagtcccagctactcgggaggctgaggccagagaattgcttgaacctgggaggcggaggttgcagtgagtcgagactgcactccagcctggtgacagagcaagactctgtctcaaaaaaaaaaaaaaaaaaaaagcatgtgagagaggacacatggcttcctagggagaccagagtttaaagacctttgtcttgtaccaactctagaaacagactgaaatagacgggaaacacctgagctagaaagagctggcttgcagcgcttgcctgaaggatttaggtctgaggtggctctcaggggctctttggatgcatctggattcagcttcctggccatgcacacccatgcccacgcttgtgtgttttgtccctgttggggttatccacagaggggtgtgcggtggttccctacattcctagtcctcggtttgggtatatgctgtgaacatcctgcccctgggggcagctgaggagagtaatgagcaggaacttttattgggacagaagcctgcaaggagaaccttccttctaggaggccactatctacttaccgccttccctcccggttcattttctggacaatgatgccacctagtgggaaacggtaagaactcacacagcatttcgacaactatacatagatcttcaaataaaaatttccctactttgtattaggttggtgcaaaagtaattgtggttttgccattaaaagtatggccaaaaccacaattacttttgcaccaacctaatacttaattctgttacccattgagtcctgtttgctggtttctccccaggccaaatacagcacatgagcaatcaggatttgctaatactatcaccagtttttaagacagctataaatgatgtaaataaatgtaaatttaaaactgatgcagaggctgggcgtggtggctcacacctgtaatcccagcactttgggaggctgaggcagggggatcgcctgatgtcaggagttcaaaaccagcctggccaacatggtgaaaccccatctctactaaaaatacaaaaaaattagccggacatggtggtgggtgcctgtaatcccagctacttgggaggttgaggcaggagaatcgcttgaacccaggaggcagaggttgcagtgaaccgagatcacaccacttgcactccagcctgggtgacagagcaagactctgtctcaaaatagaataaaattttattttgagccactgagcccggcacagtggctcacacctgtaatcccagcattttaggagaccaaggtggatggattgcttgagcgcaggagttcgagaacagcctgggcaacatggtgaaaccgcgtctctacaaaatattagcgaggtgtggcagtgcgcatctgtagtcccagctacttgggaggctgaggtgggaggattgcttgagcctgggaggtagaggctgcagtgaaccgagattgcaccactgcactccagcctgggcaacagagcgagaccttgtctcaaacacacacacacacacacacacacacacacacacacacacacactgatgcccagaaaggcttaatgaaaggagatatgccaaaatgaccatagcgacagggttaggatggtgcagttatgttgtctaaatgctttgtgatacaattatgatatagtttgcatttctttcttagaaagtttgtgttattcatagtatatttttttaagtagtagatcatggtgaaagtaaagttggaaaatatggaaagagagacaataaagacaaagttacccatagtttcaccactcaaatataacttgtttacatttttggtgtgcttctatttagcctttttttaaattacagagtttatgtattttttaattgtgattatgtattttcacgctggtaataattctattggatttattttactaaaagtcaccctttagacaaagctgtttccagaaactatcattaagatgcattggcttcctggaaatctgatcttacaataatttttaatatttttgtgttgtatgttcatgtatatggagatatcttcaaaaacgagtaattggacaggtgaaaacagtaagaagacagtactttttaaattcatgatgcaacatccagtgagcccaccagccaccagcagggcccagctgtgtgctggcgccacctggtggtcatggttataaacggtttaattctccgcctctcctctctgcttggcacactgaaaaggaacaaggctgtggtgagctcaaggatacccaggaaatctatggattggagtttgcattatgagtaccaaataggcaccacatgaaaggaaagaaaggtctcatggaatctacgaaatgaaaaattcaaagaggaatatagccatttggagttgtagcccttgggttacctccaaatcatcttttttacaaatctcttttttttttttttgaaatggaatcttgctctgtcacccaggctggagtgcagtggcacgatctcggctcactgcagcctctgcctcctgggttccagcaattctcctgcctcagcctcctgggtagctgggactataggcacacgccaccatgcccggctaatttttgtatttttagtagagacagggtttcaccatgtcggccaggctagtctcgaactcctgacttcaggtgttctgcccgccttggcctcccaaaatgctgggattacaggcatgagtcatcgtgcccggccacaaatctcttttaaaaagaaatctcttctccacttgtaactcacttatcttattatcaaaaaacataatttctgtcctttctctgtgacagataagttttacgttttgagaaggttctgggagagacaggttgtacaagagaaaacattcttgtttattagagccataaacagctgatatgaatcccagctctgccacttactaaccgtgtcccaggctaagtcatgtaatctttctgggctgttccctcatctctggaatgggggtaatcacagcttcttttctaggttataaggagtagaaattatgcctggtgctgtgtttgtaatgcagggttcagtgacctgtagatgtttttaaaataaaaagccttatggataagtcagattaggtttaaacaattaaaaagttaattctgtttaccaattgtagaacgcacaggtttttcccatgttaacatctctgaagatgtgtctgtggcgtgccagcgtttttctcaatagctttataaaataatggtgctccttccatttggtggtgttttacacagaatgtggtagtgaggtcagcagagtaaagtgttacagagagaagtgtttcaagtgctttagggttgtgtctgtaaagcctgaatatgagacttggtagtatgaggtctaatgggggcaactctccccctgccctgttcccagtcccagacttgaacctgagagcaactgtttctatgaagtttatttgaaaaatgtgtgttaaaccttttcagggccgggcgcagtggttcacacctgtaatcccagcaccttgggaggccgaggcgggtggatcacctgaggtcaggagttcaagaccagcctggcccacatggtgaaaccctatctgtactaaaaatacaaaaaaattagccaggcgtgatggcagacgcctgtaatcccagctactccagaggctgagacaggagaattgctggaatccgggaggcagaggctgcagtgagccgagatcatgctactgcactccagcctgggtgacagagcaagactccatctcaaaaaacaaaacaaaacaaaaaaaaaacctttttagattcaatgagatgacacagcgcagatcatccctcagcagcctgtagtgtttgagatgacacagcgcagatcattccccagaagcctgtactgtttcccacacacagtgcacgtgaggggagcgatggagggtgggtgtgatcccttctcaagtcctgctgctctgctgtgtccactgctgtcatctctcagggactgttttgaggactgaatgggatgttgcctggaaaatacctggcacttacttgattccataaataacagctggtcatactctccatctccttggcaaccattcctggtcttttttgtctctttcagtctaataaagttcctgtcgttcagcacccgcatcacatgcatccgctgactcccctcatcacctacagcaatgaccacttctcccccggctcccctcccacccacctctccccagagatcgatccaaagacaggtaagtcgtctgccactcaggcagtgctgctgcagggcaggcgggcttctcttttgtgggaacataacagcccttgaatcaggctgacctgggttcaaatcatggctctttgtctcaggagtctttggaccttgtctgctaactttagccttgtcattttttttttcatctgtgcctcccctgtaccttctccaccatagggtcacgataaggcccacaggaattaaatgcagtaaagcacagggcctggctccataggcagtgtgtggggtggctctgcccaagtctagcccagctgtgggccgtgcttccctacaccaagacatgtttgccctaaactgaacatttttaaatagattcatcagtctaagcagacacagaagtgcaaccgtaaagcagtgaggccaaactggcttttatttatttatttatttaagacagtcttgctgtgtcgcccaagctggagtgcagtagtgtgatctcagctcactgcagccttgacctcccgggctcaagcagtcctcctccctcagcctcccgagttgctgggaccacaggcgcatgccaccatgcccttgcccagctaatttttgtatttttagtagagatgggtttctgccatgttgcccaggctggtctcaaactcctggactcaagcagtcaactcacctaagtgccgggattaccggtgtgccaccatgcccaacctgaactggcttttttttcttttttttttttttaacttgcccaccagacctgtccattccagggagccactgtctttatagcattcacacagagttgccaggggaaggcaaagcatttttggagcccctctttggagaaataacagtcactacaagttacagataatgaggaagacacatgtggaggaggaatccaaagtttatttctccatgaatgaggcgggctttctagagacttggttcaccagtgactcttgtcattggtcttgtgggtcctgtccctctcttccaggacgctggcttctgtatcacagccagctggaagatactcttcacagagatagaatccgtgcagctagagagggggtgcattagtcctgcctcccctgaatatgtccttgactgactggtgagagctgctagggagttgacagagggcaaggacaatgacacaagcacctgctaggctccagagcaccagggacatagggcaggatgctcccatttgatgttcgttaaggtgctctggcagggcgagggaacagtctgacatatctctctttggaagcaggaatcccccggccccctcacccatccgagctgtcaccgtattacccactctctcccggagctgtcggacaaatcccccaccccctcggctggctcgtcccacagtaaggaacccacagcctctcttccccctgctccctccttgcgctgagctctgcctctgtgccctgcgcgccctgcacagtggagccccctcagaggcaagcccaggactaggcctccctgcccccgcccaggcagcgtgctcccagcattaccttcccgcttccttcccatatttctcatcccttcttcccaagtgcctctcttcctctgccctgagctttcccaatatgctgaccagatttcctccccctcacaggcaaggccagcccatgtactcccttcctcccggtggcttccggcacccttaccccgccctcgccatgaacgcctcgatgtccaggtgagtcccggggctggggctgtccgcatgtttgtcttagcaaccacgccatttctgaccacgaaacagctttttcttgccagttaatgagcaggcacagggctcaccctccccccacctctctttgatcaagcatcttctcacgtcccgcgctccccacccccaggtcagaatggagaccacaggatcactgtccccatctctccaacagaaggattgcaaagccctagcactctgcctcctgccatgggctctggcactgaagcattttgaggacagatgctccccgacttaggatggagccgcgtcctgataaacccgtcgtacattgaaaacacaactttccccttagaatatttgcaacatatgatggttttatccagacataaccccatctaggtcaaggagagtactgaattaatatcgtttttgcaccatcgtaaagtcaaaatatcctaagtcacggactgtctgtatatcacactgaagctagggactgggagaagatgaatttttcctgaaatgatgtcaggagaggagacggtgaaaggggatttctgtctcagggaccagctctacctgacagtggaacctctgaggacagaggaaagctgcccacagcctaagcccttcttttccccagtatgcccgggcctctgaccctcctccccttttgtgtgtttcatcccacctgcttccagcaccagatgggcagcctgggtgttggtggggagaaggaagagccattaagcatctcccaaacctggttttctagaagacgacaaatagccttctagtcctgagactctgccccacggacatgcctgtgcccttaaggcagagagccaccgtgtcctctgctgggtggcaggtatccagcctgaacccctctgttgccatttgtttctatccggtgcacagcctggtctccagtcggttctctcctcacatggtggctcctgcccaccctggcctgcccacctcagggatcccccaccctgccatcgtctcccccatcgtcaagcaggaaccggcaccccccagcctgagccctgcagtgagcgtgtaagtaagcggcagcctggattcaggtgggagggtgcaggctgtggggaggggtggccacactctgagcagcaaatgtcatgtactcttctctcttggtgtcactcagcaggcatcacagcctccccagccaggccctccctcttcctcgggacttactccctctgaccttctgggtccctgtcctttcagggacatggtgcatcttctctcttattaaggaaagttttactgtcaggtctcagaggctgaaagagaacctgagaaagcttttaacaccccaccgtaagatatatgaaaaggtgaggcccagaaaggagacagtgttttcttaaggacttgtggtgggctggtggccgagctgagatgagcaccagggtccttaccttgcccgtgtaccataaagatggcaggaagccaaagtcagtgctccctggagatcccaagagaaccccctcccaacttggttctgcccagagtgccccacactgtgtcctgtcaccgccgccagcacctgccagctccagtgagagctcatctcagcaaccccaccatgctctgttcctctgtcaggaaattggagagtagattttcaaagaatctggcgtggagatcgttcaaaggtgggaaactacgggaggaaggtactcaggtgttgagtgcagccatggggccacttgaattagcatccaggcagcccgcgcccctccccagagacaatcagcggtgtttcagtgacaggtggggattgatgagttgtgtgacacctgacatgctaacctacaaccacgtgccttcccaggaaatcaccagtcaccgtgaaaaaggaggaggaaaagaagccccacgtgaagaagcctctgaatgccttcatgttgtatatgaaggagatgagggccaaggtggtggctgagtgcaccctgaaggaaagtgcagccattaaccagatccttggaagaaaggtaagacctgccctctccctccaggccagggaggcagcgtccctgcattgatggctccgtgtggtctctgaccctctctcccccagtggcacaacctgtctcgagaagaacaggccaagtactacgagctggcccggaaggagcggcagcttcactcgcagctctacccaacctggtcagcccgggacaactatgtaagtgcacactctgggcagaggacgctcagaccccaggaacagcctctgcaagaggaggaagggtgaaggaaagcaactgcatttatttttatttattttattttcttttattttttgagacagaggctcaccctgtcacccaggctggagtgcatgcagtggcgcgatctcggctcactgcaagctccgcctccccggttcacaccattctcctgtctcagcctcccgagtagctgggactacaggcacctgccaccacacccggctaattttttgtatttttagtagagacggggtttcactgtgttaaccaggatggtctcgagctcctgacctcgtgatccgcccacctcggcctcccaaagcgctgggattacaggcgtgagccaccgcgcccggccagcgactgcatttatagaggactcttaagatcagggagaagcccatacttctctagaaataaggaaggtgttttaattctcaggaggtcaacaagtcctgaggacggacttcagttgatgcatttccctttgaactggactctgccctcgatttcataacacagggcacggggttagctgtggtaggaagagttgtctccagccactcctaacccagggctcaaagaccagtgtgtgagcctcagggggcgtgtctctaagctcccggaaaccaagccaattttcgcatgcgtgttcttctttgctttttttctggtaagaggacccacagttgcatcaaactttcaaagggacctgggacccctcagaaaagatctagaagcactgttctagggagagaaacagaaaaacagagtctgaagggcagtggagggaggaggccttccaagaaggcctggacacccgacctggaggggaaacgcgtttgtaggggaggaagggctccctctgcctcctcacgggctcccacggctgtgatctgaattatctctccacactctccctgagggatcgagagcagtaaagggcaacgtcctgtcttctctctgatctgggagcccctgagaagccagcattcttctctcccagcttacctcttcctttggctgtattttccagggtaagaaaaagaagaggaagagagaaaagcagctgtcccagacacagtcacagcagcaagtccaggaggcagagggtgcgtctcggggcactggcctcttctcctgcttttccttttgtcacagccacacctgcccatgctgtctctagctccctgatgggtcagggcttctgcctcggtattcgcgggcgggtattattacccctttctcgaggtggccacttaagaggctctgagatgtgaaggcattttcccaggcactctgcttcagtggtggtggtaggatttgatcccaggactttgtcacttcaaagcctagacaatctaattccattgaaaagtgaatcatcctacctgagggttaatggaatgaggttgaaattgtctttgaaatacccttaggaaggcagcacatgagcccctgacatcccacctgtcagtggatccaggggagcccgggtttccttggatgtttctttggttgaacaccagaaaaaattagtttgcttgggtttaggaggcactttgtgtcaaaaccatgtataaaatctctatattaccagaatcatgcctagcacagaaagatgctcacactgtgacgattattattaatatttaggtcacgccccccatctcatgctcactccaggacaagtgtatcgctgcttgcacgatgtaaagtgctttcaatctctcttcttcattcctccctccctccctttcttcctccctccctttcaccttccctcccattctccttccctccctttccccttccctccctccttttctccctccctttctctttccctccctctctttccctccctctccccctccttccctcccttccccccctccctttcttcttccctcgctttctccttccgccctccctttctccttccctccctccctatttccttgcctcccctcctcccttccttccttccttccattatacataggagcgcacatgagtggaacccgtacctgctacagaacccgctgtctggcacgctgttcagcaggcatgcactctctctgactgtattaataccataaaccaaagatttcaaagcaaactggagattcatcccaaaagttaccagctttaggaaaggagggtggtcctgtgagacactgagccgtcttctctccgatctgatgctgggtggatcttcatcagtttgggcgttgcctcttctctgtgctctgggtatttgtgaatgcagtttcctagtcttgaaagccttggaagtaatgtcaggtcctcgccaaaatcatccctgtgtctccaaagcacatgtatcgccagggctgttcctcagcctcctcctctcacagagctatagctgctcactctttcttgtattttccccctaggtgccctggcctccaagagcaagaagccatgtgttcagtacctgccccccgagaagccctgtgacagccctgcctcctcccacgggagcatgctggactccccggccactccctctgcagctttggcctcaccagctgcccctgctgccacccattcggagcaagcccagcccctctccctcaccaccaaaccagaaacccgggcccagctggctctccactctgccgccttcctgtcggctaaggctgcagcctcctcctctgggcagatgggcagccagcctcccctcctgtcccggcccctcccccttgggtccatgcccacagctctgctggcctctcccccgtccttccccgccacgctccatgcccaccaggccctcccggtgctacaggcccagcctctttccctggtcaccaagtctgcccactaagctccccccgacccctgcaggctgtcacatgactcattgagtagtaatgattcagaagaaaaagaaaaaggagactttattggtcaatatttgaccactctggactgttctgtaaagtggctggtaacaacagcactttacagtttgtagatgtaaccagtagctgatcttaaggcttttttaaaaaacaaaacaaaacaacaaaaaaaaatctttataagaaagagaactgaaaagtagcgtgctattcgtcctgtaggtgctgtggtggatggacctgggcagagggcacttctctctcttacctctcttgcactttctgtctcctgtctcttctcgcccctgccgcctgccccagcttccccgactccatctgcagctctgccattgtgacatttcctgttacccagcccaagttttcatcgtctgctcaataccgtgggttcttcttcgtcctctgtcctctgcccagtgtgaggccatcaccatgtgagaagacatcttggcctgatttgctgccaccagcgtcccctccctcagtgggcccgaactcgccagccccagctttcagtggagaaagcggtcctctgaaatggtttcctcccaacccccgcatttaaagggactcaaggtgcctgccacttcctcagcgaagaagtctgtgttcctccccgtccttgccagtggcgatcatcccttcacaatcccagagtggcaggcgggaccggccccatggtctggctcctgtcacctgggtccgtgccagcacaatctgccaaagttctagagaccctgttcccttccccatcacctcacatgcttcttctgtgtgtatttctttttgtttttatggtttttggagcaatttaaactcccagttgtttattttcacaaaagaaaataaaattgcagttgcaag

SEQ ID NO: 38643 - DNA, 16521 bp, Homo sapiens
gctggcccaggtgagcgggcgcgctggtccaggtgagcgggcgcgtccccgcgacggcgctgcctgcccgaggcggttcacgtaaagacagcgagatcctgagggccagccgggaaggaggcgtggatatggagctggctgctgccaagtccggggcccgcgccgctgcctagcgcgtcctggggactctgtggggacgcgccccgcgccgcggctcggggacccgtagagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctgggaggcgaggacggtctctgccagtataaatgcagtgacggtgagggggcacccgggcccagcgagggctcgtgctttcgggggattggggtgacggagatcctggaggtgtgagtgacagatgcaaggcagaccttgacggtgtccttcggctgtggaaaaacttaaccactgctagaatcttgccgttctagtgattgagcaagctgggtacaagttcgcaccactattgttagaatgtgagaggtcacattctaacggagaggtgtaccccccgtcccatttgcattgcttctgaattaccttttccccccctcaattgcaccaagttgccgaagaacttactgacgtaggaatcatgggaatagagtggaacagactggttttagctcatttttgcttctgtaaattggatgaacatgcgaagcaaactgagaatttaaaaaccatgccgtattaactttctctataattgatattaaatggttttttttctgcaaacccatagacaataacttgcgacctttgtacagacttttggtgtactcgagtgttgagaaagggttccgataactcttctttccttagatatcagtgacccgcctcctcctcattgttggttaacgttaatacagttatcttcatttactcttttaatattttttgaactttctctttgaacctgagaatttgtttggtggcggtatgagtactaatcaactcagtatttcaggcagagatagttcttttgtagcacatttttgagtgcttaaatattttaataggtcagaaaaatattggacttttgtttggaaattgaaaatgttaagagagcagttgggagatcatgtttccaataagattagccaaggttagagtctcattatgctggcagcggaaaataatcggggatccagtgacttcattgttggaacctgattgtataggtgaacttaaaaggaactggtatcatgtaaacctatgatgccacatgctgcctgcaattttcaagataatttctagttttatgttaatagaagtaaaggatgaactgtatcttgtatactttaaagcgctgaacaggtgctgagacatgttgcattgcttcttaaatttgtgcctaaacgttaccacctaaacgtatgcttcatgaagatgtttttattcttgtagaacttgttcggaggattaagtgcataatttaaggatcaaatagttgcctttcctaaagcaaatgttacagttttacttagtcattcctattcattatacaaatatttgagtcccaactgtgcttcagatgttgttctaatttgagattcagcagttaataaaacagacaaaaatctctgtccgtggagcttgagttctggtgagggagagatgggcagtaaactagtaaataagtaaaattaggggaagtgtggagtctgatcagggcagacgaggggccatgttggaggcaatttactcttctaaatgggttgttcagcaaaggcctcactgatgaaagaatatttgagaagaaatctgcacgtggtaaggggagggaatgtggttatttggagaaacagcattccagacagagggaatagcaagtgcaatggacctgaggagaaaggccagtcaaggatgactctgaaggttttggcctgagccaaaggaaggaaacggttgccatttacagagatagggaagacttggaaggagtcgtcttcataaatttattagtctagggttctagagtttatttacatttaaaacatgcctgaagttgaatgaataccagccttgttaaaatactgttttagtctttttattttattttttgttaatatttttgaggcaaggtctccctctgtgcccaggctagagggcagtggtgtgatcattgctccctgcagcctccaactcctgggctcaagcaattctcctgcctcagcttcccaaatagctaggactataggccatgcccccactacacctggcttaatctttctttttaatctttttcatcttctacaggcttctcaaaatttactatttggagtttagaggaaggtctctggcacaaaaaaacacaaaggaatttgagaatttaagaaatgttatatgcctcagtgaaaaaaaattttttgtcttagtaagtactctacgtttaacggacatgtggtttcaagtccaagtcaccatactgatagataattggatctcaatgaaaaaaaaaattaggcaggacgtaatggctcatgcctgtaatcccagcactttgggaggctgaggcgggcggatcagttgagctcaggagttcgagaccagcctggccaacatggtgaaaccccgtctctactaaaaatacaaaaattagctgggcatggtggtgcacacctgtagtcccagctacttgggaggctgaggtaggagaatagcttgaacctgggaggtggaggttgcagtgagccgagaccgtgcctccagcctgggtgacagagcaagactctgtctcaaaaataataataataataataataataaaattgctgttactcgagcagtctctctggaacaattcaacctttcctatattttggaattcaggtgaccaaatcagaaccaaacagaacaatcccaaatctggagaaacatggtgattaaggggtatttttagttgcacgaaagagatcaagagagctttaaaaaaaaaaaaaaagagtgagttaatggtagggagaggttggtcaaataaagggcacatgtccttgctttacctgagggactggcattatggagacttgctcccttagttttggccatcctctcttgggtaggaaaaaggccttattgagagttaagtatttagggaaataaatttgatgatccgttattttcttcaacttttttctccctgacagcaaggaagatttaaggaagaaaacttttcgatttcctttgaaaaatagaacacaaaactggcttgtaaatgtttttagaatgatgaataagtcattaattaattcagtgacgtatgttttctaggatccctctggctgttgtgctgagaacagaaggggtcaagggagtgggggagtaaaaatggaagcagggtgacgcatgcaggagtccagacaaaagacgggtgattttgctcaggttggtagcaacagaggtaatgagaagtagttggattttggatatattttgaaggaaggacctaaaagatttgctgatggcttagaagttaggtatgagttaagtcaaaaatgataccacagtttttggcctgaacaactggaaggacagaattaccattaactgatatggggaagaccgtggaaagaacagttttcgggcattaggaaaaataataacacatttgtatgcttttgagaatggttcagtggagagtagaaatactgacgagggagagaattattggagtcatagccttgggtaagtgagagggggtagtttctagtacatacttagagagtttggccaagagcatatagcatagccctgttaataggaacacaggtagaggatatgagcactggtgctggttaagtgggtggatgttcaagttctcctgattgcctgcttttttcagtaaagtaggaatccaggtcatcagctgacagagaagatggggaatggggatgttggagatttgaggaaaatataaaagtgaacagactagaaaaataaagtaatataaggaccttttggagattaatgatcatgaatacttaaagtctcaagtgtttgggagtgcaggttggaatcttacaaaactctgccatgagacctttgtgtgacccagcagactacttcttgtgcttgtcatctgcttcatattctgtcaggtgaaaacagttggtctatctggaagtatttgcatcaaatttagaaaaaatacatggaaaataatcaactttgtctcagtctatgaaaatctttagatttctgcagtccatacaaatgataaacaatcaagagaaggagctattgcttaagtcaaaaatggaaattaatgaatagtctttccatgcagttgtacacagtggatttggtttgtatccgcttacaaattttagaggacaatggccgcaacacatcatggtgttttgatgttactctgattttgtttcttccattattgagtttttgctttatttgtaaaaactggcaccagtagaaatgctaatttttaaaatgcttagccatttataaaactataacaaaatttaaaatattaatacatttgtaacattggtgtctgaatcaacttaacctctaataaagaactgtctatataacttgccttgttcagaaataactattttaatttaaaggtgaatttagaatttcaaaatactttagaatttctcaggaaactagttacttccaagttttcagttttttgctgtggataaagaattattttaatttcatcaaagaatgtttcccattttttaatctggtaatttattgggtgcccactgtgtgctaaatatcttctaggtgagcaagactaagtcctttcttcatagaaaccgactaatgttaatgttaattaggtcaataaatgctagaaagagagggggtgctattttagattgggtaagcagggaaagcctctctgaagaaatgacattaggagtttgccttgaaaaaaactaaagaaccatacacatatgccccttttgccatttacactggggagccaaactttttaccagcatttatttcatggtgttattatccagtttttcatgtacagtagatgttggctctttattacttgatttttatcaacttttcttcttcagacagttataaccactagccctgtttggcacagcagcctcctacttccttgtacctccattctcatttttgccagttgtccttctctgtactatctcttcctctttactctcctatggtgggcatgtttttagtttttctgacttcatttgtgtctgatcattctcccattcaaaggtaattatctcttatgagaaaatgtctatatatgtacacgcatgcatacacatatatatgtatcactgtcattacacacatcatcagcatcaggaatgtttttatagatttgaaatcagagtctatggatttagataaaatacaaaaggaaggaaaaatagaagtactgctgttgtatgtacattgagggaagtatctttctgattaaaaaaaaaaggccgggcgcgatggctcacgcttgtaatcccagcactttgggagactgaggcaggcggatcacctgtcaggagttcaagaccagcctgaccaacacggagaaactccatctctactaaaaatacaagattagccaggcatggtggcgcatgcctgtaatcccagctacttgggaggctgaggcagaagaatcgcttgaacccaggaggcagaggttgcagtgagctgagatcatgccattgcactccagcctgggcaacaagagcaaaactcagtctcagaaaaaaacaaacaaacaaaataagacaattgagacacatgtctttaaagccataggcccatatcggttgtctgagggtggtaatctttgcttctcatggaacagggtgaggtgccagaaatctctagactggcagatgggagggagggagaatgtacaaggtgtctaaaaagttggaaacataggataaacattatgttttattttcaaatgacacactcaatatgtttttcattaaccactagacacttttttagatgatatacttctaaatttaaaacagtccagttgttaacctgaacaatatatattgtaaatacactattattcctgtttccagactttttgaacattctctggtgtatttattgtacttttttcagattaacaacttgacctatttcttagtgtgtatctctagatatgtttctaaacattttgaacagttgattgtcaaaacccctgacgaaagagagtttcatgatgaagcttgaggaactagaatgggcttcccaagaattaaatgctgatccagcctccttttctgtgaagagatttatagtgtgttagggcaaagaaaactatagataaatgtatagtttctcatgatactcctgtgagaaaaactggttactatttgatgacttcacggctgcttggagagaggactcatctgtagtggacctctgtcctgattaatatctgcatcttaagtttgtgaatatctgggagcaacaggcaacactgggtgaataactctagatttaaaaactgctcagcagtcgagaatggtgaactgaaactaacaagattgaatcttatatacaatcttatatttagactcaaaattaaattgcagaagtgctaagcctctagcagtaagtattaaaaagtccattttagaaagaactgatgatttttttttttttactactgtctatgttagcagtcaggcacagctgaaacatactgtgttaggctgttttaatacaagtactttatccagcacaaaaggttaaaaagcccatcttaccctacagtgttcagtctgaggtgctgtattttaaagagatgtgacaagctagaagtcatcagtctttggaggctggctgatgaatgctcaccaagcccaaaagagactctagggcaaacagcagggtttcttaacggataatctccatttataatgaatattccaagccttccaagtcttctgttcattaattcatcacatacttattgtaaaaattcatcacaaagttattccaggcactgttctaggcattgggaatccaaaacacaaaaatgtctgctttcgaggagtttacattttcggatggggagacataataaaataggtagattagtgatatagtatgttagaaggtcatatgtgctacaaatagtatggtcagggaagacttgctgagaaggtgaatgtcttagtctgttcaggctgctgtaacaaaatgccttaaactgggtggcttataaacaatggaaatttattcctcagttctggaggctgtgaagtccaagatctagcatttggcagattcaatgtctggtaagagtccacttccttgttcatagatggcaccttctagctgtgtcctcacatggtgatggatggggcagggcagctctttagggccacttttatagggcacaaattccattcatgagagatctgtccacatgacctaatcacctccaatagtcccaccttctaataccatcacattggtgattaggtttcaacatgaattttggggtgatgcaaacattcaaaccatagcagtaaaggagaaactagtgtcaggagaaagagcatccacatacaggaagagcaggttcaaaggccctgggacaggagcagacctgcagtgtctgtggaacagcaaagaggaataggttgaggaagaaaggaagagagactaggaagaggatgaggtcagagaaatcatgggaagaccaggttatacagggtttcataggctttatagactttggcttttgttctgaataagatgagaagccattaaagcgtctctgagcagaaaaagacttgatctaacatattttaatacgatcatttgtgctcggtgttgagactggattatgggggttggtgtggagcaggggaaccaaagtagggcaaatagttaggagtttatagcaataatccattgtggcttggagcaggattggtagtagtggaggtggtaagaagtgattagattctgaatattttgaaggtagagtcaacaggatatactgttggattgaatgtggggtataagaacgtaagaacataagcaaaaatgtctgacatttttgctctgagcatctggaaggacagaattactgttaactgaaaacagcaaactgtgaatggagcaaatttgaggtgaatgtcaggagggacagcttaagtttgagatgcccactggaccttcctctgtaggcccttgtaagtaggaagccaagtcataaactgttttcttaggaatgaaggactgggccgggcatggtggctcatgcctgtaatcccaacactttgggaggccgaggcgggtggatcacgaggtcaggagtttgagacgagcctggccaacctggtgaagccccgtctctactaaaaatacaaaaattagccaggcctggtggcacactcctgtaattccagctactggggaagctgaggcaggagactcacttgaacccaggaggcagaggttgcgatgagccaagatcgcgccattgcactccagcttgctgggaggcaaagcgagactccatctcaaaaaaaaaaaaaaaaagaatgaaggactaaaagtaggcgatgagagttgaaggatcatggtgactcatctgtgatagcctgagtcatctaccctcatcttccaagggtccagaaacaacccttccttatggacagggctggagaaacaagacgaagtgctatcattggccttcccttttctagactcatcttaaccattcctttttgtatacatttttcctttagagcaggctgtaggttttgtttttgttgttactgttttttgagacagagtttcgctcttgttgcccaggctggagtgcaatggcacgatctcggctcaccacaacctccgcctcctaggttcaagcgattctcctgcctcagcctcccaagtagctgggattacaggcatgtgccaccacattgcccagctaattttgtatatttagtagagatggggtttcgccatgttggtcaggctggtgttgaactctcgacctcaggtgatacacctgcctcagcctcccaaagtgctgggattacaggtgtgagccaccgctcccagcccaggctatagctttatatcttcgtgaggttatactactctcttgaggctatgtatggtgaccttagttgagcatggaacttctgagcaagtcactgaaaccgtttatttttttctctttctttttttatttttttaaaattcatatatatatatatatatatatatatatatatatatatatttttttttttttttttttttttttttttttgaatacagacagagtctcatcatgttgcccaggctggtctcaaaaacctgggctcaggcacctcaacctcccaaagtgctgggattataggcgtgagccaccacgcccagccaaaaccatttttcagttattaccttgaggggttccttattttgatggttgattactgaaagagctgcttttttaccctcaatttatttttggagggtaaccttgtctttataaaatctaccaataaatgttaaatgaaaattggcggaatactttgtgtcactcctatgtatccaactgtggggttgtatttggaaactgccatgtcttagggtaaaatacctgggaatatctcattttagaaggcaagataaattgtagcccaaaatatttgaaaggattattgtgtaaaatagggagttggcttatttttctgtttccccaaggggcagaggattgtttataggtagaacttaaaagaaagcagaagaatgtcttaacaattgatgtcatttcacagtagaataggttatttcttgatgtaggagggttgtgggaaacattcaaagagccagtaggtgactggtaggttgaagtgatttctatacaagcatacttcattttaatgtgttttgctttaatgcacttcacaaataattgtggggtttttttttgcttgtttgctttttaacaaatcgaaggttagcggcgaccctgcattgagcaagtctatcggtgccatatttcccacagcatgtgctcacttagtatctgtgtcagcattttttagcaataaagtatttttaaattaagatctgtacattggcttttttagacagtgttattgagcacttaatagactacagcatagtgtaaacaaaacttttatatgcactggaaaaccaaaaaaatttatgtgactcacttcattgttatattggctttattgtgatgatctgggactgaacctgcaatatctctgaggtaaacctgtattaaatgaggtgaggtgtttctgaagtaccctccaaaatttaagattgctatgataatgtcatctttttccttgttactgaacccttgatgctactggggaacattagccttccaagtcttctgttctttagaagtacttcattagaactacagtacttctggagtaccgtagttcatcaagtatccctcctaaccttttccttagatggcaaagaagtatatttgtggaatggttgactcggtgggagggcagcaggcagaatgcgtggtcttgtaatgtcttgtagtactaaggttattgaatgatcatcagatgaccttgtcttccttagccttaggctttgcccaagtaaactggttggttaatggttattgaggtttgtatgcaatgaagcatttgtgggagttgggaagatactgtcttagccctaaaaaacaaagtgttagaatgtacaggaaaacagggtggatttatctttcatacatatgaaccctatctggcaagtgacctctgaaatctccagaagtccaggataagcttttgtatgtttcgtatgacataggcttacaaataattacattttatgagttgctatatatgtgtatatgtatatatgtgcacatttgtatatattcctcaccacaggagaaataaaaagtctaattagcattcttaatgctcatcagaataaagacatatgcacttatgttagcatccaagtaaatattacatatttctaaggctaatgtagcatattgacctttttgagtatgtattttacttttatcatatttgaaaattaattatgataccattatattttataggatctaagcctttcccacgttatggttataaaccctccccaccgaatggatgtggctctccactgtttggtgttcatgtaaatattgtcttttatttgataagttttgtaactggtaaatcatgtaatacttttggtgatataagactatcagcatgttcttagattcacaaataatttagctgggtgtaagagtgatcaggtttattagattctttttggcaaaactaacaaaagtaaatgaagtaaaattgttttatttttgaatcttatagatgttcgtactatttaaatgatatttcccaatatcacatacatagttgaaaagtttggagtacagaagtgctactacttagagggaaaaagtatagataaatcatgttttcgacattaaaacaaggctaagtgggatagctgtgtggttgttgtaggagtgactggatctaagccaagtattatgggaaaaaaatgtttatgagaatgattcctagacacaaggattttgtgtataaagttatttaaaataattgaagttatagattcagagtaatagtatctttggggaatggagaaatatttaaagattaaaaaacaaaaaaatttgagttgtaggaaagttttctgtgatatttcacataaagtaaattttatttggaaggagaggccacaaacactttgagtatccaaaaatcatacttacctagcccctggagaatctttaatggacttagcctcatctttctttttttaaaacttatgttttgtgttttggacaaatggaaattttgttactgacaggtaactgtgagtgttctaacgctgcagaatagggagcagtgaggcatagctgagagagtaacatgggtgggtatgggtaagtgtaatggggagatttataacacagaaaatatttgtaggcagaaatggattttggaactatctatacagcagtcattatcatttatacctatttagtctatttgaatgcagtacttcagaggagttttgcatttcattgacagtaatccatccaaatgccttttgcagcttaacattggtatcccttccctgacaaagtgttgcaaccaacacgacaggtgctatgagacctgtggcaaaagcaagaatgactgtgatgaagaattccagtattgcctctccaagatctgccgagatgtacagaaaacactaggactaactcagcatgttcagggtaaggatgatctggtggcttggggatgagtgtactttttaaagttgtatcaaatgctctatgttttagtataggatttaccaatagaaatctttcacatatattatctattgtgacacagacttcaattttctgaggtgaggagctgatgattttataatctaaaatgatttatagtcacagaagcaaaaagcattaggaaaccttgggagagtaggggtgtctaaggctgagagagagaagaattcatctaccttgtgccctaaaatatatctccagtcatcatgtaagaacctaaagtagctaaagtttgaaactctgattccagttgtcttagtccatctggactgctaccatagactgggtgacttatagacaacagaaagttatttcctacagttctggaggctgggaagtccaagatcaaggcactagcagatttggtgtctgataaggactcattttctagttcgtagcagatgccttctaactgtgtcttcacttagtggagaggactagatagctctctggggcctcttttataagagcactaatcacatttaccatcttttggaacttagacacctccaaaggcctcaccttctgatttcatcactttggaggttaggatttcaacataaattctggaaagacacaaacattcagaccataccaccagtgaatttaagagtatagcacactggatttggagtaggaatttctagaagacttgtcttatgggtttctgttgggaaggtccccagatgacccccaggttcagtgatttactaggaggactcacgggactcagcatatagttgtactcactgccatgaggtattatggtgaagagatagaaagccaaactagcaaagggaaagggccctttggtgtcatttttaaaagaatgatgatactcacctcacagagttgtcataaggatgaagtgaagtatttgtggaaatacaaataaatcaccattcaaatactggtagttataagatttctctactgtcaagccaaagaacatatcatacactgaaatcagaagaggcaaggcaggaaaggaaaataacattttaagcactttcataagatactgtgctagatattttattcatgttttcatttgatgccaacaaaaacctaaagaggtaggtagtgttatccccatttttcaaggaaggaaacgatggttcagaaaacagtaacttgccccaagtgagcatttagcctgactttaaaatctgtgttctgtctattatacagtattctccaaatagtctcatattatagccctgattctaatatcctaataattcatgtcaaggaagaaatctctgctgcaggtaatcttgaattcacagcctctgtatccctttgcagcttttggctaaggtaaactagctgtaaacctgaagcatagatagatttatttcctgttttctgatttaagaagaatgtgaaaccaatcatcttgtaacctcctatttaatagtcatagcctctccacttctgtggttggttgtttcttaatggcaaagtcttttggagaactttgaaaatgttaagattttgtaatgacaagtttcttccttaacatgaatattttgaaacgaaaagtatttggataactaaaagccactctgtgctatatctctgtaagtgtaacatgttaagataatctcacctggatgtttcaggtttcttagaataagaaaagtaaataaattaccttttcatagtcttcaaaaaatttaaaaacctaactggggccgggtgcggtggctcacgcctgtaatcccagcactttgggaggccttggctggtggaccacttgagcccaggagtttgagagcagcctggccaacatggtgaaaccccatctctaacaaaaaatacaaaaattagccaggcgcctatagtcccagttactcagaaggctgaggtggaagaatcacttgaacccaggaggcagaggttgcagtgaaccaagatcatgccactgcactccagcctgggtgacagagtgaggtgagaccttgtctcaaaaaaataaataaaataaataaataaataaataaataaataaaataaacctacctgactggggaaaaatacttttgatttatatgctcccatatccccaagtcaaattaggacattggtcaaagagattggattccgtttactttaagcctcttaactgatgtatgatcagtcctcagaagccattggccataatgaaatgttttgagatttcaatttttaaactttgtttcttccgcacataaaacattttttcttaaaatgcaaatttaagagtattatcagacaactctgttagtgattatgtttttcaaataaaaagaaagttaaaacactgattaatcagtgctattttaaaagacttttatttgtctagtttaaacaattgggccaggcatggtggcccacgcctgtaatcccagcactttgggaagacaagtcaggaggactgcctgagtccaggagtttgagaccagcctgggcaacatagtgagacctcatatctactaaaaacaaacaaacaaacaaacaaacaaacaaaaatagctgggtgtggtgttgtgtgtctgtttaaaattaaaaattaaatttaaaaaatttaaattaaaaatgagctggccatggtaatgccagctactcaggaggctgaggtggaaggattactttagcccaggatgtggagactgcagtaagctatgactgcaccatgacactccactctgggtgtcagagtgagaccctgtctcaaaaaaaaaaaaaaaaaaaaattgggttaaacagttgaatgcaaacaaaaaataagatgcatgagactaaaactggaaatctgtagatatatatgtgtgtatgtaaatatgctacaggttgtgagagtttggtgatttcatctagcatacatttcagtgctcacgagggatatgcttgttgctgtgctgtaatgtgtaacataggtgaaaagagcaatgcagttgcccaacagtaatcccattttcttgttttgcagcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacatacctttgacaaataactaatgtttttacaacataaaactgtcttatttttgtgaaaggattattttgagaccttaaaataatttatatcttgatgttaaaacctcaaagcaaaaaaagtgagggagatagtgaggggagggcacgcttgtcttctcaggtatcttccccagcattgctcccttacttagtatgccaaatgtcttgaccaatatcaaaaacaagtgcttgtttagcggagaattttgaaaagaggaatatataactcaattttcacaaccacatttaccaaaaaaagagatcaaatataaaattcatcataatgtctgttcaacattatcttatttggaaaatggggaaattatcacttacaagtatttgtttactatgaaattttaaatacacatttatgcctagaaggaacggactttttttttctattttaattacacataatatgtaattaaagtacaacataatatgttgtttctctgtagcccgttgagcatatgagtaagtcacatttctattaggactacttacaaggacaaggtttccatttttccagttgtaaaattggaaccatcagctgataacctcgtagggagcaaccccaggatagctaagtgttatgtaatatgcctagaaggtgatgtgaatgcgattcagaagcatagccactcccattttatgagctactcacatgacaaatgtcatcttttgctataacctttgccaagttagagaaaagatggatttaatgagataaatgaaaagatatttaacctaatatatcaaggc

SEQ ID NO: 38644 - DNA, 60955 bp, Homo sapiens
gttcggtcgaagccctccccttaattatgtgcaattcaagtccccactgcccgcccgcaagcccccactcatcctcgctgcgggcagggtggcccctgcactttacaagggggtgcaggagcgggagacggtcgtccgaacaccggctccccggcatgcgtagaccggcgggcggagcgggctcactttgcgccaatcctacgagaactcccagaactccgcttccctagtccaacccaagccagagttgcccacacctaagatggcggcgggggcggagtcggcgcggccgcctctgggcgggaccgcggggactagacgtggccgcggggcggtgtcatcgcccccgccccgcccggtccagccagctcggcccgggggcttcgggctgtcgggccggcgctcccttctctgccaggtggcgagtacacctgctcacgtaggcgtcatgaggtctccggttcgagacctggcccggaacgatggcgaggagagcacggaccgcacgcctcttctaccgggcgccccacgggccgaagccggtaagcggcggggtcgtccaggggcttcgagtgggcagcggtaccgggggcggcggtctctgggccggcatggcccgggtacccgcaccctgcgccggcgggaccggagctgctcaggcgcgaggggacattaagaggggagcccgttcagagtgccgctcagtcccgcctgcctcggtgcgcagaagcccctcgggaaccccgggggccgcgaccgtgatcgcggagccgagccggggcctcggcaggtgcagccccaccgggcgggggcgggggcgggggcgggggcgggggagcggcggtgcagccggcgctgagctggtggttattttgggtagtgctgagcaagggacccagtggaagaacgaactgggagagaatcatcaaatgaatgggctaaggtccgagcggaggaccccggtgtaagagcaaactggaggagaaacctgcagatcagtaggcagagggctgtccttccctgtcaccgctaggtttccgccactgcgtatccgccagcatgtgacctggtagcttcttaggcggggagggaagacaaaaaaggactggagttaacatttgtgagtatgcagagggcaactattgtataacccagctgatatcttgacattgtgcagtaagagactaaaaacatcgaggacattttttttccgtctggcagtctatgatttaagttaggaaaaggttcagttatcctcaagatacctatggagttctaaagtaatttgccaaaggtcttggaacaaatcgaaaagcaggtacgtcataaagcatcttccctgaatttgagaaaattaaaatattttgctatttgacacttttgtaatatagtttatttaaaagtaacgaaaactaaagaacaaatcagtttgaatgcattctatagtttcaaagatctgtgcgtgagaaagagttgtgttggaaatttgactttggctaacccagaattgtatagtttctatatttttatttgtttttaatgttaccagatggtggcagtagaggtggcaaccttatagctccatctggcagccgggagcttattttagtcaacacaaactgtaaataccataccatagttacgttttacctggaagtcggacttagttccataaactgatcattttctgtggcttgtagtgttcaaattgtataatattcctcataaaataatatagaaatacagaaataaaagttataataaagatatttgccagagattattacattgttacaattgaaaaatatgtatatgtataatcaaaatttagcacaaatgttaaacattattctcaggaaaatgcagattaaaattacaacgaggcactatacacccactagaatagctaaaatccaaaaggctgataataccaaatgttagcagagatgtggatagaaaagttatacatctcaataaagattgagatggacaaatgtatacatttatcacgtaaattatacttcaataaagttgatttttaaaaaagtagcttatagcatcccttttaaaaacaatccctacttgattcatgtgttgagtgtatggatcttatggtactggccctgtccttcctggctttaggtggctacgtttgttacaaccatttccttttttattttccctctttacatacccactggagagcaagtgaagtggaaataatagtaacatactgtttttgctatttagaatatgataagttttatagagaaggagcatatatggcaattaagagaagtatataatgagcccccatgtaaccagcacccagattaaagttatcaattcatggccagtcttgccttatgctcatacatactgtgtattttgaagcaaatcccagataccatgtcatttcatatgtaaatatttcaattatttacctctaaaagataaggactctttttaacataactacagtactattatcacagcaaataaaaataatgcttactcactttgggaggccgaggcgggcggatcacctgaggtcagcagaccgagaccatcccggctaacaaggtgaaacgcctgaaacgccgtccctactaaaaatacaaaaaattagccgggtgtggtggcgggtgcctgtagtcccagctattcgggaggctgaggcaggagaatggcgtgaacctgggaggcggagcttgcagtgagccgagatcacgcccctgcactccagcctgggtgacaagagcaagacttcgtctcaaaaaataataataataaaataataataatacttacaaaatactcagtgttcatatttcctcaattatgtcctgattttttttttttttttttttttttgagacggagttttgctctgtcgcccaggctggagtgcagtggtgcgatctcggctcactgcagcctcagcctccccggttcaagtgattctcctgcctcagcctcccgagtagctgggattacaggcctacgccaccacacccagctaatttttgtatttttagtagagacggagtttcaccatgttggcaaggctggtctctaacttctgacctcaggtgatccacccgccttggcctcccaaagtgctgggattacaggcctgagccaccgggccgggcctatgtcctaattttttatagtgtgttcaaatcaggatctcaataatgtccataccttccaaatgattgaaatgttttttgtctcttttaatctgtttcccctgccccgctccttttcttttccctgcaattttatatccttatgttgtcctttaacatcttctgccctcctgatttactgtaaattggtaattagtagatctgaagatttgataggattatgagtctgtctgtcttaattaccgtcatgactattccataagtagaatacaagtgtagaaagtagaattgtgtcagcatgctaattctcccatacacggctctagacactggagatacaaagaagtaaacaaaacagaacaaaagctcctgcccttatagacttttatattctagtgtatattttcctaaactttcagccctctccattttgctttcttcttgggttacaatcaaagtccaacactttattttcttttttttttttttcaggatctcactctgttgcccaggctagaatgcagtggctcaaacaggtcttactgcagcctcaacctcccaggctcaagtgaccctcctacctaagcttcctgaagaactgggactgcaggcatgtgccaccacacctggctaatttttttctttttcttttttttttttttttttttttttgagacggagtcttgctctttcgcccaggctggactgcagtcgcgctatctcggctcactgcatgctccgcctcccgggttcatgccattctcctgcctcagcctccgagtagctgggactacaggcacccgccaccacgcccggctaattttttctatttttagttcagaaggggtttcaccgtgttagccaggatggtctcgatctcctgaccacgtgatccacctgcctcggcctcccagagtgctgggattacaggcgtgagccaccgtgcccggcctttttttctttcttttttttttttttttttgtagaaaaaaggtctcacttagttgctcaggctggtctcaaactcctgggctcaagtgatcctcctgcgtcagcctcccaaagtgctaggattacaggcgtgagccacagcacccagcccaacactttattttcttgccaatactctcgattcccttgcccccttctttgtcatcacatccatctcggtgccagctatctgctttcttagtgcctactcctgagcacaggcatgcagtgcttatgaagttacacactagggcagattgttcccaccaattctgtatgggtatctgctcagcattcctgtgtttcactgagaacctcatgcccccactctcttcaacaatttcttacttttcccagatcccaatttctcacaaatgagaactaacctcaattcctaagaaataacctcaattcctaatttccagaaaaaaaaacccataataattcacagttattctgtgccaagcactcttctaagtattttacattactaactcagtgaatccttataataaccctaattcaggcaaaatacttcgactagtgccaagcgtatagaaaatgcttagtaatatttgttttttgagacaagagtcttattctgttgcccaggctgaagtgcagtggcacaatcacagctcactgcagcctaaacttcccagactcaagccatcctcccacctcagcctcccaggtagctgggattacaggtgcacaacaccacaaccagctaattttgaaattttttgtagagatggggtttcatcatgttgcccaggctggtcttgaactcctgggctcaagcaatccttccccatctcagcttcccaaagtgctgggattacgagtgtgagccaccatgcccggcttgtaataaatattatctattattgtctaggcatggtggcttatgcctgtaatcccaatgctttgggatgccaaggtgggcggattgcctgaggtcaggagtttgagaccagcctggctaacatggtgaaatcctgtctctaccaaaaatacaaaaattagctgggtgtggtgatgcatgcctgtagtcccagctactcgggaggctgaggcaggagaattgcttgaacctggaagatggaggttgcagtgagctgagattgtgccactgcactccagcctgggagacagagaaagactccatctccaaaaaaaaaaaaaattatatattattttatgttattaaacttaatacccactatcccactcaatagtgttagttcttagagttactacaatacataatctagatactgcagatcatttagaatgtcctgctctccctatgtttatctgtctcatttccatacctctgtacatgctgctgcttttgcttggattgttccatctgtccctactggtgacttcctgctccttgaagagacttctccaagaggccttctctgactgtctccactgtcccctccatcagattaatgtgcctcttttgttcctttttatatatacgtacatagtactttgtcttattggcataactttctccagataaaaaggaggaagaaatcctttttactaagtgcctgctataatgtcttgcagtatttcatttaatccccatgcagcccagtgggtagatggtggtctctacatattatagctaagaaacctgagaatgaaaactagtaagtaatttctacaaaagcacacagccagtgaaaaatcagaaacagattcattcccaggtcccactctaaattagcctgtgtactttcagttacacccacacacattcctaagtttaaaacacattttagaagctgatgtttgtttttgatgggtgccatgttccttatgcaagcatgattttgctttgaacttgatgctcaatggatgttctctctcttggtcatgcaagcatgcttttgttggatcaatttcaaagaatattcacattcccaggcatgtttttctttactgctataccttcttgaaataaaaattttctgattgaatatatttgtaatcagcaaccattttattagctagtaattgtttatttttaatatttcttagaatctcatagtaatatactttgtgacacctgagttggctttttattttcttttttttttgagacgaagtctcgctcttgtcccccaggctggagtgcgatggcgtgatctcggctcactgcaacctccacctcccaggttcaagcgagtctcctgcctcaacctcccgagtagctgggattacaagtgcctgccaccacgcccggctaatttttgtatttttagtagagacggggtttcaccttgttggccaggctggtctacaaactcctgacctcaggtgatccacccgcttcgtcctcccaaagtgctgggattacaggcgtgagccaccgtgcctggccgctttttattttctaattactgactatgcatccaaaagttaaagttgcctgatctataacttgtaggtcagatttccaagtaataccacgagtaatttgaaatcattttacttacctttctttcatttctcaacattctagccccttgtaattcacatgataaggtatatcatagtcccaataaagcatcacttagggaaaactaataatgtacagtaaaataagataactgcaaataaggatagaatgaagtaataacattacaaattacagtagcataaaatagagttttttagagtaagagaattactaataacttcatccctccccttcacttactcccacatctaacatttgggcaaggcctgttaattctgcctttaaacatctcagatctgcccatttttcttcactgctgctttcactgtagtttaagccaccttcatctcttagctggaaagctacagtagtcctttaagtgatctccctgactgtacattccttacacccttcacacttctcctttctatagtctccatgcagggtccagatgagctctttaaaccatcaaccagataagctttttaaaccataaatcacatctcatcactcctttgctgaaataggtaatgatctttttaaatgctgcattgacaaaacagacatagtacataaatctgggtttttcttgctccaaattgctcaaagtaacacattttaatgcacacatttagctagatttttgagtcccccatccagacttctaggtaatatcacctgacacagagcaatgataaagaaaacatgttctgctgggcacagtggctcacgtctataattccagtgctttgggaggctgagatgggaggattgcttgaggccaaaagttcaagaccagcctgggcaaaatagtgagaccccgactctacaagtaaaaatttaaaaattagtcagatatgctgccatatgcctttagtcccagctactcaagaggctgaggtgagaggatcacttgagtccaggggttcgaggttacagaaagttatgatcacccactgtactccagcttgggcaacagagcaagaccctgtctctaaaaaaaaaaagaaagaaaaaagaaaatgtgtttttttacaaaacatgcctcacaatatccaaaccgtcattaactggacaactgcccatttggttgcagcagaaagcaaattcgcctagattctagtaatagagacaatgtgaatagaactttagaaattcagttcttacagatctggatctaactatggtagtggtaccataaatttcatagctgtacccctgaagaaaggatttaagaatgccaaatgaaaagtttcctgttaaaagaagttaatcttacacagggaaaaaaaaataatagcagttgttaaacataggagggcatacagaaaagtgagttggatcataatatattaatataaacctaagtatagttgtgcatattcattaatgtttcagtctaaatcagttcatctgagccagtatcaagacttttgtattctgtaaaatatattctctcctttgatgctaggttaatgaaaacaccaggattcttaagtaggggaaaaacatacacacatttatatgatgttgatgtgtcattaccaaataaaagcacacatattttcatttaattttaatatgtcattgcttaatgaaatacatgtttatatctttaaagaggtatttatcagccactcagagtttactaaacttaaagatgttcagactctggattagctaatttctctttgttactaagaggttgattatccttagtcagcatcctgaatcctatccctctccaattctgcaactcaataaaagaagaaaaaagagaaactatgcataagcccacagttagagtaataaataggtcaaactcctcctctcacatgatccttttattggttcctccaacctactctgcattctttttttttttttttttttttttgagacggagtctctgtctctgtcgcccaggctggagtgcagtggcgcgatctcctctcgctgcaagctccgcctcccgggttcacgccattctcctgcctcagcctcccgagtagctgggactacaggcgcccgcgaccacgcccggctaattttttgtatttttagtagagacggggtttcaccgagttagccaggatggtctcgatctcctgacctcaggtgatccgcccgcctcggcttcccaaagtgctgggattacaggcgtgagccactgtgcccggcatcctttttttttaatcatggtggtacattcactgatttccctttttactgtgagccctttacgcttgataactactgagcaactgtcacagatgctgcaactgtcataggttctgcaagtttgcttctagattcttaaatgcatttagtttacgatggctttaagtattaatcatggcttctgattcaaacccagcctttgaggatactcttcgaggtaagaaatttatcaagagaaatttcatgccctacccttggcagtaaattttttttgctatgctacatttaacaatgagatggctactaactcataatcagtaatatatcatgtcattgtaagtactcaagtacttattgaccatgtttcagatagtttttcagaaatagtaatgccattaaacctccttacctgcttttctcatgccgtatatctttgccagctgacaaggagtaggggttcagtttgaatctggaatagatctttttctcagcaaaggtgataaaactactacctccatgttttaatgaacttttttatagttcaggctctcatgtgtgaaatttttaccaaaactacagatatgagaaacagctaatctttgacaaatgtttcttagatttgcttaatctaagaatattctttaacattttttcataattatttttgtacttttaaaaagcaacctttttcattatttagacaatatcatgtaattaacttttttaattaaagcagccgggtatggtggccaatgcctataatcacagcactttgggaggctgaggtgggtggatggcttgagcccaggagttcaagaccagcctaagcaacatggcaaaaccctgtctctaaaaataaaaatttaaaaataaataaaaattttccccaatctttatttcagctccagtgtgctgctctgctcgttacaacttagcaattttggccttttttggtttcttcattgtgtatgcattacgtgtgaatctgagtgttgcgttagtggatatggtagattcaaatacaactttagaagataatagaacttccaaggcgtgtccagagcattctgctcccataaaagttcatcataatcaaacggtaggtgctattttttaaggaaacaattttaattatcctaaaatacttgcaagtaaaaatattaaaaggtcttttttcatcctacagaaactatactttgtttgtgtatactctgaatcactttctttttgtgttttcccaggaactgattgggcaataacttgtaactatagctactactgctatgccgtaatacaccttcatctgtttgaaaagtagttcttccattccctctataaacataccatgcttaaagaaaatttggaaaaacctgttttatataacagaaaattaaactgttttaaattttctaaatagcttttataggagtattatttataaccctatatcacttatagagttacagctgcaagagagtttaggtaatctcagttgcaagatgaaaaacaagaactggccagtttcttaggacattcttttctgaatgtacacatgcccaacctaagccacataagtcattttgcctgccttatgttatagtggtattaataaatgtgtattcatcatttgtttataattaagttatatatacttcattttatgttgcttatcacacgaggagatagtacagaaagaaaagctagtattctttttagaagtacatttgcaggctgggtgcagtgactcatgcctgtaatcccagcactttaggaggctgaggcaggtggatcacctgaggtgagtagttcgagaccagcctggccaacacggtgaaaccctgtctttactaaaaatacaaaaattagctgggcgtggtagcacacacctataatcccagctactcaggaggctgaggcaggagaattgcttgaacctgggaggtggagtttgcagtgagccgagatcacgccattccactccagcctgggcaacaagagcaagacttcgtctcaaaaaaataaataaataaaaaataataaatttttggccgggcgcggtggctcacacctgtaatcccagcactttgggaggccgaggcacatggatcacgaggtcaggagatcaagaccatcctggctaacatggtgaaaccccatctctactgaaaatacaaaaaattagacgggcgaggtggtgggcgcctgtggtcccagctactcgggaggctgaagcgggggaatggtgtgaaccccaaggggtggagcctgcagtgagccgagatcgcgccactgcactccagcctgggccacagcgagattccgtctcaaaaaaaaaatttaaaaataaataaataaataaataaataaattttcacccattttcagtgctcacgaagatactagttcatacttagatgaatctcctctatcattcacaagcagagcattcaagcaggaaagagggtttctctctaaacaaaataaatctctccgaaaatctttatatttgactttaataatgttgctgagtaacatttgggtacacatcactcactttctccactccaacctgtgaccttcagggacaatactgctggaatgtacatgaaatcctagaattccacagataaactgcaaattggtaccctaaataaggaaaagtaagagtttgctttgtgtctttttctttgcaaagtgcttttgttgaccctgctacttatcttcatctgccttatatcagcagtagaaagaaatcccggaatggttcttgacatgttggctttgttatacagctacactgcattaaaaatgtcagatactcagatcagtcactaaatcttcattagtaccttgctgtgtgctgttactaatgaaaacacaggttctattcacatgaagtttgtggcttgatttaaattcttgctctttggaattgttccatgtgcttgtttaagtgcttcgtctgaaatggggagatattattaatatctacatttatgcatgttaatagccagcactaagtgaacactaactgtacatcaagccttattttatgtgcctatttcatttcctcttcccagatcacacattcggtaagtaatagagctaggattaaaaccaagcctggttcccaaagcctagctcagccactacagttttctgcttaatagctttctggattaagcctgtgactctttttttgggagggggaggcagggccgggggggcggcagcctcccgagccatagtaggctcagagatacccaagccttttttgtgattcttttgtgagccttcttggtcatagttattataaagcttctggcagctcatcctgcagtctagttttataaaattgcaagccttcttgaagtttacgactgtcagttctttttcattcacttctaaatactgtatatctatattgttatgactcacccacctactagaaagtttgcatgttcttcagtccaaaatagtggttcaaaatctcatttatatgtacttacatgccagtaagagaaaagagctgctctgtgaaggtcttaaaggattgttttattcttttctgatttttgtagggtaagaagtaccaatgggatgcagaaactcaaggatggattctcggttcctttttttatggctacatcatcacacagattcctggaggatatgttgccagcaaaataggggggaaaatgctgctaggatttgggatccttggcactgctgtcctcaccctgttcactcccattgctgcagatttaggagttggaccactcattgtactcagagcactagaaggactaggagaggtaattttcttttctctcttgttttacttcttaccgtgtgtctccttctcttcttcttaaagatgtcattctttggtatgaatatgaaccaaaaaataacgttggatgataacaggggtttattttttagagaaaggactaactagaaaattacctgaatagattttgtttgtggtaaatgaggtctctagtaggagcaccccgaaattggaacctttactcaaaaaccagagaaaacttttttccaaaagagacttcatagctcatactttaggagagaagaaaataaaccattaataaatggttaagatagtccgggcgtggtggctcatgcctgtaatcccagcattttgggaggccaaggtaggtggatcacttgaggttaggagtttgagaccagcctggccaacaggtgaaaccccatctctactaaaaatacaaaaattagccgggcatggtggtgcacacctgtaattgcagctactcgggaggatgaagtgggagaactgcttgaacccgggaggcagaggttgcagtgagccaagatcgcgccactgcactccagcctggacgacagcaagtctccatctcaaaagaaaaaaaaatggttaagattgaccatccttacctcttgtgctcttgccaccgttaaactctgctctatcattgatgcccaagtctgaagcacattttacacaatagactgttgagttgcatttaatttcttttttatcgcttattcttttattttttctggtcttgtaacttagagacaaatattttatgattttatataactatctcaatttagttctatgattctgctctttttagaagtattattgatttttgcctcttttatttccctcctcttaatagttttatcattttttaaaattttgattcttgtctttcttttccttcccacttttcttttgtatttcatcatgtgtacccccatacttaataattttcacttttcctttataacttcgaacttctacctctgaaatccagggaatggtgtattttgctctcttgcatttctttaattcaagcaagataatggccactgggcttggtgtagaggatgaagattattttaagtagcagtgtatcatgctgttggaatgaacactggaccagagtttgaataatagctctattgtatctaacagtgaaaccttaggtaagctctaatctctagatctcagtcccatcattttttaaactgggactaaaataccttccctgttttcagtcacagattagatataaaattcatatgtgataaggattgctagaatactttggaaattgccaggtactattaaaagatttttcattcatctgaatgtttttattttgttcttatcagtagaggtccattaagtaaacccttcctgatcacaaaattaaaattactcctctattaccaggttcctgttcttcttgacaaagtaaaatatacttaaatctagcatattttctctgatcctagtattcaatctccttgctgaatgtattcccatattttacttccagtttatgccactaatttaacattacggcatattgatcatattaccactgttatctcaggtgacattttatttattcatttatttatttttttctagtctttgagacggagtctcactctgttgcccaggctggagtgcagtggcatgatctcggctcactgcaacctccgcttcctgagttcaagcaattctccttcctcagcctcccaagtaggtgggattacaggcatgcgccaccatgcctggctaatttttgtatatttagtagaggcggggtttcaccatgttggccaggctggtctcgaacttctggcatcaagtgatccacctgcctccgcctcccaaagtgctgggattacaggcatgagccaccgtgtccagccaacaactaaatagaatttaagttgtatttatactcaggttctctcgtccttcttcatcccttcaatatgtatcacaggtgcatttcctcattcataaaggacacttagattactatcttgcattcctaccatctgattcaccataaatatacctacattgtccctaggttttataataaagttttctacaacataatctctgtgggcatttccaaacatctcaagttttcttctataatgactcatcctgtggatgctccatcatatagattcttattgatttgcaatgtacctaaatcatctttgccttccattggtattacttttttttaattccttttgtttttgtttttgaaagagtcagcggaaagtacaaagtattaaaacatttattcttctctccactaataatagcactagttaccatttatctttacaacaattatgcaaccgccttgaagttcagggaggttaactaatctttctgaagtgacacagagagtgtccaaggagagccgttctctctcactgtcctgtggtatctcctcatttacccagtctctatgaaactccctgtttccacatcctgttagctctccgtgtcagtaattggcatctactaggcttgttatcacaggaaaaaaaagaagaaaggctgtaaacatgctaattgaattcatcctttttttaataggactgtttttctggttgattgtcagcttgaattttttttcagtatcccaaaatattagctcagtattttttaaagttataagttagtaatattccctttcattcaggtgattaataaagtgaatgagtaaaattaaccttgagcaagatccctttatgtcctcactcagtacaattattttagatttattgtaacccttatcttgttgtcttaaaaccagttccaaaatccatgaatctttggggagttttactttttttttttaagagatggtgtctcactacgttacccaggctgatctcgaactcctgggctcaagcaatcctcctgccttggcctcccaaagtgctgggattacaggcatgagccaccacacccagcctcaaattctgaaagtacttcattataagatattttcacttaacactgtaaaaatttctcatttcatggaacctgattcgtttgattcttatccagaaaatgcttttgtagcaaaatacttaacttactttaaagcattaacaaaactaccttacatttcatcagaaatatcatgttcccttctctcagggtgttacatttccagccatgcatgccatgtggtcttcttgggctccccctcttgaaagaagcaaacttcttagcatttcatatgcaggtgagataacaattaccaaattttgctgtaatatgttatgtatatatcaacctttgggaaaaagggcctgcataccagaacgatgcaatgttggattggatgcccctttggggagaacattaagtttcggtagtataactttattaccaatttttctctttggctcaacaacttatagtaatgcagcttaattgactaatgtcattttccccatctgccatcatctatttcaaagtatgttgtgttttcagatattggtatagagatgctattttttttctttttctgtttacttttttgggggttttaaattttatttttgtttgtttagagatgctatttaaaaaaaagaaaaaaaaaggccagtagctagaaaattgagtgtttttgtccttaaattgtgatttctgttttgattaactaatgaatgtatcatgattctcaacccctctcttcatgcatcttttttctattgcatctttatttgccatcattttgatctacaggtgagataacatgagttttatatatgtgaattataattttatcagattgcataagaaattctagcctttctttcattgactaaattaaaatttttccaccggactgctttttaaatacagtagttgagaaaaggcctctctgtggtacttttaagctaaaatctgaaggataagaacaaaccattcatgcagggagaagagcatttcagccaatcagaacagcatgtacgagggcactcaggcaagaaataacataagggttaaaagaagtggaaaactaccttggatggctagaactcagtgagtaaggaggatgatggcataagatgaggttagagaaagagataagagccgggttatatcaggtcttacaggctacaggaaaaaatgtagattgttttttaagaggcatgattcaattacattttaagaagattattcttgcagctatgttgagattgacatgagaaatctgatgataggttcaagaacaggtactatctaaggttcccttttacctattgaataaatcccaaactccttgaactaggggcaagattctttacagtcttcactactttgttgcagctagccttatatctctggcagatagtgcctagcatggagtaggtactcagtaactgttcaactgtccaacctatttttccagctttatctgcttttcctttcctttacccaaatgaagttcccaagcctactctctgctttactacttccattcctttgcttgtcctgttatactacctctatatcttttttctaatcttgtttctatgggaccacattttagccttttttttttttttgagccagggtctcactccaggctggaaggcagtggcacaatcgcccctcactgcagcctcaacagctgaagcgatcgtcccacctcaacctcccaagtagctaagtagctggtactacaggcgtgcatcaccaccatacccagataatttttgtatttttagtacagataggagtttgccatattgcccaggctggtctcaaactcctaggctcaggtgatccacccacatcagcctcccaaagtgcagggattacaggaatgagccactgtgcccagcctgttacccatcctctgtaagcagtagacttgtctgtcctatccttgtttctctctccaaagtttataaaatagtcttatgtgttgttctaggagcacagcttgggacagtaatttctcttcctctttctggaataatttgctactatatgaattggacttatgtcttctacttttttggtaagtttaaaattttaactaaattataatgtaacaaattcaaaatgtaataatagtagcctaataatgttttaaaaatatatcttccaaatcactgaaccacagttctgaaacacttcctgataacctgtttttcaagttggtatgatttacttgacctatttgagttacgagctgatgttagttttggaatatttctcagtagaaatgactgttgatcctgtacttaaatagtacatttgctatcaaaaaatcactatcttaggtattttgaatttcttctcaagcaaagtaggatgttctcacttggtagttttaatgttttttttttttttttctttttacttagtcccaaggcattttattgctcaatttccttggcagcatgatacacatttttaataaattagattttcacatagacatgtcatgcaagaaatatatctgcaatcaaaatttaaaactcaactaacaaaaacagacacctttggaaatatgtagattgtggaaatgtatcttcaaaaagatttgtctggtagaccctgataggcaaagtcatgtggttaaaagttgttttcttctggctgggtgcagtggctcacacctgtaatcccagcactttgggaggccgaggcgggtggatcacgaggtcaggagttcaagaccagcctggccaacatggtggaaccccatctctactcaaaatacaaaaattagccaggcgtggtggcacgtgcctgtagtcccagctactcaggaggctgagacagtagagttgcttgaacccagcaggcggaggttgcagtgagccgagatcacgtcactgcactccagcctgtgagacagagcaagactctatctcaaaaaaaaaaaaaaaagttgttttcttcaaaatgtataagcaataatacagttatagcaattatcccattaaagaattgagagaaacttgaaattgaatccaaactgaagtcagttttacattgaatttatagttacataattttttcaagacatgtaaaaattgttgttggtgctttctaattttgtgtttttgttttgttttgtttgttatttggtacattctaattttatctaactattatttttctattttaaggtactattggaatattttggtttcttttgtggatctggttagttagtgacacaccacaaaaacacaagagaatttcccattatgaaaaggaatacattctttcatcattaagaaatcaggtatggactttgacacattttaaaaataatgtcagaaactttttttcttcagaattaagatatcagtttttaaaaatatatattcctattgtgcatgctctagacaaagtagaataggcaaatgaaatgaacatccaaagtattgtctggctgggtgcagtggctcacacttgtaatcccagtcctttggggaggtctaggtgggaggatcatttgaggtcaggagactagcctagtcaacatagtgagaccctttctctacaaaacatttaaaatatttaaaaaaaaattttaaatacataaatatgaacaaagtattgtctgaagaatttcagttctttcattttttatagaaagtatagttttataaactataaaaaatatttttaagtcattttaaaaccttttagtgtagtgattatcaaatgagtcttaagtttgttttttccacttgattagtagaaaataaaatgtgttattcatgaaaggattctcattctgaccattagttgttagaaaaccaactagtgtgtttatacagttgtacatcccaaatctgaaaattctaaatccaaaatactctgaaatccaaaagtttttgagaacccacatgatgctcaaaggaaatgctcattggagcatttcagagttcagatttttggattttaagatttaggatgcttggccagcctgatggctcactcctgtaatcccagcactttgggaggctgaggcaggcggatcgcctgaggtcaggagttcgagatcagcccggccaacatgacaaaaccccatctctgctaaaaatacaaaaattagctgggcatggtggcacacacctgtagtcccagctactcgggaggctgagacaggagaattccttgaacccaggaggcagaggttgcagtgagctgagatcgtgccactgcactccagcctgggtgacagagcaagactccatctcgaaaagaaaaacaagatttaggatgcttaattgggaaggtacgtgatacaaatattctaaaatccagaatccaaaacacttctggttccaagcatttcagacaagggatattggacctgtatctatattttaaatgagtgtcattaaagaaagagaacagcacatttattatgatataatattataatatgatatacatctgtttgctcttctagagtaggtctttagaaaaaagtttatatcttattaaaaccagatttcaatcacttaatcgagcacaaaggcaaatcacaaataaaaatctataataattcaatatactaaattctcaaaccatggaaacaaaatgtttgccttttgagtagaataaaagaagaacataaaaacattaggaaagattaaaatatacacagtttgttttcagcattcttgttggcttcaaagtcactttattagtttaagaacataaaatatttaagacttttcctattaaattgtcatgattgatattttattttattttatttatttttttttttagacggagtttcgctctctcacccaggctggagtgtagtggcacaatctcagctcactgcaacctctatctccctggttcaagcaattctcctgcctcagcctcctgagttgctgggattacaggtgcatgccaccactcccagctaattttttgtatttttagtagagacgggatttcaccttattggccaggctggtctcgaactcctggcctcaagcgatcctcccaccttggcctcccaaagtgctgggattacaggcatgaaccactgtgcctagcccaagattgatattttaaatatttatatacaatataaccaggcagtaaaattaaaaacttagtcttggctgggcatggtgatttacgcctgtaatcccagcactttgggaggctaaggcaggcagttttcttgagccctggagttcaagaccagcctggacaacatagcgagaccccatctctaaaaagaaggaaaaatgtactctttaacatttctttttaagttttttattttgctataaatgtctctacaagcagctgaactttaagaattatgacctgtcttgatctttgccaaagattggcaaaaacttagaaacagaagaaatcagcactgtaataaagttttaaccaggtggagagctcatatccaaggttacttgggtctgagtcttcccagcaaaaaaaaaaaaaaaaaaaattaatacaagtaaaaaagaaagttttagctgggtatggtggcacacaagtgcagttccagctcctcaggaggctgaggcaaggggactgcttaagtccagcaggtcaaggttgcagtgaactatgatcagccattgcactccaacctgggcaacagagcaagaccatgtctcaaataaataagttaagttactttgaaagtttagagtcctacctgatgttaattgagttacccacttttttccccttaaggaacaggtaaaaaaaatttaacacattataaacagatgttgccatgtaaaacttgatatgttttgtcattttctcaacattgatgggtaacagcttgctttctccaatatttcatttttatcatgatcttccagaactgataaaacttttgagtttgtttaaattttttaaaaagctttcccttggccaggggtggtggctcgcatctgtaatcccaacacttagggaggccaagatggaaggattgcttgggcccaggaattgagaccagcctgggcaacatgacgagacctcatctctacaaaaaatttaaaaattagccaagcatgaggttatgcacttgtagtcccagctactcggctggctgcagcaggaggattgagtgagcctgggaagtcaacggtatagtaagctgtgtttgtgccactgcactccagcttgggcaacagagcaagaccctgtcttaaaaaaaaaaaaaaaaaaaaaaaaaagctttctctacatcgatatgtgtcttaatctctccaaacttaggttgtttctcgacacacttcggaaaaaggaatattcagaggcaagagagttaggaggagaagcccagattgcattcctttttttttttttttttttttttgagtctagctcagtgcccaggctggagtacagtggcaccatcacagctcagtgcagcctcaaccctacaggttcaagcagtcttcccacctcagcctctcgagtagctgggactacaggtgcacaccaccatgcctagctaattattttttgtagagacggagtctcgctatgatgatcaagctggtctcaaactgctgggcttaaggagtcttcctgcctaagactcccaaaatgctgggattacaggcatgagtcaccttgtacaaccagactgcattcttaaagcacatgacgttatagttgacagtgttgtaaaatgatgtgttacgtgaagctgcatctttaaatcttggacccaagaaatgtgcagcatctactcattcattctttaaacatttttttttgaaactttactatgacctaggttctttgtcagctgaggacttaaaaatgaataagaggaaaaaaataaaacatggttcctgtggggcccaaggtctccagagggagacagacatggatggacagaatttcaatacaatatagcctgcataatgcagtgctgtaaggtacaggacatctttggaacagagaaggtggcagtcctcagccagcctggggcagacaggaaaagcttccttgtgtcagtgccttttggccaaaggaacacacttgtagttgaacaagttgggtttcttggttcgttgcagtgaggaagaaagcacaccatgaagaaccatggggcatcttagtgcagagttgagaggaacttgttgcagtttagacttgcagtaggtgactttgggaagggtttaaagaatcaatattttgctctggatttgataattctatgatgaatttttatctagaaggtggggtaaagctgtgattagtaagggcacagcagtcactcatattagctgggagaggaagatgtttcgcattttttgtagtttatggcatttgtgtttttgtctgtgctcagacatgactgtggagtggttttttttctttttcttcttctttttagagacagggtctcgctctgtctcccggactgtcatgcagtggggtgatctcagctcactgtaaagtggtcttatttttgtcttgctccagcatgctcatagagtggcctggtttcggttcaacaggacaaccccaggcctagatgttagaaccaggacagtttagcttaccgcagcccaggactgctttttttctttttttttttttttcttttgagacagagttttgctctttttgcccaggctgaagtacaatggcacgatctcagctcactgcaacatccgcctcccagtttcaagtgactctcctgcctcagcctcccgagtagccgggataacaggtgtgcaccaccacacccagctaattttgtatttttagtagaaacggggtttctccacgttggtcaggctggtctcgaactcccaacctcaggtgatccgcccgccttcatctcccgaagtgcttgtattacaggtgggagccaccacacccggcctgactgctttttttctttctcactttcctgagagaaagagtgatatcttctagagagagagtgacaccttctaggaaatgtggctgttgggtgttgctctcgtgcataaggtaaaggcaaaaaacagcaggaggaggaacagctggaagtcaggtcacagagggtcctctgtgcctccctaaggagcttagcctttatcctttaggcactgggatgccatgaagtatttgtaagctcgaagtgacagaatcagatttgcattgtagatagcttatgctggcagtcatgtcgaaggagatctgagctggacaagcaagagttgcagttcaaatgttttctcagttatccaaccaagaaaaagtcagtacttataggtagaaatgtgatttcattcttacaataagtggattttacaattatgatagcatatatagttctaattctgattcagaaatttctacaagaagagaaataggctgggtacggtggctcacacctgtaatcccagcactttgggaggccaaggcaggcggatcatgaggtcaggagtttgagaccagcctggccaatatggcaaagctccatctctagtaaaaatacaaaaattagccaggcgtcgtagcgtgtgcctgtagtcccagctactcgagaggctgaggcagaagaatcacttgaacctgggaggcggaggttacagtgagccaagatcataccactgcactccagcctgggcgacagagcaagactctatctcaaaaaaaaaaaaaatagagaaataaaaatcttcattgcacgctgcagttaaattcagaaggaccatctcatgactagcgagtgctttaagatcatcagctactcctctatgttgaagatctccttttaatgaattatggaaagacattaccacttcacccattgaagtgttctttcctatatatctgctatttttgttcttcttcttttctttcttcttgtttttttgagacggagtttcgctcttgttctcttgttgcccaggctggagtgcaatggtgcgatcctggctcactgcaacctccgcctcctgggttctagtgattctcctgcctcagcctcccaagtagctgggattacaggcatgcaccaccacgcccagctaatttttttgtatttttagtggagacagggtttctgcatgttggtcaggctggtctcaaactcccaacctcaggtgatctaccagcttcggcctcccaaagtgctgggattacaagcgtgagccaccacacccggcttcttcttcttttcttaattccaaggatatcatggggttttcttgtttggttggttctgggtttgttttttgtttttgtttgtgtgttgttttgttttttgacacaaagtctggttctgttgcctaggctggagtgcagtagcatgatcttggctcactgcagcctccctctgcctcccgggttcaagccatcctcccacctcagcctaccaagtagttgggacgacaggtgtgtaccacaaagcctggctaatttttgtattttttgtagagacagggttttgccatgttgcccaggctggtcttgaacttgtgaactcaagtgatctgcctgcctcagcctccaaagtgctgggattacaggcatgagccaccatgcccagcctgaagatagcatgttttgtaactgttttacttctcctttatgccttttaggaagagtatacaattttgcagcattgcgaagcaaatcaaatggggaccttggtttgaatatttagttgtcaaattaagacagaaattaagagcattttttacatgtaactttgctaaatcaatttgctgttacttgcatttgacaagaaaaattttttttaaatggcatattagaatatattcaagtatttgtcgagtgatcttaccctctatatttcacacatttcatgacaaataatttttatagtttgtccttttctgtttcaacttatatggaaaaaaagttgattgagctattattagaaattcgatgatacattctgaatacaagattcaggatctcattgatttttccttcacaaattccattatcatttaaatctccaaagtatatttgctttcaaaatgttggctgagcaaatgatctgagcaattttaaatttttttgcctgtatgtattttcctttttggggggtgggggtggggaggacagagtctccctctgttccccaagctggagagcagtggcactatctcagctcattgcaacctctgcttcccgggttcaagcgattctcatgcctcagcctcccgagtagctgggattacatgcacgcatcaccattcccggctaattgtttatatttttagtagagccagggtttcactgtgttggccaagttggtctcgaactcctggcctcaagtgatccgcctgccttggcctccaaagtgctgggattacaggtgtgagccaccacgcccagccacgcatatgtattttcttttatcagcagtggtattttagaataatgtagccctctaataggaactttcaggaccaggtgcagtgacttatgcctgtaatccgatcactttgggaggcctaggtggaaggatcacttgaacccaggggttagagacctgcctgggcaacatagggagaccccatttctacaaaaaatttaaaaattacccggtgtggtggcacatgcctgtagtctcagctactcaggaggctgaggtgagaggatcactagagcccaggaggttgaggttgcagtagccgtgatcgcgcctctgcactccagcctgtgcgacagagcgaaaccctgtctcaaaaaaaaaaaaaaaagtggcaggcacagtggctcacgcctgtaatcccagcacttttgaggcaggtggatcgcctgaggttaggagttctagacaagcctggccaacgtggtgaaaccctgtctctactaaaaatacaaaaattagccgggtgtggtagcaggtgcctataatcccagcttctcaggaggctgagtcaggagaattgctcgaacctgggaggcagaggctgcagtgagttgagatcgtgccactgcactccagcctgggcaacagagtgagattccttctcaaaaaaaaaaaaaaatgctttcataatttttaattttttgccaacaattagatatgatgaagccatcgagagtatgtgtttacattgcttgattggcaagatagtagtgtgttagaaacaatagcaagagaataatttctagatccagaacatcaaaaaaagctgttttgtaccttcttaagcccaaccttgtgttgtccagtatggtagccactagctccacgtggctgttatatttttaatttaactaatttaattaaaaatttagttttggccaggcacggtcgctcacacctgtaatcccagtactttgggaggctgaggcacgcagatcacgaggtcaacagatagagaccatcctggccaacatggtgaaatcccatctctactaaaaatacaaaaattagccaggcatagtggcacgcgcctgtagtcccagctactcaggaagctgaggcaagagaatcacttgaacctgggaggtggaggttgcagtgagccgagatcacgacactgcactccagcctggcgacagagcgagactccgtctcaagaaaaaaaaaaaaattagttctggccaggcgtggtggctcacgcctgtaatcccagcactttgggaggccaaagtgagtggatcacctgaggtcacgagttcaagaccagcctggtcaacttagtgaaacccccatctctaccaaaatacaaaaattagccaggcatgacagtgagtgcttataatcccagctactcgggaggctgaggtgggagaatcacttgaacccaggaggcggaggttgtagtgagccgagatcgctccactgaactccagcctgggcaacagagcaagactccatctaaaaataaaaaaatttagttattcagtcacacatatgtcacacatatgacaagggttttgtttcacttcattttctttcatcaacctgttagaaggacaagatttaataaccacatgtaactactggttaccctgtggacaatgtgcatataaaacatttccatcatcatggaaagttctactggacagcactaccttaaactcttgaaggatttttttataaatgtctgctagatacgcggatagtttctcctagtaacatttgaaaattcatctttaacttgaaagtttttataaatgaagactttccccctgaaatataacttgtaatgtggaaatactataagttgatcttacaattcatattgggagaacagaaaactgttgtgttgtacctagattacaaatgaacactaagctggaatacatacatttcacattcttctttctaagcctctaaccctgtgagccttgtattcgtttgataagcagctattgagaacctgccatgtgaagggcttatgtgttagacatacagctcatcttggttgggtgattgttcaaaaacatcagattatcaaaaactcaattgatatttataggttgtgaaaacataccagtgtgactaaaattaaatatttcttatttcaggttatgtttccaagaggtagggtacattcttcagaatacattcagttttcagagatcaaatacatttacacttgtacctttcagcataaaagaatgatttcacttcctttgtggatttcaaagccatataaaaagagctatgttccaaattccttcaaactctaaaatcctctctgccctgagcttttcaatcaagaaggataagggcagactttttaaaatctgatctctacagcagtgggtcccaaacttgctgcacattgaaatcacccagggatcttcaaaaactagggatacttacctcccacccacccacaacctattcaattggtctgtggtgtgaccttggtctcagtgtttttaaggctcccctgggtgattcttatatgcagcaaagtttgggaacccactgctctatagaatcaccagtgaagccttttaaaacttagattccttggccctacactcagagtttttttgccttacttgtttttgttttgtttattcaataggcagagagtagaacacaggcccctataattgtaaagtatagctggagttgaaaaccactgctgtaaaagaatcaatgttctctctccttctctttccctatatctgtacatctttgatcatattaaaaaatacaaccaagcgcaatggctcactggctcacgcttgtaatcccagcactttgggagaccgaggctagcggatcacctgaggtcaagagttcaccaccagcctggccaatatggtgaaaccccatctctactaaaaatacaaaaatcagccaggggtggtggcgggtgcctataatcccagctactcgggaggctgaggcaggagaatcgtttgaacctcagaggcagaggttgcagtgagccaagatcgcgccactgcactccatcctggacaacagagcaagactccatctcataaataaataataattttttaaaatttgtaattaaaaaacacaagagcatatctacaaagatgtcaagtaaaaagtccatatgaaaaaggccagaagaaggttgggcaatactggttcttcctctttttaaaataacagcaactgtgaactctgaaggcagaaacatagattgctcttgcttttgagaaaaacaacagtcttagcgtatagaaaatataaaaatctgatgccctaaatatcagtggtatccaagctttcttgatcatgcaagaatcaataaacaggtgggaggctcacaatctgaatgtatatatatatattgttttcttttgagacagagtgttgctctgtcgccaagctggagtgcagtgatgtgatcttagctcactgcaacctccgctccctgagttcaagcgattctcctgcctcagcctcccaagtagctgggactacaggtcgcgccaccacatccagctaatttttgtatttttagtagagacggggtttcaccatgttggccaggatggtcttgatctcttgacctcatgatccgcctgcctcggcctcccaaagtgctgggattactggcatgagccaccacgcctggccgtatatttattcttaagttatctatatgtactatgatacttatgtatatcataaaatatatacagaaatagactttttaaaggattgatagatgaaataaacagaatatacataaaatttacatcttaatagaaaaaaacttctttgctataacttaaaaattacaaataatttgttgtttttattttttgagacagagtctcgctctgtcgcccaggcgggagtgcagtagcgtgatctcagctctctgcaacctccacctcccgggttcaagcaattctcatgcctcagactcttaaccagctggaattactgctgcgcaccaccacacccggctaatttttgtatttttagtagagacagggtttcaccatgttgcccaggttggtctcgaactgttggcctccagttatctgcccgcctcggcctcccaaagtgctggaattacaggtgtgagccaccatgcccagccataatttgttgatataataatatttaaagggagcaatgtgtttgactatgttatagttaatgatctgccattattttgcttggcgaagtagttgacaaaggactcatcaagaaaagtggcagctcagccgggtacggtggctcacgcctgtaatcccagcactttgggaggctgaggcggacagatcacgaggtcaggagatcgagaccatcctggctaacacggtgaaactctgtctctactaaaaatacaaaacatttgccagacatggtggcacgtgcctgtgattccagctactcaggaggctgaggcaggagaatcacttgaacctgggagagagaagttgcagtgagccgaaatcgcgccactgcaatccagcctgagcaacagagcgagactccatctcaaaaataaataaataaataaataaataaataaataaataaataaataaataaaaataaaagacacttaaaataaatcacttacgctgggggcagtggctcacacctgtaatcccagaactttgggaggctgaggcaggcagatcacttcaggtcaggagttcgaaaccagcctggccaacatgatgaaaccccgcctttactaaaatacaaaaattagccagatgtggtggtgcacacctgtaatcccagctacttggggggctgaggccggagattgcttgaacccgggaggcagaggttgcagtgagctgagattgcaccactgcactccagcctgggcaatagagcaagactccatctcaaaaaaaaatacataggccaggtgcagtggctcacgcctgtaatcccaacactttgggaggccaaggcaggtggatcacctgaggtcaggagttcgagaccagcctgggcaacatagtgaaaccttgtctctactgaaaatacaaaaattagtcaggcatggtggtgcatgcccatagtcccagctactcgtgaggctgaggcaggagaatccgacttgaagtggggaggcagaagttgcagtgagccgagatcatgccactgcactccagcctgggtgacagagcaagactctcttaaaataaaataaaatagtacttaaactgcaatatgctataatactctgagggcaaacaaacaagtgaggatgccattattaacctctctgaattgggggactcatacgatttgtaatcacctgacatactccagggccaacatatttattaaatattaatagagtgtgtttttttatttttataataaaaatgagtaaaaatggaaataaatagaaatatgtctttcctcaccccaacagatcatcttgcatacccctatggtgcttttaccctgctttaaagaccactactgcatatggctgcatacagaaaccttgtattgcctaatttttataaatcatttcaattgaataaagattggataattaaacatgaattctaacaggaccttccaatctctttcctttatccttatgtcaacctctgaatctgaccgtgaaactatattttagaaatagagaattcaggccgggcacggtggctcacgcctgtaatcccagcactttgggtcggatcacttgcagtcaggagttcaagaccagcctaaccaacatggtgaaaccccgtttctactaaaaatgcaaaaattagccaggcctggtggagtatgcctataatcccagctacttgggaggctgaggcaggagaatcacttgaactcaggaggcagaggttgcagtgagccgagattgtgccattgcactccagcctgggcaacaagagtgaaacttgtctcaaaaaagaaaaaaaaaaaaaagaaagaaagaaatagataaatcaatgctgcaggtgacttctgacattcataaagaatgtttagggttgacattatagctctacgaatacatttttactttttcctctaatctgaatcatggactttctagttaatatattttttaaaaaatcaaacaactaaatatttatcatgtattttgctatttaatatttcaaaggagttgatttaaaaatttggagtttactaattaaggtgatattctgtatgaattctggatagagttttagctgatacggtacagatctaagcattaacatagccgtagtttatcctaattattcctgttttcttcagctttcttcacagaagtcagtgccgtgggtacccattttaaaatccctgccactttgggctatcgtagttgcacacttttcttacaactggactttttatactttattgacattattgcctacttatatgaaggagatcctaaggttcaatgttcaagaggtaagaaaaaataatcatctgcttcttatatatatagtataagaccatacacagaatttgttctcatctgtataaaattcagttattctgtatcttccattttactctgctgtcctaaattttagagattcttatacatcaaaggactattaagaaaatgaaaaacaacccactgaatgggagaaagcatttataaatcaaacatctaataagggtctagtatccagacatattaagaattcttacaattcaataataaaaagacaactcagtttttaaaatgggcaaaggacttgaatacgaatacacatttctccaaagatacacagatggccaataagcacatgtaaggatgcccgacatcaggccgggtgtagtggctcacgcctgcaatcctaccactttgggaggtcgaggcaggtggattacttgaggccaggcatttgagaccagaccgggcaacatggtgaaaccctgtctctgttaaaaatacaaaaaaggccaggcgcggtcgctcacgcctataatcccagcactttgggaggccaaggcaggcggatcacctgaggtcaggagtttgagaccagcctgacaaatatggagaaacctcatctctactaaaaatacaaaattaaccaggcgtggtagtgcatgcctgtaatcccagctactcgagaggttgaggcaggagaattgcttgaacccgggaagcggaaattgtggtgacccaggatcaagccattgcactccagcctgggcaacaagagtgaaactccatctcaaaaaataataataataataattaatcccagcactttgggaggctgaggcagaaggactgcttgagcccaggagttcgataatacagattggataatacagcaaaaccgtctctactaaaaacacacaaaaaaattaaccgggcatggtggcctacacctgtaatcccagctactagggaggctgaggcacgagaatctcttgaacccaggaggcgaaggttgcagtgagctgaggtcatgcccctgcactccagcctgggcagcagaacaagactctgtcccaggaaaaaaaaaaaaaatgctaacaaggctgactgcacaactgcactggctacatggacttacctgctttaaaaactattaaagtgaatcctcagtcactcacattccaaagtataccataaacattggcctggctatgtggaccaaaccttaaaacttcaggcagctaagctgtgaagaactcctctgtctacttctgaaaaacaagatcactatatagaaatatttccacaaattgcactgacagaagttaaattgaaactaggctttggcaacataatgggatggattcattgtgagcaatcttatttttcccaagttctctgttaacagagcctgattataatctactactacatttcaactataaagtggggctgatttttaaaaaagaaagaaataaataatatactactacagtgattaattgcattcaactgtgcattgaaaggttaatttggtaattatcatttggggtaaaactgagatccacaggaagattaaaaatagcaaatccagccgggcccagtggttcacacctgtaataccagcactttgggaggccgaggtgggtggatcacttgaggtcaggagttcaaggccagcctggccaacatgtgaaaccccatctctactaaaaatataaaaattagccaggcatggtagcaggcacttgtagtcctagctactcgagaggctgaagcaggagaatcactggaacccaggaggcagaggttgcagtgagctgaggccatgccattgcactccagcctgggcaacagagcaagactccatctcaaaaaaaaaaaaaaaaaaacaaattctcaaaatcatattaacaaaatatcttattttacttataaagtatatttaaagattactacactgatgtttctatttgagattttccaggaagaactatatatggaagaaataaaatatcaatagctggccagtaattaatgttgtgtactttaaaacaaggatcttttatcttgcattttcatagacaaaaaggtttatcttaattaaaattaaaagaaatgtgaatataggaccttctttcattctgtaaaataaaaagaaatgtgaatagagtttgaaaataattctataattatatagcctattttttaattgattttttttcttgaaaatcaatgtgttacattcatgaaatggcctaggtgtttttgtttttgttttttttaaatagtagagatggggtttcccattattgtccaggttggtttcatactcctgagctcaaatgatcctcctgcctcagcctcccaaagtgttgggattacaggcatgaaccaccctgcctggccatcagatggcctttgttcaaaataagcttgctttgagaagcgtggcatgcctccttttattgcactttgctttattatactctgcaaatattgtattttttatgaattgaagatttgtgctaaccctgcatggagcaaatccgttagcaccatttttccaacagcatgtgctcacttcagggctcttgatctttgaagttagtgttgtaattgttggggggcaccataatccttccccatataagatggcaaacttaataaatgttgagtgtcttctgacggctctgccaaccagccactaccccatctctttccttctccttgagcttccctattccctgagacacaacaatattgaaattaggctggttaataaccctacagtggccgggcgcagtggctcacgcacctagcactttgggaagccgaggcgggcggattgcctgtgctcaagagttcgagaccagcctgagcaacacggtgaaatcccatctctactaaaatacaaaagaagttagccaggcatggcagctcgtgcctgtaatcccagcacctcgggagactgaggcaggagaattccttgaacctgggaggcagaagttgcagtgagccaagatcacaccactgcactccagcctgggtgacagagcaagactccgtctgtacagaaaaacaaaataaataaccctacgatggcctgcaagtattcaagtgaaagcaagagtcacatatctctcatttttttaaatcttttatctaaaatgtgtttatagagatggttttccactcatcttgattcagagtgctcttagtgctgcttcctcctgaaggaacatccttccataagccttgcttttcctcctgtaggctggcagaggacagtagagcacccaacacacaaaactactgtttgtgcatgagtaaagaccgtgatgattttatagcgtcctgggcacttcacatccatgaagtaggaattagtgctctgcaccaggcatttcttcttgtgtttcctcttctcctcttctggagagggatgaaggaaattttttgcaagaggtgtgttctcgtcggtaggtcgtcacaaccagaaactcattttattttattttattttattttattttattttattttattttattttattttattttatttcattttattttattttaagactgagtcttgctctgttgcccaggctagagttcagtggtacgacctcagctcactgcaacctccacctcccgggttcaagcgattctcctctgtcagcctcccaagtacctgagatttcaggtgtgtgccaccacacctggctaaattttttatttttgtagagacagggttttaccatgttggccaggctggtctcaaactcctgacctcaagtgatccctttgccttggcctcccaaagggctgggattacagacgtgagccaatgcgcctgcaaaaaaattggaatcaatttttttaaataaatgaatacaagggatcttatccttgaagagaaaacttaacaactgtggaaggtgcctgtggaatgtataaatgctgaagactttagtgtatttaggttgttgcccaggctggagcgcagtggcgcaatcttggctcactgcaacctccgcctctcaggttcaagcgattctcctgcctcggcctccctagtagctgggattacaggcatccaccgccacacctaatttttgtattattagtagagatgaggtttcaccatgttcaccaagctggtctcaaactgctgacctcaggtgatctgcctgccttggcctcccaaagtgctgggattacaggcatgagccaccgtgcctagccggcagtttttagcattgcaacttgaagtggcaatattactaactgtgaggaattatcaaccttatcccaccaggaaacaaaatcaagatcagaaaattcacttatctgatttactacagcttattcttttttactttcctactaatattttgaaaccatttattcttatacaggattttgccacaaataatgatagatgtgatcccaccgtgcagaagtctaaatggaattgtgtttttttttcttttttttgttttttttctttctgagacagagtcttgctctgtcacccatgctggactgactgcaccagagcaatcttggttcactgcaacctccacctcccaggttcaagcgattcttctgcctcagcctcccaagtaactgggattacagtcatgtatcatgatgcccagctaattttttgtatttttagtagatacagggttttgccatgttgaccaggctggtcttgagccccgtcctcaagtgattcttcctccgcggcctcccaaagtgctgggattacaggcatgagccactgtgcccagccaagctttttttgtttgtttgtttaagggaagtagaataggcaatgcttgatgattggacgcgaaaaatgagggaaaagaaaccatcaggaaagactctcagaggccaggcgcggtggctcatccctgtaatcccagcactttgggaggctgaggcggccagatcacttgaagtcaggagttcgagattagcctggccaacatggcgaaactccgtctctactaaaaatacaaattagccgggcgtggtgacacacgcctgcaatcgtagctactcaggaggctgaggcaggagaattgctggaacccagaaggtggaggttgcaatgagccaagatcacgccactgcactccagcctaggcaacagagcaagactctgtctcaaaagaaaaaaaaaaaaaagactctccagttctgttaaaaataaacgtgtgtgtgtgtgtgtgtgtgtgtgtgtgtgtgtagtaaataaacatgtaatgcacttttgagttattgttttactgggcaccgataaattttaagaaatagataaattgtaagaaaaaaatgaatggaagggaacttacagatttaaagagacataaaaggcaaatcaaaaaaattttaatggccaagactaaatcgaagtgtctagggatgtacatttgggtgatgtaactataaataaaagtgagtacatgattactatacaccaaaacgaggttaatgcttatttaaggggggaggaagagggctctgataggactaggaccatgaagtgtcttctggcaaggctggcaaagttctatttcttgacctagatggtcattagaaagactcatgaggccgggtgcggtggctcatgcctgtaatcccagtactttgggaggccaaggtgggtggatcacaaggtcagaagttcaagaccagcctggccaagacggtgaaactccgtctctaataaaaatacaaaaattagccaggtgtggtagcaggcacctgtaaccccagctactcgggaggctgaggcaggagaatcacttgaacccaggaggcagaggttgcagtgagtcgagatcacacccctgtactccagcctgagtgacagagtaagactccatctcaaaaaaaaaaaaaaaaaaaaaaagaatgattcattaagctatgtttatgtggttttctgcatctgcattttattttatagtaaaaaaaattttttttaaataaatgagtgagaatggaagatgaaaatgttcagtagggagaatccataggctaacaggaaggtttgtcttctctcacaacccagatcccagagaaacagtcaagattacccgaagcagacaggactagggcaaggcttatttccctctgagacagactcttagggactgccttggactgaaccctataatccttctgacagccagacttatttactgtaattatattaaaaaattaacaacatattgctatgcatttcctttgctttcaagtggtggtcattggctgtgatgaatgtgtatgttttgtttttttctctcaccgtaattaatcctgtatcttcttattccttccagaatgggtttttatcttcattgccttatttaggctcttggttatgtatgatcctgtctggtcaagctgctgacaatttaagggcaaaatggaatttttcaactttatgtgttcgcagaatttttagccttataggtaagtgaagcaatcaggttttgttttggtttacagttatttaccatgtttacagttataggagataggaaaacaaagtgtgtttcccacttttacacacagttaacacaatactcaacacagaacacctcgctctaatcaccaaaatgtttgtggggatttctgcctacacataaccagttctgcagcggacaccagctaggtatcctgtaattcagttctgacactgtccagctggcggtagcatcagatcctataggttgagggctcagttccacaagatcgcccccctacttcggataccaatcacaagtcccagcttgtgacctctgcttctgactgaccggctataaatcagggttcccatgactgtcttgtcaggttcagttaatctgctagagcatctcagagaactcagagaaacactttattttatgtttacccacttattataaagggtattgcaaaggatatagatgaacagccagatggaaaagctgcatagggcaacatatgtgggaccgggtagggagttttcatgccctctcctggaacaccaccctccaagaaccccgaccgcaaaagttcatccaaaccctgtccctttgagtttgtatggagacttcgttaaatgtgtatgattgattaaatcattggccattggtgactggctcaaccttcagcccctctcccctctctggagtttgggggtggtgccaaaagtcccagacctctaatccagccaccatcctgaagctgtatggggacccccagccaccaattgtctcattagcatacaaaagacactgttaccactccagaaattccaaaagttttaggagctgtgtgccaaaaaaccgggggcagagaccaaatatatatttcttttttaaaacaattttttaatagaaatggggtcttgctatgttgccccgtctggtcttgaattcctggcctcaagtgatcttcctgcctcagcatcccaaaatgttgggattacagacatgagccaccacactggccatatttcttttcttattttttttcttgagacaggggctcactcttagcccaggctggagtgtggtggcatgatcttgactcactgcagcctcaacctcctcagcctcaggtgatcctcccacctcagcctcctgagtagctaggactacaggcacacaccaccatacccagctaattttttaatttttactgaagacggggtttcaccacgttgtccaggctggtctttaactcctgaactcaagtcatctgcccgccttggcctcccaaagtgctgggactacaggagtgaggcaccacacccagccccagccattttgtttaatttctttctttaatgggacaaggtctcgctttattgcccacattggccttgaactcctggccttcagcaatcctgctgcttcagcctcccaaagtgctaggattacaggtgtgagccaccacacccagcccccagccatattttttaaaatcacaatatcacaacagttcaagacaaaataaaaatgataatattagtcttttattttgttcacataacaaaacactatgatgcatttaagtgcatttctttacaatatgtttctttttgaatcatacattttgaggattaagatttataatattcactgggcgcagtggcttatgcctgtaatcctagcactttgggaggctgaggtgagcagatcacaaggtcaggagttcaagaccagtctgaccaacatggtgaaaccctgtctactaaaaatacaaaaattagctgggcgtggtggcaagtgcctgtaatcccagctacctgggaggctgaagcaggagaattgcttgaacccaggaggcagaggttgcagtgagctgaaatcgcgccactgcactccagcctgggcaacagagtgagatcctgtctcaaaaaaaaaaaatttataaaagatttatctccaccatggcttataattatttttaaaatggcttgctgtgccaaacatcatccctcacaattttatatatcactgtgctttcagctcagactttgcaatgaagatttttatatcaactttagacaagatgtaatcaaagtatttttaagcctccatcccttttctaagtgaatgcattttaagtttcaatccaaaaatatttactagcattattatatcaaataaggagctataaatcaaagaactcaaagaacccataaataatcatgtgtttcagactctgctttcagaaaggtaattttttttttttttgagacagggtcttgctccgttggccaggatggacaaccatggctcactgcagcctcaaccttctaggcacaagtaattctcccacctcagtctcctgagcagctgggactacaggtcacgccacagcacccagctaattatttttgattttttgtagagacatggttttaccatgttgctcaggttagtcacaaattcctgggctcaagcgatcctcccacctcagcctttcaaagtgctggaattacaggcgtgagccactgtgcctggcctagaaaggtaacttttaaaactatctaatcagttaggcatgatggtatgtatctgtagtcccagctactccagaggctaaggtgagaaaatctcttgagcctagttgtttgaggctgcagagagctatgatcacaacactgcactccaacctaggcaacagagcaataccctatctctaaaaatagttagaaaaaaatgtacgtagaaataaaactgtctaagacaatcatttaactttttaaaagtctccagtagagaccctggaagtctcagtgactatacttcagtaattacattataaaaagaccctggctgggctcggtggctgttgcctgtaatcccagcactttgggaggcagaggcggaggcaggcagatacttgaggtcaggagctcaaaaccaggctggccaacatggtgaaaccccatctctaatacaaagattagcttggcgtggtggtgtgtggctgtcccagctattcaggaggccgaggcaggagaattgcttgaacctgggaggcagaggttgcagtgagccaagatttcgccactgcactccagtctgggcaaaaagagtgaaaaaaaaaaaattagccaggcatggtggcacatgcctttaatcccagctactcaggaggctgaggcacaagacttgcttacacctgggaggcagaggttgcagtgagctcagattgtgccactgcactccagcctgggtaacagaatgcgaccctatttcaaaataaataaataaaagtaatgaaattaaattaaatcagacatggtggcgtgcacctgtagtcccagctactcaggaagccaaggcagaggatcacttgagcctgggaagtcaaggctgcagtgagccatgatcgcaccactgcactccagcctgacgacagtgagaccctgtctcaaaaaaacaagaaaataaataaataagtaaataaatgtaattgaactttttttaaagttcctcagttgcagtatatacaaatacaacatttccatcatcacagagagctattggatagcactgctgtagacacagaaaaactgacagcccactcattaagtctcttctcatattttacgcttaactgcctgtaatgaccaatgtgtattcttatcagttgttaataatagggaggattcctgcatattaggtggggcagaaaaaaaaaaaaccaaggccgggcatggtggctcacacctgtaatcccagcactttgggaggcaaggtgggtggatcgcttgaggtcaggagttcgagaacggcctggccaacatggcgaaaccccatctctactaaaaatacaaaaattagctgggtatggtggcccaggcctgtaattccagctattcaggaggctgaggcaggagaatcacttgaacctaggaggcagaggtggcagtgagcccagatcacgccactgcactccagcctgggtgacagagtgagactccagctcaaaaaaaagagagagagaatgaagacagagattttaaaaaatctttttaagaaacaaggtcttgctctgacaacccaggctggagtgcagtggtgccatcatagctcactgtaaccttgaacttctgggctcaagcaatcctcccacctcagcctcctgagcagccaggactacaggtgtgcaccaccatgcctggcgaattttgtttttaatatttcgtagagacagggtcttgctgtgttgcccaggctggcctcaaactcctggcctcaagtgattctcccgcctcagcctcctaacgtgctgggattacaggtgtgagctgccacacccaggcaagatggagtattattctaacctcatccaacagagtttattattcagtttatctcctttggttatatgtattttaaaccacattctgtgtcagctattgcttctctctagaaacatatttttaagttgttcttgtcttgttcttctctaacaccatggaattttagctgagttttggccacatgtagatttaataacattgcataatgagattttccttttatagtatattagttgtattacgcccatgttttccagcattttttttttctcatgaaatttgttagtcttccaggcaatatagtgtttctacagtaggtggcagcaatttcaaatttcagatttataccatattaaggtagagcaaatattaatgctgggtgttttttcccttttataactttttaactccaggaatgattggacctgcagtattcctggtagctgctggcttcattggctgtgattattctttggccgttgctttcctaactatatcaacaacactgggaggcttttgctcttctggatttagcatcaaccatctggatattgctccttcgtgagtactaatataaagatttgctgtgattgactttaaattatatttttaaaaatcctgataaaaggccagaggcggtgactcacacctgtaatcccagcactttgggaggccaaggcaggcagataacctgaggtcaggagtttgagaccagcctggccaacatggcgaagccctatctctactaaaaatacaaaaattagccaggcatgatggcgggcacctgtaatcccagctacttaggaggctgaggcaggagaatcgcttgaacccaggaggcagaggttgcagtgagctgagatcgcatcattgcacttcagcctgggcaacaagagcaagactccatctaaaaaaaaaaaaacctgataaaatagatatgatataaaacttaccattttaagtatgcagttctgtggcattaagtattcacattgtttcataactagcaccaccaacaatctctagagcaatttcatcttctcaacagaaactgtacccgttaaacacaatctcccatttctccttcctcccaggccctggcaaccaacattctactttctgcctctatggatttgactactataggaatgactttaaattcttaacaggattttaatttacacaataattaaagcaggaagttgtttttaaatttaaacttttaactatcatcacctctgtccacagtgctctcattagaacattgcaataactcattactgtgtctgttcacccaactagactaggaactctgtgaaggcagaaactcccttattgtcctcagggctctccatggcacttggcatgtagtaggcattttgtcagatgaatgaatgtgaaagagtagacccaattgatttgtctaactatattacctatgtgcaaatatatttgtgtagcccttgatagtttacacatcactttcataaacactatccattttacccttaaagcattcctttgaagtaagtatttttgccctatttgaacgctaaagaaacttaagagaagttaagtgatttatcttgcagcacacagctaatataataaatgatagagccaaaacttgaacctaaaatttttacttttaagcccaaaattctttctacagctacctctctggaaatattctttgagccacatacttctaaaaccattttgtgccagctgacaaggtaaataagggagctatgtaaatattttaacccaaaagttttaatacactttatttgtaaaaataatagatataaatttattttggagaaaagacagatggactcttaccctcttttcactacctcaaaatcttcacacctggactcctacagaatcttctgatttctatgaatcctcagtctcctatctcttcaataaatactctaagataagctgcactctgtcacccaggctagagtgcagtgacgccactgtagttcactgtggccttgaactcctgggatcaagtaatccttcctgctcagcctcctgagtcgctgggactgcaggcatacatcaccatgcctggttaatttttcaaaaaatattttgtagagatggggtctccctatcttgcccagggtggtctcagtctcctggcctcaagtaatcttcccgcctcagccccccgaagtgctaggattacaggcgtgggccacagcacctggccaagacttgaggttttgtcaagcctaggattgacgaatagtcaaagggatatgggaattgagagttttggcaagaaatagttctaggctatgttatcgcttaggatgtttttagttgaagtatagaaattctaatttaaactgggctaaacagcataatctattgattcacttaattgtatccagaaataataggcttcaggcaagagttgatatccagctgcctactaatatcaccacagattgtttctttctcactctctgtcttttacagtagtagttttgtcctaagactgggtctgcttataaaatcacacaatgaaatgattgccagcaacaatcaggactacatgcttcttcattcacatcaagcagaaagaaaaggatcttttcctctctccaccatggaaataagtcctgggcttcattttggttgacccaaactgagtcacatgaaccaaccccaatggccaagagaatatcatgtgactttaggacaatcagcacctaccccaaaagttagaagtcaaagggtcagtgcccctcagacatcactattgctacacagatgggggtggggagtgggaatggatgctgaggaatccatcggtaacatccattataacacatgaagatgtaaataaacatgagtcattttgagccgggcacggtagttcacgcctgtaatcccaacactttgggaggctgaggcgggtggatcacctgaggtcaggagttcgagatcagcctggccaacatggtgaaaccccatctctactaaaaatacaaaaattagcagggtgtgatggcacacacctgtagtctcagcttctcaggaggctgaggcaggagaatcgcttgaacccgggaggcagaggttgctgtgagccaagattgtgccactgtgctccagcctgggtgacaaagtgagactccatctcaaaaaaaaaaaaaaaaaaattataaggaacataaaattggttcagcagccatccagccagaaggtggtaagtcacccacaccatttaataaatctgaaaggtagcttaggattcatcaggttcctgaagtcttattagaatctctggaatctgatgagggccccccctgctctcttgaactagcaatgaaagaaaattggatcatcggataaaaattggagctatggtcggccgggtgtaatggctcatgcctgtaatcccggcactttgggagaccaaggtgggcagatcacctgaggtcaggagttcaagaccagcctggccaacatggtgaaactctgtctctactaaaaatataaaattagccaggtggggtggtaggacctgtaatcccagctacttggaaggatgaggcagaaaatcacttgaacctgggaggtggaggttgcagtgagcaattgcactctagcctgggtgacaagagtgaaactccatctcaaaaaaaaaaaaaatagtgctattgtcaaaagatgaaaatagatgctgaagaaaaagaaaaccaaatatccatggtacctaccttataagatcgttgtgaagattaaatagaacacgcacagaacactttgctcataatgcaataaaggtatttgcatataatgcaatagatgtaattattttctggctaactttgagtcaggtgtggtgaccagggtcacagatcaatccaagtaaaatattaaagtgatgattggtgtgctttcagaaaggaaaatgctgaccactaaagagccaccattgggtcactaagagccaaaatggcaaaacagtctaacttctcaacataatttttagcctaatagaataaagaaaatatagtagatttgatatgtcaggacttcagccaggcctcctatgatagatgccgttttggacaaggtggagaaagatgaattggatgtacaattagataaatttgtcactactaaatttcagtgtaatagcatgctcattaacggatctagtcatttgagaaacactgtgccaggcactgtaccagatgttgaagacacaaacatgaaagtaacatgattcctgctggcatctgtataagcttaagctggcctggatgatggtgggtcatgtcatgaagtataatgctggacaggcagcagggggatcctgtgcctgagcttcaagcatcaggtgggtggttgaagtctacatcttaaagacccaggtccaaccctgaaattttatgagtcttataagccgaaaaagacatttatctagatatcataagaagctaaacaggtttagtaacataaatgatgccagcaaatagttgtagcagttgggaggatggtaagcaagtgcctttgtgcctcagataatgaggactgctgtactggttctcagctgactgagacacaactattccaaatgtaagtaggcccggtgaggtggctcatgcctgtaatcccagcactttgggaggctgaggcggttggatcgtttgaggttaggagctccagaccagcctgaccaacatggtgaaaccccatctctactaaaaatacaaaaattaaccaggtgtggtggcgggcgactataatcccactgactcaggaggctgaggcatgagaattgcttgaacccaggagttggaggttgcagtgagcagagattgtgctactgcactccagcctgggctgcagagtgagactcagtctcaaaaaattaaataaataaataaataaataaatctcatcaaattcaaaattattattatttgttttttgttttgttttgtttttgagatggagtttcactcttgttgcccaggctggagtgcaatggtgcaatctcagctcaccgcaacctctgcctcttgggttcaagtgattctcctgcctcagcctcccaagtagctgggattacaggcatgtgccaccacaccctgctaattttgtatttttagtagagagggagtttctccatgttggtcatgctggtctcgaactcccgacctcaggtgatccgccagcctcaacctcccaaagtgctaggattacaggcgtgagccaccatgcccagcccaaagtcaaaattatttatctcccttagtgtgtgtgtgtgtgtgtgtgtgtgtgtgtgtgtgtgtttaaaccttgcagttctagctcaaaggataactttcttatattttgattcagctcttcagatgagctttttagtttttcttttccaactggaatttcttcattcaaagcacatcagttatttctagttgcaggagtcttggctacatatcttattggggattacatatcttaggtttttcatagttgctttttgttgtggtaacaactgagggcccattcagtgtaatacgctactagttaaaacagaggcacttgaggaccataaacaagccataaacaagttcaacaccagggcttgtggtgaaaaatgaagcatgagaaaatttatctttcctacagattgggttcagtgattactgtgttttgttttttttaacaaggtagcattgtagattataacattataatattaagtactgattcagaatcagacaaattgggtgacattttatggtttttcttcatctataaaatgaagataatccagctgggtgcagtggctctcgcctgtaatcccaggacttcggaaggccaaggtgggaggatcgtttgggcccagcagttcaagacctgcctgggcaatatagcaagatcgtacctctaaaaaacttaacaaaattttaaaattttaaaaataaaatgaagataatccttcctcatggggttgattttataattaaaatgatataatatgatatataaaacccttataaacatgtctgatatcaggttttccaatacatagtcagtaaacagatacaaggttttccaataaataatattcctattaacatataaatgtgtacttggattttataggcctttacttctatagactgaaatagagattttatgttatcaatgtatttattatcttttgaggcagagtcacaccctgtcacccaggctggagtacagcagcaagaccacggctcactgcagtcgcaagcaatcctcctgcaatcctccacctcagcctcctgagtagcgagcgggtctacagcctgagccaacacacccagctaattttgtgtgtttttttagtttttgtagagagagggtttcaccatgttgcccaggctagtctcaaactcctgggctcaagcaattctcccacctcagcctcccaaaatgctgggattacaggcatgcaccaccacacccggccccaaaatagagatttttctatggtaattttgttgcccgaattcatgggaattagatagattttcagctattaattccaatagtactccaacagcacagaatccagactgagtccatacaacttgttttcttccaagtggtcatcaatctttcatggcctgtcctggccaagtgaaatataagtacttgaatgagcttcttgttgctgacatttagaatttcatggcattcgtctgcacttaatatctgtcactggaaaggctggcaacattgcagttgactcctcttactgccaaggtgttaatggtttaaaaagaaaaaaaaaaaagagaggctctgccaagcttggttaatttagatacacccctaaaggggatgagccaaaaagatctgtacttcatggttttgttatagtgctgtgtgtatgcacaagttttgaacataaaactttgtgatctttatacataactgaattagttaagcagcactttttttaactgaactcctccttctcctttaagtgttttttttttgttttttgtttttgtttttgttttttaccaaaaacattaaacctaaatctaatgaaccccctaggatctagagtctagaaactatcagtgtacaggaaatacaggaggtataagattatgtgaaatgatacctaagagatacaatcttcaaagtccagaattcatgaatatatacaggacaaacatcctagtaaagggacagcaattttaggccaggcgcagtggctcgctcctgtaatcccagcactatgggaggctggggcaggtggatcacctgaggtcaggagtttgagaccagcctaaccaacgtggtgaaaccccgtttctactaaaaatacaaaattacccaggtatggtggtgcatgcctgtaatcccagctactcaggaggctgaggaaggagaatcacttgaactggggaggtggaagttgtaatgagccaagatcacaccattgcactccagtctgggcaacaagagtgaaactctgtctcaaaaaaaaaaaaaaaaagaggcagcaattttaaaaatgaattatcgggccaggtgcagtggctcacgcctgtaatcccagcaatttggcaatttgggaggctgaggcaggtggatcacctgagatcaggagttcaagaccagcctgacctacatggcatgcgtgtatagtcccagctacttgggaggctgaagcagaagaatcacttgaacctaggaggcggaggttgcaatgagctgagatcgcgccactgtactccagcctgagcgacagagactccgtctcaaaaaaaaaaatgtaattaatggaacaagcaaattttatgtttgatatgatctcacgtctataataacatactagaaatatatacagacagaaaaaaataggatatttatgaaaatgttaatgttgatcatctctatggggaagaattataggtaattttacttcattatttttttcttttttcgtattaattttcaaaaattaattacaattgaattttcaaatcaggaaagaaattttttttaacttaaaaaactttaagctagacatgctaagctttctgtatgaaaatgatatctcagaactttcctatatcactataaaaaggggttatttccatggctgtgttcctgtatgtaatttttttttttttttttttgagacggagtctcgctctgtcggccaggctggagtgcagtggcgcgatctctgctcactgcaagctccgcctcccaggttcacgccattctcctgcctcagcctcccgagtagctgggactagaggcgcctgccatcacggccggctaatttttttgtatttttggtagagacggggtttcaccatgttagccagcatggtctcgatctcctgacctcgtgatccacccgcctcggcctcccaaagtgctgggattacaagcgtgagccaccgcgcccagccttcctctaatgttaatgttttttgttgttgttgttgttgttaatttttattttttttattgatcattcttgggtgtttctcacagagggggatttggcagggtcataggacaatagtggagggaaggtcggcagataaacaagtgaacaaaggtctctggttttcctaggcagaggaccctgcggcgttccgcagtgtttgtgtccctgggtacttgagattagggagtggtgatgattcttaacgagcatgctgccttcaagcatctgtttaacaaagcacatcttgcaccgcccttaatccatttaaccctgagtggacacagcacatgtttcagagagcacagggttgggggtaaggtcaccgatcaacaggatcccaaggcagaagaatgtatcttagtacagaacaaaatgaaaagtctcccatgtctacttctttctacacagacacggcaaccatccgatttctcaatcttttccccacctttcccccctttctattccacaaaaccgccattgtcatcccagcccgttctcaatgagctgttgggtacacctcccagacggggtggtggccgggcagaggggctcctcacttcccagtaggggcggccgggcagaggcgcccctcacctcccggacggggcggctggccgggcagggggctgacccccccacctccctcccggacggagcggctggccgggcagaggggctcctcacttctcagtaggggcggctgggcagaggcgcccctcacctcccggacggggcggctggccgggcggggggctgaccaccccacctccctcctggacggggcatctggctgggcggggggctgacccccccccacctccctcccggacggggcggctggccgggcagcagggctcctcacttcccagtaggggcggccgggcagaggctcccctcacctcccggacgggttggctggccgggcggggggctgacccccccacctccctcccggacggggcggctggccaggcggggtgctgacccccccacctccctcccggacggggcggctggccgggcgcggggctgacccccccacctccctcccggacggggcggctgccgggcggagacgctcctcacttcccagacggggtggctgccgggcagaggggctcctcacttctcagacggggcggctgccgggcggaggggctcctcacttctcagacggggcggctgggcagagacgctcctcaccttccagacggggtcggggccaggcagaggcgctcctcacatcccagacggggcggcggggcagaggcgctccccacatctcagacgatgggcggccgggcagagacgctcctcacttcccagatgggatggctgccgggaagaggcgctcctcacttcctagatgggatggcggccgggcagagacgctcctcactttccagactgggcatccaggcagagggtctcctcacttcccagacgatgggcggccaggcagagacgctcctcacttcccagacggggtggcggccgggcctaatgttaatgttaaaatgctacttaactattgaaatgcaagtttttcaccagctgaatataaaatcccattgcaataagacattttatttagacataaaatttcacaagaacacaacctggagcagaatagctgtctattgaaagaagcagccaggcgctgtggctcatacttgaaatcccagcactttgggaggccgaggcaggcagatcacttgaggtcaggagctcgagagcagcctggccaacatggtgagacaccggctctactaaaaatacaaaactagcccagcatgatggtggatgcctgtagtccccgctactcaggaggctaaggcatgcttgaacccgggaggcagaggctgcagtgagctgagatcatcccactgccctcaagcctgggccacagagtgagactctgtctcaaaaaaaaaaaaaaaaaagaaggaaagaatgaagctgtttaaatgtgtatcacaataataaacgtctatgaaaatgtttctacaggtatgctggtatcctcctgggcatcacaaatacatttgccactattccaggaatggttgggcccgtcattgctaaaagtctgacccctgatgtaagtagataatttacttgtaaactggaaaggttttggagctgcacatctgtgtcaaagttcagtgtattttaattaagtttaaaattctaaatgttcttatgaaattctttttagcaacaaaaagctaaatgccttaatggatgggaaagtatattttcaaagaacagtttttggattttagacaaaacaattgaactaagtcaaatgaagacactgtagctgaaaccacacaagtagttaaaagttgtgatattggccgggtgcagtggctcatgcctgtaatcccagcactttgggaggccgaggcaggtggatcacgaggtcaggagttcaataccagcctcaccaacatggtgaaaccccgtctctactaaaaatacaaaaattagccggtgtggtggcaggtgcctgtagtcccagctactcaggaggctgaggcacaagaatcgctcaaacccaggaggcggaggttgcagtaagccaacatcaccactgcactccagtctggcaacagagcaagactccgtctcaaaaaaaaaaaaagaatttcaggacatacttacagactttcttattaccaaatatactgatttcagacatatatccgacagatagtgttcctacttcttctccacatctaccatttctaattccttaagtgacacggtacctgttactatttcctctcacttaataaaaaggaatgttgtagaaatgctttttctaaagttctgtgtctcaatatggacatgtccaaaatgtttaaccttgtcctcatggagcagggtggcaacaccagaacctaagtcagctcactaccatgtgttcatttcacttactgataatgccagcacttctgctagggaaatatggattcctgaattacagtcttgtatgtttacaagtgggaactgcgcttgatttgggatatgttacagcatttgtttaatgctattaaaaggatatcactgttttagctgggtgtggtttgtacctgtagtcccagctacttaggaggctgaggcaggtggatgcataagcccagggttttgaggctgcagtgagctatgatcatgcctctgcactccagcctgggtgagagcgggagaccctgtctcaaaaaaataaaataaataaaaaataaaaataaaaaaataaacaaaataaaataagtttcgcactccgttgcccagtctggagtacagtggtgcagtctcagctcactgcaacctctgcctcccaagttcaagcgattctcctgcctcagcctcccaggtagctggaactacaggcactcaccaccatgccctgctaatttttgttttttgtttgtgtgtgtgtgtgttttttggtttttttttttgagacggagtttcgctcttgttgcccaggctggagtacaatggcgcaatctcagctcaccacaacctttgcctcccgggttccggcgattttcctgcctcagcctcccgaatagctgggattacaggcatgtgccaccacgcccagctaattttgtatttttaatagagacggagcttctccatgttggtcaggctggtttggaactcaggtgatccgcccatctcggcctcccaaagtgctgggattacaggagtgagccactgcacccggccaaataaaactctaaagtatattatttttaaaaaggaaaagcacacacttaccttcacaattgtaatttctttcttctttttgagatgaagtctcactcgtcccccaggttggagggcagtggcgtgatctcagctcactgcaacctccgcctcccaggttcaaacaattctcctgcctcagcctcccaagtagctaggactacaggcacgtgccaccacacccggctaatttttgaatttttagtacagatggggtttcaccatgttggccaggctggtctcgaacttctgacctcaaatgatccacccgcctcagcctcccaaagtgctgggatatcaggcatgagccaccgcgcccagcctgtaatttcttactttgagcactgcctcaaaaactttgtggaatgagtcagcatataaataaataatgcaataattaaaattcaaagtgtgtctgaggttcaatgttgttataaacaaaacagtattctctaaaaactggtggaatttttgttaaaaaacaaactaggagctgtgtgagacttgtagtacaacgattgattttaagttcactcattgccttcagataacactgaagtattattttgtcccagagaccacacagggcagctttgtcttagtaatcctaagaagctgtttcaaacatttctttctggtataagatgtaattattgactgattcctcagcagaatttaagatgagtatctaagattttttttcattaaaatgcactcatctcagacaagtatagccaccacagggtgtttctttcttcatgtttctccttttttcccaaataaatgacctcatactggcttcccagtgccttctctttcacttcctcattgctagttctactgcttgtttgtttgggttttttgtttgtttgtttgtttctttgttttttgagacagggtctccatcgcccaggctagagtgcagtggcgcaatcatggctcactgcagcctcaacctccccaggctcaggtgatcttcctacctcagccccccaagtagctgggactacagatgtacactaccatgtccagctaattttcctacttcttgtaaagatggggtttcaccaccttgcccaggctggtctcaaactccagggctcaaggtagccacctacctcggcctcccaaagtgctgggattacaggcatgagccgccatgcctggcctgcttggttttttttgttttgttttgttttgtttttgagacggagtctcactctgttgcccaggctggagtgcagtggcacgatcttggctcactgcaaactccgcctcccgggttcacgccattctcctgcctcagcctcccaagtagctgggattacaggtgcccaccaccacgcctggctaattttttgtctttttagtagagacggggtttcaccttgttagccaggacagtctccatctcctgacctcgtgatccgcccaccatggcctcccaaagtgctaggattacaggcgtaagccaccacgcctggcctggtttatttatttatttatttttgagacggagtttcactcttgttccccaggctggagtgcaatggcatgatctcagctcactgcaacctccgcctcccaggttcaagcaattctcctgcctcagcctcccgagtagctgggattacaggagcctgccaccacgcccagctaatttttgtatttttagtagggacagggtctcgccatgttggccaggctggtcttgaactcctgacctcgggtgatccacccacctcagcctcccaaagtgctgggattacaagcatgagccaccacgcccaaccagttttgttttgttttgtttttgagagggagtcttgctctgttgcccaagctggagtgcagtggagcgatctcagcctcactgcaagctccacctcccaggttcacgccattctcctgcctcagcctcccgagtagctgggactacaggcaccagccaccacgcccggctaattttttatttttttagtaaagacggggtttcaccatgttagccaggatggtctcgatctcctgacctcatgatccgcccgcctcggcctcccaaagtgctgggattacaggcgtgatccaccacgcccggccgtgtgtttcttagttaatgctgcaaatgtagtcaccactctggttagactgaaattgaaaaaatccaaaaaatggttgttaaaggtagtcacatgacccagaaatttagataactgtctgatatttttatgccacagggttatacactgaacagttgtcttactgacagatcccatgttatatcctgctttgtatgccattcaagatcttttatacttgccaggcctctctctgatgtcacagatcctcaaagctgaacttgagttcatcttaacagtatttacttgatccacctgacacctttcacctgagaacccaggagaccgtgcacaggcataagactttcttagtgttagttagtgttaggcatgattcagggacatgccagtacactttttattgaagtatatctatctatcttcagtaaactttttattgaagtataactttttttaaatgcacaaatccaggccaggcgtggtggctcacacctgtagtaccatcactgcgggaggctgaggcgagtggatcacttgagcccaggagttcaagaccagcctgggaaacatggcgaaaccccatctctaccaaaaatatatatatatatgtatatgtatatatatacgtatatatatatatatgtatatgtatatatatacgtatatatatacatatatatacacacacaaagaaaattagccaggcatggtagcatgcacctctaatcccagctccttggaaggctgagttgggaggattgcctcagcccagaaagtggaggctgcagtgagccgagattgcgccactgcactccagcccgggtgacagagtgagactctgtctcaaaaataaaaacaaaaataaataaatgcactaatctaaagtgtgcagctagatgaatttccacaaagttaatacatctgtgtaaccagcacccaatcaagaaacagaatattacctccctcagtaagaccccaggtaccatttcctcctatttttccttcaccctcaccaagtggaaccactctcccaacttttaaccccatagattagtatggtctgactttgggctttatataaatggaataatttagtatgtaccttttttgtctggcttcttttgcttcatattttgtttgtgagctgtatttatgatgttgtagcccattctcattgctgtattgtattacgttgaacaaatataccactatcctactgctggtggacatttgggttgtttcaaggatgaggcttttatgaataatgtggctgttttaacactcttgtgacactatctttttaatgaagtgaactacacacaaaattttatttcacttgcattttttgtcttcctttatagaacactgttggagaatggcaaaccgtgttctatattgctgctgctattaatgtttttggtgccattttctttacactattcgccaaaggtgaagtacaaaactgggctctcaatgatcaccatggacacagacactgaaggaaccaataaataatcctgcctctattaatgtatttttatttatcatgtaacctcaaagtgccttctgtattgtgtaagcattctatgtctttttttaattgtacttgtattagatttttaaggcctataatcatgaaatatcactagttgccagaataataaaatgaactgtgtttaattatgaataatatgtaagctaggacttctactttaggttcacatacctgcctgctagtcgggcaacatgaagtaggacagttctgttgattttttagggccatactaaagggaatgagctgaaacagacctcctgatacctttgcttaattaaactagatgataattctcaggtactgataaacacctgttgttgttcactttcctcataaaaattgtcagctctctctgacacttagacctcaaactttagcatctctgtggagctgccatccactgtataatttcgcctggcaactggactgaggggagtgtgcccaggcagctgccaagcactccctccctggcttcagggtcagagtgcccagcgtttatcagaggcagcatccaagcccagagccagtgtcgactcttcggctggtgcctttcctctgaggggctatcaatgtgtagataaagccctgagtaggcaagagcagtgagatccactgctatggtcttgatacatcctcaaactttcccttcccagcacagaggaatattggctggcatgcaacctgcaaaagaaaaatgcgaagcggccgggcacggtggctcatgcctgtaatcccagcactttggggggctgaggtgggcgaatcatgagatcaggagttcgagaccagcctggccagcatggtgaaaccccatctctactaaaaatacaaaaaattagctgggcgtggtgacgggcgcctgtaatcccagatactcaggaggctgaggtaggagaatcacttgaacctgggaggtggaagttgcagtgaaccaagatcacgccactgcactccagcctgggcgatggagcgagactccaactcaaaaaaaaaaaaagaataaagaaagaaaagtgcgatgcccagtcaatcacaaataagatcatcctggtttaaatctactctcacatggatcacagtataaatttctatgtgctgtgttttgttcgtttgtattttgtagagatggggtctcgttttgtcgcccaggctggttttgaactcctggcttcaagcgatcctcctgtctcggcctcacaaagtgttgagactacaggcatgagccactgtgcccagcctgttctatgtttttaagctacacgagaattttttttttaattaattctcactgtttgttcagtctgtcttcatctaagtttgtgttgcagtttaaagttaaagtgacttttaaaggccacatcacctgagactagggtaatcatctttacttctggttcctgaaatcatatttttccagtggaccatcctccagtggctgtggttgttgagcatgctttcagaacacctatgtggcttaaaacttagtttatgttttgtgttcaacactacgtgtaatattttaaaactgtttaatgtgatgtgaatacatttatgtacatttatttttaaatttgtaaatagctttaaattgctatggcaatgtttcttttataaatcatcaaaataaacctttgtgaattg

SEQ ID NO: 38645 - DNA, 73909 bp, Homo sapiens
agtgacgtctttgccccgcgccgcgccgtcccacccatctccctggcctccggtcccaacttcgcttctctgctgaccctctctcgtcgccgctgccgccgccgcagctgccaaaatgtgagtgacgctacgcgacgcgggcggcttcgggccccgcaggcggcagctcgcgctgggaccgccatactgcccagttgccgccggccgccactcggacgcaggccggggctgcgcggggatcccgaggcctgggggtgggcggtggcccttgggtcgcgggctgcagacgggccgggcgggtcccgcggccatcgggcggacgcggaaggggcaagggcggggcggcgagacgcttcccggaggaagtgagctgcccgcccgcagcccgctcctcgccccttccctttctagtccccgacgtccctgagaggaatggggacgacagccctggttcgggagcgcccgctctcggcccggtgctgcgctgggccccagaagttgcgaaagaaaggacctcggccctgtcctgagcccctgtgggccgaagagctccttgcctagctaggggcatctgcactggaaagatcacttaaccgtgggccttcgctctcttaagcgaaagcacgttgcaaacccctgcttccagtggtaagactcagagaatgctaatggttaagaatcacaaggactccctcttccacctccattctgctcattgctcaccgtcggaggaagccccgggtttcttccaggagctggggacccccctcgaatgttcctgctgaggctgctgtgccaatagatcacagtggttaagatctagagccaaggtacacaggacctgatctaaaaacaagctgtcctgcagccagctgtgttgactctctaaacctcactttactcatttgtaaaataggagtaatattcccctcagagagttatgagggttaaaggaggaaaagcatggaaagagtctagcgccacggcatggtccttacttatctaccagatactaaactccgtgaggacggtgatgagatctgttgtagccctggtcattgacacatgacagatgtaaagtgactgttcaaacagcccatcagactgttgtataccaaggcacatgctaggtgctatctaggatacagagaagagagtaagaagacccaggaacctgtgatctattcgaggaggcgggactttatacctgaaaaaccaaagtgatactttccaagtaatggagccaataatgacttcagagtcagagtggttaagaaagatctgcatggggagaaataaagcctttgatgaagattttaaaagatgagtaccttcctgggccgggcgcggtggctcatgcctgtaatcccagcactttgggaggccgaggtggacggatcacttgaggtcaggagttcgagaccagcttgaccaacatggtgaaaccccgtctctactaaaaaatacaaaattagccgggcgtggtggcacatgcctgtaatcccagctgcttgggagactgaggcaagagaattgcttggacccaggaagcggaggttacagtgagccgagatcgcgccattgcactccagcccgggcaacaggagcgaaactccgtctctcaaaagagggggaaaaagaaagagtaccttcctaaaagaggaggcatttcttcaacacacctttccactcacaccacccactccctgcatcccagtgttcctgactctgtttctgtaaattaatctatttttccatattggaaaaagggcattctgtaactgtttgtaactatgaaaacagttccttccacaatgaaaagatcaggaaagtactgagtacattcaagcagatgtgtgccttagaacaagtttcaaaaaaggacagtagagcttacctatcgtgggatcagatacttcagggatacaaagtaggtcctattaaagcttaacatttgtccctttagtaggtgggacagtcttggaaattatagagaaattagaagaaatgcaattaaaactttcgttcattgcttcaggaagaatttctttttctgttttagttctaatgtaagagattgttaacagtgagagtcccggagtaacatctttatacttaagaaaatgtatttggaatcgtaatgtactcatgctcatgcctttacatgttccaggtctacaggtccaactgctgccactggcagtaatcgaagacttcagcagacacaaaatcaagtagatgaggtattgctctgaaatgttggaaatatgaattttaaacaaatatgagtactctggaaatctgtttagaaaaagtatcatcaaagtgtgaatgtaaagcaaattctgactgtatcataattgtaacgaaactttgctccctgctgtgctggaagatctaatctaagcaaaagtcagactttctaggtttcacgcttgttttcctgtgatagaaacctgctcataacatttagctcaggagaaataaaaaatcatatgcctaaaacatgaacatcactccctgagtgcattccccaagaagcactttataaaatcggataatacaatgttaaggattaggtctttagattgctcaagccaagaccagttcttctgatcagatttttttatcaaaatgctttgtcttcttactaattgtccagcctgagcaagcctctctgtagaattcatctctaatggttgtccattgacacacacaaagtagatactgtcaaactccattagctcagcaaatctctgtttgtagaattcttgagctagaggacctccatcttttgttctgcgccgtatgtggagaaccacagcagaagattgagaaattcagactagtgtttccacattcctaaaagccgtcactgtccgacaaatatatttcggtctttctgcatttagctgccctgaaaaaacagttaaagttatgtcagatactgttgttaaataatatagtaatgttttgatctgatggttttgttcatgaacttatacaattttagattttcacagtaagaaacccattgtaattctgtcctgcctggaaattctgtttacttacaaaatcaaattggatttttttttttagccaaaggaattttaaggagagttgtttttttattgaggcaaaattaccataacatacaactaaacattttaaactgtatataattgagtgttatttagtatattgataatattttgcaaccattacctctttccattttcagaactttttcatcaccccagaacacctcatgcccatttagtaatcattcactatttccccttcctcccattctctggttacctctaatcagctctctctttctgtggatttgcctgttctgggtatgtcatataaaaggaatcatacaatgtgtggccttttgcatctgccttctttcacttagcacaaagttttttgcattcattcaagttgtaacgtgttgtaccgtgttcctttttacggttgagtaatattccattgtatgtgtatacacaatttgttgagccatccatttgttaatgagtcttcgagttgtttccacctttcagcaattatgaataatgctgttataaatattcacaggaaagattttgtttagacataggctttcatttctcttgaatgtatacctaggagtagcattgctaggtcatagtagctgtatgtttaattttacgaggaactgccaaattgttttccacaatagctgcaccattttattttcccaccagcaatgtccaagagttcctgtttctccacatccttgccaacacttgttttccattttgattataaccatcctactgagctctttgggttttcatttgcgtttctctaatgattagtgatgttaagcatcttttcatgtgcttattggccatttgtatgtctttgaagaaatgtctgttcaggctttgcccattttttaattgggttgtttgagttgtgagagttttttatgtattctggatattaaatctttctttatcagacatgtgatttgcaaatactttctcccattctgtggcttgtcttttacattttttttattttttttatttttatttattttttttgagacggagttttgctctgttgccgaggctggagtgcagtggtgcaatctcagctcactgcagcctccaagccccaggttcaagtgattctcctgcctcagcccccagagtagctgggattacaggcgcccgccaccttgcccggctaattttttgtatttttagtagagacagtggttcaccattttggtcaggctggtctcaaactcctgatctcaggtgatccacctgcctgggcctcccaaagtgctgggaatataggcatgagccaccgcacctggcctgataatgttctttgatgcacaaaagtttttaatttttatgaagtccaatgtatctgtttttccttttgttgttcttgattttggtatataagaatccacagtcaaatccaaagtaatgaagatttacccttatgttttcttctaagagttttatggctttagctcttacacttagattattgatccattttgagttactttttgtatatagggtgaggtggggattcaacttcattcttttgcatgttggctcttcaattggcccagcactgtttattgaaaagactgttggatggccttcgcactcttgtcaaaaatcaattggccatagatgcttaggttgacttctagactctcagttctattccatcagtctatatgtttgtccttatgccagtatcacactgttttgattactgtagctttgtagtaagttttgaaattgggaagtgactttggggagtactgccctcttagcaatattaagtcttccagtgtgtgaacataggatgttttcccatttaatgatgtctcttaacaatttctcttagcaatgttttctagtttcattgtccaagtcgttcaccttttggttaaatttattcctaggtattttattctgttagatgctattgtaaacacaattgtttccttaatttccttttcagattatttgttgctggtgtatagaaacacaactgatttctatgtgttgttgttgtaccctgcaactttgctgaatttgttagctctagcagtttgttgtggattctttggtattttttatatagagagaatcatctgcaaatacagataggtttattcttcttttccaatttggatgccttttctttctcttgactaattgctctgttcagaacttccagtacagtattgagtggcagtgtgaaagtgagcatccttgcctcgttcctgatcttaggggggaagtctttcaccatggagcatgatattagttgtggattttcccataaatgccctttatcatattaaggaaattcccttctatccttaatatgctgattgttttgatcatgaaagagtgagcccattttttctaaagtgaaagtttggctcaaagtaataaagtgctgacctgaaagaacaatgtgcctgtagattgtctttgaagtctctgtgcctccattttttttgagacggagtctcactctgtcacccaggttgaagtgcaatgacgcagtctcacctcattgcaacctcctcctcctgggttcaagcgagtctcctgcctcagcctcctgagtagttgggattacaagcgcccagcacccctcccggctgattttcttatgtttttagtactgagacagggtttccccatgttggccaggttggtctcgaactcctgaccacaggtgatccacccacctcggcctcccaaagtgctaggattacaggcgtgagccaccgcacctggccctgttcctccattctttgtgcattacttgctgtgatcacactcatctaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaaggtaattatcttttaactgacctttacatttaaccccccttctccattctcagagaattaacaggctacagataatggactttcacgactctgggaggtgggtttgacttcctccacatggaaatgtgggtccactgtgaatccgaaacactgactgcataccctttcctagccccacactaggaatcctctatgtgctgtggctgatcttcagaagatgcaggtagaacaggaatatccaaaatcactcacagtcatcagcccctcccaaccctctaccccagcagggccccaaacagataggagagggctggaattggtcagttttctcgtagttctgtgaatggttccaaggtcaagggaaagaaatgctagaaagccacagtgtgcccaacagaagagtagaaagcagctctcccaggagcacgagccaaagcagattttatacagttagcgtgctgcaatcagatccagatgtatcctgtcctctgccttgtttacaagtgacactttgagacacagggcaagctgagcagcctttccatatgtggaaaacttgtatacacaaacaaatgcctagctagaggccacacatcatttgaacatcttttaaaagcagataagttaccttcaggccctaattgagaacatttaatttaggctttagaaattattaattactccagactgtatgcacctgaatttccctttcagtgactagatgaatattatataatactcttcaacaagcacattatgtctgcatttgaaatgtgatatggacatatgttttgttacagatgtgggcaatcgggattactgttctggttatcttcatcatcatcatcatcggtgagttacccttttctaaactgattggaaaagtcttctccatgtgttcacagaccattgattttgtgtacaagaactcagattaaaatttccctccgaaatgttagttttggctaggtgcggtgactcatgcctgtaatcccaaagctttgggaggccaggagtttgagaccagcctgggcaacatagcgtctctacaaacaattgttaataattaaccaggcatggtagtgcacacctgtaagtcccagctactcaggaggctgagacaggaggattgcttgagcccaggaattcaaggctgcagtgagccatgatcatgccactgccctctagtctgggtgacagagtgagaccttttctcaaaaaaaaaaaagaaaggttcatttattccaaggttttcagttttctttaataaatgttttaagtacttgagttttgtataagtctgagatttgatacaaacattaatcctttgaagttagagaaaatctattcatttccacttcttttctctgaatatatttttttcacatatttccttttatgtaatgtagtggttaaaagcatggagtgcctgtgatccatcctggctccaccaccatccagctgtatggccgtggacaagcaatttaatatctctgggtttctgtttcctcatttgtaaaatggggataataatagtccctgtcttgtttgtttgtttgtttgttaaaggacagatctggtaaatatataaaaattggccgggcttggtggcgcacgcctgtaatcccagcactttgggaggctgaggcgggcagatcacgaggtcaggagatcaagaccatcctggctaacacggtgaaaccccgtctctactaaaaatacaaaaaattagccgggtgtggtcgcgggcgcctgtagtcccagctactggggaggctgaggcaggagaatggcatgaacccgggaggcggagcttgcagtgagccaagatcatgccactgcactccagcctaggtgacagagcaagtctccgtctcaaaaaaataaataaataaaataaataaaaattgcttaggttggtgcctggcatataataataaaaataatagctatataaataatatatatgtatacacaaacacacacacaactattattatataatattcaaacaactcactgccatcggtagcccagtatatgagaaccgaaacatgacttctttcattgatagatggatgttagtggatgtttccttttagcaggaaggtacagttacttggatccttttgactctagtctccttcctctagccctctatagaatggagagaagccagtagtaggaaatcagcccagtctaatttctgatcacatttagactgcagcattggatgttggcttgggattcacactgagagactaacctgctgtttcccctgcctttttgcatctctcctccttcttagtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagaggccttcttaagttccagagtgctataatctagatgtaatgttgtcactaattaattgccattactcccagttagttacccttgtcatttggcattattttcagaaccacattttaaacctttgggtaatcagatttccaacttatgccttccagaaaaaaacactactgcctaacacaaatctgtgataacaacaggctgtgccttattttgataattttctgattccctagaagagaaccctctactttttgtaagcactactgactctcgctgtatttaagatgctggtgaagagcttttgctcttgcattagatttgaagatgtttacattgttgttattgttatgtatcacttgctaaaaatattgttttaatcagagataacctctttaaaaaaatttttaaagaactatggctatgaccaaagcttctattttgccaaaaagttaaataccgataaaatggccttaagtgtattcctgacagttaaattcagaaacgtgccaaatggaactcaaggtgccccttcagaattaaaatcattaccttgtgtgtgaaccttctacatcttcataggcctttcttccttttgaaaggctgtagacagtgtggctccccttctgattcagtattttgcatgggggttagagaaggtttgaggtagactctgaccgtctcataaaagagttctacccagcagttggcagattatcagctgtggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattatgcctgcaattaggcattggtcaggggtgaatggctcttttcacagagagtagccaaccagagacctttgctttgatatcatcaactgcagagaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttataaacatgattgtggcacctgtgctccttgtagaggaatagctgcacctggtccgagtcctaaaaatgccattccttgctgctccccatacctgtcccttagaagccccgaaactgtctcccccttttctcaccagcccctctctaggtactctacccttttggtacccagcatttccgcataccccagtgaacagaagaaaaccgctccccttgtgaaaagtgctttttagtataggcgatgaggaggaaactggcttttacacaattaccaaaattcaggatgtggctttggagttccctaaatagatggtctttctaaagtgatgtgcagagccgaccccgtctgtggtagactagatggctgctggcatggaccctgggatagatgagtggataggtgagggacatccccagacacatggctctgttcctgtagatccttttttcctcatgaatgtatttccattcttatcgtagaacccctaggaaacaatataatacgggtggaagaggacttttgcttatgtttacaataggaaaatccaagtccctttcccgaattacaggtcccacgatgatctggtcctttctagttttctgacttcatgtcacacgactctccagctctctcttctccaagcaaggtactccaccaaagtatagctgttgacatcggagagacttgtgcccatgagactttcaacatcagggtgtggcttgaaggccagagttagctatgaatgaaaacaggcaaggaagccctgagggagaaatggacctgataaagtttgtttcggtttctcatcagcaaactgacttctttccaaaggtcttctgcaggtactttcagctctgccgggtctacttcctcacccgcggcaggcgcctctcatctcaggttgaaatccgccttccccactcgcggcaggcgcctctcatctcaggttgaaatccgccttcccagaggcctgccctgctgatctgactaagcaggctctggcctccccactccacctttctcccagttactcttccttccagtagtttgttttctacacatcgctttaggctttatgaacttgtttatggggttgtttgtatggctttctcaataaaacgtcaactccctgggtggcagggactttgggccactgttctatccgctgggattccaagcgtccctacccagatctgcacgcaataaatgcttgctgaacgaatgcagtttgacaaaacccagcttcggaggagagcaagccaacctagagtatcgcttggaagatataaggtggtttattcaatacctaacatgaacactcacctcacttttcccctcttcctttacatacaatttcatccatccaacaaatactgaatattttttctgtaccaggcagcgaagaggggcggcactctgcactgtacctttcatttctaacatgttgagatactaaactgagctttcagacattttttttaaagggctctacaacttcttttctgaaacagagtgtcttttacgtttgtcttcctccagttgccaaatgaatctaattttaggaagtgcagggaagtgttttaagttccaccgtcaaaattctgtttctgggccggtgcagtggctcacgccagtaatcccaacattttgggagaccgaggccagcagatcactggggcttaggagtttgagaacagcctggctaacacagaccatctttaccaaaaacacaaaaattagccaggtgtggtggctgcacctgtagttccagctactcgggaggctgaagcaggaaactggcttgagcccagaagacggaggttgcagtgagccaaaatcgcgccactgcactccatccagcctggacaacagagcaaaaccctgtctcaaaaaataaaaaatctgtttctaaaaatcgggtgggctttttaccagggctgctttatggcccggttcctccaagtccaccccactcaccgaaagagttagcggaggatgggggcggttggggtgggctcggtaggtcacgggcggtgaaaaccgtgggaacccagaaagacggccaaagcacgatgaggaccgctgccggcagcccgccccaccctgggctcctccccacacccgctcgggcagccgggagccacctacaaactccaggactcgaccccagagcgctggcctgagccgcccctgctcgcccccagtccccgcctctccctccctctaatgcccccgccctcgacaccgtcgcccccccgcccctgcctctcgctccccacgtctctcggcacccccgctcccatccgcccccccgtccccgcctctcgcccccatccgtccccatttccagcctccccctgaccccgactcaagccccccgactccgcctctcgcccctctctgcccccgcctctcactcccctctccttccccgcccgcctctcacgtggaggttgggccggacccgccccgccccacagagcccgggtcccgcccccacgtggctggcagcttcctggccctatcatttctgcgctggcttcagcggctccgccccggcgccgtgccagggggccggacactccagtcgcgcggcacaggcctgaggccgctgagggccaccccgtcccctgcccgcccgccggcctgctgggattggccgagcgccggcctccgcccgagcccgcgcgttatgtaacgcgccccgggggccccgccccctcgccctggcttatataacccgggcgcaccggctcgcgccccgccccagggccaatggaggcctgcggagtcggccccgacgaccaatcgcacggcccgggggcgggaccggtcacgcggcggcagggggcgcggcgccggctgctgaccggcacgcggcgagcctcgagactgcgcgagggcggccccgggggcgagcggctgtgcgcggggccaagggcgggggcagcaggtgagtgcgcggccgggcgggagttctgggcggccgggcgggagttctgggcactcgcgcgcggcagaggagccccgcgagccctgccctcggtactgggggcccccggagcgtggcgcttccgagccacccgcctccccgggccccatccctcggcgcgcgggaaagttggggcaggggtgaggaccgcgcggtcggggcgccccagccagccgggccgctggcgtcggactgtctgttccatttgtcccttgtcacccttgtctcctccccctaggccggagtcctgaaagtcgagcgagctccgggttttgaaaatgttggagggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacaggtgacgcgctggcttcaggccgagggccccatgcgttcgttgtccttccctggagcagggaaagggggacctaaatctttttattcttttgttttcaagcccaggggaaagtgtaaaggggagactcgggcaatgtaggatgaagtgatccgtgacactgaagaaaattaccgaagagtatcaggagggaaaagtggttacaaaagttagctgagttggggctcaagtggattaagggaaagtaagtggagaatgtttgtcattcaccagttgctttgcctcgagttccccacctagaggaagaggggtcaccaccctgtggactgatgccggtagagcacttagaaacttacctggcttgcagtttgtgttccctaagccgcaagatgctgttgtcttcagaggatgaagttgtaatttttttttatcttccagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaaggtaaacaagccggagagaaatttcatcctacgaatgcaccaggactcatacaagcagccagaggagtggtcagtggggtctcagtcagacaaataatttgagctttttctggtgctttgtggaagatgagcaaatctacaccgattccattcgtgtcttaattgttcacatgtgaaagaccaggaaaactttatctgtataatagtgtataatacctatgcaatgttttgctcatgtgttgcaagagagtagagtttagcataagcacattttgaaggctgaccttttaaagaaatattgtcttctatggaagttatgggaaaaaaatgcattccacgaaatagttacctttacatgccgtacacatactttcaaaatgcagtaatgaggctgggcgcggtgcctcacgcctgtaatcccagcactttgggaggccgaggcgggcagatcacgaggtcaggagatcgagaccatcctggctaatacggtgaaaccccgtctctactaaaaatacaaaaaattagccgggtgtggtggcgggcgcctgtagtccagctattcgggaggctgagacaggagaacggcgtgaacccgggaggcggagcttgcagtgagccgagatcacgccactgcactcccgcctgggtgacagagcgagactctgtctctaaaaaataataatgataaaaatgcagtaatgatatatcaggaatttaccaaactaaaaatgaaccattgtaaacactttttctctctgacatttccagggatttcattaaagccatattctctttagcacaaacctcagtgcttcatatatgatatgttcctgaatgacagagtactgtttctgctccccccgcaaaaaaattgtgtatgcatctgaaatttttagttagtaccttaaatgtatcttgcttcctgtgatccagaacatgcagaattcataaaatcaaatcttaagtttgcacaactatcagtattttaggtaaaagcagaaaatgatctgtttttgagaaaaatgcactgaggtgttctcatccgaaaaaaataatccagcttgatagtgatgaaatggtttcctaaagatactgttgtcactggactacctgtttatctccctgtgtttcttagcaaacagtgagtttttccagattctcagtcagaatggagcacctcaggcagatgtgagcatgtacagtcttgaggagctggccactatcgcttcagaacacacttccaaaaacacagtaagaattcatgcattttgccatatcaacctgggtgacttttcctaagggcctgctctagatgtaggcttttaagaaggataacaacgtttcagcaaccacaatttgagagaagcaaaggaggaactgctaaagaggcatggtgtagcttctccgcccttgccagagaaaacatctaaaagcagaagcagcccgttctgtgtgctgtgcagctcagtgactttggttatgaggtgcttctagctccttagcattcccaagctctcttgaattaagagaaaacaaaaattacactgcagagtaatttcctgcaccttattctaatctccgaattgttaatttctatttatatcattcttagttccaatacctactacttcaagttgtaacaactggatgttatagaacaggtgagttgagatgctgtcatttttcctaaaattttggaagagacctttagtatatcttttttaatctctcttcttgtttgacagagtaatcttcatgtttggttgatacggtggagattacttattttaagtaacataattgttacttaaagattttgtaatagtggaacgtgcgcaatccctagtattataacagtgcttattttatggactggtgtgtacatagtactgtaggaggtgctatggagatttttaaaaatagcttaagaaaatatttgtcttttaagatatttaaaataaagctagagaggaaagtatgccaatgctagcaaacacaaactgctgattataaataagtttcatttatgtgtaatggaaaaaattagagcagtgatgcttatgtaatgaggtttgtcaaggacagcttcttgaagaaggtgaatcttcagtgtgtcttaaagcatagaatctgcgttgatgacgagaacaccgtccacccaggtgtatggcacagtttgcagagaagttatgtgccatacgtattttagtctgcatagaataagctagtatattttttggcatagaaattgaaccttcagtaggtgaagtgcaggtcttaggagaagatttaagaagcatgttggagaaaattatttgaggagttttgttgcatttgtaggttgtgcctgtgtattttaagatactggtcatgttagagatccagaagaaatttacctttcagggaatattgctagtgagtatctcaatatttgcatttattttaaatgtttttcataggatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagaggtaacaggaccaatgttcagatgtctatctttcctcatcaagatcagtttcattcttacaggaatagtacagaaattaacatattatttagaacatgcacactatctggtttttcttattcctgttatagaaagtcacgtgatgaaaacagcattttaaaagcttctgataacatactcaatacgtttgtttccattttgtcacatctgtttcacagatgatatgtcataaatattatttcattaccagcgtattgtatagtggtttagttgctatgaaggctctgtttcctttaagttaaaattaaatgtttttcctccttcatgatttccttgtatgagaaattttactttggagataaaatttggatcattaggctgggcaaggtggctcacgcctgtaatcccagcactttgggaggttgaggcaggtggatcacctgaggtcaggagttccagaccagcctggccaacatggtaaaaccccatctgtactaaaagtacaaaaattagtcaggcatggtagtgcatgcctgtaatcccagctactcaggaggttgaggcacgagaagcacttgaacccgggagacagaggttgcagtgagccaagatcacaccattgcactccagcctgggcgacaagcgtgaaactgtttctggggaaaaaaaaaaaaaaaaattcagatcattagctctcttacagtttttcttgcccctgaaacttatgagtcttattactttgttttccttctggaatgcttttctttcataattcaaagatgcctattgcagttttctttgtgacattcagtcctgtgtgatcttaatttatttctttttagtcatccttcattattttatattctttgtgaagtgtctcttaaagagctttaaaatatatatatatatatatcagcgttctctttgattccaagcccttctctctaattaaaaaaaaaattcattgtagtaaaaaacacatacagtttactatctgatatagtttggctgtgtccccacccaaatctcatgttgaattgtaactcccacaattcccatgtgtcgtgggaggaacccagtgggagataattgcatcatgagggcgtctttcccatgctgttctcgtgatagtggataagtctcatgagatctgattgctttaaaaatgggagtttctctgcacaagctctctctctttgcctgctgccgtccatgtaagatgtaacttgcccctccttgccttctgccgtgattgtgaggcttcctcagccacgtggaactgtaagtccgttaaacctctttcttttgtaaattgcccaatcttgggtctgtctttatcagcagcatgcaaacggacctaatacaccatcttaatcatttttaggcattcactccattgctgtgaaggatgtttacattgttgtgaaacagatctccataactttttcatctttatatctgaaattctatctactatttctaattttttacccagtagttaatttaatgaagggtagctttgcgtgtttcttcttccaattatagattgccccatcttttaaaaatatttttacataagctctagaaaacatgcatgtcatccctgcttgcttctagctcatctcttttcccatctttcaaaaatactgattttatttctcatcccctttcctaaatacacattttcaacctttgtctgtatttgtttctctgcttttgttagctgttcattccgtaaacatttatttaataatcacgtgggtcaagaactagtccggatacagatacagctgtgaacaggacatacacaatattgtctgccaggtctttcccattttttccccaggtatttttccttcagcactgcctgtggcttttcagccttttcatttttgctgattactgattactgcgatatttcccttctgtattagtccattcttacgctgctataaagaactatctgagactgggtaattaataaaggaaagaagtttaattgactcacagttccacatgactggggaggcctcaggaaacttacaatcatggcagaaggggaagcaaacatgtctttctacacatgatggcaggaaggagaagaatgggagccgagtgaaggaggaagccctttataaagccatcagatctcttgagaacttactatcatgagaacagcatgggggaaactgcccccatgattcaattacctccctccgggttcctcccaccacacatggggattatgggaactataattcaagatgagatttgggtggggatacagccaaaccatatcattctgctcttaagccctcccaaatctcacgtcctcacatttcaaaatgcaatcatgcttttccaacagtcccccaaagtcttagctcattccagcattagaccaaaagtccaagtccaaagtctcatatgtgacaaagcaagtccctttcacctatgagcctgtaaaatccaaagcaagttagttatctcctaggtacaatagacgtacaagcattgggtaaatacacccatttcaaatgggagaaattggccaaaacaaaggggctacaggccccttgcaagtctgaaatccactgaagcaataattaaatattaaagctccaaaataatctcctttgactccatgtctcacatccaggtcatgctggtgcaagaggtgggctcctacagccttgggcagctctgcccttgtggctttgcagggtacagcctcccttatggctggtttcatgggctggcattgagtgtctgtggcttttctgggctcacagtgcaagcttttggtggatctaccattcttaggtctggaggatggtggccctcttctcacagctccactaggcagtgccccagtgaagactgtgtgggctccgaacccaaatttcccttacacatctctcttagcagaggttctctatgagggctccgcccctgtagcaaacttctgcctggacatccaggcatttccgtacatcctctgaaatctaggcagaggtttccaaacctcagttcttgtcttctgcacacctgcaggaccaacaccatatggaagctgccaaggaatagggcttgcaccctctgaagctatggcctgagctgtaccttggtcccttttagccatggctggaggtgaagcagctggaatggagggcatcatgtcccaaggctgcacagagcagtgggggcctggacaggcccagaaaaccattttttctctcgtaggcctcagcctgtgatgggaggggttgctgtgaagtctctgacatgccctgaagacattttccccattgtcttggtgattaacatttggcttcttgttacttctgcaaatttctgtagcaggcttgaatttctccccagaaaatgggtttttcttttccattgcatcttcaggctacaaattttccaagttgttatgctctgcttcctctttaatgctttgctgtttagaaatttcttccgtcagatacctaaatcatctctctcaagttcaaagttccacagatctctaggccaggagcaaaagttgccagtctctttgcatagcagaagtgtcctttactccagtcccaacaagttcctcatctctctctgagaccacctcagcctgcacttcattgtccatatcactatcagcattttggtcaaagccattcaacaagtctctaggaagttccagactttcccacattttcttgtcttcttctaagccctccaaactgttccagtgtctgcctgttacccagttccaaagtcacttccacatttttgggtatctatggcagcaccccactctttgcagtacaagtttactgtattagtccattctcatgctgctaataaagacatacccaagactgggtaatttctaaaggaaagagttttaattgactcagttcagcatggctggggaggcctcaggaaacttaacaatcatggcagacggggacatgtccttcacgtggcaacagcaaggagaagcgccaagcaaaagggggaaaagcctcttataaaaccatgagctctcatgagaactcactatcacgagaacgggatgacggcaaccacccccatgattcagttacctcccaccaggtccctcccttgacatgtggggattatgggaactacaattcaagatgagatttgggtggggacacagccaaaccatatcaccttttatgtaaaatcttaatatgccctgaaataattcttttggatctcaaaattcacttatgccataaggcacgatataattctagtttactctttatattgtacttttgccttatgaatctcaaggattgatactgagagcagttggttaatgccaccccctttataggctatgcctgcgttacccccttcgattccttactttgagcacatagaacatcaagaggacttaggaagcaatccactcagctgttgtcaacctctggtcctgtattagaatatgtttctatttaacatgtcttgtacaaacctcttagaaggatctgaccattacttcttcagagtacgcttttagaaacaagcatcacatatttacagcctaggaatggaaatgcattgtgggtgcacgtctgctgtcttagatcacgtagtctagctttcagtggtccaggacttctagtgagtgcagttggagttcatgtgtctggtgtgatgaataaatggtataagcaaactgacctcacagtagaggccgttttctgtagaagattataccaatcttcagtgctttattaatgctttctgactcttctgtgatcgtctcttagaagtatcaagacctgggctgcttattcaatattttggttgttttggattttcactgtttatgctaccttcagtgtatattttttgaacatctcacagttttccatggttcctataactgaagacttcttgtttcagtgaacaaatgcccaaaagatattcaggaagctctaatcagaggaaatacatatagtcaacaaacactgggcagaaatttcagtcccctcatctcctaaggcaaatttagacatttctgaattatcacctcataaatcaataaaatgggtgcagaaatcaatggaattgctagcaaatcattggcatgagggttgtgagaaaacattaataaaactctgaagattggtacagttttctggaggtttatccatacacaataaagtcataaaacgattctatcatttaacctaggaacacaactttttgaaatttatccaaagaaagagcttaaagaaaaaaagaaaattatatatcgtatagctaagaagctgaaaatagtctgaattcccaactttttagaaaggtccagactattacaatgggatggaatattaccaccagaataattgtgtccaaggatcattacattgacctttgagatgatgaacatgggcagtttgggaactatgaaaagtagtaaggggaagagataaagccgattctcactgttatacctgaggttcacggttccagtaccaaaaccaatactagtatttcccaattctagtattgtgactggatctcaaaatgaaggaagggggttctattttaatcaaggagacctctctctcttttaaaaaatagtttgttgtttgataatggtgcaacattgtttcactgagaaagacctggataagagggagtgactgaccaggcatctttctttctagcagctgcacggtatgaatgtgctccggtgaaaccttttttctgcaggatccggtaagtatagtggctcgtggaagccagcaacagtggattatgttctgagtttattttgcagttggtttgattcttgtgtattcagctcacttctgttgcgagatacaaaaaataagacttggttattgccacaaggagttcgtattttgattgagaagagacatactcatgagaaaactagataataatgcaataggaggctgggcacagtggctcacacctgtaatcctagcactttgagaggcagaggcggaggcgggcggatcacaaggtcaaggggtcgagaacatcctggccaacatggtgaaacggcgtttctactaaaaatacaaaaattaattagacgtggtagtgcacgcctgtagtcccagctactcgggaggctgaggcaggagaatagcttgaacctgggaggtggaggttgcagtgagctgagatggcgccattgcactccagcctggcaacagagcgagactctgtctcaaaaaaaataaaaataaataataatgcgataggaaaaaagtctagaaaaataattcttaactctaggagtgtataagaatcactagatgtgaagtacactttaaaatgaccattgttttgggctcttttttgtttagctttttgtttttcagtcacatttaaaattaatttttgaaatttttaatagctttaaagaaagcaagagatttatatttgtgagaaggatttaaaagatctagagacagtgaaccagaagaaaacagatgaaaattttaacagtagttgattgctggtaggaattactactgaattttttatcttctaaatttgctgcaatatattattagtgttccttttatgttatatacataatatataattatatattctgttatgttatatattatgtatataagatgatataataatatgttcttttgtaataagaacaaatattttgaaatgacattgtgattgccagttttagtattgaagttactaaatgctcaagatgtttagagagaagaaaaaccctcatgatgaaatagtctaatattccagtactccatggaactgggggacttgagctcataggctctggatgcttgggggggacggcctgagaaagggcacagcggtgggaggggctgtcttgttccagtgggtcattcacaagtgagttgtatgaagatcttagaacagttcctgcctcctaataagtgctgtatgtgtttctgatgttaattaatattttggggtgctttctctgagccaggcactttgtcagtgctgggattcaaacagttcttgcctcacgtaccttaaattctgtgaggaggagaccaataataaacacatattcaaatgcctgtgttggctggtgataagttgtgtgtagacagtaaagcaaggagcgggagttctgggaagcgggagattgccgttgtattcagggtgatccaggaactcttaggaagtctaattggaaacagcgaccagaaggagggcagggggtgagccacaccggtatctgaggggtggcaagtgtctgagaaagtgtgttccaggcagagggagcagcaggcgcagaggccctggggtgggccatgcctggcctgtgggaggagtgacacggagctgctgtggcctgagtggaggaaggaacgaggatggaagaagacgggaaagcacgggccacaccacagggagcagtgacttctgcacgaagtgttttatttcagtttatcacttgcttattttcaaaacgttttactttgggaattttcaaacataacacaaaagaagagaagataatgtaatgaactgctgcggtgtcatcacccagctttttaagaactcgaaccctggccagtctggcgtcatctctgccagcagcagttctttaaccccctcttcccaggttaccagacagcgtagctcagatctcgtctgatttcctgcatcagtatttcagaatgtcattctaagagaggaagttctcattcacgtttgtggggttcaaaatggtcccatctttggccagtaggaatccctttgggttggcccctgtacccttgtgagagtgccccatggtctttgacagcttccattgttttaagcatgagacaccccagacccattttagacattccttagcccagacttggcatcagccatttctctaaggatccctggttccttttggtgggaaatggcattcacatttggaggccaaatctggatggtagggatggttattgctacagggttatcattgcatctagaaattttcagtgaacagaggtaggaaacgttcatttcagtttcctttttttttttttttttgagacaggatctcactgtgtcccccaagctggagtgcagtggcacgatctcggctcactgcaatctctgcctcctgggttccaacaattctcccacctcagcctcccaagtagctgggactacaggcatgcaccgccacagctaatttttatattttttgtagagacggggtttctccatgttggccaggctggtctcgaactcctggcctcaagtgatccaacctcctcggcctcccaaagtgttgggattacaggcgtgagccaccatgcctggcccggaaacagtttccaatatgaaagactggtgttggctgcagtgttgaagatactttggagggggaagaagggaggcagggagggcagttagaggctgttacagaggtacaggctataggccagcgttccggggggaggtataaatatttgtatattctggatattttttacacttgatcttagccaaaaggccaagaagcgatattctggatatttttagagaacaaattaccagaatttattaatgggttatatttggagtgagtgtgaagtaagagtcaaggataataccaggagttttgggctggagttatcattttttgaggcagacgaaattctaggaaaatcaacttcctggaggtggagagaaagaatgtggtgcttagttttagataagttaagtttgtgatacctgttgaatatccaagttgagactctatgagagtctggagttaaggaaaacttttaggctagaggtagatatttgggtcatcagcgtgtaaatggcatttaaaacctttggactggatgagcctggaaaatgcattcgtggatgtggagggaagctggaaggtgtgagcatggatgtgagcatggatgtgggtcggcagcaccgggacacagctcacttcccggtgattctcttttcttggtgaaatgggaagcaaggtcatcagttgagggtgcagagtgggagaagattctgtagtgtgtggtagaagagaaagagcaaggtggggctgggcgcagtggctcacgcctgtaatcccagtactttgggaggccaaggtgggctgatcacctgaggtcaggagtttgagaccagcctgacgaacatggtgaaaccccatctctactaaaaatacaaaaatcatctgggcgtggtggcacgcacctgtaatcccagctactcgggaggctgaggcaggagaatcagcttgcacccaggaggtggaggttgcagtgagccaagattgtgccatcgcactccagcctgggcaacagagcgagactccgtctttaaaaaaaaaaaaaaaagaaaaaaaagtgaggtggaagtaggaacagactagagaatctctggcagtactaaagagcccctcaggattggtagtcacacctttacgtgctggcgagagagtaaatggatgattggtaaaagttggggagtgtgaattcagtcttgggctttttgacttctaggtgaagtggcatctcccagtagaagcatccgctgggcagctgcagtggtaacaccgggtgatgatatttgaagtcatcaatcagagcctcccctgccgagaggttctttgtgaggagtggaaaggggtgcgccctctgggccagggacagggcttgctgaactcggttttagcctcaactttttctttcctcctcagccagatgcctttatagatggagcacctgacctcatgcaagggccctcatcactgaagctggagacgaaattggttcttagagagtgtagaaagggacgactgagaactagccccggggcatgattgcaggggaccctgttttctctcttgtgacacctgttgtagatatgtgaaatgagacagttatgcttgtccctcttcacagcagaaggggaaaagtcaaactgggaatgcatcacatggaggccaggagaaaagtcatggaaccactaattctgtttttacactcacagtaatctaagccagttctttacacaacctcttactcgttgaataatagcgaaaatttaagctaacatattctttcttttgaaaacaaacatgtttaaacattttagatgtgggtatgtctgtcttggaaattaccaataaaatatttctcccagccttgtttcgccatgggccagtagggtgcgtcaggaccagcactaatatctttaatctcctcagtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaaggtaagtcagtagataagatgcagaaatgtcagcaatcagataggaacatgggaaagtctgtttacgtcagtcatagaacaacaaaaagagctcttgggtctccaatttgacccttaaactcttcaggcatttgaagctggttttcattgatgtctctgtttactgacttttagcttcttgtacagtcattgtcttcatggtcagcatggctgaacgaatggtctcagcacaggacttggtgacagatacggttttctagtcctctctctgctggtgacccattcagtgtggccttttgcttgtgttgtgtgaaataagagtgctgaaattgtttcccagagaggccacaagagtgattttatgtttttgaagtcttctgaaactccctgagtaaaatgtatattttatcttgtacgagcagaactatatttctaaatgcatatatcaatacataggcagcttccatgtattactgaaaagtcagttcagatgtaaaatgacatatgctttcctgcaaattaccatcctatgcaacagtcacacaataaaaaccacagggcttatgggaaaaatgggtttaggagcacaaaactcaaaagcttagttgcgtattaaaaataagacaggaatcaaataaaaatgataatcgtgccgggtgcagtggctcacgcctgtaatcccagcactttgggaggccgaggcgggtggatcatgaggttaggagttcgagaccagcctggccaacgtgatgaaaccccgtctctactaaaaattacaaaaattagctgggtgtggtggcgtgtgcctgtaatcccagctactcaggaggctgaggcaggagaactgcttgaaccgggacccgggaggcggaggttgcggtgagctgagatcacaccattgcactccagcctgggcaacaagagtaaaactctgtctcaaaaaaaaaaaaaaaaaaaagataatcatttcatgcatgttaaatgattaggaaatctacaaacactacaataaatatggctcataccacaggacggactgaggtagcaggtagatgtttgaggtgtgtatgcatgtttttgtgtattctttttttgttgttgttttgctttgctttgagacagggttttgctctgtcactcaggctggagtgcagtgtgtggtcatggctcattgcagcctcagactcctgggcttcagtgatcctcccaccgcagcctccagggtagttaggaccacaggcacgcaccatcacgcctgactaattttatttatttatttattttttgtagagacagggtcacactatgttgcccaggctgttctcgaactcctgggctctagtgatcctcctgccttggcctcctaaagtgctgggattatagatgtgagccatcagacctgtttttgtgtatttgtaagtggttcctttgaactggatgctgttttctgcattcacttaaggcttcttgaaaatgaaatagcgcacaagcaaatgagatattagcatttgctcataccattccctaatatatcaatcacttcatttttttttttcttgagtctcgctctgttacccaggctggagtgcagtgggcacgatctcagctcactgcaacctccacctcctgggttcaagcaattctcatgcttcagcctcccgagtacctgggattacaggcgcccaccaccccaccctgctaatttttgtatttttagtagagacagggttttatcatgttggccaagctcgtctcaaattcctgacctcaagtgatcggcctcccaaagtgctgggattacacgcgtgagccaccgagcccggcgacacttcatttttaaagcaagcattagaatagaactgaccataccaattttattacacaaagaatatccatatggtactaaataacatttgtagtattttcgtttgtttagttatatgcagctactaaatctgattaaactttttagttactccagttttaactattaaatgatttatgatgagccaggtgtggtggcaggcgcctgtaatcccagctacttgggaggctgaggcatgagaatctcttgaacctgggaggtggaggttgcaatgagccgagatcatgccactgcactccaacctgggggatagagcaagactctgtctccaaaaaaaaaaaaaaagagagaaaactatttaatgtgcacattctttctctctctgtttaaaattgactttaataggcttcaaatttttacctaattaaaatgtagttagtaatgaaattactatcatttaactgtagctttggctgcttgaaggccaggcccctaaatgagatttctaccatttcatatagattttgttctctttttaatatgttaagtggttagttaggtggataattaattagatatttgcctttaaatgggtctttgtttttttttccttagctcctcggatcccagtgaataaaagaatcttcaccaccacacacaccccagggtgtgtttttcttgaagtagatgaaaagtaagtacttctttaagcctaaaagaaatttgtttctgaaaataaatataaatgtgaagaagattacattatgtttgcatgtttatacattatgtaattgaaatctgtccatttgcctatttgatttttgttacatggaaatgtatgttgtctaaatttttaatataaatattttgcatattataaagtgattacaagttgtatttgatttctaaacagtatgctttaggtaggccaagaattatttcattttacagagaagacaatgaacccaccggccagtttgctgagaacagatgtatagtatctgattgcgctcaaactgggaccaagactctggtcttctagcacttattctggtgttatttacacttgccaagtgcttctcaaatcagtttatgatgaaatttcagttagtctgaagtgggggcgaaggtggggagaacagattattttttgtaaagaattgttctttattttgaacttctgtccttcctacttttgggggatgttgaaatagtctttgttatttaaaggatagtgatagtaggtagtagttattgcttaatgctgttttttagtatctttatttggaaaaagtaaatatcagtatcactacatcagtatcccgcattttttccccacatttattttaacattttacttactcatgaaattcaaaaatctgggaaccaacacaccacaccacacataactgaaaagcaaaaatgtcagaaacattttcttgataattttttattaaaaaaatttaacatctgaaaatcagtgtatttgataatgtctaccctgaaaccaaatagtaatgtgtgagatacttaacctgtataaagtaagaaaattcagctaaatataattctaaaaatagcttaaatctcttgtattagaaaatatttgtgggtttttacacagggaaaatatttacggaatccagttttttctgaagcatccttagtcttaccatcgtaagtttcccatgaacctttatcctgaaactatttctgtgtactagctgtctgtctatctgatattaccttttgggtgacattgtgttttttttgttttgtttttgagatggagtctcacactgttgcccgggctggagtgcagtggtgcggtcttggctcactgcaacctccacctccctggttcaagcaattcacctgcctcagcctcccaaataactgagattacaggcacacaccaccacacccggctaatttttttatattttcagtagagatggggtttcaccatgttggccagactggtctcgaactcctgacctcaggcagtctgcccgcctcagcctcccaaagtgctgggattacaggcgtgagccaccgtgcctggcctaggtgacattgtttttatgtaattttaattatgctgtatgaattagcaacctgcattattcatttaacatcatcagcatctttctacgttacgatgtgctttttgtagactttttaaatggcaacataaacataattatggagggcatcagagtcctctaaggaacttgctaaaagacagatgcctggtcttatttccagagcttctgatttagtaagcatacagcgagactgtggatctgtattttagcaagttcgctagatgattttgatgtaatgtgtcagatgaccaacatgtgttagattatacagccatttcccccaggatgggcacttgggttctttgctgtttttataaatgctaagataaacagctttgcataaaattgtctcacatttagaatgaaatacagaagtatttttaaaagtgtataagaattacctgatgagtatgccacctgtgttgtgtatctgtatcccagagcagtgcctttgctgggttacctacctcaggacctgattggaacatcgatcctaagctacctgcaccctgaagatcgttctctgatggttgccatacaccaaaaaggtcaggacctactcctttataggaggaaatatttttctctcattgatttgttctaatttttcttttcatctcattagagcgcaacctttaaccagagaggcattacattgaagctgctaaagcaattgttttctatttaaacatactaaaacaggccaggcacagtgggtcacacctgtaatcccagcactttgggaggccgaggtgggcgaattgcctgaggtcaggagttggagaccagcctggccaacatggtgtaacccatctatactaaaagtacaaaaattagccaggcatggtggtgcacgcctgtaatctcagctactcaggaggctgaggcacaagaactgcttgaacctgggaggcggaagttgcagtgagccaatatcatgccactgcactccagcctaggcaacagagcgagactcaatctcaaaaaaaaccactaaaacatttacaaataaatggcttaaaaaggacatttgtaatcagtatctgtgttaagtaaatcctatttttgtcttattattttatatagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgtaagccagtcagttttcatattttctaaaacatctcttgtatcaaataatattccttagcttattgactgccctctgactcaattgacacataaactaaataaagcacagatttgttttcggtgctttggggagacagtttgacagtgtgtaccgtgagccttaaaagaagtcataatatcagccttaaagtagcttaaatatccatcattaagtaaactctggaatatttgcttgatgtattattatattggtcaatgaaaatttttgcagagatcacataacatggaaaaatatttgatttttaaatataaaaatcagcatacaaaattatttatacctatgattataattatgtttaaaacgaacatactatgaaataaggaaaagagaattgaaaggaaataaaatatgaattttggttaagtgtaggtactaggacctacaagtgtttctttctttctttttttttttttttaaagatctctttagtgagcatgtaaaactttttatatcagccttccgccatcaaattccacttgtttgtgtctttttttttttttttctttgagacaggttctccctctgttgcccaggctggagtgcagtgatgcgatcacagctcagtgcagccttaacctcccctggctcaggtgatcctcccacttcagcctcccaagtagctgggcccacaggtgcctgccaacacattcagccctttcttgtattttttgtagagatggggttttgccatgttgcccaggctggtctcaaactcctgtactcaagcatcctcctgcctcagcctcccagagtgctggaattttgaaggtacgagccactgcgcccggactgtgtccattttttaatacttcttttcctgccagcacagctgacaccagcttgtttgcttgctgttgcccatccacgtaacagcatcatgtggaatggaacgagaccagcccggcccacaacttcttgtaggctacagtacccctacccctaggcccttgaatctttagtcctttttttttttttgagacaggatctcagtctgtcacccaggctggagtacagtggcctgatcgcggctcactgcaacttccgcctcctgggttcaaacgtttctcctgcctcagcctctccagtagctgggattacaggtgcacgccaccacacccagctcatttttgtatttttaatagagacaggtttcaccatgttggccaggctggtctcgaactcctgacctcaaatgatccacccaccttggcctcccaaagtgctgggcttacaggtgtgagccatcacgcccaaccctgtggtccatttttaattgaactctaggccttttgacctggctctaggtttccctctgatgtctatcttttttaagcatggaaattttacttgactccagtatcatgctgagatcgagaagttatgttttttggtatcttgttatacagcattgtctacatgaacatgaacctgagaacagtagatctaccagtaagacgtatttgatcacctgttaatattacagtagagatgatgccgagccatggtgagaagaggtctcaaggttgctcttacctctttctactccagggtttggcccctccgcagagcacgtgtagaacttaatggaagaaatgggctcctggccgccctaactcatgagactgatttgtgctagaaaacgaatttgattattaagaaatacagctgccaagtaattaccattggtattgctcagaaaggactttgtcccttctccccaccccataccccccaagtacggaaacctattgggaaatgaacatgaaatccgatggttgcttggcatgaacgtaggaaactgcagccagtaagatgccttcatgaggcttccatctggggctcgttgatggtctgtgttccccagccccagtcagggttaaagatacggcctggatttctgaagctctcttttcagttctttgatgaaatatatgtgaaattatgcaacatataatgaatattcagaatgttttcagtattttaaaaaattacactggtatttacatcttaacaacaaagattatgtgagggaaaggatttaaggtctagtaggtattaatcttgctcataaaatattaattattcattatatttataaagtataaagctctgtgtaagacagtgtgctgggccttgagaatgtaatggtaatcaaaacattctctttaccatcaggaaacccacactgtaatgggagagacagtaaataaaaatggcactgtcatatataactagagtttggtaagtgtgacagttgaaatgggaagggggctgcaagactgtttagcaagggaccctgcctgtatctctctcagtccttcccagcagcactgcaggcaagcaggtcaggtgtcctcagctctcattttacaggtaaaatccatactcagtaaactagagtagccttcccagggatcacttcgggaggagtgaaagtggagactgcagccaagttttctctcttactcctacttcacttcacatacacagcaaagcaataaatacttcatggcatttttgttgctgtttcatgaaggctgtctccttattgcctgcagattaatcagttctgcattacatagttactgacttaaaatacattttagtgtcttacgcttataatcccagcactttgggaggctgaggcaggaggatcacttgaggccaggagttcaagactggcctgggcaagatagtgagaccccttctctacaaaaaatttaaaaacaaaaattagttgggcatggtggtacgtgcctgtagtcccagctacttaggaggctgaggcaagagggttgcttgagtccaggtgttcaaggcagtagtgagccagaattgcaccactgcactccaggctgggcagcagagcaagaccctgtctcttaaaaaaaaaaaaaaaaaatatatatatatatatatatatattacatacacacacacacatacatacacaatttagttttgtagaaattttcacaactaggaatatgtaaatctcataaagcaatctgttctatttccatttcactcaaaaaacaaattccaaatacctctgaaaggttttcaagctcacaatgtgtttatattaggaaccaggtgtacttttattcccagatcaatcaaccatgtatttgttcctttagcaaatatgtagtgggtgcctgctatggaccagacactgttctaggtactgaagatccaggagtgaacaaagtagacaaaatacctcaccccgtggcacttacctggcagtgggatatagggagagacagttacataaaacgtatagtgtgtcaagttgtgaaataaggttatatattcaggtactgcttgccacagacatatggtgtacctgacgccatgcagatagatattgatctagatacagtctagatgctaaagtagagaaaggcgattggtgcagctgttccactgtgatggaaatgtgcagggtgagtgaatagtccctagacgtggagatattcctgactgcttttacgatactgtcagcatcctatgattgtcttgataatttctgcctttgggaaactgtttcagtttttaggtaactgagctgcatgtatcagttgagaaacggcaggctggcataatggaaaaaggacagcccaggcttgggggtcagacgtaggcggattcaaatcctaactgctgcttctcggttatgtgaacttgggccagttcctcagagtacctcatcccctgactttgtgtatcggggataattcctactttctgggttgttgtgagaactccgtgagctgatgcagctgattcagtatgcctcacgaatgggacttgctttaccaaggtacccacaggcagtacagtgtggtggcacacagggtggactctggagcccagactctggtcccttcgtgaacacctgcttcccccttacctgccaggccacctggaaaaggtatttaatcaggtgaaggagaaaatacgtgtaaagcacttggaataataaggattttcaaaatgtcaggtattcttctatgttataaaaactagtacaggctgggtgcagtggcacactcctgtaatgccagcactttgggaggccgaagcgggtggatcatttgaggtcaggagttcaagaccagcctggccaacatggcgaaaccccgtctctactaaaaatacaaaaattagccaggcgtggtggcgtgcacctgtaatcccagctactcgggaggctgaggcaggaggatcgcctgaacctgggtggcaaagattgcagtgaaccaagattatgctactgcactccagcctgggtgacagagcaagactctgtctcaaaaaaaaaaaaaaaaaaaaaaaaaaactagtatagtacagtgcctgtcacatagaaggtcccaagtaaacatcagttccttcccttctttgtaatcctctctgttggcatgtgtgccattcactgtattcaggtcatagattgaagatgctctaaaatttgagtataaataagaccgaaggtattgtaatagctacattttcaccactagggtgggttgcagaactgtcttaattagatagcttaagtgttaggtgcaataaacattaaatgttgtttggaaaacttggggtctttaaaattcttagagtaagttacagttactcagttactgtcaaattttgaaaccagttatttgctgaagatattttagtagctaaggaggttacttgtccctgatttcagatttgtacatatatagcactgaaaccattacagaaagatgagtgctttagagaaacttaaggggcctgttaatgtctcatttgtttcttattattttctgtaccttcatgaatagaattctagcctcatattttttctttggagtcaaagaattgttttgtaaaagcatagatctattcttggaatagtctattaaaaatcactttcgacttcatttaaattgtttgactcagtctctcactgggcattttctaggagcccactaaatgaggatgtttttgctaccaaaattaaaaagatgaacgataatgacaaagacataacagaattacaagaacaaatttacaaacttctcttacaggtaaggtgagattgttaaaaatgcaaagttccctgaattgtgttttgttttaatgctcagtaaattcacttcacaaaaataaactgtaaagggagacaaatctttgccctctacattccagaaatttttgtctttctcttttcgtttttaaattaaattttattctttgttccttattctgtgttacacagaatatttttgtaagaacccattgtaagacagcaaaccacgtgactgagagaattattacattccaaaggcaccagcgtgctcagcctttgggttttggcttcaggatttttaaaataatttcagttttaaagatgggaggagagggatggtaggtctcagtttctcttaactattgtaaggtaaaagtgggaaaatgtatgtgttgaaataactaaaggtgttttctacaagagattcaatgaataagtggtaaatagaactaatggtgtcgtgtagagtaactgtcctcggtggttttcagaatgtctcccataaaatctctagggtgcatgaaatacctgccacgttcttggaaaaagtataatatatagttagtttgttctctgtattctaaactgggcataaagaactagagtttattttcctgttttaaaaaattaattatactatggctttttaacaatatgttgtcctggaaatacctacctagactagaacataagaccttgctcttgaaaattgccgaaatgacagaggagtgcctttcgtgtcagcatcagcattaaaagtaccaacctgcacacacctaatttagtatttcaggaattgtcatcttaatttttacatgattctagatgagctctgcggtggctgcatttgaacagccagcaattctggacttgttcctctttgtccttccagccagttcacgtgagcgtgtccagcggctacgggagcctggggagcagcgggtcgcaggagcagcttgtcagcatcgcctcctccagtgaggccagtgggcaccgtgtggaggagacgaaggcggagcaggtgcatgggcttatgtcacattcttatacaggcatcgtgttttctgtactacctcggttctgaatgtggtgacatcttagtatatattcctgacttgaagacctcaactgataacagatattttcatccattttggtttggaaaaaaaagtctgtaaaaagaaaatatcacctttggaaagtgatatttgaattaattgtatgcgttctaaaaattagcatattgtgaacagatttatttagaatttgttggtaccagtatactgtggcatggtgcaggaaactggattaaagtgattactgtgcttcagtcattatatcttcaaagaaacagaagctaagtgtattttgtttatgtatcttttagtggacatttttataatttttgaaacatattttatcattcctttccctaagatgaccttgcagcaggtctatgccagtgtgaacaaaattaaaaatctgggtcagcagctctacattgagtcaatgaccaaatcatcattcaagccagtgacggggacacgcacagaaccgaatggtggtggtgagtcagcgaatggtggtggtgagtcagccggcagccccaaggatctccttccatgggctgtcactctctgcatagacgtcatgtatgtgattcgtgagcataaagtcatgaccctgtgttgctgcttttcatatttcttgatttgcctagatagcaatagtaatagcaatagtagtaataataatggcagcaacaaatactgttctgaaaggaaatggtattagaatgtatttgtaacagttgcagttcacttttactgaagaattaacttctctgtaaataccaacgaattatagatttccctccctacatgggcatctctttaaacaaaaagagtggattttagaatgcattttaaataataaagtatattaaaatgaaaatccctttctgtcatttcaaacagaaaatctttgtgacctaaattcagtgaaaaactttggctcttttcttgacatgtatttacttttctcaaatacaaggtaaggagcactcaaaaagagctggatcagtagtaaaactggcatcatattgaaaagttaacctagttgcattgtatggcataggggatgttcaataatatagaaatcaaattagattgacatttaaatttagctaactttcccttcatttttcttcctgaatgttaatataacttggaagttgtgatggatcttggtcactaaatgttattaacctctatcattgtcaaatgtagacgttttacacagtggggtgaaatttttgaggtcaataatgataacagctatatgcttcaggacttgacatgatttacaccacagaaagtcaaactgctgctcccagaggtgacatcactgggaactttcttagtttgtactgctgtaacaaaatacctgtgactagataatggataaagaacagaaacctatttcttacagttttggaggcgaggaagtccaagatcagggcaccggcaggttcagtgtctagcgagggccaggtctgtgcttctcagagaacatcacttccttgaaggggacaaacgctgtgtcctcacatggcacaagggacagaaaggcagaaagagacttagctagttccttctagcccttttgaaaggttgcaaatcccattcatgagaacagagtcctcatgactttgtcacttcctaaaggccgtggctgttcactgtcacattgagttttaagttgcaacataggagtcatgggggacacacacattcaaaccatagtagagcccattggactccccagacagagcaagtcctgttctttcattttttttcttttcacctcgataggaagttgagcattccattggtttcttctgctgttacatgtaagggcacaagataggaatcacagctgctttttttattgtcccttgaaacccctacatttctcctctgcaaaagaatttatcttaaatacaatttttactatatagattattattccatgtcctagcagagagaattcttttaggaggtttttaaagctaaagtgtctaaatgtttttctcattgtctggtcctgctagtcctgctcacagctgcctgggcctaggatctcatggtagtatcacagtttcacacactgacctctgtcctcatctcagtatagcttcccttctcacttgctgcattattcagtttcttatcatcgaccatggatcttgtaatgccatcggtactatttttttttgaaggctatatctttaagtagatggcaatattccatcattcactttttataaaattgaagctgcaggtggccgggtgcagtggctcatgcctgtaatcccagcactttgggagcccgaggtgggcagatcacgaggtcaggagatcgagaccatcctggctaacatggtgaaaccccgtctctactaaaaatacaaaaattagccgggcgtggtggtgggcgcctctagtcccagctacctgggaggctgaggcaggagaatggcgtgaatccgggaggtggagcttgcagtgagccgagatcgcgccactgcactccagcctgggcaacagagcaagactccgtctcaaaaaaaaaaaaaaaaaaaaaaaaattgaagctgcaggtaactccgtgtgcttatgcagctactttagaaactgaaatgttcccactccttagatagattcttacatttggctctaatagcacacacaggatgtgactttggagaagaaggaagatctcttgccatttggcacagctttggagaaccaatgtttctgggagatcttgattttattaacatttggagacctacaagtttaaagagctacagaaacctttatactctttgcttgagagacatgaggatgcaacttaaaaatgttataatttaaatgttagaaattgactagagatgtataccaatgaaaaggaaaatgcttagttaagcatgatcattgtttacatgtgttataggaacttaagtttaaaatttatatttatctttcttacaacctaagagcaaataatgctttaaagagagattttaaaagttagtatgagttaatatgggagggcaaggaataacagggatatgtaaagccccttcagctacatgtacagaggccaactacaagagacatcattgaggaaatctgggaaaagtaagtgtccatgtctagggtgatggaatgtctgagtgagagaagaggacccttaagttgaacaggttcagagtgagattgcttccagtttctgctcagggatgtagagagccagaaacagcatcaccccagacttaacaacagaaaaatctagatgaaaggcaagttcaagacctttcttgacttcagagtgctgaggttacagagcagccagcaggcctaaaatctaaggagagaaacatatttgcagggaggagcaagatgcagcactggattccagtgcaccgacagcctgagtcaagtaacttgcaaaagacagaccctctcgaaggcacaatgccaaggaaagaccaaaagctgaaagtggagcagatactgagaaaaaacaaaaaaattacccaccaaaccagccaccagctgaggcaagaagtataactagaggaatttgaaagctgttgtacatgctgtagaaccattacaatactcaaacctggcctaaaaaatagattaattcagaggtctaaaagaaggaaaggcatgcccagtctctgtgtcctacacaagttacacagttctcaacaagaaattatgtagcatatgatgggcaagaagggaaaaaagaaacctcccaagagacaaaaccatcatcagaacaagactcagagaggacacagaagttggaactatctgacagggaaagtaaaataattatgaatgatgtattaaaggctagtggacaaagtgggcaccatgcaggaccgggtgggtaatcacagcgtagagatgggcatgaaagaaaccctcaaatggaaatgtaacatctgtaacatcaatgccagagatgaggaacgcatttgatagcactcaacacagcctggaaaagaatcattattcaagctgaaacagagaaagaagaatgaagcaaacagaatagagcattctaagaatttggagacagcctcaaactgtccaacataggtgtaattggaatctcagaagaaatagttgaagaaataacagtcaggaattttctactgagccaaagaccatcaagtaagttaaatacagaacaaaaacaaaacaaaacacttgggcatatcatattcaaactgatggaaaaaagaaaatcttgaaagcagagaaaaaagacagattacatacagagaaacaaagacaagaattgtaacagacatttcttcagaaaccatgcacactaaaaagacaatagagtagcatcctcaaccagaaaaactgtcagcacagaattctatacctagtgaaaacgatatgtaagaaaataaaggtgatataaagattttctcaaaaatcatgggaatttatttccagcacacttactccacaagaaatgctaaaggaatttcttagaaagagtatgataccagaccaaaaacttggatctacacaaagaagtgaaaagcactggaaagggaataaatgaagataaaataaattctattttttaatttttaaaattaatcataaagataatggactaaagcaaaaccagcaaactggatttatagcatatataaaagtaatctttgtgacaacaatactacagagggtgggaggaagttattgggaatatactattagttccttatactgtatttgaaacagtattttattatttggaggtagacactgagtactcaagaatatatattggaaactttaggaaaacaattcgaaaatattttttaagtataaataataagttaatagaggaggtaaaatggaatttaagacacttaacccaaaatggtggtcagaaaccaaatggactgaagccgggagtggtgttatgtgccagctactaagaacactgaggtgagaggatcacttgagcccaggagttcgagtccagcctgggcaacgtagccatacttcatctctaaaaatacacttaaatagcaaatggaacaaacagaaaacagctagtggctggcatattttaatccagcaacatcagcaatcactaatgtactgaatatatgaatcatattcaatccagttattcatattcaatattaataatctccgtacactaatttacaagactgaaatcgtcaaattggatgaaaagatccagctacatactatctacaagaacccattgtgaaaataaacataggttaaaagcaaaagagtagaaaagatataccatgctaacacagaagaaagcgggaagctgtattattacacaaagtaaacttcagaacaaggaatgttagtagagttagaaagagagactgtgtaacagataaaggagttgattccttaggaacatagaacagtcttacatgtttatgtatctaatatcagagctgtttattctctagccataatggattaaactagaaatcagtaacagaggtatccagaaaatcctcaaatgttcagaaattaaataacttcatacttacaaataatccacaggtcagagaggaagtttcaagggaaataaaaacattttgggccgggcgcagtggctcacgcctgtaatcccagcactttagggggccgaggtgggcagatcacaagataaggagatcgagaccatcctggctaacacggtgaaactctgtctcgactaaaaatacaaaaaaaaaaaaaattagccaggcatagtggcacacacctgcagtcccagctactcaggaggctgaggcaggagaattgcgtgaacccaggaggtggaacttgcagtgagccaagatcccaccactgcactccagcctgggcgacagagcggactccgtctcaaaaaaaaaaaaaaaaaaaaaaaaaattgaattgaacaaaatgaaaagagaacataaaatatgtgggatatacctaaaacactgcttaaagggaaatttacagcactgagtgtttatatggaaaaaagaagaatggtctcgactcagtaatctaagcttcctccttaaaaataagagaaaaaagaacaaattgtttcacaagtaagcaataagaaggaaataataaagaccagatatcaatggaattgaagagaaactaagttaaatcaaagggtaataaaattaataagtctttagccatactgaacaaaagaaaagaaaggaaggacaggttggactttatcaaaatttaaaacttctcctttttgaaagagactgataactatggccataccaccctgaacgtacccaatcttatctgaaaggcactgataagacaaatgaaaagacaaaatagttgcaaatgatatatacaataatgaagttatatccagtgtacataaagaacgctcaaaactcaagaagacaacccaattagaaacatttttccaaagaagatacataaacagtaaatagcatatgaaaagatgctgaacctaagtcattagacaaaaaaaatgtaaaccatatgagataacaccacacatctgtgagaatggctaagtttttttaaaaaactgacaagtgttgacaaggacacagagtgaccagagcactcacctattgttggaggtaatgccaaattgtacagccactttgggaaagtttgacatttcccataaagttagacatactcttaccatgtaacttagcaattctattcctagtgatttacccaactgaaatagaaacttaagttcacgcaaaaacctgtacatgaatatttattacactgttactctccaaacacagaaacaacccaaatgtcattcagcaggagaatggataagctatgtgtatccacacagtgaaatgctacttaacggtgaagagaaatgaacttgattcacagaccattgtatatataaatcttaaatacatttcattaagtgaaagaaggcagaaccaaaaggttacatattgtacaattccattctggaaaagcgttctttctggaatgctctagctctggaaaacagatcagtatttactatgattgggtagagaaggaggtgactacagagggacagctgtaaggacatttttaagtcatggaaatgttcttttggttactgtggtgatggatacacaactttccgtgcatttgccaaaacccacagatttgtgcactccatctcaccccaaaatgcagagagaacccaagatgagatgcaggcattgacaactgagtccaactgcattacagatgacaggcctaaacacacggaaggggtggggaagaacggagctcagtagctttggaaaacagtgcttcaactgtatctcctagggctaaatacaaaattatgaatgtgcacaaacactgtacgcaagttggtgtattcgtttcccaccagagtatgggttagcaattctaaagcgactttatactagggttgaacaaattgtggaagccgctatagataacgatgaccagactcctcactatcaggaaagccacacaaagcagaagggaaggaactccatggtgctggattggcgcgaacagtttcagtgtggactcatgccccttttgtttaatatacagagggatggatagacacgggttagtatattataccaaataaagaataaaacagatggttcaggcaaagattatcaaggaatgaaatagaggtgaaaggttaatggagaacttaaactttgagaagtttaaaagaaacagaatacttgcgtgatctcaaagtattcctccaaaacatattatttattacattgtaaaatagtaactttacacaggacaaacaaacctgagagacaccatgttaaccaatgaacaaggtaacaaaacatactgacatcatgtaccctgggatgatgcacaaggaaggacactgcacctccgccgcattctctccccaaatgcataacctcaatctaatcatgagaagacatcagagaaactcaaatcgaaggccatcccactaaagttctgaccctgaacggaaaacaacattgagtggtaaactgataaaatccaaagaaggtctgttttccagttagtagaatggtaccactgttcatttcctagttggggtcattttattatggttgtagaccatggtaacattagtggaagctgggtgatgggcatataggaactctattgtactatttttgcaactcttcaagtctaaaattatttcaaaattaaaagttaaaaatcattaatgagtgaaaggtaatacagtcatttttccataatatgctctgaaaatagagaagcctcttccaagccagctaaaaatgaccagcatctaacacttctacaaaacttctcagtagtacatgacataattagttactccttccttaagaaagttttcattcttggtcgctgtgaggccaaaccttgcaggattttctgttatctttccagctaccctttttcagtctcctttattggctcattgtcctttataggaagtttttagtgcttaagcctggaggttttttcttctctctaaactactacatctacaatggtggccacttgccacatgtggcaatttaaattcaaattcaatacaattaaatgtaatacaattaacatttagtttctcagttgctttagccatattccaagtgtttaatagttacgttagcacatataatactagtcagcacaaataatccatcagtcatcacagaaagttctgttggacacaggctccacctgggagatgctgtgtacttcacacagcatcacgtaagatgcacaggtcttcccacattccacccttagtgattgccagggttgatcagttgtacaggaagcgtcagcttaacattggaaagctccccatcaaccttaaacctatggtttcattccttgataatctttgttggaaatttttgtttcattccttatttttctaaatacaatcgtagccattctatgtgtaatgtgctctgcaccttattttattcattacgtgttgtggatatctttctattagtgcattttagatctgcactcatttttaatagccgcatgatattctgttgatatatacatgataaagtgccatgatttaattttggtaagaaagtatatgttcttaattacatgctgggtacttttaattgcacatccctttattctgtttcaggtgaatgtaagacctttacttccttccaccaaacactgaaaaacaatagtgtgtacactgagccctgtgaggatttgaggaacgatgagcacagcccatcctatcaacagatcaactgtatcgacagtgtcatcaggtatgagaccgcaagtttggataccatgtaagtctgttccggaagcatacactgccactgtagagacttcatagaatttttaatagctgctctgacttggtttttcactataaatcagtagacgtttatggcgtgcctaacacatacgctgaacatttcagaaggcacaaaaagctagaagatgcattccttctttgaaggaactgtggtatagttcagaagacaagacctaattttgtcaaaattaaatggtgtaaggcaagcttctccaacccatggcccacaggctgcatgtggcacaggacagctttgagtgcagcccaacacaagtatgtaaactttcttaaaacgttatgagatttttttgtgtgatttttttttttttttagttcgtcagttatgattagtattagtgtattttatgtgtggcctaagacaattattcttcttccagtgtggcccagggaagccaaaagattggacacccatggtataagatttgaaggttaattcaagaccacagtaaaagaaatgttacaatccagtgattgaggctgggatggtcagggaagactttatcaaagaagaaagtacaaagtatgccaaacataagtggcatgagaaaagcaaagaggtgggaaatggcacaattagggaacaggtaagaatgtgtggcctaattatgttgttacagatacctgaagagctacaacattccagctttgaaaagaaagtgtatctcctgtacaaatacaacttcttcctcctcagaagaagacaaacagaaccacaaggcagatgatgtccaagccttacaaggtaacaagaatgcccctcagagttaaattcaaagaactgtaaatacatccttcttgtttctctttaatgtcttatattgttataagcataaaattctggtttcatattacctctttatgacagtaaggtttaatttctcagttacaaacttctgtaaactgggtcttttatgtaaatttctcgttgggaatttttcttttcactgtcagtttctcttacaccaccagctggtttgcaaatcccagccatacctaaatcagaaatgccaacaaatggacggtccatagacacaggaggaggagctccacagatcctgtccacggcgatgctgagcttggggtcgggcataagccaatgcggttacagcagcaccattgtccatgtcccacccccagagacaggtaccacactcgcctcttactttgaaaatatactcaactttaactacattgtgatgagaaaacaaaagtcatgaataccattcgctcggttgtaacttctaaactacacatattttttcctttctttagttcagttaaagtatttctggaaacattatcatgtttatgttggttacatattttggacagtatttctcagttatgttatttgtcaatgaaatcagttgacacatataaagcacttaatacagtacctagtaggtaggtattagccctcaattagtgttagccattattaatgcaattattgatggcactgtgttaggttacttccttgctgactttcacagaatgtgttcctttcacctgcatttcaccatcctgtattgtgatgagctcagtcacacataccttcagatttttgtattgctgtgatggcaatgaatagagtactttaaaactcttcatttaataccataatttcttggtaaattattctactgtcttcttattcctctttattgccacttgtccttttgacattttcatcactcataacaatttgggtagatgaaggaatggtgacaaatacgttaaattgggttttcacatgatctctgctttatctttgctagtcttcagtggcttatcagctaatacgtgttaagccatttctgtgtgccactgtctgctcttagttcttcactggtatgatctcattaaatctttccaacaacctgtgagatggagagtgtggtactgacaggagatctgtggattggtggagaaagatcagagagcattacgtttctaattagtcaaaagtagagtttcactggaactgagctagcccctccacagaggagcatatgcacattttttagtgtgccttttaatattttgcattcctgtgtgggcatgtagctgttcataatacagcccatacaggaagggagggtatcacccaatatgaaaagctcttttttttatattctgccactctgctttctatactctgctcttatatgaccgtttttaatgaatttatactaaagtctatatgctttaggaaatttttactgctattagtttcttctgatcttaaatcagcctcaacatttacagggccacatctttattccatggagaaaaagcagaatcagagcccagatattccttaaaacatatctctatgtcttttgctttctgaaaagctcatattcattagctcagtttgcatcctgactcagatgagttgtgtctaaggacgatggtcacaaatgcatttccttgcaagttaatgtcttcattttatgtgtggaacaattaaaccacaaattaggcacagtaacttcacttgcccaatatgacacagcccatgagtagtagagtagggaatcaagtattgaccattagtctctaggagtcgttgccattacagatactttgaacctaaagcagggtctaattaagatggaatgtaggccaggcacagtggctcatgcctataaccccagcattttgggaggccaagacaggaggattgtttgaatgcaggagtttgagaccagcttgggcaacatggtgagactctgtctacaaaaaatttaaaaaaaaatttttttttttttttgagaaggagtcttgctctgtcacccaggctggtgtgcagtggtgcgatctcagctcactacagcctccacctcccggattcaagcgattctcctgcttcagcctcccaaatagctgggattacaggccccgccaccatgcccagctaatttttgtatttttagtagagatgatatcaccatgttggccaggctggtctcgaactccggacctcaggtgatccgcccaccttggcctcccaaagtgctgggattacaggcgtgagccacagcgtccagccctaaaataattttttaaaagatggaatatgagatacaatgactaagccaatcaataaaatgcaaatttaaaataaactcaatcccaaagaagagcaggaaaggaggaatagattaacaaaaaagaagcagagagaacaaaccaaataagataatagctctgcatgcagctatgtcaataatgacataaaattgactcaacacttcaattaaaaggcaaaaattgggccaagcatagtggttcacaactgtaaccccagggactcaggaggccaaggaggtaagattgcttgaggccaggagtttgagaccagcctgggcaatacagtgaaaccccatctctacaaaaaatgtttaaattagccaagtgtggtgacccacacctgtagtcccagctacttgggaggctgagacaggaggatcaattgagcctagcttgagctcatcttgggttcgttgctacagtgagttctgatcacattactgtactccagctgagggacagagcaagaccctgtctctaaaaataagtaaatacatgaaaggcaaaaattctcaaaacagatttttaaaaatcaagacctaactatatgcaaagtacaagtgaaattcacaaatggattgaaagtaaatgaatggaaaaagatgcacaagtgaaaccgtaagcatcagaaggctgcagtgccttattaatatatgtaaaatagattccaggacatcttttcataatgacaaggtggtcaattcatcaggaagacataacagtcataaatgtatattcattaataacagctttgaaagctatgaagcagccgggcgtggtggttcacgcctgtaatcccagcactttgggaggccaaggcgggcggatcacctgaggtcaggagtttgagaccagcctgaccaacacggagaaaccccatctttactaaaaatacaaaattagctgggcatggtgatgcatgcctgtaatcccagctactcaggaggctgaggcaggagaatcgcttgaacctgggaggtggaggttgcagtgagccaagattgcgccattgcactccacacttcagcctgggcaacaagagcaaaactccatctcaaaaaaaaaaaagctatgaagcaaaaataaggaaatagactttccataattatatttggaaaattgtacactccctctctgcaactgataaaaacatagagaaaaaataagaaacagatgatccatacaacactatcagccaccttgatctaattgacacttagagaacgtgagacccagtaactgtataatccacaaccttttcaagtacacacagtatgttcactgagaaatacgacatgttgggctgtactatgtctcagatttaaaaaggattgatggtgtgtgaactgtgttctctggctagtgaattaaattaaaaatcagtaataagatatttcaacccaaatgtttataaatcagacaacacatttctaaatctatgattcaaaaaagaaatcacaaagagaattagaaaacatttccaaatcgatactgaaagtatagcatactaaaatgtatgggatacagctaaaaacggggcttgtaagaagataaatagctttaaaaatgccgttagagaagaaatgtctcaaatcaatgatctaaagttacagttttaaaaagtcagcaaaagaagtgaaataagtccaagatagaatgaaggaaataataaagacaaaagcaaaaatcgacaaaatagaaaacagacaatagagaaaattaaagctaaaagttggttttttgaaaagatgaacaaaattgataaactccttataccagtacagagtggtcttggttcatgtagctgtacagtaagtcttgaaatcaggtagtttaaatccttcagctttattctttttcaagattgctttgactgttaggtcttttgtctatataaactgtagactcagtttctcggtgccttttttccttattatggggttgtattttcctgcttctttgcatgcctggtgattctttctaattggatgccagatactgtgaatgggtaccaaatatatttgtattcctataaatattcttgatctttattctgggtcccagtgaagttacctgtaaacagattgatcctttcaggctttgctttttaaatttgctaggcaggacaaatagtgtgtagtctaggcctgtttttcctctgctacaaaggcgagaccttcctgagtgctccttgtgatgcctcaggagttaggagagtctctagtctggcggatgggaaccggcactattccgcagcttgcgtgagcttcagctcttgttcctgctaatcctctcaggtggttttttcctcccatgaatgccctggtgagtccttggaagccctccaggctgcacgctggggcagtcctcgggctcacctcccttgtttcttatcctcgggggtcactttccttcagtgtctgaaacctattattttatatattttggcttttttttttttaatctcaggaaggtaagtttggtccctgttactacaacttggccagaagcaaagccccctgtggtgctcatttagtcacaggccacttctggatgcagagtgggccaaacctacccaaaccacccggatgctgcaccacaggggcgagctggaatggatattgggggagccctctacagtgtccaccacaaaatcttttgttgttagaagtaatttttttagaagcaaccccaaaatagatacaactattctatatcaataaaagaaattttaatgtacaactattatatatcaataatagataaaaaagaggcaacccaaaatccatccacaggtgttcactttagtaaactgtgctatgcatataaaatggaactccgcagcagtgtagaagtatgagacaactgtctagccactgataaagttctccaagggatatggtaaagtgaaaaaggtgtgttgatggttaatgtacgtatgtgcctttgggtaaagatggggtcagagaggaagataatctatattcatcctcgttcatatgtaataaactggaagggccaggtacggtggctcatgcctataatcccagcgctttgggagtccaaggcagatggatcacctgaggtcaagagtttgagaccagcctggccaacacggtgaaaccctgtctctactaaaaatacaaaattagcccagtgtggtggcacatgcctgtaattccagctacttgggaggctgaagcaggagaatcacttgaactcaggaagcagaggttgcagtgagccaagatcacgccattgcactctagcctgggcaacaagagcgaaactccatctcaaaaaaaaaaaaaatgaacaaatacaaaatttagccaggcgtggtgtggcacacgcttatagtcccagctacttgggaggctaaggcagaatcgcttgaacctgggaggcggaggttgcagtgagccatgacggcgccacttcactccagcggaatggtcttctgcaggggaaacaaatgagaactagacagagcgtggacgggggtgaggggaatttactacatgtctttattaatacttcctgatttttgaaccacatgaatatattacctatttaaaaggtaagttcaaagataaaaagaaattttgaagaattcagggagagagaaaaatgtttacaataaaagcaagatttaaataaatgtgtgcatattgattatcacaactgtaaaatgtatgtgcatttgtgcaaagaatataaaggaagacagaaaatgaagaatttctgtgctaggctaatgaagatttttcgtattccagcagttataataatgtttgtaaaaatgtatcaaaaggcagttaacaaagtaaaataaatacaaataattgataggaattaaaattaaatatgtcttcttccacctcagccagggatgctaccctcttctgtgagccctggaccctgaacatgcagccagcccctttgacctcggaagaatttaaacacgtggggctcacagcggctgttctgtcagcgcacacccagaaggaagagcagaattatgttgataaattccgagaaaagatcctgtcatcaccctacagctcctatcttcagcaagaaagcaggagcaaagctaaatattcatattttcaaggtacgtaattttttaaaaataaatgccattaatctatgtaaatgttacaaactgtatctaaggactaggagataaggagtgaacaataggagttttacttgtaagaaactgatggagagatgctgaaacaatctatttacatcaacagtttatgtaagttctttgttagatcctagatctgagaaacttttttgtgagaaactgatcgagagatgctgaaataagtttatttgatagcaactatttttatccggaattttgttcatctttttagagccactttttgtcattctggtagtattggcaaatgctcattcgtcagctacttataactacctgtaagtggcatccttctcttctttttgggtttaattttccataatttgcctctacctttatccttccaggagattctacttccaagcagacgcggtcggccggctgcaggaaagggaagcacaagcggaagaagctgccggagccgccagacagcagcagctcgaacaccggctctggtccccgcaggggagcgcatcagaacgcacagccctgctgcccctccgcggcctcctctccgcacacctcgagcccgaccttcccacctgccgccatggtgcccagccaggccccttacctcgtcccagcttttcccctcccagccgcgacctcacccggaagagaatacgcagcccccggaactgcaccggaaggcctgcatgggctgcccttgtccgagggcttgcagccttacccagctttcccttttccttacttggatacttttatgaccgttttcctgcctgacccccctgtctgtcctctgttgtcgccatcgtttttgccatgtccattcctgggggcgacagcctcttctgcgatatcaccctcaatgtcgtcagcaatgagtccaactctggacccacccccttcagtcaccagccaaaggagagaggaggaaaagtgggaggcacaaagcgaggggcacccgttcattacttcgagaagcagctcacccttgcagttaaacttacttcaggaagagatgcccagaccctctgaatctccagatcagatgagaaggaacacgtgcccacaaactgagtatgtaagtgatgctcattttcaacactcaagtgagaaagtgaatatcttactaaagttaaggtggttgcgttgggactcagtgctgacattctcagtaggtaatccgcgtggctactgtgagtgagcctgttagcctaattctgtgtaaacatgaaacacatctgcctggctctgtttggaaagtagacatgaaagaatcatctatgttctagtttcttatatactttgtgaggttttttccaaagtgctatcttttaagttttcatgtgaactggattccctctactctttaaaattcgttacaggtattacgcttaagtgttcattgcctataacacgtatttgtttacttacaaccggggttatggtcaggtgagataggaataagccatattgacaatttaacgattgtacttcttcatgcacagtcacaggacaacaggtgtgtatgaagaggtaggagctattttatttgttatcagtagagtaggcagtttatagtttcacacttaaacatgtcatttttttcaaaaccaaaagcttttttggtctgcttcctttaacttttcatccctttacctaaaaagccattctcaggtttatttagcaggttaaactttggaatctgacgttcctatatttaggtatagaatccaaggcaagtgtgaatatttacacagatttttctttgaccttctctttaaggtacaatacccttctttaacagatattcaaaatctagtgatacaaatcaagaaaatatgctcacttttgaaagcctggtgtgcttgctgaaaatctaagggaaggcagtatattacagtgagtaaagcctgggctatggattaagacacggattcaaatcccagctcggtcactagttaggaagattcacttagacaagttatttaacctttctttgcctgtgtttccttattaggaaaatggaaagatgaatccctcatagcttactctgagggctaaatgatgtatttatatagtacttctccctatgcagtaggtgctcctggagagctggaactttgttttgttcattattatattcctagtgtttgacacagtgcctagaacatataaatgttcgatatgtgtttgctgagtgacaaaaaaaaactacttgtggggtgcctggcatgtagcaggtactgagaaagtagtagtgccttaatattacttacaaaggaacttatttcttagagataggctggaacgtttttacttcttagttatatatgtaaattttattctgtttaacacacgaagttgaagatctgccagttacagtagtctcccttacccaggggatatgtttcaaacccatggtggatgccggaaaccgtgggtagttctgaaccgtatatacagtatgttttttcctaaacatactatacatatctatggtaaagtttaattgataaattaagaacagtaagagattaacagcagtaactaataacatagaacaatgataacaatatactcatcacaatttcatggatagaagattcgtttttgcctaaaattgtagcactctcagcatatgggtttttcctttccttcttgagaacttccaccttttcacttaaatgcagcactttatgacttctctttggcatatcccaattgctggcatcactcctcttgcactttggggccattattaagtaaaataaatgttacttgaacacaagcactatgataccacagtagatctgataaccaagacggctactgagtgtggaggtgtgaaataaagggatgattcctatcacaggctggaagcaataagacagctcaaaattttatgacactaccagaatggctgacaattttaaacttatgaactgtttatttctggaattttccatttactatttttggaccttggttgaccacaggtaactgaaactacagaaagcaaaaccatgaataaaggaggactactgtattttgtgataagaagattaaagtgtcttttcatgtgcccttactttctagcagtgtgttacaggcaacaatggcagtgagagcagtcctgctactaccggtgcactgtccacggggtcacctcccagggagaatccatcccatcctactgccagcgctctgtccacaggatcgcctcccatgaagaatccatcccatcctactgccagcgctctgtccacaggatcgcctcccatgaagaatccatcccatcctactgccagcacactgtccatgggattgcctcccagcaggactccatcccatcctactgccactgttctgtccacggggtcacctcccagcgaatccccatccagaactggttcagcagcatcaggtagtggatcaggacaactaatgtttcaaactccaatgccagacattcactatgtgctgagctctcactgtgtgccccaggcactgatgtggaagtacaaggtttttttttctttttccctttttcctttttgtcaggtatattggggtatatttatacacaataaaattcaccagtttgaggggtacaaacaagaattctgacagatgtgtaccttagtgtaagcgctaccacaatcaccatatagaacatttctgtcaccccaaacagttctgtgaccctcaccagtccatctctgccctgacccttggtctcctggcagccactggtttgctttctgtcactttagttttgcttttcctatgatttatgtatagaatcagacagtatgctgtctttcgtattcggattctttcagttagcatgatgctgttgagatgcacgctcaatagcatttatagcttagatctgtgatccattttgagttttgtgtatggtatgaggaagggtcaatatactttctttacattgggatatctaactgttcctgccgtttgttcaaaggattaatctttcccccgttaaattgccgtgatgcctttgttgaaaataacttgaccatacacgtgtgggtgtatttctggactctcttttctgttccactgatctgtatggctagctttaggccaataccacactcttaagtaatgtaactttcaagtaagtcttgaagcgtggtgaagtaagtccttcaacttaattcttcttttcaaaatgattttgaatattctaggtcctttgtccatataaattatagactccatttctcagtttctacaaaaaagtctcgtggtgtttggaatgaaattgtgttgaatctatagatgatcaatacgtgaataattatcttcctgatgatattgagtgttttgatccacaagtacgatttttctatgtaggtctttaattcttctcagcagggttttatagttttcagcctacaacccttacatatattttgctaaatttatctctaaggattttataattgttgatgctactgaaaatggcattttaaattttcaatttgcaattgtttgttgttagcatatagaaatttaatcaaattgtgtatttttaacttgtattttgcagtcttgctaaactcattgattagttttagtagctctttttagattctgcaggacttttctacatagtctttattatctgcaaatataattttacttctttttttccgtctgtatgtctttatttatttgtcttgcctcattgaactggctaggacccacagtgaagtgtttaatagaaataggaaaatagacacttgcctggttcacagtcttaaggggaaagcagtcagtgtttcaccattaagtacgatgttaagtataagttttccttgaatgcccttatcagattgaggaagttcacttctattgctgctccactgagttgccctttctgcgtctgttgagataatcatgtggttttcctcccttattctattaatatggtgaattacatcagttttctgataataaattaaccttgcatttggtcatgctcttttatccttttttatatgttgttggattatcttcctaatattttgttacgcattattgcatctctgtgcagaatattggtccatttactttctttacttgtaatgtctttgtctggttttggtatcagagtaattctggcctcaaaaaatgagctaggaactattctttgctattctgttttctggaagagtttgtgttgaactgatattattttttctttgtaagtttggtagactttaccagtgaatctttctgggcctggagttttcttggtgaggaggattttaacaacaaatttaaatattttaatatatatgggtctaatcaggttatcagtttcttagtgatctttggtaatttgtatctttcaagaaatgtatctattttatctaatttgttgaatatattggcataaagtttttaatattcccttttccttttaatgtctgtaggttttatagtaatgtacccctcttattgctggtattaatatttttcctgatcaatctgactgtatgtttatcaattttaataacttttcaaagaactttggatctcattggggttttttttcctattgttttttggttttttattttattgatttatgctctttttttttttttttttttttccctgggacagagtctggcactgtcacctgggctggagtgcagtggcacgatattggcttactgcaacctccacctcccaggatcaagcgattctcctgccttagcctcccgagtagctgggattacgggtgcccgccaccacacccagttgattttttgtatttttagtagagacggggtttcaccatgttggccaggctggtcttgaactcctgatctcatgattcgcccgccttggccttccaaattgctgggattacaagcatcatccaccgtgtccagcctatgctctaatttttattacttcttttctctttactttggattttattttttttttcttatttcttaaggtagaagcttacttgttagatctttgaattgagatttttcccccccaatataaacatttaatgctattgaatgctctaaccattgcatccctcaaattttttttttttttttttggaaccaaggtctcactctgttgcccaggctggagtgcagtggcatgatcccagctcactgcaccctcaaacttctgggttcaacaatcctctggcctcagcttcctgagtagctggaactgcaggcatatgccagtgtacctggccagtctaaaatatttctaatttcacttgtattttcttctttgatcttttggttgttttagaaaggcttaatttcctaatatttggagattttttttagatatttttattttatttctaatttaaatgcagtcagagaacattcttttgtattttttaaatttaccaagacattgtgtaatgatctggaatttggtccatcatgataaatgtttcatgtgcatttgaaaagaatatgctttctgctgttgttgagtcatgtgttctgtaaatgtaaattagatcaagttggttgataatgttgatccaaccttttctaactgattttctatctgttttataagttattatgatatggtttatatgtccagctataaatgtgaatttctctattttttcttatagtgcagtgagtttttgcttcatgtattttgaagctcttttattaggtgcatatacacttgagattattatatcctcttgatgaattgctctctttatcctgaaatatgtcttgctttgaagtctgctttgtctgatatcagtgtatccagtccagctttatttggttagtgtttacatggtaaatttttttcatctttttactttcaacttatctgtgtctttatatttaaagtaagtttctcgtaaccaccatatagttgggtattgctttttattcatgtgacagtctcagccttttaactgcaatgcttgcttagattatttacatttaatgtgaatattgatatggttaggtttaagttaaatctttcatcttgctactaattttctgtttgtctcatctgccctttctttttttcctcctaccctcctcctttcgggttaattgtgtattggcttctaagcataactttttttttgtttttgctctaggattaactttttatttatttttattttatcttatttttttctttgagactgagtctcactctgtcacccaggctggagtgcagtggtgccatcttggctcactgcaccctccacctcctaggttcaagcaattctcctgcctctacctcccaagtagctggtactacaggcgtgcaccaccacgcctaattttttgtatttttagtatagacggagtttcaccatgtcagccagactgaactcaaactcctgacctcaggcgatccgcccgccttggcctcccaaagtgctggcattacaggtgtgagccaccacgcccagcctgctctaggttgtacaatgcacatcttttacttatcacagtttaccttcaaatattatgcctattgtatcactttatatattagaaccttaagacggagtacttccatgtcccctttgtcttttgtgctatttttgtcatacattttaacgtgtaaaaaaacccacaataacattgttattatttttgctttaaacagtaacaacctcttaaagttgttttgtgtgagtgttttgttgttgttgttgttgttttgacacaaggtgtcactctgttacccaggctagagtgcactgatgcaatcatagctcactgtagcctcaaactcctgggctcaagcaatcctccaaccttagcctcctgagtagctaggactacaggcatgtaccaccacactcagctaattttttatttttatggagatggaacctacctcactgtgttgcccaggctggtttcaaactcctggcctcaagcagtcctctcatcttggcctcccaaagtgccaggattacaggtgtgagccaccacgcccaacctaaagatattttttaatgaggaaaatttttttattacttttttatttacatacttagttttttaaaaaaaattaaacaaatagttttgttttgtgtttttaattccttcaaagtcagtgagaaggttctagaagggtcaaatgcaagataggaaaggaatgatccataaggcttcatatcagccataaagggatggtccttgggatgaacagtttctgtgttgtggcaggaggaaggtgaggagggggtacatatatcattaattgtgtatgtttggtatcataaaggtgattaatttgctttctgatggcttcttttttccttaaaaaataggtgagattgaggcaggaaatagagaggttgaaaatagtcattgctgggggtaggttagtgcatgaccagagaactgtagcaggattcccaggtattttgatggtgcatttgaggttggtgatgatgcgtttattgtagaaacactgtaccctgttatatgtgactttctgtatgtatttggcgacttgggtttaggtaagaacaaagtcaataattggctttattggagttggcattttgacagttatgaaaagtcagagggaaaaagaagtctaaggtattgcaaggtgtgttactgaatgatgaactgaggactccactacaggaagactaagacgttattaacacatttatagttgaaataattgaacaagcccatgagagagtgaagctgagatgttgatgattttggagatggagcggttatgggtgatgataaaggacaatgtgtgtagccttgagagtgatagctcattaggaatggaaaaagagatctcaggaagaccaaagaaccaggaggctgtccacagggaggaggaagtttcccggaaatgatggttgggctggctgaggaggaggactgtccgaggcaagagtctgaagaatgagagccagtttggcaaatcagtcggacaggtcttttctaattatgtgttgttgatttttgacaggaagcagcgacagcagtatataccttactagtagtgtttattcttctaaaatctcccaaaatgggcagcaatctcaggacgtacagaaaaaagaaacatttcctaatgtcgccgaagagcccatctggagaatgatacggcagacacctgagcgcattctcatgacataccaggtacctgagaggtaagaaagcactttagaaaacccactttttatatttttgtggtttctttttttcttttttttcttttttgagacggagtctcgccctgtcacccaggctggagtgcagtggcacgatctcagcacactgcaacctccatctcctgggttcaagcgattcttctgcctcagcctcccgagtagctggaattatagatgtgcaccaccatgcgtgtctaatttttgtatttttagtagagacggggtttgtttgtgacagagtctcactctgtcgcccaggctggagtgccgtggtgccatctcggctcactacaacctccacctcccaggttcaagattctcctgcctcagcctcccaagtagttgggattacaggtatgcaccaccacaccaagctagttttttgtatttttagtagagatggaatttcctcatgttggccaggttgatcttgaactcctggcctcaggtgatctgcccacctcggcctcccaaagtgctgggattacaggcgtgagccactgcacccggcctatggtttcttaatgtgtttttaaagacaaaataattattgaatgttttataaattccctttgagaaatgtgtcttcaaatttattcatttgaagtcaagtgatgaatgatttcttaaaataagggtggcagtggtaatgttacctctattcagatccagactaaacagatcttacacatcatgagacaaagaaacaaagtctgtgctttccaagatggcacacaagtacaagaactttttgttttagactcttgatttttttgccccttctaaaaagagctaagggaaatctctttcttccatacacctcattaaaacatcatatagatattttccaccaagaaaaaagcctttaccaacttgaaaaggaaatgatctagttatttttttaatgtatgcctcatgtgttagaaaatgtaaggtgtattaccaaccaagaagaagtgctattcctagatgacgggaaaagaaccctgtgtcttattcaggactattaagattctgtttgtttgttttcagggttaaagaagttgtactaaaagaagacctggaaaagctagaaagtatgaggcagcagcagccccagttttctcatgggcaaaaggaggagctggctaaggtgtataattggattcaaagccagactgtcactcaagaaatcgacattcaagtaagcacagtaataatggctgtcatatactcatgtattttggccaggtagtgcttttaatataggtcgtgttcttgcatgatcccactaaaaactttaatcctcacagtttacctctatggtaggtgttattattccctctttaccaataagcaacaagcaggttatacacatgtgaaataattaatacaaggccatgcagttcattgggttttgaatacaggtctttttgcctccaggtggttttttcttctaccagttggaatgttagggtacgataaagagtaaaaacacctgctttgatgtgtgattgactgcatttgataggtcatttgttatgtatttcaaatatgtctgcattgtttgaaaagagttaaaaaaagatgtaagattcacaccagaggtagtattcatactaagcagaaactttaatgggacttaagtgtctttttgctgttatgagttcttctcaatgagattatttgtgaatagcctgaacagtaaagctttgatttaccaatggtcccaaccagtgttggtggcagctgtggtaatggtagtgatggttgtactagtagtgagatctttattcccgcaagtatcaagatatgggaggttgaagagtcaagttaataacaagtaggcctagtccagtggctcacgtctgtaatcccagcactttgggaggccaaggtgagaggatcaggagttggagaccacgctgggcagcatagccaaacctcatctctaataaaaatcaaaacaattagccaggtgtggtggcgtgcacctatagtcccaactactcaggaggttgaggcaggaggattgcttgagcctgggaaattgaggctacagtgagctatgatctcgccagtgcattccagccagtctcaaaaaagacaaataattcgtgtgtgtgtgtgtgtaaaaatatttttaaaaaagagagtaaagttaggtgttaaagtatgatattaaggcttatgaagtaagcaagacaatgaaatcctactaccccctctttttaaaaactaacatttttattgtggtataatacacataacatggaatttaccttctgaactatttttaagtatataattcaagaatattaaatattttcacattatgcaaccatcaccaccatccatctccagaactctcttcattttgcaaaactgaaactctgtacccatttaacaataacttccccattcctccttctcccaaccctttgcaaccactggtctactttctcttttttctttttttttgagacaaagttttgctctcttgcccacgctggagtgcagtggtgtgatcttggctcactgcaacctctgcctcccaggttcaagtgattctcctgcctcagcctccagagtaggtgggattgcaggcgcacaccaccatgcccagctaatttttgtagaaatggggtttccccatgttggccaggctggtctcaaactcctgacctcaagtaatctgcccgcctcagcctctcaaagtgctgggattacaggcaagagccatatgaatttgactactctgcacacctcatatgagtggaatcatacattatttgtcttggtgtgactgacttacagacgtacctactctcttggttactatctgcatgtagtaactttttacatcctttcactttcaacctatctgtatctagatctaaagtgagtaggcagcatatatctgaatagtgcctttcaaaatcggttcagtcaatctctgtcttttgattggagaatttagcccatttacatttaaagtaattactggtaaagaaggacttacttgtggcattttgctatttgttttctatgtgccataaagatttttttttccctcatttgctgcattactgtcatcttttgtgtttagttggttttttgaagtgaaatgtaatgccctgctcatttcctgttgtgtatattgtgtagctattttcattgcgataaccatggggattacgtttagcattctaacatatcactccagtgtgtaatttataccagcttaactttgataacctacaaaaactcgcttctgtagagctccatctccatcttctttcagttactgaagttatgaaattaggtttttatacgttgtgtttccaaaaacataattatttttatgcattaatctattaaataatatagaaagcaaaatatgagattacaaatcaaagttaaaataatactggattttatagactactagttttctttgaatgtattagtttcttaaatcatgtagaaaacaaaaagtggaattgcacattgtcgttgcaatcataatatttaccttcgctgagatctctatttcttcacacagcttcaggttactgtcagtgtcctttcatttcaaccctgcaggactcctgttagcatttcttggatggtaggtctagtggtatcaaactccctggcttttgtttgtctgggaatgtcttcacttctcccttacttttggccaaaggatttcttagttgacagttttttttctttaagcactttgaatacactgggacactgccctctggcctccacagtttctgatgagatatctgctgataatcttatcgagaatctcctgcatgtgtgagttgcttctcccttgctgcttttaagattatctttgtctttgactgcacggtatttaattatagtgtggatctccgagttctgagtacatcctagttggagttcatttagcctcttggacttttacattcatgtttttcatcaaacttggggagttttcagccattattttttcgaataatctttctgcctctttctctttttcttcctctggggcccctgtagtgcttatgttggtccactcgatggtttcccacatgtcctccaggccctgttgacttttcttcagtcttttttctttctgttcgtcggacttgacagtttcaattgtccggtcttcatacgtgtattctttcttctgcctgcttagatcggcttttgaatccctctagtgaatttttcatttcagttttgtactttttatttatggaatttctttctggcttctttttaggtttactatctctttattgatatttacattgtttgtacattgttttcttgattttgctccatgtctttctttaattctttcatcatctttttcttttttctatttttttttttagacaaggtctcactctgtcacccaggctggagtgcagtggcatgatcatggctcactgcagcctcagtctcctgggctcaagcaatcctcccacctcagcctcccgagtagctagcacacaccaccatgcccagctaattttttaattttcgtagagatggagttttgccactttgcccaggctggtcttgaactcttgagctcaagcagtccacctgcctcagccacccaaagtgctaggattataggtatgagccaccgcacccagctttttctttttctttcttttttttaagacagtctcactttgtcatccaggctggagtgcagtggtatgatcacagttcactgcagcctctacctcctggtcccaagtgatcctctcaagtagctgggactgcaagtgtgtaccaccatgcctggctaatttttttttttttcccagagatggagcctcactctgttgcccagtctggtcttgaactcctgggctcaagccatccacctgcctcagccttccaaagtgctgggattacaggcgtgagccactgtgccctaccagttctttgatcatctttcagttgttttaaaatctttgtctcgcaattctttcatctggtctttctcagagacttttgctattggtttatttttccctttgaatggcctataccaagggtgtccaatcttttggcttccctgggccacattgtaagaagaagaattgtcttgggccacacataaagtatactaacactaacaatagttaatgagctaaaaaataataaatcactaaaaaaaactcaaaatgttttaagaaagtttatgaatttgtgttgggccacattcaaagccatcctgggccgcatgtggcccatgggcaggaagggggtcgcacaagctggggctgtactttggcgtttctttgtatgccttaatgattttttttttttttggttgaaaactagacatttgaatctaataacatagtaattctggaaaccagattctcccctttcccagggcttattgattcttgttttatgattgttggaagacggggtccttattgcccactctgactcccacaagctgtgtgcaggctgctccaggaatacgtgccttgtccaaggtcagggatgggtagttgctgctgtgcttcaagctgaaattgaccacaggcaaccacagcttaccgtctaagcatttcctagaaagttgcaggcgttcagatagactcgagttccaaatagttacctcggactcattttgtcagtccagttgttgtctaggtgaggagacagagtcctagtcttcctactctgccatcttcccagaataatctccccatctccattttcaaagaaaagaatgagtgtctgtcatgtaagaatggctgggtagggtctcaccaaaaagcaggagctgggctggttattgtaagtgtctttgtttttttcagtgttgttctggttgtaaatagacaggtatatgaaaaatgagccccacagcaatttaaacaaaagcacagtcctttcaccacttagtaatggggatgttttgtgcaagcgtcctagagtgtactcatacaaacctcagtggagtagcttgctacaatcactcctaggccctatgggacagccttttgatcctaggctacaaacctgtacagctgttactgtcctgaatactgtaggccgttgtaacacagtgttacttgtgtatctaaacatagaaaaggtaccataaaaatgtggtaggataatcttacaagaccaccattatatatgcagtctgtttttgaccgaaacgtcatgtggcacatgactgtatttaaacaatttgtcatttgccttttaataataaagaatgaggctgggcgcggtgtctactacctgtaatctcagcagtttgggaggccaaggtgggcggatcacgaggtcaggggttcaagaccagcctggccaacataatgaaaccctatctctactaaaaaacaaaaattagctgggcgcggtggtgggcacctgtggtcccagctacttgggaggctgaggcaagagaatcgcttgaacctgggaggcggaggttgcagtgagctgagatcgcaccactgcattccagcctgggtgacaccgcaagactctgtctcaaaaaaaaaaataaaaatagttataataataataaagaatgaactataatgaaatattttcagacatgaataagttggggatttagaaacatgtgaccagccttttactgttttaaaactctttaggtgacattgacatcaagtaactcgcctgctttgttcttttttggaggcctgtgtcacttgtgaaaatgaagattcagctgatggtgcggccacatcctgtggtcaggttctggtagaagacagctgttgagtgactgtgaggatgaaccttcataccctttccaagacgtgttacacagacagacctttttaagtcctggacttttaaatgaccatgaagttatcattgaatgttaagattttttcttcttgattttttaatacacgtaatctttttgaagcagacattgtatacagaatcttacttctctttgttcctgatatattaaaatggccagttaggctctttttgtagttgaattgtcttctaaagagattggatggcctctaaagaggtatgtgtatctttatttcagatgtcacccagagtaaattataattagaagtatagctagaatgagccccaaaccttagcctcatttattttgttctgttacataagtcattttccccttagagtgcttgaagaaatgccacctacaggttgtgtacttttcataatggtttccatgaatgtagtacgttcatacaggcttcattcaacctggcgttcccctccataattaagatgaaacattccggttttctcacaacacattagcacatactgtccattagcatatctgggataaccaggttttgggggttgagttttggccttcatccttgtagatccctttcctattgatttcccaccttccagtgaaattctgaaagtcttatcttaaaaatcgatccgcttaccatgggcctattcttgtaagtttcagttagcatttgcatgtgtaatattaaaatgaaagagcttcttacccagtgctgttgcccttttgagtatttttgtttttaaaataatgattgtaaaatgttttacaagtaatgtaaaagctagtatcattcttacatacttctgtgtttaaattttcattcttaccaaaacagttaactctttctttccaatcaatttatacaaaagaggtcgctccagccctaccacaggtctgactggcactgccttttgtttgcccttgaacagggcagtgttgtggggactgcaaaagagaaaacgtccaggcgagcccagttgtcctcgcccacagggtcctgcaggctccatcagtcaccgctttctatggcgtttgtagttgtgtcttttaagaagtgagtgtgattgtttacttgataaatcagctcactctctggtgctttttagagaagtccctgattccttcttaaacttggaatgatagatgaaattcacacccctgcagatcagaaaaaacaaatagaagaaaatgagggttacagtaacctgttgtctttatataacttgcaacaaactaatttatttttttttcctttttttgtttttggttttttatggttttttaaggaaaatacttttctcctttgaagttttacagctttttgtaaatgcgtcctgataatgattaggaaaatcgaccttttcatccatgatgaccatcctcatagctcagatctcctttcaaagtagtggctttctggatggtaattccatcttaaggtgtcagaactattttcaaatgctgcctttgacagttcttggaattttctgatattaagcagttccatgcaaatattcgtgttttataaatagctctcatagtctgctccatcttgatagttaagtgatttctgaagcgtttgtgtgtgtgttgatcaggttgtgtgatatttttgcttgatagagaatcaaatttgaaacaattaaccagccagtagattgtctgtcagtgaccttctgtagtaataaagtttttgccactgtaaataaaaacagtatccgtagctatcaggatcattgcgcactcatatatgctaagccttctgttctctaatagaagcctttcttttccattgtttctggatatttgtattatccaaatgtgcttatttctttgccttagcacacgttttatggagtacttgttatactaggtttgatttgaaactggtgcttgtcgcagaactgtcagagcatgaggagcgctcctcctgtgggtggacgcattcacgcactcccaggttgcacctgctgctggcggtgagcagggggttcagcagcttgaccgatgccccccgagggggctctccccagcttaaactttgttgtttaaatttgttaactttttatattaatgactattgaaagtggtaataaaaatttatattataggcttcaatgttttcatgaatgttacccaaaaagctgtgttttctttggtcagaggtcaaaatttatgaaaaacaaaatgctgtatgaatggaaatcattttgcaattgagtgacacttcattgtaattcacagtgtaaatttaatccaaactgaaattttgtttcaactgaatttgtaattaactctgaatttgtttttaatcattagtaatatttcagttgggtatctttttaagtaaaaacaacaaataaactctgtacatgtaaaacgtga

SEQ ID NO: 38646 - DNA, 17231 bp, Homo sapiens
ataggggggcggggccagcgcggagctgggagcgggagccgggcactccaggggccatggatgggctcggccgccgccttcgagccagcctgagactgaagcgcggccatgggggttagtgccggccggggagagcgcggggggacggcgtgggcaccggggagccggggctagggctggcggctggggcccggtggagggcggcacggggcgtcgagatccgggagcagttggaaggggactcaggaggctgcgcgggggcaggtgagcgggaaggagcgcgcggagaggggaagagggtcaggtgggggcggggacggcgaggccaggcctgagggggcgagggggaggcggcgggacacaggaagccgttgtggggccccggggccacgtgtccttccatccaggaagcttgtggtgcaaccgcagtgtgcctgaaagcgccccggttgtggtgtcctcccagaggcactgcctcagctcccggcgtgcccgccgccccgccccacctcgccgccctgggagtcctccgtggtctttgcccagttcctcggagccagcgcccctgcccctgcccagcagatagccaccggccacaaacacaggtctccccgatgacgttaccacccccacccaccctcggccaggtgcccttcagagtgtggcctccagcggagcggcggtagaacctgcgcagctgctgctttccagcgtgtcgcccagacagggcaccccttccctttccctcagccccgcaacagtgaaatggacataattcccccgtccaggattatggggattaaattagaagtcaacttctaagttaaagaagcaccttcttttctttcttagcagagccctggggttggaaggagggcagttagaaattcattcatttattcattcactcggcaaatatttgtgtggcttaccactagccagtcctatggctgaacagccgtgacccttagatactttgcccagaggtcctactgtctgaggagcaaagagcaggggccattcccagacaacctgccctttccaacattggcacgccaggaggccaagtgagcccctctcttagcccaagccccagagttggggggacctcagggagtgaggtcagtgcacccttctttgaactgcagtgacctctgagtgatctgctcttcctcctgttgccattcctcctgccacaccctgctccttccctctttgtagtgtcctctctagacacagatctccaatatctggccattccatctgcaccatcagggagaggtcagagaccacagtttggggcagaggcctgggaccgtgcagtggtgggagcagaaggcaggatgaggctgacattctctcttctctggagagcactggcctggtctgtcctggtcttcccagaccctgggacatctgtgtgaatggaaggggtctgccccctgcagcccagaggagacattccagttgttcccacccacccctgccccaacaccaggcacttcctgattgtgcctggaggagcttcctgatactgaggaactgtaagaactgaggcctaacacttgtagggccaggagcatatgccctcttcatcttccataccatcctccacttgcctggggattctcccccttcctcctttgcctttctggccccaggacagttgtgtattaggagggagtgtgtgtgtgtgtgtgtgtgtgtgtgtgtatcctggtgacaaggagtgatgtggtggtggtcctgggttgagagcagctgagctggaagggatgggccagcttcccagatcaaggttccagaaggtcccctcacctatgttctagacagatctgggacttcagtcaggtgtgtgtgggagaggctttctggtggaggaacaagtgtaaccagattcctgacttccctagaaagggtggctccctcctcaactaaaactctgaataataattcctttctagggcactggagattaaatgagatgccttatatgaaacatgagtttgatggaggttagttttctcttacgcttttctctcctgtggataacaccttttgaaagaggggagaaaacagtcttttgctgcatttcttgggcctcatcccaaaagtctaattactttcttttgtcaatgatttattaattttgctattctcttggcttgcttgataaagcagaagaaaatgatctgaaaacgcagcccaaaggatttagggaaaggcataatttcattagaatctggaatgatcagtgataagattctgtttctcaatgtcctttgaaaacctctgtggggtatttgatgtcaaatgcatccagaaggcaggagcatggatttggagctttcctaatccccattcccaacaaatcctgtcaattttaatagcctttgaattactttatgcctcagtttccccatctgtatcaggaagatgcttgttcctcaaacaggtggtaaggcttgtgcaacaagtctgtgcagcttgcaagtaaggtgtggtgccagctccaagtgttctagttcgctcttctcacccattacagcatttgaacatctttctttactgtacatgagtttggccgtgagtcctggctttttctagtcccacagaagccaggtctagagctcttaggagcaaagcagctgttttccctatcctagcaccccactctcttccagaggggtgcttattcttagcaggagtggcaaacactggcgtcaaacccttttgccccctgctttccctttgaggcagcttcctggtaaaagccttccctgtatttactcattcaggggtttctgtgagaatccaaggtgatttttttgctattccttctctcttacctagtctccagacacagcagtgggctagcagctgtgcctgtagcttgggcagaacagctgacctggcctgacccggaggaaggctgagcaggcgtgggggttgggtggagatcacccagatgttttccactgccatggaatcaccctcaggctgctggtgcaatcagtcccctaccttatgctggggacagtcttctgagccagtgcttcctatttgagaagagggactctgctggaaccctggaacaagtgccagtgacagaactctccagggggtgaaattcaccattgtagctatttccaaaatatcacgaactctgggcttagagatggattttgctctctactgcaccatcaggaaagaaggctattgggtattgacttccagaactctttcttttgttggaagaattaatctatttggataattattaggccaagtctatttatcttaatcaggggagggcagtgacatcctggctgcagaaagtgtttggccatgtgctctaggtcgggaagtcctggaagttctagaattcagcaggtggccttgctggggtttttgacttccgttgaccaagttgagaagtgaaaggtcagcaatccaagtgttggaggtataggatccctatcctgagaccagccggtttccagtgcccacagtctgacactatcaagcattgtccactgttctaaggttgtaaattaactctctgcacaatctgcagcccagattcaaaacccttagcccataagtagccaggcctttccggctactttcagccagaggtgtttgctcatgaccttttctctcgccacaccctggggctcttgggaggagctgagatctgcgctgcagtgccaggatgctgactctgttggtgctggcttctgctgccttcctgggtcccgtcacatccttcttgctcaaccactgggtgcacaggatggaaacttctattccctctctggaagacagcgcgtggcttggcttcacagagttgtggctggagaccgaagcagcccctttctcaggcttactgtcaccagtctgtctgtgttaggggagaggggagtccgctctgtcctgaaggcccagagatggaaggacaagtggtaggccgggtgttcaggctcttccaacgccgactgcttcaactccgagcaggtcaggactggactgcctacttccttgtttttagggtgaccctcttaggcgggactgtttcttccttgaaatgctccttcctcctcttcctttatatctcggcctccacatggttccccatgtgactgggtcaggaggcttcctctgctggtttttaagagctggtcatgccctctctggggctagtgtggtcacagtcacatgccctttgagcctgttcttattcacttagtatgaactaaactctcaggccatattgttccaggactgccagaagcacccgacaggttaggcagtctctgtggtaccctggggccttggcctccatgtggcctctccagcacatttccgtggcttctgtgtcagtggtttctttcctctgcttggctccccatggtttcaagtctaccagggcaggtgtggaaactgcccatttggccctgatcctgagtgactggtggttctggccagtatccaggtatctcagcattggcaaggcggccttgaggtgtggaggtcacccggattctcacagactccactccaggaatggatcaatgagattatactaaatgggctctggcttgatttcaggaccaccccaggacaattcaggggaagctttaaaggaaccagaaagggcccaggagcactctttgcccaactttgctggggggcagcacttctttgaataccttcttgtggtttctctcaaaaagaagcgttcagaggatgattacgagcctataatcacctaccaatttcccaaggtaaggactgaaggaggggcagggccagccagaggactggggtgtttggaaggtggtaggggtgggggttccacctccttctccctaccctaccggggcttgagcctggagctgccctgagctctgagctcactgctctccatttccttcttagcacagccccagttctctgttatcacccacagaatctaggtctaacttctttgtgagggactgacctaggcttcctagcagggaaactaggctagacattttgccttttaggggacctgataggtcttccaaatcccattttcagtcacccttctctgcagagaagcttaccttctgccagaactcctagaatgaatcccctctctgggatgtgtgggaaggaaagagtggggcagccttgtaactggtgggcaggcacagccctctgcccgagcccaagcattagactccttgtctgatccttcaccaggtagagggttgggaagccttctcattagcaggtgtgccaactgagctggccgcttctcttctctgatgtggtacctctctgatgttgtcctcccaggggcctgggccatttcagggcctttctatattcaacatggccctgtcccctttctatgtagatctcgatactgaggtcgaactcaagcttatgtagagttgacccaggaggggctgtttcagctttggagttgttccaactggacccagaatgcaaactgtgcagagtcatgggcaaaggcacccttcgcccctatgctagtggagaagcttaaccctagactgctttagagcctcaaaggaagcccaccagctctgaagctgtctcctgctatctctgcccccagcttcacatccacttgtcttttcctttgccttatagcgggagaacctgcttcggggtcagcaggaggaggaggagcggctgctcaaagctatccccttgttctgcttcccagatgggaatgagtgggcatcactcaccgagtatcccaggtaattgctcagccctgggcaagggtattggatttggggagaaggaacatgtgtgagttctgtggctcctgtagcctccctcactgctgtcatttgttgattttcggcctgggagtgtaattgatttgtttgaaaacatctggcctggggtccctcaaggccaagaatatgagctatcagtttgatcagtcacttctgtccaaagagccagattctcccacctgtcctagaagcaatagttgctgcttttaactctgctactggcccaagctggacttagcagaaagcagttagcctccaagaaggcgacgtagcaaaggcccttctagcatgagccctggaatttgactgcttgagctttgacttcactatttatgagttgagtgaccttgaataagaagcaccctctggcctcagttccttcatctttaaagtgggaataattactgaacctacctcaaagagttgttttgacaattagatgagatgatgtgtttagggcctgacaccagtgagcccttactcctgtgattaatcagcaactcccctttgccctcctctccaccctctagtgctgaccactttcctgttttaggattcagtgagcaatacaaatcaagccttgtctgctctttcttagggagaccttctccttcgttctgaccaatgtggatgggagcagaaagattggatactgcaggcgcctcttggtctgtgcagctcagaactgccccttcctttctgcagtctgctcagctccacggctgggcttgctcaagcctgagctgcaaaactccgggcttattggcagcactggttgtagaaaaagcacagcccaggacctgctgccatgctagtgctccctctgcagccccacaagcacgaggacctgatgccccttctcccgctgctggtcaggctctggtctgtgctctctctggctttcaatacaactaactcctctccctgcctgctctatccaggcctgcttaccttggcccctggagcctcccagagcagaggctgggacttggacaattagtttcaaatcttaggtctcaggaggattccccaagtcacctttacagtgctttcctccttagccatttcttcatctctaaggcacacttgctacccctctttgctgaccccagattgtgctggcactgaaggtggcagcgcttgcccaccaactcacccagtaccctcaaggatttcttcttttgatgctggtggccattctgacctccctgctgcacccaccattccccataaatccccctccccagccctcagccttgtgctccttcatacccagttgggagaagcccttggggaggctgcagcactgaaggagcctctctgtccctccccagcctgccggccctggccctcgccttcccaaagtgtactgcatcatcagctgcatcggctgcttcggcttgttctccaaggtagggataggattcctcagggcctgcccatattccaggctgtctctggctgccaaccctgcctgtgcaactaagctcttagtggagctcttctcccatagccagagtcagcattaaagcacacttgggaaaactgaggcaaaggggcatgcacttgacttaagggaaaagtggaaattgaatctaggggactggacctcttgcagagacagctactgttcccactctagccaagtaagaaagtagttgaagtaggacaagcagaagaaacttctgccctgagtttcaatttcctcatccgtcgaatggatataataatctcaccttcctatctcactgggtggcgtgaggcttaaatgaggtgatatatgagaagactctttataaaaggcagagcactaaacaaatatgaaggagttataagacccattctgactccttcaagggtagaagaacagttgaggtccccaggacttctcttggagctaatttgagtgccagtgcatctgagacagaatttgagcagaatccatgggggccatgccatccactggtgaccagaaaggacttcattatgctctgaccccagcaggacctttggaggaggaggggaggaaactctgtcagcttttgcttgggcagagcattcctttgtgcagtgctcctagggatggaggcagtctctgacctcgggaatctacagtgggagttggaggacagagtggtaccaagaggcttagccttctagcctcctgctccaaccagcatgagtggacatggtaccatcatgggtgatgagtttactccgggatgacttcccagggaggtgcttttatgttggtgttaggagaggggaagaatatggatgtgtagagagataataaaaaggaagctggaagaaggcaggtcttatgtgggagataaactgcagattatttagcatgagcccagcctctgccagggagggagaggaccagttcgtggagggccctagaagatacatgaggatcagctgaaccagtatgagaacattatgacgctcaggggcaagtagagtctcttccacctgcctggtagtgtccctttgagccgtgcctcccgtggttcttttccctgcagatcctggatgaagtggagaagagacatcagatctccatggctgtcatctacccgttcatgcagggcctccgagaggcagccttccctgctcctgggaagactgtcactctcaagagcttcatccccgactcaggcactgaggtgggttagcaaaatgggtgagaccttccctagctggagagggtaggcatctgtggcacctctcaccactgttcttccattaaccaggttaaagtacagagaaactgagccagatggggactgggacttggttagaatggacaaagctgaaatcaaacccagattttctgatccttctaacttgatacccacaagcacctagttactgctcaagccaccaagacttttatttataataaataaaccatgtaagttgaggcttctggtgctataaaggacttttccctcagccctcagactgccacttgccgctaccccccttccactctcctttgtttgtcctgtctctaccttacagcgtccatctgtccatttcttatcatccatccccacctccgagtctccacccatgcacaggggaatgctatcgttttaaggcaccaagcacactgaggcagcaggtagaacactgttctaagaattccagtcctgtcctctggaactctgaatagtctgtgtgcccctttgaaccttggcttccccacaggaaaataaggggagaggctagaaattttcactttctcaaaaaataagtgcttaatgcttgctgtgtgccaagctatactattttctgggaatacagtggtgaccaaaatgaatgtggtccctgaccttttggagctgtaagtccagtggggagaacagatgttaaataaacacaccagtgcatgttgaattagaaattatgtaactgtgatgaaagaaaaaaaaacaaaacagggtgctacataagaagatgggaaagtatcacatggccaaaggggggcctctgtgacctgaaagagggtaagaatgaagggagcagagcagtgcaggaggagggccctcactgtgaaggctgcaggcaggaaagatgggattgctcaaggaacagaagcccatgtggtgaagcacagtgagagaggggcgtgtgctcggggaggcgagtgagggagggtgcaggacattatgggccatactcaagatcacatcagtgctgtcctccagccaattagcagggggacagagagacagggccagattcactcctgggggcagaaggaatagaggctggtagaggcctagcacctcggggtctgcatgatcttgcagtatagtgacaccttctctctctctggtttccccacagttcatttcactgacacggcccctggactcccacctagaacatgtggattttagttctctattgcactgtctcagttttgaacagatacttcagatctttgcctctgccgtgctggagagaaaaatcatcttcctggcggaaggtctcaggtgggcccagcccctggacggctcacctgaactgcccagcatccctgggttcaagggaacagactggaggttatccaaggaaaatgggctgtagggtccatgcgcccaccctcctgtttctagctccttgttctttaaaccaagagaaacagctgttttgaaccacccccactgcctcttcctccacacaggactgctgcctgggcctgaggaatgctcctgacttagcttggggaaggacaggaagtattcctgggacagcctgggtgggaccagttagggtggatgcagacatgattctgcccttgcaaggctgagggagggtggagaacagggcaggaggtagatactcattcaacaaacatttattgtgtgtcaactggttgccagatgccaagcattgggaagatacaaacaggacaaggtccttcacctgaaggggatgcggaattacatactggttgaaagcacagggattgaaatcagcagaattaggaggtttaaatccagttcttctacctttagctatgaggttcccattaagttagtttgttaacttcttaaaaatggaaataatgattgtgattacctcataaggttgtggtgaggattaaatgaaataatgcacattaggtacctaacaccctgctgagcacatattgctgagtgctagcttctgttcttaagttcacagttgagtatatccctgtgtatagtggaagcagggtactattgtgccatggtctctaccttttaggggcttcagatctgagaaggacgtggggagatgtaatagaatggagaatgaaagaagtcataaaacagtaggggtaggggtagaccttctattcatatctggggagggagaaaaccagtgattttaggttgacaaccctgcttttatcttttagggaagaagaaaaggatgttagggactcaacagaagtcagaggggcaggtgaatgccatgggtttcagaggaaaggaaacttgggcaagcagtggggtctctgtgttgaagattctgtaaaaatgggtgataaccaaagaggaactagttgtaggtaatccttgaagggagtggcatcatcttttgctttggaaatagctctttcactcccagccttgaatggaaaccagaaattcctgtgtggctagagctgggattctgcctttcctcctcagatcagtgtttgggaagtggaggtcggcaggattcacctctcagacgtttactttcttcagggaaatcccaccactccccacttccttcccacactgagtttttcagctccctgaagctcggacagggaggggacttccagtcagctagcctctcagagactcaattttgctaattcaggaagtgccagcttgaaacccagaactgaaacaaggattcccgcatctgtgcttttattggccttgactttgaggcaatttggctggagtaaagaagagccatgaaagccaggggataaaagagaaagacagagagtgggactgtgtgtatgtggtggcgagaggagtagggtccaagttgtgacttgggcaggagtgacgagaaatgcttcactggaaagtcttgaggaggcacctttgtgggactttccgtgtaggaattgctgggcagaggttcctagaacctgggaatttcccaagctactcaggcagcaacctggtaatctttaataacctcgagtgtgcccagagggggctgtgtgggggcaaaggctggggatgagggtggatagacatagcgaggtaaaaaggctttgcctctcggctgagcctccagtgcttgtttacatgtttgtctcttaactacactgtgaattccttaaaagcagggtcagtgtcttactcttcctggtatccacatctgtgaggtatgctcacagttgtgagcacaggctaggggctcaatcaattatctccttgaatgaaagcaactcttcttccctcttctcttcagagtcacttttatttttggccagtagtaagttgagaagactaactgggaaaagaagggtcaaatcaaggcccttcttgatagtgaagcctcagactctctagtttctgtccctccctcccagcaatgtacgttcaagctctgtgaccagcatggcccccagacttgcctttctgcccatgggcatgggcagcactgctctagctgctgttggtggtgggcgatgaggggtgtgtagcatggtggtgcaggggccccctgactctcatcctctgtgctctgtcccagcaccttgtctcagtgcatccatgctgctgccgcactgctctaccccttcagctgggcgcacacctacatccctgttgtccctgagagccttctggccaccgtctgctgccccacccccttcatggttggagtacaaatgcgcttccagcaggaggtcatggacagccctatggaagaggtatgatgtggcaagaagagtgcatgatttggagccaggtagagtgggattcagatcccagctctgctgcttacagctgtgtgattaggggcaagttaccttacctctttaagcctgagctttctcatctctaaaatggggataacagtgttcacttcctaaggattctgggggaaaccacctgcctagagctcctaacctggcacccgacacacaggtgatgctcaataaatgcaggttcccttctgaaggattcccctttaggcataaggggcagtggatagcttattcaggggtgagcagactgttctgtgccagctggccctaatgagcagtcttcggggtgtcccatctcatccaaatgtatgacacagctggtctatacaacacacaccccactggaatgtatttgaattccttggaattgagctaacatggccctctggcaaactatgagtcttaaaaatgcagatttttgcagcaagtcatctttctgagtagctcagagctaaggtggctaatgaggatataggtctgaatcctctttgattttgttagcttcttacatcttggcagtgcaccagacacaccagagaactcagttgtgaaaatgggcattaaaagcgtaaatctatccccgctgttggaaaaataactcaaaacatgtgctttagagttgtcagtatagggactttcaaaagatagtatgttactgtatctcaagccagaagagggacttgggaatgtctgccctggccataaccattgactcactccaagagataactgagctccagagacttatccaaggccacatagacaacagtggaacctagcacagataaaaccaaatcctctcctatagaaaccattgctgcaaagtaaagaagaaggctgtgtttcccttctttgctccaccggccccctcatccttccttaggactgctgagtacacatgccctttgaaccagctttagccttgtgactaactgggacagagtattagccccatgtttagcaataaacatttaaatgttccaaccccagaaattatgaaacttcttgactctgcagctccagctccctggaagccgtggctcctctcctgatggccagtcagactctggcttttggtaagggattactccacagacaataatatgcccaaatactggaaagatttctgggaacaatcttgaaaaacaaattatttatacacactctctccccccaatccctcaaaggaacagtcttcccttcatgaaggcatctgagcctatgtatacaagtggtttcaggcctggactagttcaacttttctcccctgatgacagataattacagtgcatgctctattttttggcatactttccactctctccttgtatttggaagaagggacaatggagggatcattctctctatcaagaccaagggtcacaaatggaaaagagaggcccagcgggcatttaaatgaccaatacatgatttgggaagttacggtaaactggtgggaacatgccctgcctaaagcaggcaactgctactcagttccatctgagtgttgtcctttagaaatgtggacccagtgttagatctcctgacttttcaggagaagccccaaatccaaactttatgtgagatagtccagtttaaatattggaaaccaaatcaattacttaaaaatactgtgaagatcaaagaaacagatctgctggttggaatcagccagcaggatgcctatttgtaatctctggtctagactgaaggctccctgggcagtgatggggccagtgctaaaactcaggtcccccaagttccagcccagtgcttatctcacttgaggactgtagacacatggtctcctcacttcctttcctttcctcttcctgttgaccctgggctcattttcttcctttgctgtttcctgctggaaggcccaaagctgtgaggtagttttttttttttttttttttgagacagagtctcgctgtgtcgcccaggctggagtgcagtggcgcgatctcggctcaccgcaagctccgcctcccgggttcacgccattctcctgcctcagcctctggagtagctgggactacaggcgcccgccaccacacccggctgattttttgcgtttttagtagagacagggtttcaccgtgttagccaggatggtctcgatctcctgacctcgtgatccacccgcctcggcctcccaaagtgctgggattacaggcgtgagccaccacgagaggcaggagtttttctaatagaaaattgtacataagatgttgcaagcatgaaaaaaataaaaagatgttggtctctgttctagagagcagggagttgaaggggaattgtagagagaggaatgcaatctcaagaatatcagtctaggcttggaaaaaaattggttctcttattagcagcatagtatgacctcgggcagcttctttgggtctgtttcctcatcttcaaaatggagattgtatctgcctcacgggactgttgcttgagatcaaacgtgtaaagcacttatgtgaacaatgtactaaatgctccatgtagaagcaatttctgcagtcaatgttttattaagggagtgactggctgtgatttctccatcttgtatttcccttctaccttagctctttctcctactcccttcctacaaacacccacaccctttcctcaggaatggaactgagatctccagaggggaatggtgagaaaggagaatgctagataggaaatgagaactgaagatattgattttgttgctacctgggctgaaagatacagccacaggcagaaatcaagacggtaaatcctctgggggtctatgaagaaagaggaccagagaaagccagtctatgtttatttcaggtcctgctggtcaatctttgtgaaggaaccttcttaatgtcggtaagtgtctgggttcagatcccctgcaggcctatcaacaactctaccactctagtttcatccatgttccacttatttaaacaaacatttaagttctttgttgagtgagaatctgtgctaaaaagaccacatctctctcaaggagcccatggacataaacacagatgacttcactataagacaatcagtgatagtgccttttaagcaagggatataaatcaagtaccaccgggatggagaggatcccttgctaatgtctagagtcaaactaaaggccaagaaacagcttctgttgtttctgtcctatgtggctatttgcgggtggagtgggggtgtagaattcatgccctccttatgcttttctgccaaccaccttcactccacacttccttcctgcttgacctcggagctctgtcctcttctaggttggtgatgaaaaagacatcctgccaccgaagcttcaggatgacatcttagactctcttggtcaggggatcaatgagttaaagagtaagtccttactcttattttgggtctctccaggcagtgcaagggcatgcttctcaatcattcccttccagaactaaaatgaactcattcagtagtcctagaccagccctagaggcctagaacctagggcaagtctgaatttgggattgtattcttcctaagcaatggcagagaactcatacccagattcccatctcagtcagtaattatgaaccctaccctatggctttccccaggagctttccgcctgcaagaaagccattcttgaaggtgagtttgggtaatttcatccttctgctaccctctgagatggcctttatatctcctgcagctgcagaacaaatcaacgagcatgtttcaggcccctttgtgcagttctttgtcaagattgtgggccattatgcttcctatatcaagcgggaggcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggtacagtaacagtccccatcagtctaagcccatagagggttacctctagaataaagaggaggggaaagaaagaatacttctctttagaaacccacaaaatagctgtaggtagacttttattagtggagttgaaatgacataacctgaaacctaagaaaatgtctaatgggctgccattttgtggaagttggtttacccattagtgaacaggactgagccctttcctctgttttagtctagagctaattcctgctaagtatcctctgtttatgggctcctttttggacaaaactgaatgtctggatctccagaacctgtgaggccagagacatcctggcagggatggcagtatggggagcagacaggatatttctgatccttattcctgagctcattataatctgcctgaccagatcagatgcctctaacacctgtatttgaacccacaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagctcccaaaatccatatcctcactctgagtcttggtatccaggtattgcttcaaactggtgtctgagatttggatccctggtattgatttctcaggactttggagggctctgacaccatgctcacagaactgggctcagagctccattttttgcagaggtgacacaggtaggaaacagtagtacatgtgttgtagacacttggttagaagctgctgcaactgccctctcccatcattataacatcttcaacacagaacacactttgtggtcgaaaggctcagcctctctacatgaagtctgtggacatgtaaggacgagagtaaagaggaaaatcttat

SEQ ID NO: 38647 - DNA, 27738 bp, Homo sapiens
gtaacagggcggagcgcgcacctgggcacctgggcagccgccgcggcgctggctagacgtgcgcgatggagggcgacggcgggaccccatgggccctggcgctgctgcgcaccttcgacgcgggcgagttcacgggctgggagaaggtgggctcgggcggcttcgggcaggtgtacaaggtgcgccatgtccactggaagacctggctggccatcaagtgctcgcccagcctgcacgtcgacgacaggtgagcggcccgggcggggcgctggggcggctggggcccgggctggggtcggggtcggggtgctctggtcccggggtcctgcctctctctcccgaactcacccccggagcagcttcgggggggaaaccaattgccggcgaggccgcggggctccgacaatgtccactcggcctgtccgggccggaggggcgcgggggctttggcgagcccgggctcgatcgcgcacgtcggggccgggtcaggcggctcctctggggctcctctggggctcctcgggggccgcgtctgcccggacgtcctaaggcgcccagtcgtgcttcctgacactccccgagtggccctggttttcggggtctccagctcgccttgcgcctcggacccgcgcccttgggaggcgcgtccggcccgcccgggacccaccggggcgctgcggtctgcgcagggcttagaaaaattgccatgtgggcctctgggctttgtgagtggagttagcctccgttcgacttacttagtaatttacgttggaacacaaattggtgtaagactgtaattatttcggtcggaagcttcggcttggctcgggcgaggcttcccgggcgcccggcgcttgcgcggtggagctccggggctcgggcctggcagtggggtccggcacggggcccggggtgttgatccgtccgcccagcgcttcctcgccgcacactctcgttttagctgacttaatttcgagaccgacccgctagggaagggccttgcattcaagttctgtggccgtgccatggggccctcctgcaccccagtttcccagtccaaaagtcagaatggaacctgcctgtacctacctagcaggagtgttcaaggtaacaaagacgaatgggaaggacgcagagccgcccgtgttaaattcggtgggtcggttgtcgtctgtgcataatttgagaggtagggagaatgttcttgaacagtacctctttgttgttgtagatttcactgtttacagttgattttgatggttcatatgtaaggctcaatttagcacgttttaattatttatcctttaatgaagcttaccttctacatggaagctatgcttgtattttacctagagattccttgaacacatacactcagaagcgacacctttttaaaataccatttagcctttgctgcctggcagacctggtttcgaatgctcggctgattgagtgatggggccgctaagccccagcttttctgcagaatcgttgtgatgcctgtgtctggggtggcagtgcgtgctgcagccccataccgtgactgtgacgcctctgtggatgagaggcctgtcctctccctttgcattttcgtccttggctaggagactacacagcagagatagtggtggctttttgccgtaaccctcaaatccagtgtttcttggaaacaccagtagagtggtgacgagtgtcatcaaatcaccactagttcaaaggtgagatgctggcccaggctgtgcactttttctcccctgcctcagattctgggaacttctcaggccaggaggggtgctgtggttattttgatgaaatccaaaccactttgaataccagccagtggttaggttctgaaagggaaccctctccataggggcattcgttttatctcttggggatgtgtgtgagctttaatcatcagtgaaaattttcacaccactttcttatattggaagagcaaagtaaacaagcacctacctggactgactcaccagctcacatccttaggatcttctgttatttctagcgaccagtcccttatttcttgggtggcctggttggagggaggctttctccacttaaggtggatcacttaggatattgcatagcttggttgaaaagtgttttgtactttaactggaagcctttcctaccctgcccaaagcagacaggtggtggcatgtcaggtggctaggtcgaggtcagcatcgcctagcaggaagcatttcacctcctgtgctctgctgggcctggtagagtaggttggggctttgccatgtgcagcagtggctgatctttctgagaagttggtcaaaccctggctctttgtgaagctgattcctttaggttaattattgactgtattgagcctgaggttcttgttaggaatgtacatcagtcccactgtgctccaggagctggttgcattgcagtctcacaaggttgtacctaggccttgaagtagtcgctgtgccacttgccctgccacatttctcagtgcttttctgacgagctgcctcccaccccagcccctcatatttgcaagatgttccctgaattggggcataggattctcctagggtctttgtgtgcagcccccggccctgtaccccttctgcctaagtcttgcttctcttctcggagggacagcccctctcacccctgacacacgggtctgggcctcttccaggctgctgggggtcagtgatggtctagtccacttgttacataggagccaccacaggtacaggtgcaggtgaggctgattttcactggccaacgctgcttgcctctcaaggtggtctggggtctcctggctccctgcagctcccctgggccaggccttcagccggcccttggccacagcacctgctcggggcttgtttgatgagcaggctgcgccaggccatgtgagcttgcttttctgtgcaggaaaggttggggggccgcccagcccccagacacttagcgaggctcccagggacaggaagtgcctgccagggggccctcctgggagttcacaggtgacaccccattgatctgagattaccttcatcatggggctcggtgcctcggagggtcctgtggggtggctttggagaggcagctggcctccctggctgaccctcattgtgggggtcacagggcctagggtggggtgtagggatgggtgctgtgaccagtttggagagaataaagtgatcccaaaggccccgttcctcccctaccagcccccagctaaggggatgctcagaagaagccagtgcctgcggggcgccggctgggagacgctcctgccacattcagccctggctggtcggggcgagcctgagcaaaccccaggtttgtaacaacagagctgacgattggacaagcccgtttcttgtcagttttaaaaatagccgtgtgggaacccctccgaggctccctgggaacataattggattggtgtgcagaaggcctcgctgagaggcatcagctaacagatgatgaaacacattttccggctgcattttcctgaaggtagttgctaggtttctccttcggagctctttgttacctgagcggtctcaccgtctcccccacctccctgcttctcacttttcccttcgtttattgcttctccgcttgcacaagaccatgtcccggggcagttctttccccctttccaggatgcgtgcttgcaggggaaaccgcagctggcctggtccacaggtctttggaatttctgagcctggagaagaaccttgggacttctttagaagttccttttagagatgattggtgtgatgatatttctcgtatttctcgctactccattggcctccctgggagggcgaaatacactttggctagccctaaatgaggagaaaaccgaattcatctaagtgctactcaccgtatctttaaaaagttgaaccccaagttaatcctaattaatgcccagagatttttcatgtggaacccaaaacaggacccaggacacttttgcgggggagggggggcttttcccgttcctgcgtggaagcagaattagcaacgctttcaccagcagcgaaggagaggggaataggatgccaccccctctgaactgtgcctaagcgtagctgcgcttggagcaaggcacagtttttaggttgtgttttaattaacaccgacgagaggggcttctggtcaacccagaaacgttgacttcactgtcaacagtaagaaatgcgatttggagacggtgcgaatgtgactgtgtgatgttctgtgctccctggccgccaccccagcacctaggctggattcggcatctctccacgtgttaaaatgataatagtaataaatctacagttccttttgtgtggtcatcagaataagccagaatcattaaaataagccagaaacactgcttaggagaaaaaaatgtattaaaaaaaatagtgccattgctcaaaagcaattggtgggttctttctgtgcttcgagtacctgagcacttcttaacctccctgatcagaaaagcctcttcttgcagcttgttgcaaagaggccctttcaggcttattgaattgcaaatgccgccgggcgacacccgaccccagaagggctggagcttcctaaagccgctggagtttcccagatgtgcgcctagggagcacctggagaggggctggaaggcggggtcgtgtgggttttggcccagtggttactggatggtaaacagtgtggaaagtttctgaggacatgctggtgcttctgagcgaaatccaggctggtaggcaagggagccgccccacccccactcctgggcctcagatctcccacagggcggtcccgggacccccttcctcagctggaatcctgtctaccccaagccagtttggatcatgctgtcacaacacttttgtccacggaaacaatgactttttttttccaggacagctgattttcctcgagaaagtgccctcaaatgtgtggcccatggaagggggaagtcgtgccgggctcccttcaggcagttgcgcaaagctggggtggactccgttaggaaattctagccgggatccgctttcaggagccaactagcagcagtggcccttttttgtttgtttgttgtttcttttaaagtaaggtaaatggggtctccgttctgcagaaagagcccggggcagggagagtaaagtacttgctgaactcggtgcgctggggaggggtgtgcactgctgccagcccgtagctgttagagtcgccaatgagctcactctgcaatcagaagtcaccggggttttatgtattaagccctttgggcaaataaaagaaaacactatttgtggagtggctcagagcttccacttaataagctactcagccttcctttgattgacattgttctcagaatacgtgtttattatcagtcagctttggcttagagagttcactctcagaatgtctacttaatgtggaaaaatgacccttgcgaatggctggcctctaaacacccgaattgtcatttcctcaaaaccctccggcgaggagggtgtgcctcacacggttgcacagtggatgtgggtctgagtcctacggaaggactttcgccagcgccccggggcagagtgtccggaggagggaggccacactggtaggggaggggcggcaagctggccacatttgagcaatcggaaacagacaaatcataactctgattcttaacaagacataaaagagaagcagcagctggtaccatgtcccagtccgatggtttggaagttagtggcagttgccgggttggaagttgtgctggtattcctttaaataacaaatgagggcctcagccaaccggtgttcccagaggaggagaaaggctgggagctgagaggtgtcattttccttctttggtgaccggtttcattttagctgatgcttgacgttggcatcaggtcctcgtcttccttttttcccaatgctcactgagactggggacagggttgagagtcccacgatctgatctgcaccccccatcccttgatgggtcccagagcctggcccaagcctgtggctgcagggagagggatttcccctggagagggaggaagcagccgatggtatgctggtgatggggcagctttcagctcagcccagggacccccacaggctagcactgcacactggtgggcatcttgttttccattagttggtcatttaaccagagcgctaggaaagcaggccgtgctcccctaagttttgtctcataataatttcacgttcattcctgatacttgcttcacttgttcccaaggccagtgggattctttgctccttgagtgtattcagacacactcgacctgcccaccccccacaccccccagctgctcctcctggggtgctcccgcgtccaccgtagagagctgcctagtgacccctggtgcagctccagagaggtcctgcaagcttctcccctccacatgcagtcaatggacccatcctgcagattcttccaacagagtgtgtgtgctctgctggcttcccctctctgctttgccaagcccaaggggatccacagcgactgctccgctctgctggcctcccgggtgcccctggactctgcgcaggtctcagccttcccgattctctcaggggccctttcctatgctgacttctgactttggatctctcttgattctccatagctccctggaccttcctttcaagaggcttagatttttcaaccacacttctcttttgggggtagttcgccatcttcttccttagagggtacacgtaaacaccatgaaggcgggaaagggacctcttgtccttagttctgacatatggtggattcaagcgagcacttgccaatacacagaactgcttaaaatataggtcaggtgagtgctgggaatactgaagtggtgattctggacagtagtagtttattggctgaaaatgcactcacttgatttacatcggggttattcaacttggcaccgttggcatttggggctgagtaattcttagccttggggctgtcttatgcattgtaggatgttcagtagcatcctttagttgtgacagccagaatctctccagacattgcccagtgtttcttggggggtgaagttgcctctaattgagaaccagtgggctatgtcctgagacgcagagccctagctgcagggcttgcattgttggggggcagacaggctgagatctccgagcctttggtacctgtccgatgtatgggaatttccacagcaagagctaaacagtaggatccaggggttcctgctggcctttcctgcagggaaagtgttttcactatggtaagggaagcctaggaggggctgaactctcgcaggggcggtcagatcattaagaaatggatgcgttctgttggcactgttttggattcaccagcaggcgaggaaatgggagccactgagtgatttcccagcacctgctcccgggtttgtcactgggaggagcaggcctgtgtccgagctccagaagagccccctgctgtggcagcggacactgggttataggcagggacttgggctggacgctggattctgggggaattgtctggaggccaccccagccagctgccttgcgtggcctgtgtgtggacatggagctgctgggtttcctgctataggaggtcggatctctcctagtgtggttctgaacatttcctttagggagcttattatattattagaaagcagattggctgggcacggtgactcatgcctgtaatcctagcactttgggagctgaggcaggcaaatcacttgagcctaggagttcaagaccaccctggcaaacagcaaaatcccatctttactaaaaatacaaaaaattagctgagtgtggcacacctgtaatcccagctaccctggaggctgaggcatgagactcacttgaacctgggaggtagaggttgcagtgagctaggatcatgccactgcactccagcctgggcaacagagcgagactctgtttcaaaaaagaaaaacaaacaaaaaaacagattttccagccccaacctggaatgcattctcaaggagtgaggcctgggaaccagcattccagccagcttcctgggtgctttctaccatgtctgtgtttggggctgctgatctcgatcctgcatggccagcgtgcgtccgtgggattcagcctcttactctgaacgcattctgagacttttgacccatgatgccaatacagaccattgcactgggattctagtctgtgaaaacacaggctgcaccagggaagtgaccttagaccagaggttggtcagctttctccacgaaggcctagagaggcaacattttaggctttgcaggccgcagggcctctgttgcaaggactcctctcccctttgaagtgcaaaagcagccacagccagtgtttaaatgaatgagtgagactttcttccagtaaaagtttatttatacaaacaaggtggtggcacgctgtgggcaaccatttggcagtttctcaaaatgtgacacatagactgtgaccaagcaattctgctcctaggtatgtatcgaaaagaattgaaagccacgactccaggcgtttgtcccccaatgtgtgcagatgtgcagcattatccacgagagccaaaaggtggaaatggcctgcacccacgaacagatgaacaaaacgcagtacattcgtgcagcagaatattattcagccatgaaaaggaagttttgatatatgttacagtgtgaatagaccctgaaaacatgcttaatgaaataagccagacacagaagggcaaattttatatgcttatgcttatatgaatttgcctagaatgtagaaaagaggttactgaggatggggatgagggaaggagttattggttaatgggtgcagaatttttgttgaggatgatggaaaagttttgggtgtagatagtggtgatggttgtaccacattgtgaatgtgggtaatgtcagggaattgtacacctgtgaatggctaaaataataaatactatgttatgtctatttgactacattttctctctctctctctctctctctctctctctctctatatatatatatatatatattttttttttttttttttttttttgttatggagtctctctgtgtcgcccaggctggagtgcaatggcgcgatctcggctcactgtaacctccgcctcccaggttcaagtgattctcctgtttcagcctcctgagtagctgggattacaggcaggcgccaccacgcccagctaatttttgtatttttcgtagagacagggtttcaccatgttgatcaggctggtctcgaactcctgaccttgtgatctgcctgtttcggcctcccaaagtgctgggattacaggcatgagccatcacacccggcctatattttttattttaaaaaatggctggttggatttggctgttggcaaccccatgctttggacctatgctgtttcattagtttgagtgtgaggttggattcaggaataactgggccaactcaggtattgggcttaaacggagaaggtgagttgggttccttgaacataactagttacaactttttttttttttttttgagatggagttttactttgttgcccaggctggagtgcagtggcatgatttcagctcactgcaacctctgcctccctggttcaagtgattttcctgcctcagcctcctgagtagctgggattataagcatctgccaccatgcccggctaatttttgtatttttagtagagacgggggttccactatgttggccaggctggtctcgaactcctgacctcaggtgatccatccgccttggcctgtcaaagtgctgggattacaggcatgagccaccgtgcccggcctagttgcctagttacaaccttgagtggaacgtcaacttctcttccctcctcccaggagaagggattatcggcctgcacctgcagtctctgagacccccaagccttggctcatggctgcctgtggaattattcacacacgtggaccccccacatgtgttatcagtgctacctgtaaaacgattagaatttccctcctcctcacttgtgataaccctgtgatgcataggtacatttcagcagcctcaggactgagactctggaaagccctgcattcgtgatgtgacattgaagtgtgccccatgtgtgtgcacttgaggcatttgctcagccctctggagctggtcgtcttctggccagggtgctgttccatgtttgtggctgagtgaccattgcgtattcttcatgcctttgaactttttcagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcttcggagccattgccatgggatctccggttccgaatcatccacgagacggcggtgggcatgaacttcctgcactgcatggccccgccactcctgcacctggacctcaagcccgcgaacatcctgctggatgcccactaccacgtcaaggtggggggccgcacggtgcccgagagagctgggcagggagggcctgtgtcttggggagcagggtatcaaggggtcaagccctgaggtcaggacaagggcagaagaggaggtggttcttcttggaggaaagagcttgaaaccgaggccttttgcagcatgaggactccaggagcctaagcttgtcctggttggtatgaaaaccacacgccatgtagctggagggtagcttggtgaacatgggggctgttcccccaaatcttggcatatgactcattccggaaaaagattacgggtttgtgggttttggtcttatgaaatcaggttagaattcagcccgtgggccaggtgtgtccttgcgagaccttaggctctgcaacaaagggacgcatttccctcagtgttttcaggagctcggggtggtgggaatgtgggggtcctctgcagtggggtcctcaaagtgctgtggaaagaggcttgtgaggaggggctcgttgcctctgtctgcccctgcgtagagtgcggagtggcagcgtgttgcgttagtgcaacgcctgggagatggagcttgcttttgcttcgctgataggtttttgaaacacagaaaagtaagagagataatgtaactgaaaaccagtgttgcctctgggccttggcaggtgttagcatcatcacctttgcatcagggctgtatttccttgtatctcctttgatggccttcgtggctagggttgtactgtcgttgacatgtggtggttacacctggcgcgttgtagtttttccccacgtggtgatgttcacatgctcttgggaggcccagggtgataggctggtccacatgacactggtgtctgccctgggagtgagaaggagccgagagccatggtccggatccatgtagttcatgcaggggacaagcagaggagtcccctgcctggcttggctgtgctactgttcctggtggcacagcacttccaggcctctctgatggcctgaccattaattaggagagacctgaattcagggcccggccctgcccctgagctcttgggtgggacgggagcggtggctcgtatggcatgcgcacggccgctccctgtgcccagactctgcggacgagtgcatctcgcgtgccttgctcagccagggcggtggtgaggaggtcaatttttcacttcgggcagtaattataagttgtctcttaggtaggtgttgcgcagtaataagatttcagctagaagatgaagcaccgtcctgcgaagtgaagtaggaaattgagataatggagacaaaaatcaaatgacttggcttgaacgggctctctggtggtttcccgcatctgcttatgttctgggacccctgggattcccgtttcctgtgatgggcagggctgggcctcacatgcggaccccccattcccgccaacatttacgggcttgtttctaggtagcacaggctctggggccctaatgactagtaagctctgccgtccaacgtgcactgaataccggaaaggacatgctagaggcttcacctgcgggagctgccctcatcctcagagcagaggtgcagagtggacggtggcctctggttctcgctgagtctctgcttagagtgagtaaattagcagccaggatcgtccagctgtaagtcacggagcagagaccttgatttccacctggcctgccactgtgcttgacatgaaagaaaccaaatgaccactgcacgtagcagtcacttgggggcagggtgtgtggcccgcaggctgggcctagaggcggccctgtgggagggggtgggagtgctcctggggctgggccttcacacagggtggggcttttctgccctcaggagtcggggcaggcagcagcagagcctttaggtgaaggaaacagcccaagagacgcagagagctctgggccttcctgcaggggcagcaggcagcagggcttccctgtctttcaggacagctgcagggggcggatgctgcctggaactgctttctcagggaggctgctgtcgaaggcacgctgggtgctggccaggaagtgacaggacatctctgtgtggtgcccctgggacatcttagggccctgtgtaccctgacaggccgcaggaaagattgcttttgtgtggcgtccttcttaatcaggcatgttagtcaccatcaagaagcccaaaaacaaaccgaaaaatacctttacgtgacatacttattttttctgtgaaatagctactggtgtgcgtagagtgcagcagggagtgtgtgtcggggttctgagagtcagcgcctttgttcctgaagacgaagtgtggaagctttgcatggactgaccactgggcttctgggcagtcctcagtagacagttattcaatgcaggaaaactgtaatccagaatcctgcaattagatcctaagttgccattccagtgctgccattcgcctctgagatgggctccctcagtgctcagggctcgattcaaactggaaatatcacagcaactgtctacttcatgaagcagttaaatgtaaatagtatacaaagtaatagtatcaaattaatgcttgatattattcaacattacatatactaaataccaatattaagatactagttggaatcaatttcaacttaaaaatgaaataacttggtttaaaatctcaggctgcatttatatgtccagttagcccaaaacagacgcttttcaaagggtcacacgcgggtcacgttctgctgtgtctttcttttagaggcagcaaaaccccggcaggctgctttcttagtcttgacagctggaccttgaagttgaagggccatgtgcttgggggcagctgtgagccctcagctcttggagatgcagagtcgggtgctgatgagagtgtttgtaactcttgaagcatttgctggtcagagtggatgccacagtagctcgctgttgaggacacggggtgaggggcagcttgggtgggaagatgaggaaaggcggaggggaaatgcagccggccaggagtccgagacatggagggaggagaacatagagggtcagtgaccctcctagaattctcaattccgagcttgcattttgttgccagaggttttacagagaatttctgctcgttttcttttcaccaagtatagtttggagtggctggctctatctgacaaagacaggaggagaaaaggctgcaggcctggggaagcaccaggctgagatctctgcacccctgtcgtttttcttttcttttcttttctttcttaatgatctcagatgtcatttaattttcacaacaaagctacaggatgggtactgctattgcctccttttatgaaaaaaggaaacaggcacagagaggctaatagtccagggccacggagctactaacttgtacaggcaagattagaacagtgagtctgatccttaactaaccgtgggagggagatatttttttcctacattcaaccatacagggggaggaggaattgcctagaaagtatgtgatgctttctttatttttattattattttttattttacttttagttccgggatacatgtgcagaatgtgccagtttgttacataggtttatatgtgccatggtggtttgctgcacccatccaccatctaggttatcacctaggttttaagacccgcatgcattaggtgtttgtcctaatgctctcccttccctcttcccctacgcaccgacagggcccggcgtgtgatgttcccctccctctgtccatgtgttctcattgttcagcccatttctgaatttgaaggctttcaagccactgatgactgttgaactgaaacttcctgtgctctggagctatttggagagttaggacccgttgttgtgtcccagcgtccagcagccgccggggtttgcagggtcgggtgatggcgttcctctggggagctggcgctttccctggagtgcagagtgtggctctcaagggcggtgcaggcctgaaggccctgggagaaatggaagtgggaggacatgagagccgctggagtcgaggccttgtcctggtgctcctggctgcagagaaggagggccggtccctgctcgcaggccttcccccctacctccctgcagatgtgctcaggatccctggaagcccgagtcacaggtcataaattctcccagctgtttggtgctgatgacagcagccctattggctcaccacatgggcatggccagcccagaattaaggcctgactcagcctcatttcctgtcactccatgggtgtgtttgagaggagctcaagagttaatgaaaagggtttttaaaaaaatccatatgccttgaaggaaagttgagagcagcactccccctggatcaagagtcccattaatgctgatgacttgtgtcttcatcccacatacggttttcagcagcttcaaaggggactgagttacactggagagggtaggacactggcaggaaaggggatgcccccgagagaggtcagaccgggggtctgtgaagtctccccagtgagctccaaggtcacctttgcccgaaggagacctgagacctgcctcccctgaatgcggacgttgagggcattcctggaggagctgggtggccggtgctccttggggcccgggcgctgccagcagaggtgtttatcagaccttcactcgaacacatgtgtttgaagcagccagccagtgtctgctgatcacaaaacactccagatggacggggctctgaggcgtgtgttttgtttgctttaaagtttaaagggcttctgaaggtgtgtttctgtgtttccctttaaaggacttgcagccacttgcccgccagcctccccagctggcaggttgcataacctgctccccgacttctctaggagcagacctggtcttcacatgtgtctctctttacctgaaccctcgaaggcttgtttttttccctttatgccggctcagccggctctcaaccaccatggcaaacatgatgctttacagaaggtggattctaattcttctgcagttctgtcccggataactccttccttacagtacgattctttcacctgcccgtcaaatgtgctgctcctaatgcctccaggcttgcttctgccccagaatctgtctccctccctgcctggggcagggctacctggagaggcacagacacggctcttaggggctcctggaaagctctcacccaccctctgagattgcagaagggagcttttgataaagcatcataaaatatcactgttgcaggctaatgagccccgctctgatggctgtgttgcagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacaggtgtgtgacatgccgccccccatcccctgtgggtgccaggggctctcaacctcaatgcttcatgccctgagctgcagctttcagaaaggcctcttgctgccagtcagaaatggggctcgggccaggcgcggtgactcacgcctgtaatcccagcactgcgggaggccgaggcaggaggattacttgagcccaggagtttgagaccagcctgggcaacatggtgaaacctcatctctacaaaaaatacaaaaattagcccagcttggtggcgtgcacctgtagtcccagctactcgggactgaggttgggggattgcttgagcccgggaggtggagattgcagtaagtcatgattgcaccactgcattccagcctgggcaacagagcgcgaccctgtctaaaaaacaaacaaacagaaagggggctaagtccacatagaaggggtgggtgcttgtagagttcagggatttctttgctgtgagtgttgctagccaaggaggaagggtgttcccaggtccacatttgggccaggctgacagccctgccctgtcagagccttggtgatttcatgacccgtgggctttatggcttgtctgttggaagaacctgctgctttcagtggtctgtacgcatgtgtgtttgtactttccgaaattcactctgattttgtgaggcgagcagctcatcttcttcatggcacttaacctttgttggtcagagatcaatccccaagtcacctagtcccttcctttttcaaattgtaaaggtcttaatcacacagacttcttggagaagaaaagtgggtgggagcgtgtgagcaggcactaagcctcccattgtggctgttatccagcagcactgtgactcggaccccgcatgtgagctctgccttttggtcactgccgccgccagcagcccaggctgactggtttgacagtggccattgtgcatgtgcttagctggggctttaagctgagagttgcctggaagtgtcactttggagactagtcacagcttgtagagtttggggagattgagatcctctccatttattttagagtttggagttccagcttttgaacctgccgtttgaactaattttcgatggtgaattcgttgtctataaacagccctcaccaactcagtgctccttggaggctcagttttcggacttctgtttttcttttcttttttttttttttttttttaatcaatttgggcactttttttggtgtatccagagtaatgtacatgaacgtatccctcatattatctatatatttctaagcagcccccgaaaaaggctttggggcgttcagctgtgttgtctcctacgttttctgcgcactttctttaacaaccctctaatgatgaactctcagtgagcctctgttaggaacgctgaaatctcagcaagcctacgttaggaacgctgatcagaaccagaatccgtgttttcagagaatgaaatcattgttgggggagggcatgggagttgcccatcattcattcatccatttcttcagtaaatgcctgcgcaggtgctctgtgcctggtgcttgcgagaagatatcagtgaggcacacaggcgctgttccccaggagctcacgccccgcatagggtggcaccctctttggaagtccctcaagctgcctgaagattgtagcccagttggcgaagttacttgagtctgtctgacatctgagctatcaacatgctgggcttcactatagagaattttctctttttaaaaacaggagaaatatctcggtgtcatggctctgtctttggaaggcttcagaacaggtgtcttcacgcctgttgctgtgcatgagtgcatttggctttgagtctctggctgtcagatgctaacgtgcctggtttctcttccagctttgcgatcgtcatctggggcgtgctcacacagaagaagccgtttgcaggtgagtggacctgtctttgaggtgtaatgtgcttgtctttcctggaataatggggggacaccttgttgtcctttctctatcctaaaacagagcctgtgatccacgctgccataggtgctgctctgtggtgtaatttgcatgcaggaaaagacacagatctgaaggggcctgttcaatggaatgtttttaggtgccagctagtttttttgtggtagtaaaatatatataacataaaattggtcatgttagccatttaaagtgtataattcagtgacattaactacactggcagtgttgaacaagcgttaccactgtctaattccagaacattctcatcatgctagaaggcaaagcccatggccattctgcagtccctcgcccttcctcctgctcaagccccagcaaccactcacctgctttctgtctccaggggtttgcctgtgctggtatttccagctaattcttttttgtttactttttaaaaaaatagtcataaaatacacagaacaaaacttagcatgtcagccgtgtgaagcatacagttcaggagcattacatgtacccgcgtgcttgcgcagccaacctccagagctgctcagtgccatggagttgcttgcaggagtggcacccctgcccagcttgagagctgtggtgtttgcttccccagccaggcagccaccattccgaacaccatcctcaaagttgtcacaccttgacttacttatcataaaaatccaggactttttagctttgttggacagattcccttttcctctaaagacatttctgggctactcatgatattttgtggtgtgaccgaaaatgtctaaaaatgaagatgagagtcaaggcctagccccttgttagtcggggctcagactaggagccgatgtatgggaaagtgctggggtgagaagagatcttccagcatcgcaagatcaagtatcttggcagctttaaaagaatgtcagtagaaagcacagaacgcgtcctgccaggcctctgctggccggtgtccgtctgtgttgtctgaccgcctgtcgcctttcttgccttctgtacgttctcccgcacagtggcctacagcccgaaggcttgtgaaatgaggcagtgtctgatagatgtgacacccgaagctaggcgcaggggacaggtcaaggctcaagcccttgtgctttattgctgaatatgcctagtgttcccttattggaacgctaatcatatgggaattattcgtgtcctactgttcaaggtcatcgccaaggtctgatttttcaaattcaaaaaattgcaacctcaggcaaaaatgggtaggagggggttcaaggtgcaggagaacaaggcctctccccagcttttccagtctgtgcttggcagcaggaaacattccgggcgtttacttcagtttgcttccattttatttagaggagctgttggttttgaagtctgaataatcatggaaatagcctgctaaacacttaacgatatttattgcacaagatttaatgggaaagtggagcaaaacattgtatggaatcctggcagccgtgggtgattctcggctgattttccacacctgctgaggcacatggcctctccaaagagctgccattccatgcgtgggtgtgtttggatctggagggcagagagggctgttgggaacaagaaccttgagggttccaggctaagcagaaaaaagaacttggcccactggatgtcaccctgggcccttcccagtcagggtagaagttgtggcaataataataataagctagagcccatgcatgctagtgaaggcagttggaaaggacaggtgcggccccacatggtgaattgaggggaaagagcccttccacacatcccagccctggtgcaccggcaggggaggccagctggggacctgagcttgggattggagttggaactgaggaagacttcttcgccattgtagagagagttgggtctctgtggatgtaggacgctgtggctcctccatggtgcgtgagcctcattccctttgctggcttgggctgttgatggaatgagcctcataagatattgttctcctttgaacctcatcttcctttggatgggatgcctagaaagatctgctctgtgaccaaacacactgactccttctggtagatcagaacccagggaaagaggtcgatttcaaaaccaggaaactagagagcatggcgcaccatgagggtgagggttacaggaagctctgcctttgaaacggagtgggggagccgtctccctggggtggtgtggggatggccccattgtggcccccggcgagtgtgtcgtttcctcccaagggtgagatgctgccacccagccctgcagagcccctgactcgcatccttcccttggcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaaggtgagcaccccggggtctccccgccacattctgtgggtgtcacaggagacagaggtgacagacaggacagggtgagggaccaggcctgggtgagaaacaaggcgtgtaacaggtgggccgaaatgagccctgcacagataggttggacccagcacctgcctgcggcctctggtactcacggctcggccacggcagctggaactgagttgcctccaaccatccgccccctgctccccaccagggttgggcttgccacccagaggagtctgtatgggagcctgaagttcaggtgcagccatgctcttcccggggacttacctggccggtggccggcggcgtcgcccttctcttgaggagttgacttcctgggacagatgtgtctctggcataggaaagtcaccctgatgagatggaaactgctgcatttaaagcttacggcaggaaacgggctgaatggggagctcatccgccaggtgctggcagctctgctccctgtgactggcaggtggcgctcccccggggaaggcttccgccttgagtctggtgaggccttcaaatgattaccgatgggggggcctgggtttggccagcaaattgtccatgtagggcccctgggcttgcctggtgagctcaggctgggccgaggcgtgtgagaaatcccccagctcgtgggggccctgcgtttatatggaacgcgtgtgtacgcagaagtcatcatccgagtgacatgtcccctttcttccccacaagaaattacttctgaaaccgaggacctgtgtgaaaagcctgatgacgaagtgaaagaaactgctcatgatctggacgtgaaaagccccccggagcccaggagcgaggtaacgagtccttcccacaggggtcttttgtctcctcggcttccaggcaggagtttccaaaccactcctctttgcagagtcccccgccgcccggaccactctccctctcttctgagcccatcccgcacccaactccattagaagtgtaggtcccatgggggctcaggtccacctgcccgactgcatccccgccccacctcctgtctgattctgcgtgagtggcggaagggcttccctgacactaaatagccactcattggatgtgtgtggaccacggggatcagaaggcccagccccggccggggagggagagctggtgtctgagtgtctttgcacccctggctcggggatccagttcctttatagctgcccataaatggtctgcactctgatgagtgccacccaggtgatttcagatgtgataagaagctccaagtagcagggctggctaaatgccttttcgggtgatgaggctggagcagacctgtgaggcccagctgataagtgagctttataacgtgttatctggtgttgggcgattaatcccaggctgttggtgtgagctcaggagatcaggaaatatgtatatcaggaatatgcgcccactgcctcaacataaagtgcatgtgtgccagtgagcccgggagcaaaggtgcccgggggttgctagtacagaggcagacctgggccctgataagggaaagaaggcaaccaacatgtaggggtggctcggtacacccagcaacagtgcgggacctcgagccgtcccacaaagggtggggagttggggcaaacaggtgtgcctaagggaagaagcgtgaaatcccgtcagattccacttacccaccagaaacctgctgcccctgcagtccatgaagcgagactctttaaaaggccccatcggtgtatgtcggattggatcacccctcgtccctgtagccgggtccttcccctttccctcgtccccacacagcccccaggccagccccacgtggctccgcggggaggtcgcagttgtggccacgtgtgggggtcctgcccagttcctgtctgtcctctcgtttcctgccaacgctggcctgtgctgggcagctgtgtcccgccatacatgcctcacattctgcagcttgacaccgcctgccttttgtctgggtgacgctctgtgcagtgttactgagcagatggtatccagagctgcatgaggctggattttgcacttttatgaaggctatctttccttaagatgtctccgtgctgggtggggccagcgcaagtctttgtagctccaagtctttgagctccctggcgctgtgcgggtgcagagtctgagcatcccaagtgctgtgcgggtgcagggtctgagctgcccggcactgtgcgggcgcggggtctgagctccgcggcgctgtgtggacatggcgtctgagctccctagtgctgtgccgatgcggggtctgagctcggtgaccaataggttatctgcattgcttccagggtccgtcctttcctcccccatctccctcccgtggcccaccttgctcttctgtgtttgtgtcatgggcgggccatgcggtctatggcagggtcttcacccaccccctcttctgcatcttcgcaggtggtgcctgcgaggctcaagcgggcctctgcccccaccttcgataacgactacagcctctccgagctgctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcggtgagtggggacgcctctgtgtcccgagagatgctgggcttggcgggacagtggactggactcagtgagaagctaaacggaatcaaggggacagtttcttgacccagcaagaattcttctttgtgttctctctgtcttaagtaattaattttgtgtgttgggcatttggctccgtcttatgtcacttagcatgtgtggggaacaggccacatcaccagtctgtgcagcagtcttgcctgtgccagtgccatgggtggaggctgacctcaggtctacagattggaaaccccctccagtgcagtgagcctggcgagtagccgagccccactccctggcgggcctcctgtctcgggcgtggcagtcccgcaccctctgctcagacgctgctgggtacacacccacgccttcgcatatgtgggctccccgttcacggtagtccaggcctagtaatgtgttggttatccttggaggttttaccaccaggccacctttgcaaaccacctgatagggaggagcacttctcttttagctaatctcatctttttatgttaattttgatggcttttgtttctggaaggtgctttttttcctatccctgccccagggtgctggacctggtgcttgttctggcctcctttctgccggctgcaggggtaagatgtggtcctgccctgttcctgaaggggctgcagctctgatggaaaatacagggatttacactcagggctacagccacgggggctgagggccaaggctgcaatctcgggggaaggggaagttggcttttcctggtggattggaaacatcctcttggaggcaaagacttttcctggatcttacagacttcccgggatttttagattagaatattgggggcaaaggaggctgtcttgttttaaggcaatgctacatagacacagtggggaagacctggttcgacggcagataagcagtgggtgatgggcttgaggaggagagtcagggcaaagtctaagactgagcagaaagaaataccaccatctcccatggataagtacgttctagaacattctctttgggtctaatactctgaaatgacatcttgtcttcatgctcgagagagaattacttcactggctccacttggagtgccagtgttcagacaccaagcctgactgggagggttccgttttcttaacaccttcccaccgccgacttccaagtccccacgcgtttcacatgagggcggaggagagtctcgttgcagggtttcagcattccaggcactacggtaggatttttgtggtaaatacaacttttcatcctgagtgctggactaacgtcctcctgaaacgagaagctcggtcccttcaggattatcatagaaaacttccgacttaacctccccaggtcaggaggtgccacttcgaggtggggcaagagctggagcagccccttccagctctagtcaccatctctgcaggctgctaggcctggggcgtccgtgggtggcaggtgccaaggcttccaggcgaatgggagctctggcctggtctttttagtctgtgccctttttccttctttctttaatgaagggatgtttgcagtcactgccatctctaagcaccaagggggctcaccaccccgcaggacagggagagcgggttttattttgcaaaccgactaacgagcacctgggagacattcgccagcctgccccggggctcccgctaggactgaccttaatcacgaggcacagacaacgctcaaacacagtcgggtgaccagcgagcagcctggaggccatggcactcctccacctgagcgccacagccaggctcccagagacgccacgtccctggatgtgcagccacgctctgacctttgcctctcctctccctgcagatctgggcaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcgcggaagatcagtgtcaacgccaaggatgaggaccagtggacagccctccactttgcagcccagaacggggacgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccatgacctcagacggctacaccgctctgcacctggctgcccgcaacggacacctggccactgtcaagctgcttgtcgaggagaaggccgatgtgctggcccggggacccctgaaccagacggcgctgcacctggctgccgcccacgggcactcggaggtggtggaggagttggtcagcgccgatgtcattgacctgttcgacgagcaggggctcagcgcgctgcacctggccgcccagggccggcacgcacagacggtggagactctgctcaggcatggggcccacatcaacctgcagagcctcaagttccagggcggccatggccccgccgccacgctcctgcggcgaagcaagacctagctggctgcctgcggagaccgggggtccacgtggggctcttgtcctgtcctgtgttcctcgtggggatggaacgatcctgcgtggggccctgttgtggcttacctaaatgttaaccaagcagaggtgacatggtgccatcaggaggcggctgctgctgaccggagtgtcccctccaggtgaagctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatacatgacggtgggcagagaggcctgtcttaaagtttccatggaattgttttataaaatatcttaagagatgaataccttatcagctgttgcttgaaacctgttaaaaatgttcataacattggatagtctagtctctaaatgatgactaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcgcccttcccagctctcatttttgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaagctg

SEQ ID NO: 38648 - DNA, 1694209 bp, Homo sapiens
tccggctctcctttgtttattttctaatctatatttttactggaagatttcctctttattctctcccgccctcctacaagcgctcttgctggccgtctgggtgcacacaccgctccctcgatcaccccagcccccttcctggtctcccgagcgcggggtttgaaggtcacctcctttccagtccccgtgcgagccgcgctgccgccgcctcctccagccagagtcggtgggactggctgcgctgccctgaagtggttctccaagcagcgcggagggtggcggacggcggacggagcccaggggccgcgtcgggtggggaaacccgaactcgcggaggggaatccctccccctccgccccagccccccagcagcacccgcggtggggcgggggcgctctgccagccccgggaacagcagaggcggcggcactggctggacccacgcgcgcgcctccggggctgaagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggtgagtgtggctgggggtgcagagagcgcacgggaattcgggggtctggggccgagaacgtgaccgcagccgggctcgccgggagttctaggtaagtccaggcggagtcattgcctctgcacccaccctgacctggtgggtcaggtccagaaggtctcatggagggaagcgctaggtccccgagaactggcctcctcctagcgccagtctgggcgctctggacgggaactttttcagggtgtgtggaaagatctcgaggcgtgtccccccctacccccaggaggccgagaccctgagcccccttgtgcgtcgcttccagaagcacgtccttccttgccccagagcgcccctccgaagcatccaggctacctcgtccgtcctcctgggagcgagtcctaggtgccaggagcagcgggagcctgcctgcgcactttgattagtctccctggccggctgcaagcgtgcactcagcgcgcccccggaccgctgcctccgcccgcagggtgtgcaggaggaggcatcttagtgacccgggagggtgtttaggtgccccgaaccccttgtgggaggaggggaagagaaggctcacttatgtggagaaagcgccgctgtgtttactggcactggaatcgatgccccgcggtgccacctcgaccccaggggagggggccagccgggaaacctgcgaatgggaaactcctactgtgcccctggttcctgggagccttagagaaccttcaccccagagaaggaaacacaggggtagcagatcttagccctgtgttgttgtgcaggccaggggggggcttgtcagctccaatcaaccaattgtccagctatggaagcgagggcggggctagtggggcgccgctcccatctccccaccgcccaggaggccacttggctgtgagctcctggagcctccctggcgccagctgcggggaccaggtgtcacgcggagcccggaagctgtccactcagcaagggaggggaagaccccgatctaaccttgtcctggagcccccagctccattccttgctgccagggaatggtcagggggctgggagagctcatcgctcctgtgtgggccagagctggggtgcacctgctggcactggaacatctggggtgcggctactgaagagcttggaaatcctggtcaggcagtccgggcaattggcaccccaaaggcggatcttttcagttgaacttgaaaagaagtgggggagtgtggtgaaatagctttgttgagttgaaacatcatgtctcctaacttgggttttcctttattagaataatgattgtttatttttatttttaaactccgttgtgcagagaggcctggccttgacagcccaagtttaggacatgccccagcctgccatcccttccctgccccctgtcctagttcatctcccctccatttatcattttatctttgttacaaaagagagaaaaaaaagatgagagggcctggattctttcaatttttaagtgaccacagaggccccggctggagctactggcagatttatttttagctaagatcttttatgttcagaagcaaaggacctggggcctgtgaagggtaaaggtggtgctggcagtggctgtgctggtaaaaagtggggctgactcaaaacctgtgtcctctttgagctcgtcagggaggccctccgtttggaagaatcccctgggctttccttaagttagcttatggttgcctcgggttaggaagaaaagtcatcattcctcgcggtagtggaagtgacaccttaggggtccagagagtggagctttatggctcagaagagcacagggcttctggatccgttatctgccagctgtgtgaccttgggcaagttgctttacctctctgagcttcgggttgtcacctgtaaaatcagagtttcagtcgtagttctgtcctcagagggtttgggggtaaattacttaaagcactaaacatttagaacagtttggcacatggtaagtgcctgaattctatgagttttgtttctttattctttcaagtagattcctctaatttttgagccttgtagcaccgagtggtacaggaaaggcaggtggcttgccttatacacacacgttttcttttaagtaaggaacagaagcctcaagctctcccattctgctctctgcatgttccaaggaggatcacggacaagctgcccacccactggccaagatataggttggtggcatttgacttgctgtcttgacaagcacctgaaattaagtttttgcagcagttgtacatttcttctgacccactgaaaggacttgatctccttggccccctgggatgaaagtattaccttagcaaatctgtttttttttttttaattagaacatcatttatttaatacatagaatattttgaaaacacaagaatcgaagaatattagaagtggctttatcattcctcctgggattcacacattgcaattagtatgtttagatataaaattttgtggccaggtgcagtggctcatgcctgtaatcccatcactctgggaggctgaggtgggcgtattgcttgagtccaggagttcaagaccagcctggacaacttagcaaaaccctgtctgtactaaaaatacaaacaattagatgggtgtggtggtgcacacatgtaatcccagctaccctggaggctgaagtgggagaatcacctgagcctgagaaggttgaggctgcagtgagccgatatcacgccactgcactccagcctgggtgaccagaatgagaccctgcctcaaaaacaaaacaaaacaaacaaacaaacaaaaaacaatttgtgatagtatctaaacaatttgtgatagtatttaattgtataaacatataaacatctgtggcacacatttgcccataaatgaactgaatgcacaaataccttgatccagtttttagaaagaattttagttttgttgtggcaagaacacaacatgggctgtaccctgtgaaaagatttctaagtatatcatacatgactgttttaaggatagtattgtataggagatgtcaaggagttatttacctttactgcatgagggattcggggatctaaaatcgtcaaactcatagaagcagagagtagaaggttgtggccagggtctcaggggccagggaaatgaggatttgctgatctaatcaacaggtataaagtttcagtaatgttgtaataaatcttgctgtccgtagaacgtacagttttttacatcaccctgaagctacagagttttccactcagaaatgaagctgaaacatgggtctgagcgggtttctcctcctggaattgacccactctgccctatttttcttctcattataattgaagctatatatatatatatatatagaacctgctcctgtaaggtttgagcacaggtcttctagacatcctcatgtctctgatgattttagaaaaaaattaagcttagtccttttagctcgaaccatcccaagctattatattttatcaaagtcctttctgatagtacatattttttgtatccagaaaattgggtctgccctgtataggaatctgacatttcacctttccaaaaattagaccatttcgtttgcatcctttaagctgatgtgtggagtaatgaacacattccaagagggaaatcgtatttgacacagaaaatactttggagacgcagcgatttcccagtggcgtgtaaggagactattgaaatcctagcacgtttgctctgaaggacagagggcagctcgtcctgcctttgccacccagcatgggagttacacagtaagcatcatccacaaattaatactggctgactttcctaaaatcatcctttaatctgtcgctttcacatttacccacagtgtcgtgccggagacctcaaacaccgaggcgacgtttttaaagaagccacgaggctcttcccaatgtctacctccattatttaaaatactgcctcgaggcacaggtataaatattaaaactttaattaaagaatcaatcagtgatggagcttcaaaacaaggggatctagcactttcagatgatgtcaactgtgaacacagttagactcggtcgtagggctaggagtttttatgaaaaatgacgcgtggagttatatacacaggcaactgtcctcattttttgaatctgtagtcattgtgagcactgtcactcattaccactggtttgtcattgttcgctagtcaaagagacatgggtgactgtggcctgctgctacagaagagtgtgttgtcttaggggaaggagtggctaatgcaagaaatatttatttggaatgtaccacatgttagaccctgtgcttggtgaataaggcagacgagaactttcctttcttgtagcttatattgtcgtgggggaagccgcgtcataagcaagacgttgaaatatattttcataaggataatgaaaagggttccaaaaattatagtgtgatagtgacttggggggacattccagagaggagagatttgacctgagaagtacatgaaaagaagtagctgatctgtatggatccatacatttatccaatgagtattctactcatctccgctttcttttttttgaaacagagcctcacgttgtatcccaggctgtagtacagtggtgtgatctcatctcactgccacctccacctcctgggtacaagtgattattatgcttcagcctcctgagtagctgggattacaggtgtgctctgccacgcctggctagtgtttgtatttttagtagggatggagtttccccatgactggtcttaaacgcctgacctcaagtgatccacccgcctcctcggcctctcaaagtgctaggattacaggcgtgagccaccacgcccagcctcattcacccctactttctatgaattcctgagtgttcatcaggcacccactgtgtgccaagcactattgaaagcacttcaagtgcagagtgatcaatacatgcagataccttgtcctaaaagacttccgttctaggatagttgtctgcatggagggcgtttcagagaaggggaccaacaagcacaacgatccagaggctggaatagtgacaaaatcatacagttgaaggttggtcctataggcccttgtggcctgggaagggaccctggctgttattctaatgggaaaccattgggggattttatgcagagagataccaggatatatttatgtcttaaacattatgggaaaattgttaggtgtttttgagatgagtgaataaacaagcatgccttcctggccggccggctctattttttcaaagtttcaattcatttctatgaccagatttggtctgtggacgtagtgacatctgaaaaggtaagccttgcaacgtctgagaaattaaactcgattccccaccaccacctacttcgtagggcttacactaaaatctttcattcaagaagagggattactttatagggaaaaagaacctcattttccagtaatgttctttgtgtgagggtggaagaccctgggaggatacatctgtatacattagcctacttagattttctttctctggggcctcccttcaaagaggcaacatcatgtgttcttgtgtgcctgcatgagcagccgcaccctcccaccaccacatccttttgatggcttgactgacaagtctcctgggagtaccctgagaacagttgcactcagatgccctttattgatcgtctgtccgggtaggttccctttcagagtatggccacagattctcccattggtaggtgtgggccagggtaataacagatattgacagtgcaaagtgggttgcttatggagagctctgagtgcagccgacgttgtccatcttcagaggctaccctgcccttagaaggttgaggtgcaatttgttggagggtttggacacctggacaattcagttttcctcccacattgactgtctctttatccacaatactggaactgcattattgcctattatatgtgacatgaacatcagaataagtgtacatggattgaactcttcctatgtagcacaagctgagccaagcactgtaccttcatggctgtgtgttgtgctatgtgtttcaggcatgtgatcgcctcccccacccacccagcagttcaccttattcgattcctgctcatccttcaggttacaactcaaaagccccaggcttagagaaactgtccctgtttgcctgtgtcgattctcgttttttacagccatcccaggggcatcttatattttattgagtgactctgttttatcctttttctcttactccactccatggtcaactgcaggtggaccatgcatacacctgtttggacatcactgtctccttagcatctagcgtggtgcaaggcacacagcagaagccccatatggaaataatgaattattccatttgatgcttctcacacactttgaggttagtgcttttcagatccccattttgcagatagagagtggggtgtaggcaggcgttaagcaatttgtccaaggacacaacagcaggtaagaggcacttccaagattttgaacctgacagtctgagtccacagcccctgatgctcatcactgtgcacatggcctcttttgctgcctttgcaagatacaagggagggtgggaggcaatgtgtgcagtggttagggagctcttgctgcatagcttgagttgctctgagaagtgatgctgagcccattagagccacaaaaggaaaacaaggcacttgtttctatttattgcagtattactttatcgttgtgtaagagcctcgctagatttctgcactggtgcaatctggctcttgttttgttgtttgtctccttggagtctcaaggccctgggttgcccagggcatctctggcctctttatctaggctcacgctctgagtatgattttgagggagcggttggaccacctgcctggttacaggcagtccttgggcatcatgcagtcacagctggagctgctctgatagccactcaaaatgtggtgtgcaaaccactgctcactccatctaatcaccgtcatctgaatcagcttccctcttcatttcttctgagaacaaaattagatctttgccagcataatggatgaacttgtgcaatcaccttgttcattgctagttctgcatttccccaagatgttgatgtctcttttctgtgaattttagaatatagagtgtcagagatgagggtgaggacttgaggttttcaaaattgtcttctttgtaccatggttgggaccctaatagctatgacactcactggaagctccttctgtgctagggcttcctgtgtgtcatttcattaactcttcatggcaaaccctttattataccacttgacagatgaaggaactgaggcccagtgactaaatggcaaaccgagattgcagactcaagcagttctcttcccctgctgtgtgtggagagggcatgcttgggatgcagggaatagcagaggcaccatgataaggtactaggaaggaggcagtgcaggtatttcactgagattccagaatcagtgtgtctggcttgagatcccagctccatcactttctaagtccataacctttcactttcttcaatttctctgaacctcagtccatccctacaaatggagattatcactacattgtacagtccgtctgaggattaatcagcctggtaaattattttagcaaagtgcctggcacctagtgtgtgtttagtgcaagtaggagtcatagggctgactatgataatcatgacgattactattatccattgataataatgatatcattattaaccttgtttttgttgctagaatttcacaatccctttgggcagcaaattggtcccagaatgtgcttcgtatattttcctcttgactgtaactgaggtgacaaattgagagtgaagggggaagaacccagcgtagctgcaaatgtacggttgagatcgttgacagacttgaggccctgtgtggagttccgcctgcagaggatgctgacagcagccatatgcatgggctctgattgattggcagagagaaacactaatttattagactcgttatgaaaagtgacggagcaggggattgagagggctgattcagcaacagtagccctggctagatcccaggggtattggcttggtgtctgtttcccttgggaccagccccctgtcttgattctgggtcactgcctgtgttctcaagtgagtctcctgaagatgtccatggcatggctcacttttaccacgttgtaaatgtcatacctatttcttcagtatccttagaaagctgagtccagttcaggttgctgttgattgcaaaggctgataagaggagggagggagtgtgtgcatgcagaaattccccagtggagggaaaatagtccttttcacaggttagagaaagtgcagtagtttccttgagggagaataaagggcatggttgatacctctctttaagaacatgatgaccgggcatggtggctcctgcctgcaatcccaacactttgggaggctgaggcaggaagattgcttgagccaggagttggagaccagcctaggcaacataatgagaccctgtctctgttaaaaaaaaaaaaaaaaaaaaaaaaattagctgggtgtggtagctcatgcctgtagtcctagctactcaggaggctgggacaggattgcttggctctgggagtttaaggctgctatgagctgtaattgtgccactgcactccatccttggcaacagagcaagaccctatctgtaaaaaaaaagaacatgaagctctttgtagaaagatttctcatttctgatttggagagattgttcagtctgaattacagcaggtaggatgctggttaaagaagtgtcttgccttcaaggtgataaggcactgaatggggctatgttggagtcagaaaagctttgagaagactgaattccctgagcgccaaggtgcgaaaggacaaagtcatggcagccaggtacacttaacttgtggatccagattctgccacttcctggctgtgtgagcttgggccagttactgcacctctctgagcctccatttacttgtctattaaaaggcaaatgattctgtctccaaggatggctacctgggagtgagttaagtcaagcagcaatcacacagacttccgagctagtcacttcttatttttttttaccttgtggtattcagacaatagcctctcaccccatgactctttgatacaaaaggttccctagttagtgtgctgtgatttgtggaaagatattttgtttcctagtgaatttcattcattttgctcaggaaactttattggttttgtctgtgtaaacctaaaataatcttcaaaagttcataacaagaacaaggaaccatccaccccattctataaacttatttctactgaattgtgcttcgctggtgtcagtttataatgagaaatagtataagaaagccgattagccacaaattttaaaaacttgacattatatatgcacactgaaagaggatagactatttaaagtttgagaatttttacagttgaatctagcatttgaaagaaaaacatggccgggcgtggtggctcacgcctgtaatcccagcactttgggaggctgaggcgggtggatcacgaggtcaggagatcgagaccatcctggctaacatggtgaaaccccgtctctactaaaaatacaaaaaattagccgggcgtggtggcgggtgcctgtagtcccagctactcggaaggctgaggcaggagaacggcgtgaacatggggagcggagtttgcagtgagccgagatcgcgccactgtactccagcctgggcgacagatcgagactccgtctcaaaaaaaaaaaaaaaaaaaggggaaagaaaaacatgttattgaatgtaggtgagggataagaaccaagaacttctggtaagaacccagcaggacaagcgagctatgaagaattcaactctctaatgttatttgctatgattattattgttatttttttgagacagagagtctcatttgttgcccaggctggagtgcagtgatgcaatcatgtctcacttcaacctctgcctcctggactcaagtgatcccacctcagcctcttgagtagccaggaccacaggcatgtgccaccaagcctggctaattttcgtgtttttaaatttttgtatttttttgtagagttgtgatttcaccatgttgcccaggctggtcttgaactcctggggtcaagcaatcttcccttacaaagtgctgggattacaggcatgagccactatgcccagccctatgatgatatttttgaggactctgttggctattactgtgttagctttggtttcaggatcagaaagagtttgtcctttcttcaggttctgattggtatttatgtaccagacacttctaagtggaatacctgtccatgttcccttttcacaaagcctgccaggaatctcagagctgattttatagttcagtcacagtagtaaatagaatttgatagcatggattttgcgtattaacctcacttttgactcagttttatttctctacccttccattttaattttctctttttattgtgatgtatgttactgtatcaaaagaatacctttgcaaggtacctaatgtgaacatattcaaatattgaataagaaagcaatataaaggtatataaggtaggtgaacattgaaaggtatacataaattacagccctttaaaacaccaggaaccctggaaaataggaccatatagtgcagtgcttggtatcttgagctagacctgaagttagagaaatgcaattttgagtcccaacagtgcaaatggttactctttcttattttctccttttaaaaaacattttcctggagcactatttatgctatataaattcacttttattgggccatttattgcctttttcatgcattcagcaaacatttttgagcccatgctctgggccaggcactgttaggcactggggatactgtatggggtgggtatattgaccaatattgacatcatctctgcctagtgaaacttatgctgtagtgagagagactgacacgaaacatgaatgcaggtaaaaagacaatagaattacccgttatcataagtattaaaacggcaacagaatggagcattcatgtaataaaagagtgagtgaccctgttcggtaggaacatcagggaaatgtctccaaggagaggtattgggccacatttaagctacggcctgaagactgagaagggccaagctgtgaccagtggggagaagagaagagaggagaccatggtgagcagaggtggcagtgtgttcagaagcccgggggaggaaggagagggctctgcacatcctgagaacagcaaggtggccagcgtgcctggggtggtgagagcaagggaagggatgtggctggcaaagcctgcagaggccagaacaggcagccttgctctcaggagcctgtgccctgtgttatttttgagatggggaagatcttaactagtaccatcctttataagcatattcaagataggtgcgagaataaggtacaaggagcaccatgccagaaaagcaatgtgtgtgcctctgtgtgtgcatgtgtagatgtgtacacttgtatgtgcacatgagtggatgtgcacacacatctctgtatgtgtgcaaacgtgcatttttgtgtacatttctgcacgtgtgtgtatgtatgtacatgcatgtatgtggcatgcgcatacgtgcatgtattgcagcaggaagagaaggagccacgaacagtatgacagtggggagattgctgacttcagagcccagcagaatgagggtcagtgttgctgggcacgctgcttacagcatgtgcagagcatagctctgttttgcctcacatccctcctggactgatccctttctgtttgtatggtacattcagtgagtgacagcatcacaggaggcagaccccagccttatgaacatatcttcataacaccatacagtctcacgagaaaggggaggtcatttgttcactgtagtccacccctgaattgttccctcactggctctgtgtcactttcagagatttttttaaattctgggaaatgctttggggacttcggcattttggagtgtgttttcaaggattgtattagcaccacagagacccttagcctctttcttaaaggttctgtttttagacatcctcctcttttatccgtgctttcaattctgctgcttccttccttctgagattccttcttccttgctggtcttggaacaagaaacatttagctgtattttcctcgttctcgcctaggtagggtgtggtccccctgtgtcctcatttgttcaacattttgagacaaagattggtggaattgccacttaaaaaaataaaaccagggaaagcagctcagagaatttaatttgcctctaacccaactcttctacttattaaaaaaatatacaattattcattccgtagcactccagattgcttcactgaaagaaagaaagaaagggatccactccagggagaaagaggctcttgagctttttgttccttgatgatcctgtctttacgtaatttggtggagcctactggggaatcatcattttgggagactatggatgtgcctcattgcagaagaataagtagagagcagtgtctggaacaaatgcttgtcttaaaaaaagtttatgaaatgccagcagatgtcagtgtgcccttgccatttgattttttttttaaagcaacattaattattttcggtagtaaaaacaacacaagtatattctgctacagttataaatgaaaagatcatgaggcaacgttttttaggtttggagaaggaccagcagaatttatgtcataaggtaaaatcctctaaattatctgtgtaatataatttgtcttttcccagaaaagtggtttcaaaatgcaaaacctagtgtaagttttttttttttttttccctctctcccagccattgttcaggtgccaataatagcttaggatccagcttagcttctgagaagctactggctctgctaattgataacagctccttatttcaaagctggagtttgcaaaggaaggtagtgtagggttgggtatggccttgtcgtttgtcatctgagttgtgatgagaaactcttgcagtttacgttgttaccgtgagcacagcaaattgcgtgctaatagttagttcctccgcagacattgtttggatcaaaaatgagggcctctatacaggaaaaagattcactcaaataattaaaaactattcattttaagcaagggataatttgccagcatgtagtgcaagagaggtagggtcgtttctaggcagggaatgatgtatgttacagggcatatttgatgctttgctttatttatttaatagttttgattaaatggtacaatattcaaaaatgcaggagtatgcagagaaaaataaatctctcttgcacttgccttgcagtttattagagacaactatttttatagtttctcatgcaccctttcatatatattttatgcgaatacaaacatttacacagatatttataccaacaaaagatagcatatgaaatgcatagttccactgtttgctctttttaaaaaaattaagaataccttttaaggattattccctctcattgtgtgtgtgtgtgtgcacacgcacgtgtattttttctgctccacctttgttaatggatatatagtattccattgcacatgcttacattatttaattggcctccttttgatggatatttatgttgtttccatttttgaagcgctacatggaatatcttcaaccgccaccacttcccacacatgtctgtaggatacattcttagaggtgaaattgttaggtcaaaggaaacatgcctttcattttgacagacactgccaaacctgatgctctggctgagctgcacccttacatgttggtggatgaatggggtttagaaccaaatgaagccatgtggtgattctggtctgacttggctaccgtgatgactgtcatgaattatgtccctattggaagtgtcttagtctagttctgctgctataacaaaatgcttatccagggtgatttagaaagaataggaatcgttggccaggcgcggtggctcatgcccgtaatcccagccctttgggaggccgaggtgggcggatcacctgaggtcgggagttcaagacctgcctggccaacttagtgaaaccatgtctctactaaaaatacaaaaattagctgggggtggtggtgggtgcctgtaatcccagctacttgggaggctgaggcagaagaattgcttgaatggagtcggaggttgcagtgagctgagattgcgccactgcactccagcctgggtgacagagcgagactgttgcgcaaaaaaaaaaaaaaaaaaaaaaaaaagaaaagaaaagaaaagaaaggaatagaagagaagttgttttctcatagttttggaggctgggaagtccatgatcaaggtgtggcaagttcaatgtctagtgagggatgcccgctctgcatccaagatggtgcttcctggctgcatcttcatatggtggaaggtagaagtgctgaagagtctgactagttctctccaacctttgggtaaggttcccatctaagcatgaaggcagagtcttcatggtctaaacagtccttaatagtgttgcattggagaataagtttgaacgtgaattttggcggggacacaaaccttcataccgtaacagaatgttttgcagttcttgtcattgctgtttttttgctaacactttccatctgccaagtagtttgttaagatctttaattccacgttcacatctttgtcctcataacaaccctgtggagtagaccctgctctcatcctgtttcaggatggggatgtgggggctgagagacctcaggtgctttgcttagggttacagggtggatggtcagctcaggagtcacactcagggcctctaggcttaaccattgagctgggaagctgtggtgggttttaagcagcagagagcatactattgagttacaatgagtttaatgtcaacccgattgtgctgttgaccttttggattgcataattatctgttgtgcaggctgtcctgtacactgtaggatgtttaatagcatccctggcctctacctgctagatgttagtagcacccccttcacccatccatgacaaccaaagacgtctccagattttgccaaacgtccctggggtagaaccttgccccactaactcagacaaagagcaaaatatgccgtgggcatctgtagcataacaccagagacatgtatttgaggacacacatggtggctgatgtcagggcatcttccattcagccgtctcagccaagggacactcatttagttcttccccaaggatggagcagatgggctgccccttgtggcagatgccagtctaggaagaaacaagacggtattactcaaaccatttcatcctccattcgatcacagtagcactgcccaacaagactttgtcttttaaaatgtagtttagaaacgtccttgaaaaattgcctggtaaagtagacttataaaaaattatgttcccaactatagtccagcttatatattatacagcttttctattcctgcattttcctttggtgttcagtaatgctctacatcaaaatggcaagcgggaggcatcagccctcccagctccctgcacgtggcagacattgataatcaattcttttcccccctcatcagcgtcaccttcttagaatcctcagtgcatctctctaggcatagactgtcaaccaattggaattactatgtgaaatgaaatgtatttgccacccctgttacatggtgcctttttggctgagaagaaggattacgctttccaaagaggcaagcttatcatgaggtattagcttatttttcagttactctgagaaaagtgcttgatagatgggaagaaatgtctattcttaaagcatttggaattacgatcttattttgtaacagtaattgggtgcctgaagaatactcctctttcctgaggtgctttacatatactatcatcctatgtattattgtttttctgtagtaacatctctctcccctccaccaccaaaaatcagtcccctcccttcaaagcctggtggaggcagccacctgagggtgacacaaaacgctttgtgtacaatgggaactgagacaattccctcagcaaagaacattgagaagctgcaggacgttactggaactgtgtcacttctcagcacagggcatgtgagggagctttaaagagatggggaactgaaccatccaagatttccagaagtaacttctgatgtataaaggcatggaggccaggctgctctgggaaggcaacacaggtttcagagttgaaaatgcttttaggtggcatcatagaaccatccattctagcataatgttttgtgttttttttttgccattgcttttttggggaggggtggaaaaactcccatggaattgtgtggtaacttggtaatttggtttagtaacttgatgaacctatatgcaaatacctatcacttagatagtttttaagtcatctcctgtttctgattctaagaaaatagagaaaaataatcttggaaagaaaaggccctgggtcagacagtgtctgtctctttttatttttcagactggtgggaatgttttcctttctccacttttagatgttttagtctgtgagagatagggacaaatacaacacgtctcctatttcctcttctgagaaaggaatttttaacttagatgggaggcaccagtgaacttcaagggcttgaaattgcatttaaaatttaaagaataaacatttttatctgggcagaaggctcatagctttttaaaaatcacattctcaaagtgctatatgggacacacaaaaaagtaagagcccatctttttcagaacaataactttcagactcttttaccatgaccctagtaggcaaggaaaaaggatactacagcccaaccacttcacctgttttaaccttctggtgggactgtgtgtgttggaggtggggggagacagggaggtcacagaaagctcagtagtgatgaaggattggggtgcaactgtatttggtgggagagatacttacctcttacttagcagtaggaatatgcatttatttgagtcacaatctctgtatgtcttaaagtccaattatttagaaattatcagaaaaaagtgcagttaatgctaaagtgttagcattaaccaaaccccataaaaccacaacagtaatgttttcttaaaacattgaattgagtcccgcttaacaactttgataatagcatgagatcagaaagtccttcctgaaaattccaagaatgaaagccgtgtgcatgagtttttgcgggagaatatttgcaacatttctgtgaagttcttgatagctagacttcctggtacaacatttaattgtagtccttagtaaacttttgtaataatttatgttgatttttcaataatactttcaagttttcaattttactaactcagtggaatactactgttggtatctattggtcacttacaaaaaaaaaaaaaacagtccgttgaatgcattttctttcttttttttcttttttttgttttgttttgttttattttttgtttttggagacggaatctcgctctgtcgcccaagctggagtgcagtggtgcaatctcggctcactgcaacctccgcctcctggattcaatcgattctcctgcctcagcctcctgtgtagctgggactacaggtgcccgccaccacgccaggctaattttttatattttagtagagacagggtttcaccgtgttgcccaggctggtctcaaactcctgaactcagacaatctgcccacctcggcctcccaaagtgctaggattacaggtgtgagccaccacacctggcctgtagaatgcatttcaatgtgcataacgctaatgaaaagacttgcagttttggttcagttaatggcccattgtgaggactctttaggtctgtatacttaggcatgatacattattgctgtaggaagttagagaagatgggaagcacagggcttccattctacagatatccctatattttttggcgggggattgactccgcaaaccatattttctaaactttttcatatatacttgcttatgaatatattggaagcaagcctatatttatttattattttattttattagttttttttttttgagatggcatctaactcaccctgtcatccaggctggagtgcagtggtgcaatcttggcccactgcagcctccgcctcctggactcaaatgattctcctgcctgagcctcctgagtaggtgggattacaggcgtgcaccatcacacccagctaatttttgtatttttggtagagacagggttttaccatgttggtcaagctggtctcgaactcctgacctcaagggatctgcccacctcagcctgccaaagtgctggaattacaggtgtgagccactgcaccctgccccaagctatatgtacactgtacctcaatatccatatatatatccgtggagatatatatatatatatatatcatccatatatatatatcatccatatatatatataaaatccatatatatatatatatctccatggagatatatatatatatgtgtatgaatgaagcacttagtaggagcttttgtgacccattattaagcaaaatgaataaagttcattaaaatgaaactgtatttgattgctttagagctttgattttttttttttttcttgaacaaattctgcagaaaagctaagtggaattatttaccacttgggttggatttttggttatccttcctatttaaggccacacccagcaatcctaatagagttgaatggctgtgtttttaaatacgcagtgattctattggactcatgccaagcagcatcctggattttctgtgcatcagtgtctatgtgtggattagcactgacatattacataccagccaatgtcctctgctctcttcatgtatgctggtttgcaaaaaaaaaaaaaaaaaaaaaaaaagtagaaaaattaaaaatgctgaatcccgcagaaagtttccactccccagaccaaactgtgtgcatagcggggagaagggaccagatggccagtgggttgaaatcagtggaaaaccagctgggatgcatgagagggcatttcctcttccacttccctggaagcctggtcggggcaagtcctggaggtctgagcaggacaagaggtgtcaatgtcatggcctctgtctggctttctggatccttagatgaattgcagttggattggaatttggcacaaaaatctgaggataagctgttagttttctgctttctggaaaaaaaaaaaaaaaaaacagaacaaaacatgccagcttgacagaaggttggagggtaaaatgctgatgaacaggaaagaaccatatttccctgcgttagcaccagcttggagaccgaagttctatgaggagggcacatgatttgggtagttttgaatcctaaaggcaggatttttttcccctctcatttaaagcaaaacctttcattgccactgaataattatgcatttcttagactgccagcttctgcaacagtgattcctaggccccagtttgacactgagtgtgttcagttattttgaggaaagttacaaacgtttcaaattctctcacctctaataaaggtttaaaatctgccttttatggtgcctttttctgggttaacatattagttatctatagctgcataacaaattaatgcaaaacataccaatgaaaacagctatcttttgaggtctctcctgatgttgcagctgagatgttggctggcgctgtgtcacctgaaggctcagccggggctggaggatgtctccaggctcacctgtgtgtgttgagaggcctgagcccttcagtggttactgatcagaagcttcaattccctgccacatgtgccatgatagagaggtgcttacagcatggcagcttttgtcctttagagcaagaggtagggagagagagagagtccatgacttttttgagatagcttctcctattaacatctgatctcagtgtggtgtatttgttacaattcatgaacacacgttattacattacatttttattaaagcccatagtttacatattaattcactctgttgcatgattctatatttttaatgttttattgtaaaatacacataaaataaatgttaccgtcttaaccattttgaagtgtatggttcagtaacattgaatacattcatattgttgcgcaagcaacactatcacccgtctccagaactcctttcatcttgcaaaactgaaactctgtacccattaaaaagtaactcctcattccttccttccctagtccctggcaaccaacattctactttctgtgtttatgattttaactactcttaagtatctcaaataagtggaatcatgcagcatatgtccttttgtggctggtttcttttgcttagcatcttgtcctcagggtttatctgcgtggaagcaagtgtgagggtgtgaattaatcattctttctttctttctttctttctctctctctctctttctttcttatttatttatttatttattttgagacagtcttactctgttgcctagctggagtgctgtggtgcagtcttgactcattgcaaactctgcctcctgagttcaagtgattctcctgccttagactcctgagtagctgggattacaggcacccaccaccatgcctggcaaattttttgtattttcagtagagactgggtttccttatgtggcagtctggtctcaaactcctgacctcaattgatctgcgtgccttggcctcccaaagtgctgggattacaggcttgagccaccacaccccacccctttttaaggctgaatgctattccattgtatgtatataccacagttggcatatccattcatcttttgatgggcccttgttgggttgcttccgtgttttagctattatgacagttttatgggtttggacaaatacataatgttacccatccaccattacaatatcatagagaatagtttccctgctgtaaaagtctcctgtacttcacttattcttccctccctgctctccccctgcaggttcctggcaaccactcatctttttcctgttttgccttttccagaatgttatatagttagaatcacatgatatgcagccccagtaggttttatgacctagtctcagagtcaaacagtattatttctgccttattctgtttgttagaagcaatttcatccttctttcagggggagggtaattgtgcttcactacttaaaaagctggggtggtggggagaggagatatcaaagaattttcagacatgttttaaacaaccatagttaagatgacaagactagaagtccaagcattcactgggcatctattctgtgttgggcactgttctttcttagtgttttatatgtactattcattcaacccttacactaatgccatgaggtcactctcatatttatcatccacattttacggatgaggaaactcctcatccgtatgtgactccctgaagccacatacctcataagtggcagagccaggatgcaaactcaggtcagcctgaaaccaaagcctaagtcttgaaattatatcacgctgttcccttttagtgtaaggggaagtcttagtctaaggcttagattcaggggacaaggtctgaccaaatacatcagaagacatcaatgggcgatgatgctaaacatcttccagttgcctctccaaagacattctttgtccttcctcagtgtgtagtttccattgctgctggaacaaatcatcacaaacttaatattgatttcctgttttaaagttctatagctcaggaacccagtgtgttctcacttgcaatcatcagggtgtcagcagagcttcttaccttctggaggccctaggaaagaatccctttccttacttgttccaacttcctgagactgtcggcattccttggcttgtggcccctcctccatcttcaaagccagcaatacgggcatttctggtcatctccacagtctcatctcctggactctctcctacttttttttttttttttgagacagagtctcccactgtcgccagagctggagtgcagtggtgccatctcggctgactgcaacttctgcctcccaagttcaagtggttctcctgcctcagcctcccgagtagctgggactacaggcacacaccaccatgcccagttaatttttgtatttttagtagagacagggtttcaccgtgttggccaggatggtctcgatctcttaacattgggatttgtccacctcggtctcccaaagtgctgggattacaggcatgagccaccgtgcctggccctttctcttccatttctaaggttctccgtgattatactggacctatccagatagttcggaatcatctccctatctttaggtcagctgcttagcaaccgcaatccatctgcaaacttaatttacacatttaatttacagatatttacaggtttttgggaataggaggtagagatctttgggaatgttgattaaaaaaagaaactctggaagatatttaaagaggtttgttctgtgccgatatgagtgaccatggcctgggaaacagtctctggtggtcctaagaaagcgtgtctaagatgactgggttatagtttggttttgtacgttttagggagacagaagttataggcaaagacaaatcagtacatgaaaggtatacattggttcagcaaagaaaggcaggacatcttgaaatgggggtaagtagcctgcggcttacagatcatagttggattcaaagattttctgattgacagttgattgaaagagttaagctttatctaaagacttgaagctggtagaaagaaatgcttgatttaagataaggggggttgtgaaaaataaaatgcttagccaggcttggtggcatgcacctgtagtcccaggtacttgggaggctaaggcaccaagaatcgcttgaacctgggaggcagaggttgtgttgagccgagatcacatcattatactgcagcctgggcgacagagcaagattgtgtttccagaaaaaaaaaaaaaaaaaaaaaaaaaaaaaaaaaaaaaaaaaagataaggggcgttgtggaaaccaacatcttgttacgtaggttaagctttcagatagcaggcttcagagggaatagatggtagatgtcttgttttcagatcttaaaaggtgtccgtctcccaccgaatctgtgctagatccagggaagtcctggctgcattcatggaggttcttcatagattcagaaaagacagctttgcagggtcatttcaaaatatgtcaaagaaacattttgggatacaatattttgatttccttcagagtctgctatctgtcatgcgatgctatatcagagtcaggttggaattgggtatcttattcccaaagagtctgttttgtcagtctaatgatttctatttgaatgctaatgctgaagtcagttgtgcctaaactcaaaaagggaaagggcataaggaggtgtgtctgacctcccttttggcgatggccagaaatttcatgtttcaggtttcccttggcccagggggagtctgttcagtcagttgaagagacataggattttattttaggtctcctgcctttcctgctcttttcccaggaagccagtatggaaggagaactccaggggctcttctgccctttgattgtcagctgagttctgcttatggggagttttggtgggagattggagggaggtggttaaatgataccaaggcttctattgtcctgtgtccttcctgagtagcagagaggaccggcctctgcttgctgtcactaagcagccagcctcctttccttctgggaccctctaacttttccttcacctcagccattttggcccagggaaaataattttgctgctactaattctaggttgctgcatagcctgtgtggtttcccggtgctctgcctacacctttgaaaacagtattctgtaagtaagatctccttaactaatcctaatttgagtatgccatctgtttcttatctagaccttgactgatacagtgactgagggtagtcatatttgaagttaaaacagaaaaaaacaaaacaaaacaggtatgtcttgaattaggctaggctaaatctttcaaagcgtgggacttaaccccttgccagagatgttgatgtgaaccccgaatcctaaggtgctgtgttgttttcagaagccaagtgaaatttccacatgaaagcaaagctttgtgcgttcttaaccaagaaggtccttaggatgtatacagtgttctctctttgagttcctcctggtgtctgttacaacagatgaggaattcaagaacactgccccttccatattcgcaagatgtgacaggctattgcccttgtcttagaagacctgttttaggttaaaaaaaaaaaaaaaaattcaaacaattccacaggtgagctaatgagctaattacagagagtggtttcaaaacattggcattccacaagtaaacagcatctgcctttgattaaggtgtgaaattttaaaaaggtatggaaagatggctagtatcttcaggtggcttcctttatattttttattttttgattgtgcggaaactattatataatggccttctgtgcattctcctgtgagaaccaggaaaaccaaataacacataccaagatcctacagtggcatgaggcgtgaactctgaactgcctgtctgggacacagcctggtccattgtctgcagagctagggctttctcattgttccctcatgtttctgtactgttcgctgttttacctttagaatgagagttccctctgcatacatgtagaccaactttgtaaaattttgagctatttgtgctatgtcagtggctctcactattgactgctcattagaatacaggaagaagttttaaaaatagccatgatgcctgggctgtggccctagggactctgatttgattggtcttggatggggctgttcttaagcatccagggttcagaccaacggaactaaagcagggcttctcaaattttaatgagcgtgcaaatcacccaagactcttgttaaaatgcagatgctgattcagtaagtctagggtgggacctgagattctgaatttatgataaactcccgagcgatgctactgctgctgacctgtggaacacacattgagtagtaaggagatagaacatttgggtgggtacagataccttttaaggatgggtgaatgttaatgcttgggtgtttggtgatttgaatcatgactccgagagttgagagttctctaggaagtaggaaatttgtagtctaatttggatgatcgaattacagactcagtggggtcttgagtagcaaaacacagccagacctcttcatatgccatcattgccacattaatgatgagtctgtttattcattcatgcattcattcattcatttgttcattcattcattcagtgaatatgtattgaatacctgtcagacaccaggcatcttttcggtgctgagaataaatcaatgacaaagataaatgaggttcttgaccttggctattccagtgaatggagtagaaatagattaactcaactaaataaatatgagtcaacaagagccataccgatggtgatatgtaccatcaatgaaatcaagtacactgtgtttccttaggtggaaggtgtggctacagagtttaatttgctatgtcaatggagcggccaatggaagtttcttggaagaaatgatgttttagttaagacacacacacatacacaaaaccccagggaaagaccattccaggaaaacagaaaagcagggcaaaggccctgaagtaggaaaaagattgatttattggggaacagagaagggatcagtgtagccttggtgtcatgagtgaggagatgagttgtgtggagaggtaggaagggaacgtctcatgcagaggataaggactttgagtgcttttctaagcaccataggaaggcgtctgatggttttacacaaggaagaggaacattctgatttttgtgttaaaatgattactttggctgctatgtggcagatatattagagatgaagatgtcaaaagtggacacagggaaactgcttagtaaactcacagagtaacccaactgaatgatgatgatgcctggtcctagaaaagtggcagtaggaatggatatactttttgtgataacactgacagatagggggatgaggaaaagggaggaagcatgaatgacttctagcaaatgcagaaatagtaatgatttactcacatggggaggatagctgaagatctaatttgtagggtttgacaagaccccagggctccattttagacaagtttgagatgcctgttaaactttcaagtgcggatttaagaatacaatgtatactcgagtctagagcttagggaagaattcaggtctaaaagtaggatttgaggggctattcctatattcatattaaacattaccgtattaaatgagttctcaaggacagagaaaagtagataccaagggaatattggggtttgaagaaaaattggcccaaggttagggaggcaactttggatccttcttgaaatccatcttggctttggattctcagatcttagactcaaggtaaccttgcagagatttcaataataattagtatgtaaactttcagtaaacattatttcccagacatggaacatctggccaaagtcagtgtgatttgaaatgaagtcggctttatctagatgtctctcccagagggacacattgtgaggaaacagatattacattgggtgattatggagggtggggaaataagcttgttggttccttggccagatgtctaagtatatggtaacggagttaatggatgttggggaagaaagacatgtgcagagttggcatcctttcagccaagccaggcaaggttgctgatgaaggacgcctgctgctgccatggagctgaagatatattctcggacccaaggaagaaacacagaggatgcattatcatatggaatgattagttggctaatgagccttgaggggcaggaaaaaatggactataaaacaaattaaaccagtacctgacatcctaatgttctttgtaaacacatgatgatgtcagtgtgtgtgtatgtgcgtgtgtttcctcctgccagcccatgaggttagccaaccccacacaaatactcagaattaggctgaccatctccccattccccaagtctgattcctgggcaggatgccgtgcatgaggaaggtgatttggcttttagagagatcctttccctgtggttgttcttggtagaggatgaaagatgagatttctctgaaaagctcatccctttgaattgtgttcccgaggaaagaggccagatgctatgtgaccaaagctttagaaaactccaggattttgggtgatgagcatgcaatgcctggctgtcttccatctgcagcaagggcagagccagcagggaatggacaacaatacagagaagaaaaggaagcagggggtgagggatgacttgctcacagaccagattatttcatccccaaatggaatggttcagagtgaatgaaatcaccctgatacggagcaggggatgctgatttagctaccatgacagtgccatagccactcttcctgtattgactacttactacgttcagacttgttttaaaggtttttcactcattgactaattccacaccaatcagagcagcatggagggtataccatggctgtgcctattttatgcatgaaaaaaataagtgtttagagagataaagtgattttcttacggtttcacagaccgtaaagcttggactctaggattggaactcaggcagtgacatgtctgcatgttggaggcacattttgctacgttatcaaggaaatactcagttattaaaaagagagaaggaaatgcctcatgggaacaaaggccaggatctaaaatggttttaatttaaaataaatacagccatttgtgttatgtttaatatgtgcgcagcattttacggtaaaattgccatatctgatttgatttaatctatataacagctccatggggtaggtattatgatcctcattgtacatttgttgaagctggctcaggaaggatccttggccagggtcaggcagttcagcttggctgagcgataggatttgagttcagacctttgtctattacacatgcccttcaaatagtattctagtcagatttctttccaattatcagtgcttctgcattatctataatctgggatgtttatttttacttcaagaatctctcataaagactggataccagaaaccttccaaattgtgatttctcctgttctgcccctgaaacttcattatttaatgttcccggtaataataatggacacccatttctggattaaagtacgtgccttttcaaatgatgcatcgtggaaaggttattattaataaaggtagcattaaaacaccacaaataactctgtaaccttgcttgggctcaataaattccctgcagaaaattttatttccagcaaacccttaaaatttagctcgcttttaatatactgtgaccttcagtggcccttatcattcattatatacgagtgacctttccaaagttgagaaggatagttgcaacagcttttggatattaaaacctataagaggtaggtatggttttcgttcattcctactgataattaattcatgtactttaaagacatagcgttattccttttatgacacaggtggtgatggtttcataagggcatggaatataaatggttatcttggctaaagtgggtttctgtcctttttagatgctgagttctagctatagcatgactcagactggggtttcccttggaaggagcaatgtcaagctgttggagacttgatcatcattttgatgatcatccttgtgccattttgacgatcgaccccttacatcttctaacagctttttttttttttttttttttccttttttgagacagtctcactctgtcgcccaggctggagtgcaatggcatgatctcagctcactgcaacctcggctttctggggttcaagtgattctcctgcctcagcctcccaagtagctgggattacaggtgcccaccaccatgcctggctaatttttgtatttttagtagagatggggtttcaccatattggtcaggctggtctcaaactcctgacttcgggtgatccacccacctcagtctcctttaaaaaaaaaattctttattaaataaaacttaaagcatatttaaaagtagagagaatagcctgaagaatcaccttctttgaatcacccagattaaataattatcaaggtattgctaatcttactttacatatgccctggccactctccctctctagtctcatgctactagtcttaagcaaataccagatatcatatcattgttttcttaaatatttcaggttgcatctctaaaggataagaaggtttttttcctaacacctgtaatatctactaacaattaacagtgattttatgaatctcaccactattaaatagtggtttaattttccaattttttcaaaaatgtcattgttttcttatttccaattctaaaaatagtctttatttttttacagcagtttcaggttcagagcaaaattgagcagaaggcactgagaatttgcatttccccttgccccacatttgcatagcttcctcctttaggaacacccttcccagtggtacacttcctatgattgattttatgatagtttgtttatttgaaacaggatccaaataaaggcagtacactgtgattgattgatatatctttaaaaggccattttactctgttaaaaaaaagcttaaaacgtttttttttttttttgagagtggaagtcttgctctgtcgttcaggctggggtacagcggcgtgatctcaaaggctcactgcagcctctgactcctggattcaagcaattctcctccctcagcttcctgagtagctggaactgcaggtgtatgccacgacgcctgactaatttttgtactttttaatagagatggggtttcaccataatggccaggctggtttcaaactcctgacctcaagtgatctgcccaccttggccttccaaagtgctgggattacagctgtgagccaccgtacccagcctgtattaagcatcttttaatcagtctttctcccatatttttgtgtgtttgttttaacatttttctttgtggtgattgttgaccttgttgaagaaaacagattgtttgtcctgcagtatttctcacagtctggtgtttgctgattgcatccctgtggtgtgatttcacatgttcctgtgtcctttgtattcttttaaattagtctaggtcagatgcaagttccatttctttggtcatttcttcttccaagaagaggtacattgatcgattgtctccctttttgtggtgctatttaatctccatgggctaggtattattagctttattctacatgtgatgaagcatccattgaccatggatgctcaatgcatttttcaggggttgcaatttagtgacactgtaattttacccttccttcttcatggagttaccggagtacttcttaaagagaaatttcccagtctactattaggatagtcagggggtatagtttatacaggaaatacaggaaaaatgcttgattttctctttgtgatttcaaatatatgagcttgtttatttgcatactctagtgactggaatttttggttttactacaaatgcagggatggaagttattatctttgttgatgctcagattattcaatcatcaaccggtgagagcttcctccttcctcaagtttctgcagaagtcattttgacatgactctgcttgtctttggtggctttcttactatctagtatgacttgatattctagattcatcttgtatatttgctaccccacacctgaaataatccatttccccgaggagatctgttaggttggtacaaaagtaattgcagttttttcccattaaaagtggtgacaaaactgcaattacttttgcagtaatctaatagttcctaagggtatttcaggatcataacctgggtactagaggtgtcccatgaatcttaaaagagtcttatcatctgttcccccaaaaaccacctcctccagttaccatcatcttgataatcggcctctccatccatcctggtactcaggcaagagagttcagagttttctttctttccttttttttgagacagagtcttgctctgttgcccaggctggagtacagcagcatgatattggcttactgcaacctctgcctcctgggttcaagcgattctcatgcctccaccttacaagtagctggaattacaggtgccttccaccacacccaggtaatttttgtattttttagtagaggcggggtttcgccatgttggccaggttggtcttgaactcctgacctcaagtgatctaggtctcccaaagtgctgagtctctgtcacccagactgctggggtgcaatggcacaatcttggctcatggcaacctctgcctctcaggttcaagcaatgttcctgcctcagcctcccaagtagctgagattacaggctcctgccaccatgcccagctaatttttgtacttttagtagagacagggtttcatcatattagtcaggctgatcttgaacccctgacctcaggtgatccacccaccctggcctcccaaactgctgggattacaggcatgagccaccatacctaaccagcaagttttcttttatttatctttcttccttccagtccatcctttgatttttctttccagttccactgccagagtcagagccctacactccctcacctggaccgacaagtttgacgcctaataaaatggacttctagtcttgctctctctagtccagtccccatcatgccaaacaagcctgttttatgaaaaacaaaacagaacaggaaagcaaaataaaaccaaaactggtcctgccatgcccttgttcagaaatgttctgtggctttctgctccctagagaacaattcaacgctgctccggttcttggtgtccctccgtttccagtcccataacctgcttcttccttccatttccttcatagtagggatttatccctaactcttcttacttcgttcctgctgctcccatgcctgatgtccctgtattcctcttcccccattttgcccaaggtcacgcagaaatttatgccaaggctctcttcagatgattcttttttgtgatgacttccactgaccttggccagaactgcttattcccttgattttatttctttaacgcacagtttgcttagtcaacctctatacgccttggtatcctaatctgtaaagtggggaacataattataataatgcctaggccgggcgcggtggctcacacctgtaatcccagcactttgggaggccgaggcgggcggatcacgaggtcaggagatcgacaccatcctggctaacttggtgaaactctgtctctactaaaaatacaaaaaattagactggcgcggtggcgggcgcctgtagtcccagctactcgggaggctgaggcaggagaatggcgtgaacccgggaggcggagcttgcagtgagccgagatcgcgccactgcactccagcctgggagacagagcgagactccgtctcaaaaaataaataaaataaaatataataataataataataataataataataatattaatgcctatggcctggggttgtgcaggtattagatgagatcgctcaagtaaaatccctaggagtagggttgggctcctttgtgagctcttcataaatattagttcatcatcttactgttgttagcagtaataatgtttgcagtggtaacatttctttacatctctattaatatcaccacatctcagtaattttacctggatcttgcattttctttaaattgggaagtttttcaggggaagggtctcatcttagcaattcttccttttaacacttggggctgagcggtaccttacacacagtgaggcctccgctattatttgcaaatttttgtgccatggatgtagcagaaattatccgagggctcctgatgtaactcctgcccccaatcttgcatcttagctggaaacaataaataacggaataatattgtctggtaccaaagggtgtcccagagcaggaattgcgcagagagcttgatgaagcagaaagaaggaagagtggctaacacaattagtgagtgtctggccctgaagaatggattgtattggacagaggggagaaaggggattgttctaggaggagagagagtgataaggtaagtatagaagtaagaggcagctgtcactgcagtggctgaatgtaaacaaagaaaatcatttagttgaatattagtgagtcaaatcaagaaaattcccatgtaatataacaagttttaggaaatgactattagtcacagttttatctaatggggaaaaatactgtgttgcgtaaatagtcataatcaccactattccagataaagttaaataaataaaacatttttctgcttgtaatctttccctacgtacataagagatcttcaggtcttaaatggcatttccagtgtcttagtctgtgcctcacttgtacaatcttaatgggacccccttaggctgggcacagtggcctgccccatacctataattctagcactttgggaggctgaggcaggaggatcgcttgagcacaggagttcaagaccagcctggccaacatggtgaaaccctgtctctgcaaaaagtgcacaaaaattaagcatggtggcatgtacctgtagttccagctactcaggaggctcaggtgggaggatcgcttgagcccaggaggttgaggttacagtgttggtgccactgtactccagcctgcgcaacagaatgagaccctgtttcaaaaaagaaaaaaagaaattaaatttaaagaaagaaataaatggcaccccttgagtgatggctgtaattgaggaaactgtcagtttgaagcagtggaggaagctaaagttatagtatctttcctaatagggtaaatttttgtttcatattttatttcatcctgctctgcttattaggaaacataatataatatgtttttttggggaggcagggaagaattataataattatggataatatttcaatttatgtaaataatagttcaacataaataatatataagtaatattctaattctgtaattacagcagtgggtggtatgttttgaggttttattaagtatcaaccattgatttaaacacattttgttgaatcccctaagatctccagcgtcaggtttcctgtctttcccacttgacagactaactccggctttgagagtaaatgcgaagtatatcaggtcaaattaagtctcaggtgagatctgtctcctgaaagataaacactgggttgacaccctgaccatgattcatattgggtctatggaggtgcaaactggagaaaaaaatcatgagtttcttcttgttgtcgttggtttagaataagtcactgtaatgaaaatccttcttcaaattttgtgtttctgtatgctgttgaagggaaactcacagatttgcacacatcttcacataagattcatcggtggatgttatgctatattggctactttttttattattattattatttttgagacagagtctcactctgttacctgggctggagtgcagtgacacaatcttggttcactgcaacctctgcctcttgggttcaagtgattctcctgcctcagcctcccaagtagctgggactgcaggtgtgtgccactatgcttggctaattttttgtatttttagtagagacggggtttcaccatgttggccaggattgtcttgatttaatttttagtaaatattgtcaggtgtccaatgcagaatcatgtcatgtgaggctgttcctttgcaggggacttcatgtgagggtagagtgtttcttgtggcatcttttttgggatgcaaaacttatcctacaggtcatttatagtattttggaatgagtaaaggctttttgctgtccaacggaattattaaaaagcacttattatctttctcattaaacgagtcatctgttcttctttcaatgcacttgtgtcaagtgagtatgacatgcaaggatttggagatacagaagtgaacaggcattgctgggcgcggtggctcacacttataatcccagcagttttcaaggctgaggagggaagatcacttgaggtcaggagttctagacccgcctggccaatatggtgagaccccatctctactaaaaatacaaaaattagcgaggtgttgtggtgcgtgcctttaatcccagctattcgggaggctgaggcaggagaatggcatgaacccaggaggcattggttgcagtgagccaagatcgcaccactgcactccagcttgggcaacagagtgagactccgtcaaaaaaaaaaaaaaaaaaaaaaaaggacgacgaattggacaggcacagttcctactctcatggaagtttgcagtctgagaagcgagacaaaaaaaagtgaaatcattgcgataaggaagtgtgaagacttcagaaggagcgatcacccagcacaaagctggagcaagggaatgaccaaagtaagatgagtacagtaaaataaatctaattttagtttattatagaacacttggcaaacacagaaaagtacaaggatgcaaattcctcagaatcccatggttacagtcaccttgagcattttactggatgtttgattttactaatcccctcttgatgagcacttaggttatttctttcctaatatatgaaatatctcctaattttgaaaatgtttcctctgtctactatgtgatagaatttgtttcatttctttgcactcaatgagggttcttggggtgggatagaggggcaaagtgggtagtttgggtggagctaaacaaatctaagtgatgccagtataaacggcgggaaaatatctgtccatagctgcttgtcatttttgtgtcagctccccaaggtgtttgtcagtgtctctaatctccttacactgtggtctcgcctgaggatttgcatattatggacaaagtgaatgtgggggagtgtagggataaagcaaggaaatttgacatttagctgtcaacgatattgtctttcaagtgaggttttggaatctggtaagcaaaagattctaatgagtttgaatgaactgatgagtgtaatacctgttttcctttctcttttcctcgatctctcattctgtctcctccctttcttcccctaccccttttctctttctgctttacccatttgtgtttgaatactggatctttatcaaggtcacattcatatatctcaagcaagggaaaataaaaaccttgtaatttatttatgcatgtaattgcctggcctcattccttttttatttctcctctgcttacttcctaattcctggtgggtctatagctgttaccaggagaggagactggcgtggtcgctgaccaaatcaatgaagatactcctttagagacaaagtttacagttcttagttgtgataagcattatgaaaatctaaatgaaattgtctaggagaggtacattatgaaatcacactcccttttgagtgttaatatggatcaacagtgataaatatttgagacactggttgactggacatgtgatgaagacttaagacttttttttttttttcttttttactctggaagtgagctgcatacagaaagaacaaagacggagtgcagattaataaccaaagtcctgatgtggcaattgattaaactctctttttatgatacctttcctctagagtgaaaagtgagtttgtgttcgtgaatgccctggtgacaagagtctctttttccccgaagaaagagattcacgtatggctgaaatttcccggagaacacaggaggggggggaatattgcaataaatcaagtgagtttttgtgatccctataagcaaaaacatacttcagttatgatggattgtgttagagagtaaattagattgcatggaggctaagtactaatgttgatatttacagtgcttaaatatattgtctgcctcctctaaatgcagctcattcattggctttatgttgtggaggaaatatcagaataatgacctgggttttttttttctgtctttatagtttaatatcatgcaactgtttattaataagctccaaaccccaaaggatccttctaatcctattctaatatcagactaaatttaataagatgcattcttctccccactgcttatgcctcattcattcatttattcaaccaatatttattgagggcttcccaaagtgacaggcctgggttaggctttgggaatacaatgttgaaacacgacaggcttggtctctgccaacaaatggggacagaccaaaagggaaaaagaaaaaaaaagaccaaagacactgagccaagaatgccgccaggcgtttaaggatgtatattgtttctctaatgtaatgacttcgagatttttgggagagatgagagtttagaatgcttgaagatgttggtgtccttggagtgcaaggattatctcctgggataatggaggggaaatttcttgcaattttctcattttgccaagcccccacccctggcactgttgaaattttatgagggtttgctatgggtttttttttttttttttttttttgaggcaaacataactttgttcaggttaccagaagtaggcaaccgctcagttgaattccagattcaggacaagatgtcttgctgatggtgaggtcaaagatgaggggaaatcttcagagagaaagcaagcctgaaggctgcacttcagacaaaggcctgacccgggttcttcacacttgaaaggatggcagagttcaaaggaggcagtgccaaaggagcaaacgcagacacacgggaaggcttgtgaaaagggtttttatttgaagtagagtttttgagcacgtgatggggtcgggggtggaatggagaaatgcaagtaacatgcttctttatcacagaaattctcatcaaagtcatttcctatcagaaatatgagtgtttattggttttcattaatccctgcccctattctctttctagccttcctttcctccttctttccctgccttcctccctcctcttcttcctccctcctctccttcctccctcctctccttcctccctctccttctcagatgtgaatgtgttaaagatccaacctttgctaacttcttgcactggcctagaaccatcttttagaccgtgtcattgtttatgctggtttagatctttaaagatacatctttataaaaagttataacattcttgatgacatcgaagcatttccagaaaatatcgagatccgtcttatatatctgtttattcatccatgcatccaccatccatgtattcatccatctatctacccacccatccacccatccatccacccatccatctacccacccatccacccatccatccacccatccatccatccacccaccatccaccaatccattcactcatccatacattcacccacccatccacccacccatccaccaatccatccacctatccattcactcatccattcattcacccacccacccaccaactaattatttacccatccatccacccacttacccactcatttatttatccatccatccatccatccatccatccatccatccatccatccatccagctatcatgtatacagtaattaaaacagcaccattttgcagagttgcttcactctagctttcttttctgtgaatctggaacaactaactcagactctgtagctggaaaaccaagaaaaatgaatgtgaaagaatgccacatctttgcaaaagcaaacaccaccacatgcactactattaatagactgctttctcttttcatattcttcctgtgacagtcataatttgcatatatagggttaggtttggcagaaaggaaggtagaagaggtgaataattcatctggacttggagtaaaggttttaattttctcttgaattcaagatgtcttttggaaatgaaggtggctctgaaggaagatcaaaacaaaaggtgagcaattctgatttcttccctaagcagtggccattataaaaataaattaaacctggagaactgaacaggagtgcgtggtatctcttgtgcaagagactagaatagggtgatttatatagagatgacctaatcaaaatctctttaatattattgcacgcaatataaacatttatataataatttatactaaagaaaatacatataacatgtatctcatattttgtttcactttaaccttctatttactctgtatatttaaatgtatttttaagtgaaaattagtgttttaaagggaactattcaaagttcattttcgtctatagggaggaatgcatgtgtttaaatgggttctctgagtaaatatatttttgacacttgaggttattcaaactgagcatctctcagttttaggtcttaagtttcttccttcttctatatactttgttttacttttagaagctgaaacagggcctctaccatctgtttatctatttcagccaaattcaccattcagataatgtacatttcacaactgaagcccactcagagatcaattttcaccacttaaagagcatttagccatgattccaggaatagaaaatgtatcctgagacccataatgacttgatgagagaataaaggatcatttgttatgcagcaagtataaaattataacaacatccccctatgtttacagatgaaggacattctggctcaggaagtggggaggattctccaactttctgacataaatgattggatgctgttctttcccactctgtttgttgtcttggaaacaaatataggatacattgtttaaaaaaataggtaactggcatcatttggccctaaaattaggattagggttttttttttttttttttttttttttttttttttttacgtataacaagaatggagaaacatcttgcttactaattggaaggaataagtttgttgctacaacgtactgagttttggctctcaaattctcctcttcttagccacaatttggctcagaggatttgcaccatttgttcatctgtaaaatggtgataataatagcagatactgtctaagtcttacagtgagatttaaatgagttaatagatataaaacacttacagcaatgcctagcacacagtaaatgttctagaagggttagctgtaatttttggttattatactcttaggagaagcttcctacaataaccttatgagacctgctctccttgtcatgcttttggttgacctttcacagagtgtattttcaggttcgacctctacgtcagcagttccatatactttgatgcttgcttcatgctttgcctatggtgttgtaaacaggagttctccacatgcatgtgttgctaagcaacacagaatcctttggctgcaagtaacttcaaaccactcgtactaccttaagacaacaaaatatcctagaaggactcagagctgtttcccaggattcaggggcagagagttcagtcatagaacccaagaggaggaagttcacacagttaccccagaagaactgaaaccaggaagggaacatctacaggagcagagattacactgtttttccagggctgcctggggttggtgtctccttctgtctgtgccattaccttccttttctctctgtagatttctttcccacatatggcacatggacacacggggctgccctgaacccagccctgcctactgcagtgattacaatccatgcattcatttacagttactgaggacagaacctggttggtccagccctgcccaccacactgattacgacccatgcattcatttacacttactgacaacagaacctgattggcccaggtcttttcagaagtcacccctagtccaatctgctggaccagaggagggtcatggttgctaacccacccggcagcagatacaggggtggattctatgagaaggacagggacccactatagcaattgattaatagatctagaaagtagtgtgcgaagttaccaaacatatatgcccaaataactaagctataataagcatgttcatcacttcagaagacacaactacaaccaatgggtgtaagcgacaagtggtcagatttcaagtctcaaagaataaatatctgaaaatagataattttcattatatgtctatataatgttttgttatatatctatattgtatatgtatagtcatcatatatgtatacatctattttcattgtataacatataatggtaatatagtatattgttacaaatatctgaaaatatataatgtaattattaaattatatgattatactatacactatagtatatgtgctatatttactataataaaattaagtatagaaaatgaaaattattttcagaaatttattcttaacaatataaataaatctctatggataaatctatgtacatagatttaagatatactatcatacatagaaaaaaacagtgttttcactttacactcacactcatatagcacagaatacttctgtgaccagatgtgcagggttttccccatcaacaaccagttctccagcagataccaatggggtgtcctataattcagtgccattctgacattatctacctggagatagcatcagatcccacagattaaggattctgccgccaagactgcccccactttggactccagttggaagcctcaggttgtgacctgtgcttctgaaggactggttaggattcccatgtcccttccctgggtttaagttgatcgagtggcttatagaactcaggaaaacactgacgtgcgtttactggtttattataaaggatattacaatggatagagatgaacagccaaacgagatgcatggggctgagcatgtggataggcgtgcagagcttccttgccgtctctgggtgcatcaccttctaggtagccccactagttaagaagctctctgaactgtcctttcaggtttttatggaggcttcattaaataggtttgattgattccatcattggccattggtgatcaactccatctttagcccccctgccctctcaagaggtcaagaggtaggacagaaaattcctaccctctaactagaaggtaggtccccctggcaaccatcccccatcctgaggctatccaagggtcccagccatcagtcatctcattaacatacaaaagatacccttatcactttggagatcccaatggttttagaagctgtgctccaagaaccaggttcagcaaccacatacatatttcttataaatcacaatatcaaattatatatttgtatctatatatgtatatataacatatatatctatagagattgtatatatgtatatatgttacataatatataaatatatataacatatacatatatacatatctatatgtatctatacatagatatatatctatatatgtatatatgtatctatgcatatatagttacatttatatcactatctcaagacatgtatctctttgactatcactgtgtggagatatttactcttaggaattgtctcatgtgcttctaggggcggcaaatatgaaatttgtagggcagattagcaggctggaaattcagatgagagttgatgttgtagtcttgagtctgaaatctgtaggccagctggctggaaactcaggcagaatttctgtgttacagtcttaaggcacaattccttctccagaaaacccatctttgccctgaagaacttcaatggattcagtgaagcccacccatatttttcaaggtaatctccctgacatacagtcagctgtgatgatagatgtcattcacatctgtaaaatactttcacagaaacacgtagatgaatgtttgagcaaacaacgggacaccaccacctagactagttaacacatacgctgaccatcccagcatcctttatcatcttgatgagcttgatcactttggagcagcaagagggaaagaaaactatcaaggcagaggctgccatgatcaccacatgatatgccaacttgctaagacattgagtttcaattgagtctcccaggccaggctaccttcctcatgatgaggggaacagggaaatcaatatgggttcattaacacttaatttaggttttccagtgtggagcatatcaggaagagaaatggcagacatattacttgtctcaagcattatccatcattagcgtctgttctctttctccgacacacacacacacacacacacacacacacacacacacacacccccttatatttttcccctagtaccttcctcactgatcatattgttctgttaacacccaccaccaaaactacatcctgggtcctctccacactgcagctctcaagacgatcgtttactctattatcaagcttaccatttattttattttcaggcggttgtattcattataatgccattagcatgagaagtggggtcctgtcaccagggcaaccaggagcacagagtgcacattccctccttagctgatgtcttgttccctcttgggtggactccaactgtgtctttgattcattccattaggtggtcactgggatgtagatgcttgacagcctccttgtccttaagttgtctgtctttatatcctttactggccaagatttctctctccagaattcattaatttattaccttttatttctgtaagcataacacatataatatttccaagcatatttaaccacatgattatatctttacaattcctataacctctaaccctctaatgtattattttatattacatatcttggtgcatttccctatatattgtacatattgtatgcgagtatgatacattccccttttggtcagtactaccaattaataacaagctccttactactgaaggtatttcagctacatgatcatctgtctaggatattatagagcctattcttgcattatgaaaggggttgaaagagatgacctatacgttctttaaaaatctgaagccctaggtttattccatatctataactgtcctccatgaatataattttagctacagtggatctctctaaatgaagacatctggagcattccaaatgcaagcatgagtgcaaaatgtctgcttgtagttttctataacatccttcctacctccacaaaattacttagaatttgtgaataatttcattaaatttatctttggggggatacttgattaagtagtactccaagtgggcaatgtagtaagcaaatccattcccacattttcttttcacataggcagaatacatacaattttcttttttttattattattatttttttagacggagtgtcgctctgtcaccaggctggagtgcagtggtgcgatctcggctcactgcaacctccgcctcccgggttccagtgattctcctgcctcagcctcccaagtagctgagactacaggtgcatgccaccacacccagctaattttttgtatctttagtagagacggggtttcaccatattagccaggatgtatacacacaattttcagaaggtcttttgtgtgtatgcttttgaataatatgcccctggatcttgcccctccatcaatgatttccaaacctgacattgtatttgaattgcacacacacactaacttggatgtagaaacatttcagatctcaagacatggagaatccgaatcaacaggtcttgagtaagacccagtatctgtaattaaaaattaaaaaaaaaacctccctacgtgactgtttttctatatatttcttttctttctttctttctttttttttctttttcttgagacagggtcttgttctgtcacccaggctagagtataatggtgtgatcctggcttactgcagccttgacctcccgggctcaagtgatcctcccacctcatcccccagagtggctgagactacaggtgtgtgccaccatcaccggctaatttttttttttttttttttctgtagagacaggatcttgctgtgttgccacggctggtctcaaactcctggtctcaagcaatcctcccatcttggcctcccaaagtgctgggattacaggtgtgaaccaccgcacgcggccctatgattcttatggatgcctaggaacactggggatgtctgttttcatacagctggtggtcacagtttcagtgctattgtgtgttcttaggtggtttgcttttcttgctggctttcttcatggtcatagatcatttcaaagcctctgatatatcattgcggtttccactcagtcctctgtctgtttcattcctaattaattactttgacatgcccgtaacctgctcagaaatcactgggggtttcttagcagatacagaaacaaatcttcatccttcaaactggatttcacgaacctccaaagtttcatttctcctcgtctttgagatgtgatataatgtggttagaagacctggctttgaattctgccccttcctctgtagacctactaagttccagacagtgtctctgtatcatctcatgtaatgcttataacagcctcatgggatgaatatccccattttatagatgagaaaacagaggctcacttagctaaaatcacttaaagcctcagtagtccttggggtctggattttgcctccgaggactagggttgtcctcatatgaagtgattgcctgccagtgtcaacagaaggattcctagtcttgataatttggaaagtgcgctaagcatgagatcttgagatatatttccgacttcaacactttaatggtagtattaagaggtataattgctcatgcctgtaatcccagcactttgggaggccgaggagggtggatcatgaggttaggagattgagaccctgctggccaacacggtgaaaccccctctctactaaaaacacaaaaattagctgggtgtggtggcatgtgcctgtagtcccagctacttgggaggctgtggcaggagaattgcttgaactgggggggttggaggttgcagtgatccaagattgtgccactgcactccagcctgactacagagcaagactctgtctcaaaaaaaaaaaaaaaaaaaaaaaaaaaggcataattcagacgtggcagttgagagggtaaatagaaagcactaattaaaaaaaaatccaatttctaagactgcagagcatcagctattattgaaaatgtagacatcagaagggaaaaaccctttgttcagatacagtgctgctaagttagatgcagctgagaaatgggaatacatgcagtaaggtggttatgcagtatttttcaacagtagtccacggttgagcatggatgccatttaaatacattatctggaaaaatgtacatagaacttacgatttttgacagcaggaactcattatgccagaatttggattctcaggatagctgagcagaaagggcaggtggaagtctcccgaaatagatgagtgtttggacaaaaatggcagcaggtatactgtgccaagcattggcctttgcccaggtgccgggtacgatgtcaaggatgcaagctgaagctggccatatggttctcagagtctctctgctcattctgccctccactcagaggtagagacatgggcttttctttatttgcagcagaaggtaattgctttagacttaacaggctgcatttgaccgttgactcaccattatggtgtattatgaaatgaagcctcagccttggtctcccagagtagggggcgggggagggcggcagggagaaagggtggtgcctgaactatcaacacggcacagtttaaatgtcaggctctgcaatttacaagtgatctgagattcatgggaaatgcaatggaaaagtcactgccgagtccctctccctcatgttataagattgagtgtgtcataaattttgtgcattgctaagttcatggtgcttctgtaagaagacattaaaaatagaactccttacgtcctcgattcttacctacagggcatgcaggccaaaagtctacacacagaagttaagctggtttttaatcctgtttttcgttctggggctgtactcttaaaagccaaacactttttcagagacattctgtgcccgatatagcttcattttgttaatagcagaagtgaatagaggcaaaaacaaaccaaccaaacaaacaaacaaacaaacaaacaccctgaaaatacaagcgaatgcctggataggaattcaaagtttcattgaaaataagatagaaataaatcactaaccgtacttgtcttacctgtgtgatgtggatattacataacttaatattaggtagaatatccaaactattttgatgaaatatgttgggagagagagattttttgtttcatcagagagaagttttgcttttccatgaaggtacagcctcagcttccctagagaaatctttctccatagaaggaattatctgcaaagggtgggttgctgagggctaaatccattaaaaccaatttgaggaagagctgttacttgctgaggatgggaaaaaaatatataaaaagctcattacctagagcaaaatgattgctttaggattaagaaattgacagttactgtttaattataccagcccactgaaaactcacagactaagctttctagacacttaagcatatgtgcatttgttattgtagcaattggggtaaatttatgatcataaatgccaataacttgaacagtatccaactagcctttgtgtgaataggtttattgtgttcattttacagggaaaacacagtctttctatcaatatgaccaagatttcctcgattttcttttattctcagagttctgtttaattgcctgcaatctttttgatattaggctcttcattcatttttttgtccattagtagtttcactaaggaaacatggttctgtagggatgcgaggctgtgtttcttatacgtctgctcccctttgggtctgagatcatacatacctggcttgtggtccagtgcaagctccctggcagcttgggaaatgcgtcttcagcagacttcagccttactttgttttcaggaatgtggcaggccaggtcgcactaacacagccttctgtaacaactgtctcagtgctgactgagtagttaaggtaaatattaaaagctgagagagccagtgcctttatacaaaggctggagtgtatcaaaagcctacctagagttgtgcctaggcctttcctgggccttgaagcatgacaaaataatgaaggaattcttaataggaaccgtttggggttaaacaagttttattggggttgtgaagatactccccaggtatccacaaacaagtttattcggggtttgaagggactccccaaacctccatgatttagcaggagacaagataaggataatcatcccagcacctggacccatttagattaagtaaatttactgaggctgcagaggaaggtcttcaggactcagatcttatagatgagaagttaatcacttacgtctttagaggaatgcacacttacaggtagacatatagcttagaagctgtataagctctggaaaactttctaattttaagttggtctggtgatatttcccaggccttctccctgtacccggttacaggaataaactcccttgtctcccagttcacctgcatcttattttggggcagtgagaataagcattccgacactcagtttggcccgggaacaggagggcaagacagcttttcttttgtttattgctttgttgcctgctacaaagtaggcgtttaataaacatatttataaaaaaaagaatgaaggaagggagaaaggaagggaaggagagaaggaagaaaggaagcagaaagagaggaaggaaggagcgagggaagagaaaaagaagggagaggccgggcacggcggctgacgcatgtaatcccagcactttgggaggccgaggcggatggatcacctgaggtcgggagttggagaccagcctgaccaatatggagaaaccccgtttctaccaaaaatacaaaattagctgggcgtaggggcacatacctgtaattccaactactcgggaggctgaggcaggagaatcacttgaacctggaaggcggaggttgcagtgagccgagattgtgccagtgcactccagcctgggcaacaagagcgaaactctgcctcaaaaaaaaaaaaaaaaaagggaggggataaagggggagagggagagaagaaccaccctactaagttgaagaaagctgagtcctgccttccccatgtcatgccaacagattgtgtctcttaaaagagataaacaagattaattttggcattctttattcaaaaggacctttagactcttctttctggagaatttcaaggtcatataaaccttccgcaaacttagttattttaggaagtaacagaacatttcactgcaataatgaagtggttataatcttacattaagtaactaagtagaagaaaattggctgggtgaggtggctcgcacctgtaatcccaacactttgggaggctgaggtgggcagatcacttgagttcaggagtttgagaccagcctggccaacatggtgaaaccccatctctactaaaaatgcaataattaggcgagtgtagtggtgcatgcctgtaatcccagctattcgggaggctgaggcaggagaatcacttgaacccaggaggcagaaattgcagtgagccgagatccaaccgctgcactccagcctgggtgacagagggagattctgtctcaacaaataaacaatccccccaaaaccaaacaaaaagtaactaagtagagtaaaatctactttcataattcaaattccatagaatggttttgtttttctttaaattctattgttttagaaaactatacattttttaaagtgtgatttgactagtaataatatgagaactttgtacaactaaacttttcagaaacaaagctgttgtacaaagatatgccatcatccctggggagattttgagtaaatattctgtatgtggctcccccaaagtatctaaattcatcctaaaaataatttcagggaagacgtcatgggagttaataattagggttgttattagctcttagcgttgagcattttaaaaatccagtgagtgcctgcattatttcatacacttcagattatctgccttttgcaaacacagctgaatgtagttcatcaaatttgggtatttataaagataagcatagcccaaactttcgtggttgctagggcacactcaaatatcccatttcaatgaagtctgacaagaagtcactcttgtttttagattagctctggtcacagaaagtaacacagaatgatacaaaacagcccgaagaagcagctggctatggagaggcaaattcataggtgcctttttttccttgttaaactgagtaatcaaagtttagcttttctaaaaaaaaaattcctggaaacatttgctcatatgctgtataacacaattttgaccctttatcattgcaattcataataaatgtattttttgtcctctagtttccccaagaagttagctcctaggtaataaaattatacacacacacgctcgccccccccacacacacatttgcactaaacttctttacaaagaatcatttgacagtagccgtataatttaatgtttttcatctaatgctcagaatgaagcacaatatcaaattatttttgaggttttcatcttgttcctctgattttgattagtgagcattttctataccctagtcactaaattgaaagggatcaccaaattttatacatgctaaatggaaattggctgggtgcggtggttcatgcctgtaaccccagcactttgggaggctgaggctggcagattgcctgagcacaggagttttctaccagcctgggtaacatggtgaaacctcatctctacaaaaatacaaaaattagcgggacgtgtggcacatgcctgtaggaccagctgcttgggaggctgagatgggaggatcgtttgagcccaggaggttgaggctgtactgagctgagattgcaccattgcactccagcctggatgacagagtgagaccctgtctccaaaaccaacaggaaacaaacaaagaaacggtaatgtaaccttgacatgtaaagggcagaaaagaatttttacaaaagatattttattttaaataaaaatgggtactaggtcgaatacttgggtgacaagataatctgtacaacaaaccccaataacatgagtttaccgatataacaaacctgcatgtgtagtcctgaacttaaaaaaactgttttaaaaattaatgcttcatttggtaaatcaaccaagatagctgcaaattagtctagagtgaaaaattgataaacttaaaaatcgattaacacattttaagggcataatatgatattgttgactataagcactacgttgtacagtagatctctagaactaattcatttcacacagtgtaacttcaagctaattgaacaaccaccgattgtcccctccccgtggctcctggttaccaccattctcccctcagcttctatgagcttgtctattgcagacactttgtataagtagaatcatgcaatgtttatccttctgtgactggcttatttcactagaataatgtcctccaggttcataaatgtacaaatgtcaggatttccttcttctttaaggctgaataatattccattgtatgtatacacgacattttcttcattcatttgttttagtcagttctcacattgctaataaagacatacccaagactgggtaacttacaaaggaaaagaggtttatagactcacagctccacagggctggggagacctcacaatcatggctgaaggtgaaggaggagcacaggcacatcttacatggctgcaggcaagagagcttgttcaggggaactgccctttataacatcatcatctcatgagtcttattcactatcagagaacagcatggggtaaaacccacccccccatgatccaattacctcccactgcgtccctcccaatacatgtgggcataatgggagctccaatttaaggtgaaatttaggtggggacacagccaaaccatatcactgttcatctgtcattggacacttaggtggcttccatattttggctattgtgcttaatgctgcaaaaaaacataggagtgcagatatttctttgctatcatgacttcatttctttgtatatgtacccagaagtcggattgctggatcacctggtaatcacatttttaaatttttttttgagaaacatttatactctttttccatagtggctacatatctacattctattcagcaatggcaaaagggttccagtttttccacttccaggccaacaattgttttttttttttaatttttcatttttttgataataggcattgtaacaggtatggggtggtatttcattttggttttgatttgcatttccctatgtttagtgagctgtattatgggcttaaaatttgctaagatttccctttgttaagtgttcttaaccacctccatgttaagatctcatagtaaatgttcttaaacaccctctaccccactccacatgtccaaataaagggaaatttttggatgtgaaagataggtctgttcctatgattgtggggatggtttcacaggcctatgcttatgcccaagctcatcaaattgtatacgttaaatatgtgcagtattttgtgtgtcaattatacctccataaaaccataaaaatctataatattcttatgtgaaaggctagtgtatttatggacatatctcagacacattttgtgactagttatgatgagtcagaatttgcatctaatgaatttctttaccagtgttgtaaattctcagaattagttacataccctaatatctaatgggggttggccacaagttgataactaagccttcatcccttaatatcatctactccactgacttccagggctgagatgaactactcacagcatgcatatttaagacaaaaatgactctgatgagcaggtattaggttggtgtaaaaggaattgaggtttttgccaaatatttttgcaccaacctaataaaattctctcttgtatctgggatgggtcatgggccccagagacactgtaggtacttctatctcttaactttgaattagttcaatctaatgtggcatttgggaactgaaaaaccaaggaagttcattactgctattattattttttccaagtgtatgctaataggaaaaactgcttagcccaaaatacgtgtagcatgttgaattagctgaagcatttcccccgtgtttgctttagaacgtaatacacttccgttttggaagtaaaatgacaaatttttggtgcacaaacatgttaaaggctattacagaaaatatttagaatgcataatcttcctggattcctattttattgtaagtgtataaattttaatagagtttttatattagttgttcctcccaactaattatttttaaattgctggaatgttttgaagcagaaccataaaaggtatatattttttttatttgatagggctctttcaactgcaggtgatagaaaagcaattcagcaaggttaaatgaaatagaaattggtggagggcctggaggtgttacactatgggtactggcttaaggcacagcatgatccaggagctcacatcagtgtagtgaaggttcttttctttttctgagacagagtctcactctgtcgcccagagtggagtgcaggggtgcaatctcagctcactgcaagctccacctcctgggtccctgccattctcctgcctcagcctcccgagtagctgggactataggcgcccgccaccacgcctggctaattttttgtagttttagtagagacaggatttcaccatgttagccatcatggtcttgaccttctgaccttgtgatccgcccgcctcagcctaccaaagtgctgggattacaggcatgagccacagcgcccggccatcaagcttctttctctctccccctctctgtttcttgcacagctgtacagactttttgtatgtagtaagcatgtttacctgtgactagtaattccagcacaaacatttcacccccttatagctctgcagatattttctggaatgactggagatggcctgtcttcagtcatgatccatccctgaaccaatcatgataaaatctctttggttggttctaccacatgcattaatttctgctagagcatgggggtcctgtgaaggaaccaaatatctatgatgcttgttaaagacagaatgaaagactttactcaagagggactatcgtgataggtgaaatggggtcttgcagtgggggagaaagattgggctcaattctgaacgcaacaaccaaaagtggtgatttatagccaggaagtcaagtgagggtcagtggatggagacagcagaggtaagggaggattctgagtaaatgaactaacaaggttcttgctaacactggacaatgcagaggcagcacagaagctcaagcgtcaggcctcacggggaaaaggattcagatgagtctgaaatatgctgagtttggtggcttacgtctgtaatttcagtgactcagaaggctgaggtggtaggactgcttgaggccaggactttgagaccagcctaggcaacatagcaagacaccatctctaaaaaagataattaaaaaaaataaaagaagggtctgattggagtctggttaaggagaaaatctttgtcagtgcccaccctgaatatctggaacacgaacctccagaacagagagggggttctttcactagagaagctggatggtcaataataaagaatatccctgcttctggtgctcccatttatcacatgcagggaatgaaatttgcagaagtgacatgacttgaacaacgtcagacacgaagcatggaggtgaaattaaccaaaaggttgaagttaaaatgagtactttgcaatgccattaccgatgcataaactttgatgagctttgagaaataagatcaccacattttcatctacttttccagggaggtggaaaataaatagagaaatactcatttattcatctgtttaacaaacatccattgatattctttatgtgctaggtgctgtgataaacactacagaaatagcagagaacaatacagagaaaaagccatgtcttatgaatcttacattcttatacaccatcagaataaaatactgctttagaaaatatactgtgtaccttataataatagaacacaatctgttgtttctgagatgtgaaaagtcaattgtaagatttacgccatagaacaaagatgtaattcttgttacacatacacacacacaaagacacacatttaatcagggcataaatcaagatttttgtgatattaatccagtgcattcaatacagagttggataatctgttgctatttcaaatgtagttcctccctccttaaaatgattaaatcaaagtcccagaaggaacttggggaacttctaatcggtctccatgtcgtggacaaaaattaactgaattaactgtaactatctcaaatcaagacacacaataataaccactgtttattctgtgcctgccagtcactgtgcagataatttattgtgcactgtctcatttaatgcttgtggcaacctaatgaggcaggtacatttgattattagtcccattttacagtagatgaaacagaggcttatcttctgtaaagaaaattgctcttaaaacacagctcttggccgggcgtggtggctcacgcctgtaatgtcagcactttgggaggctgaggagggctaatcacctgagtttgggggttcaaaaccagcctgaccaacatggagaaatcccatctctaataaaaatacaaaattagccaggtgtggtggtgcatgctctatcatcccagctactcgggaggctgaggcaggagaattgcttgaacccgggaggcggaagttgcagtgagccgagattgtgccattccactccagcctgggcaacaagagcaaaactctgtctcaaaaaaaaaaaacaacaaacgcacaaacacacgcgcacacacacacatacacacacacacaccccacctctttgggttacatatgctttttaactgtttgaccttcggtaggtcagtaggttagcgagtgcccatgcagtgtttgcctgagcttttgcatcagccttgcctgtttttttgttttttgagttagggtcttgctctgtcacccaggctggaggacagtggtgcgatcatagctcactgcagcctcgatctcctggcctcaagtgatcctcccacctctgcctcccagtcttgccttttaagagccttaggactcttaacctgggaaatctataaaattttttgttatgtataaggaagaacacaacttttcttctgtgagtactgcttcaaagacacagagtccaatgtacataggcaggtggatagacaagctcgctgtcaaacttgttacatagatgaaatgggacagatggggtcattcatctaaagggttcttggtaaaggtacaaaaagcaaaaccatgaggccaaaaacgggagcagaaacagttggcactcagtgagtaggctccaaagctctggctcaaggtgggaacatggaagccaatggtcaagtttgttgcacagtgcacttaataagatgaacagcagtgctagaatctggaggatcatcatccctggagcttgacagccaatatctagcctgcttgagagtgcagatgaagcgctcggcaaatgtagttttatttacagcttcgtaagcctagatgggtaatcctctgtggtgtcctttagagggaaacgtaaaatggggatgacgactttaaataccttccagagttagatggcttttagacaccaaagttcagcctcttgcaacatattgcatttcagcccctgccacggttctctgctgacatttcagagatgggcagacaccatggcattgcagttgacatggcagcttggccaggtaggagctcacatatggagcatttcttgctttaggtgttaaaaaacaagtcatatctttaaaaggtcaccgtggtttgtactaactatatgactattgaaaggcacagtttggggcaagcctgtttattatttttcaaattagagaagtgatattgcgtcactgctgcgaaccaggaagggagaatgagaaagaaaatcacccatgaccaccaccatccctcttggaattgtgtcgtgctctctagcctccttcctttaagatgatggtttctatggaaaattgctcttaaaacaaacctccttaagttatatatactttgcaactacatggtcttcggtaggtcaaaaagtgcccatgcacttttcccctgcgctcttgcgtcaaccttgccttcttttatttttacttatttatttatttatttattcatttatgtatttatttattttttgagtttgggtcttgctctgtcacccaggctggagtacagtggtgcagtcatagctcactgcagcctcgacctcctggcctcaagtgacctcccacctctgcctcttagagcttttgggagcttgcatgatatgacggttgtgactaatgttaggaacatccaaggagtagacattggaaggactcctctcatgccaccatgagctgttgcccccaggaaatgagtgaagtctcagtaaaatggagagaactttaattcccgggtagatgtatctgaatctgagactgaacattttgttggtaacacaccagttatcaggagtgtcttgatcatgctcatctttgtctaatctttagatttctcatctttccggggaggttaagagttgctgtgtcctttctcagtcccaccacttgaacatgtggtaacatgtatgaggaaatgctttgtacataacaaatcatgtgaaagtaaaggattgtcgtcatttttgccattgctattaatattattacacagggtttctagtatattatgttggttaagagcaagcctctagagcaagcttctccagcccatgtcccccacagggtgcatgtggcccgggacggctttgaatgttgtccaacaataattcataaattttcttacaaccttatgagacgtttttgggggatttttttttttagctcatcagctgtcattagtattaatgtattttatgtatgacctgagacacttcttcttccgccgtggctcagggaagccaaaagactggacacccctgttctagagccagtcctaactctactcatttctacctagctgtgtgaccttgggcaagttagttaacctctctgatcattggcttctcctttagatgctgctgcatttttacctctctcataagattgctgtgaggaggctgagacaaggcagggcatcgtgcttgcagcaacaccctgcacgtagcaagggtaccacaaatggtagctatcaatgttgttatttgatgatccagaatatgtattgcttttgtcatcctttccctagtctttcatcattctggattttccatgtctttaagtttgttgctgtcttagaattagtagattttcatggttctaagactctatctgaaaactgtgcatggtggatcttgttaatgtggtaaaaatgtcatctgtcacagcatcccagttcatgatttaatttatccttccacagatagcctttattatattagcttgtagtgtatatttaatgaactagtgtaaaagtcatttttctctggctgggtgcagtggcttacagttgtaatcccagcactttgggaggctgaggcaggcagatcacttgaggtcaggagttcaagactaacctgaccaacatggtgaaacctcatctctactgaaaataaagaaaattaccagccgcattacatgcctgtaatcccagctattcgggaggctgaggcaggataattgcttgaactggggaggtggaggttgtagtgagccaagattgtgccactgcactgcagcctggacaacaaagcgagactctgtctcaaaataaaaaataaaataaatagggagatagggtcttgctctgtttgccaggttggagtgtggcagtatgaatatggctcactgcagccttgacctcctggcctcaagtgatcttcctacttcagcctcctgagtagctgggaccacatgtgtgtgccaccatgcctggctatttatttttatttgttttttactttttgtagagatgaggtcttgctgtgttgtccaggctggtctcaaactcctgggctcaactgatccaccagcctcccaaaataagctaccactcctggctgtaaaagtccttttgaaatggtacaggagttcaagaccagcctggacaacacagggagaccccgtttctacaaaaaaataaataagttagccaggtgtgatggcacacacttgtgatcctagctactcagaaggctgagatgggaggatggcctgggctgagcagttgcaggctcgttggagctgtgattgtgttactgcactccagcctgggcaacaaagcaagaccctgtctcaagcaaaaaagaaaaagcctttttcttgtaatttttaaataattccttccaatacaaaataataagtgtctagtccattgagaattaatttagaatgctcatgtgtcttggattgactttcaaaaccctgattcttaaaccatttgtgattgaggcttacaaccatgtaacaatcctcctaagttctgggagtgaatttaagtctggtaatgctattaaggaaagagagaagagtatgttttctaatgtacagtggatatcttgaagggagccatgcaggcatatttccaccttggtgtgtacttgatggggagaggcaaggagagagcgtggcaggttcagggtttgccatcccaatcttcccttggcgctgatccgtggtttccttcctgatcccacagaataagcaatgttgatctcgtgtggatcatctgttatgtaaaggtggttaataccaccattttctgcttcacatgaatcagagaacctgggtatctctgaccttcagggttccagctctcacctaagttcagccagtgtgtgaatcctctattgacctactgggaccacttggtagattgaccacagctcctgttatgcaccaagcattggcctgtgtgctcttgccagcaaaacaggtgtgatcctcagggagcctcaagtctggagggggaggcaaacattgattgaagaaacttacaatgaatgcataattaagatagggatatttactgcaaaggaaaaataaaaagattctttacatcaaatgacacatagcaccaacttgggctgagttggaagtgactcgtttatgaacaggggtatatatttttaaaagatgtactcttctctgaatgaataatttattaaatatgaaaagcaagagaaatactattaaaagaatgccacatttttagggaaagtgttgttgagggttcgaaacagacttttggtaaccggccaattccacaggctggtgccacattttcagtgccctttgatgtgtgtacgtgaaaaagctgcttgttttcctgtttaatatcaatctattaattttaaagtatttgaagagaaaatcaaagacatagtctgcatttggaaacacccagaaccacaaatctaaatcctagtaccaccaatttgaagactgtttgtcatggcttgaagcctcctgagaggggaattttatttacttgacggagtcatgtgaggttgattggtctaataaaactggattttaaatgaatgtggagcatggtgtccctttgccctgggtatttaaaaatagaccaatgatttctcatagggcgtctttcagatacactttagcagactgatgaaggctgttcccgggacacatttaaatctgaaacaaaatgagagtttaacaaggtgtgttggttcaggttaaaagcgcctacccctttcagctcagccaagatcatctctcattggacaaggttcccccaagactggctgggctcgtcccctgggtgctgaaatgattagtataacattccggagttcaggtctctgttatcttgtttctctgtcggatgcctgggaatgtgaatttgcctacacattttgagacatttttacactaggatgcttctgagctgaagatgaaggtggttggttttcttcctcctcttccccttttcaatattgtagggaccaagtggtttgttgctctctgctgccccctgttgctcatgaatgggaacagctggttttccactgaaggtgattcttaaccattacaaagagcttcccgtgaggttgaacctggggttcctagcttcatgtgaggttggctgattttatttatttatttatttttgaaactgacttttaaatgaaagttgagctaaatggggaagaaggtatctagcaatagcagaagtcccaaggttaatggaatacccaaagaacaaagtgaacagccgtgtgcctctctttccattgttggtagattccagctacctgcagctacgcttggtttcttgagagtcctagtccttgtaattgagccctggagttaagtccatttgaacaaacatcctcctagtcccaatttattccaggtcctgcatgagtggctgggattttcaggaaggagggattatagtcacatggtgtgtggttaatattttgagtgtggagtcaaagcatagttttgaatatgagcttcaactgttttcaaccgtatggctctgagccttggtgtctgtgtctgtataatgaggattttggtggtacctgattcagaggttgttgtgggaaccaatgagaaatttaaacaacttatgatttgttggtcacttaccaataccagtgcttttttttttttttttttttttgagatggatccttactctgtcacccaggctggagtgtagtggtgcaatctcggctcattgcaacctctgcctcccagattcaagcgattctcctgcctcagcctcccaagtagctgggattacatgtgcctgtcaccacacctggctaattttttttttttttttttttttttttttggatttttagtagtcatggggtctcaccaggctgatcttgaactcctgacctcagagtgctgggattacaggtttgagccaccgtgcccagcctccagtgcattttaggcactatgcttttattagctttttaatcctcagtaggacagcaaagatgcttgtcttttccctttcaaatagggctaagggctaacagcccttagcagaccttctctttatccccttgaccaggtttgtatcacatgcctgtgcctaaaccaaatgctggcaatagggacggaatgataagctttgctttgattagttagaatgattcccaaggaagggacaatgttctctgagcacacagagaatgatcactcaaatagaactagggctgaggcaggaagagagaataccctgaggatatcagtttggcttgtaactagcagggcctaccttacatagctgcaagatgatgcacttggacccaatagcccagatcccacgggtgtcataggaagtgcttatcacggagcctagcccatagcacccctgctctacagactcacccaatcactgctctcaagagggtcgtgctgtaatggggaagactgatccatcagcaaatttttgtttgtgtgtttgtttgtttgtttgttttttagatggagtcttgctctgtcacccaggctggagtgcagtggcatgatctcggctcactgcaacctcctcctcccaggttcaagcgattctcctgcctcagcgtcctgagtagctgggaccagaggcatgcactaccttgcccagctaagtttttgtatttttagtggagatggggtttcaccatgatggccaagctggttttgaactcctgacctgaagtgatctgcccgcctcggcctcccaaagttctaggattacaggcgtgagctattgctcccagcccaaatgtttttatactaaggtggaacatgctttattagctgtagtcacagacatttatggagactcagaagatccctcatatttaaaacatgtgttcctagatatgctgttgaagtttatttctttcaactgcatatcattacttgctttcatgctctctttggtccatttttggttttggttttggtttttgagatagggtcttgctttcttgcccaggctggagggcagtggcacagtcacagctcactgcagcctcaacctcttgggctcagatgatcctccagcctcagcctcccaagtagcttggaccacagacgtgcgccaccacgcccagctaattttttaattatttgtagacacggggtctcactgtgttgcccaggctggactcaaactcccaggctcatgcgatcctcctaccttggcctcccaaagtgctgagattataagtgtgagccaccagacctggccccccttctttggtctcaatccctcaactccaatatagcccttttcacccaccttcccatcttctctaaccccgggggacactggcaatctttaagcagaagaattggctgcctgaaagcctgtagatttatttggaggatgggtcaagaagaagtctcccaaaggagcttgggggaattctccttttgattttgttattcaaaaatgatgtcaaattttagaaaatgagagaaaatttagtagagtataacggttaaagagtctcaactttgctactcaacactttttgaccctgagcaacttgcacttaggggcctgagcttttcaatctgtaaatacggccaataataatacctccctcttagggcactctgagcagtcattgagagagcacgtgtaaagtgtttttgcacagtgcccagaaatttgcagtatttaatggtccttcctccttatttatttttattacttgtttttgtttttttgagacagtgtcttgctctgtcgcccaggctggagagcagtgatattatcgtgactcacggcagcctcgacctcccagactcaggtgatcccttcacctcagcctcccaggcagctgggaccatagctatgaacaaacacgtccagctatgttttgtattttttgtgaagacggagtctcaccatgttgcccaggctgatctccaactcccaggctgaagcaattcctcagcctctgcctcccaaaatgttgagattgcagacaaaaaccactgcacctggccccttcctcattctttttgaagtattttagctttcaaaaggtcaaggaccctttataacggtttgctagtttagaaagaaaaaaaaacagtgacatggtgaaaaagtaagcctgctctctctctcgttttctatgatgctctatcgggattccttggttaggagataaggtcaggcattctagggtattcagagggcccacctcttcatggggaagcccaggcttgcttgttcttatgttttgcaggacaaacgtcttagaactccacagatggggagtctgagaccctgagtgattaagtaattttgaccttgagctatctatttgacttgaagtggctaatggccagataagtgctctgagatgatatctcagtttctgctatttttcttgtgaggaaaaggaaaaaaagagcttgatagtgatcagagttcatttgcagaagtggtttccttttccccaatcaacttgtgagaattcacttctgtcctcagcgtgcgtgcttcattcattcactcatccaaagctgtctcaggcagagtgctggggactgggtgagggcggggagtctttccttcaggggcttatttctgctactgtgcatgttcttcctccacaacttgcagatccagacctctcctcctggcaagactttctcatttctttcacgtgacttttggttagaaacattggcctgactttgaggcttacacccagctttctttgtttgtgttttgttttgtttttgagacgcggtttcgctcttgttgcccaggctgaagtgcagtggtacgatcttggctcactgcaacctctgcctagcgggttcaagcgattctcctgcctcagcctcccgagtagctgggagtacaggtatgcgccgctatgcccagctaattttgtatttttatagagagggggtttcaccatgttgatctggctggtctcgaactcccgacttcaggtgatctgcccgcctcggcctcccggtgttgggattacaggcgtgagccactgtgcccgaccctcacacccaggtttttaggatacccttggttctatgcccctgatgacctgaaggcaggcaggagaagtagcagtgtgtgtttgtgtgtgtgtgtgtgtgtctgtgtgtgtgcatgcgcgcacgcacatgcacgtaaggggatgatgcagcccgtggcgcttaaattctaccctccccaagagttgggtcccttcaccaaacattaattttttccgaactccatcttatctctgtaaaatagaagtgctgattctttttttttgtttaagttctgggatacatgtgccaaacatgcaggtttgttacataggtaaacgtgtgctgtggtggtttgctgcacctattaacccgtcacctaggcattaagccccacatgcattagccatttatcctgatgctctctcttcccccagccccctacagaccccactgtgtgatgttcccctccctgtgtccatgtcttctcattgttcagctactacttatgagtgagaacatgtggtgtttggttttctgttcctgtattagttttctgaggacggtggctcccagcttcatccatgtccttgcaaaggacgtgatttcattcctttttatggctgcatagtattccatggtgtataggtaccacttacctagtaatagacaagcacatgcattgggtttgaattttgcaagtgagttgttggaagggaacccctagatgtcatttgcatgctaagtgctttccccgactgtgttatttgctgttcacccagccccgtgcattccatctctcacatttttcatgcgagtgttctgctgcccaaagttactctgtatagtgtttaatccactctgagtcagttctgcagagcagtcggtggtaaagtcctttcaccagcactgtctgagagttcctgtgacaacagcatccccgttcattgaggcctgagtgttcttttagattcctgcttaaacataaaccagcagtgaacgaagaatctttagtacctgacgtgaaatggagcccaagtctatactgctgactgggctgggggcgcatgcttggttggggttcattatatctgaactcatatcagggagatgatttactgtttctcaataaaagatggagttttgaagaataccttcttttgtgtgggatggaaacatgtggctaagcctattgcatcaccttgtacaaaagagatattcagcaggtatttattaagctaaactgaatcatgctcaaagacgctcctcttccctaagcaccattcagttgaatgtaacatgaaagagacaatgcatcatgttcattctggtttagggtctttccttgttgaaggctttctgctgtttagagaaagaccaagtatagcagccagaaaaacacagagctggcaactgagtcacaaagctgtagcaacacatcactcaagaggaacccttctcacaatgggtagatatacattgagtggtgatgtggagtgagacggattgatatccacaatgtcccaaaaggaaaagagacaaatttgacagtaatccaatttccgtcagcaaatttagatgatgagatgaaaagttagatttatgaggatagattcattctcactaggtattatgacgttagaacgcctgccaggtgaaaagtggcacatttttaggggaatttaggtccaacgaaaaggtgtttccttaggcagaaattgaaacatgatctgtctgtccagagttttgtgccttcgagcacacatgtgcatgcaagcttttaattaaccaagaagttcttctttaacgtttatatatatatatatgtatatgtatctacagaaataggataaaaagaagttcagaattcaactgtgattccaatatccatagataactattgctaacactttctagccttttttctctatgtgtatacacatatttggaaatttggaatcactgtaacctgctttgtcttaagatagcatgagaatttcttcatgctataaatgtccttccgaagtgtaatactttaaataactatatactgttccattgtatggatgcagcataggaaactcattccccttggctggatatttatcttactttttttttttttttgagatggagtcttgctctttcaccaggctgggtgccgtggcgtgatctcggctcactgcaccctgtgtctcctgggttcaagcaattctcctgcctcagcctcccaagaagctggggctataggcgagcaccaccacacccagttaatttttgtacttttagtagagatggggtttccccatggtggccagaatggtctcgatctcttgaccttgtgatccacctgcctcggcctcccaaaatgctgggattacaggcgtcagccaccacacccagccttatcttatttcttgtataaaaactcctgcgtgtgtgtgtttgtgtgtgtgtgtaaaacttttattctaatcaagcatattttcacaatttctacagcagccacaacaaactttctacaaggtgaattttagagagaagaggttcaccgtctcgttatttcaacctcatcatctgtaacggtggccatagaacctattctgatttactctaccagaaaacttaccctcttagttactttttttctttcattttttttttctcagctgtattgcctcagttggatcatatctgtttttcctcaggaatgtttctgaaactatgaacaatatggaacatgttgtcaataagggtattttcacagatgcgtttttgtcacacagtgtttattgccagagaagtatgattagtcatgttctctgatgtgatttagtaattgtcatttgtctattattaggtgaaattttctagctgaatttttccaaagatgaataaacaaattaatcattcactttcctatccaccattcaaccatccatgcatcctccctcccttccttcctcccccttccctttccttttctccttccttccttccttctgcatttattaaataccaactctgtgttaggcagtatgttgcatgccaaagacaaatgtataaactagatagaatggtggaatgctttccttctgagcactcacattttaatgctgggaattttatgctgaggttcagtgcttttcagggagccatgaaccccctgcaatgacttgcagactgtaggtattacatgtaaaacttgtgtgagtaatttcctgaagaaggggtttcattcttcagatcctcaaaaagatctatgatccggccaggcgcggtggctcatgcctgtaatcccagcactttgggagaccaaggcgggcatatcaggaggtcaggagatcaataccatcctcgctaacacagtgaaatcccatctctactaaaaatacaaaaaattagctgggtgtggtggcgcatgcctgtaatcccagctactcgagaggccgaggcaggacaacagcttgaacccaggaggcggaggttgcagtgagccaacagagtgaaactctgtctcaaaaaaaaaaaaaatatatatatatatatatgatcctaaaaagacattgatattaaagagtaatgatggggaaggaccaccaagtgatcatttataagatgctgcgagaattgctaaagttgagggatggattctgcattccaggagaacaaaggaggtagatcccgattaactgagtagcaggatattgagggaagcttcttgtaatgattcagctgagtcttacacaatgaatgagacttggatagatgaacatgcattaggagacatcagttctggtcagaggaaacagcaaatgcaaaggcccagagccataagagattcagatgcactaaagaaatatcccatcatttaggatggtcggcatatacacagagggcctataaggaaggagaagaaactgaggttgtagaagctggtagggactgcatgctgaaaggcattgtaaatcttagactaaaatctgtgggagactttgaacaacctaaagattttaagcagagtgatgcaatgcatttgtcttttgaatgcaaatattgctggggcgggtcttttgtgttatcagctaatgatttagttggtggttacctgagtacggggtcaggtgtatgttcttagctggtggaggccttggggatgtagaagcacaaacgggtaagtcactggaaaggtaggtgaaagattggccaatattagaggtgggtgtttatagaaatgaatgacaatgaccactgagtagttcctaagacaccatcgctttgcataaatcatgtcattgaatcctcttaagaacacacaaactcaaatattgtgtattagtttcccatggctgctgtaataaatgatcacattcttagtggcttgaaagaatatggatttagtatcttacagttctggaggtcagaagtcctaagtgggtctaactgggctaacatcacgaggtaggcagcaataagaaactaatcttttggtggctttgggtacagtccctttccttgccttttatagccactagaggcctcctgcatgccttggctcgtggccccttcttccatcttcaaagccagcattggtgagttgagtcctttttcacatcatgtcactccattcttctgcctccctcttctaggttttaaggagacttgtgactacattgggcccacagagataatccagaatagtctccctattttgaggtcagatgattagtaactttaattccacctattcccttaattccctgttgccctgtaaggtaaaatatattcacaggttccaggtatcatgacatgcacatctttaagaggctgctattctgcagatcacatatcatcatctccactcttctgagtgtagcagcaagcagtcttttaggttaatgtgctacagctatagaaagttgaaaccaagatatgaaccatgatgcttttggctccaaagtcagcaggttctaaaaggtaaaccttggtccccaattaatgatcaaaggcagtgggaaaaatctaacattctgatgactttgtagatcaatgagttttgtttcacaagtctaatgcattacgttaccatattgatctttactcttcagattctgaacacacctgtgaaagcagggtttactgttcttttgacaacctgccatctctaattagctccagggccccttagtgcagtaaacaaatccgctgaatgactcagtcctctttctcttttcttattgttggatccgttaagctgtacaaatgtagtctatggtggagggaggggtgagagcagaggggaagagaaggggtgcacagttggtcactacattatcctgcttctgctccaagaataaaagcaaaacttaaaaaaagtattgattcatatggtttgttcatatgtatgggaagcatgtgatattttggtacatcccatgcatgtgcaatggtcaagttagggtatttaagatattcatcgctttgaacattgatcaattctttctgttggcaacttttcaaatcttcttttctagctattcttaaatatataatacattactgttaactattgtcaccttactgtgctgtggaacattaaaactcacttctcctatctaactgtaggtttgcacccattaaccgatttgtcttcatttcccactccacccccacacccttcccagccttagtcaccataaccctattctcttacatctatgatacccacttatgaactcctttctcctggtccatgaagtctttaaaagctatttcgtcagaagaagatttgtctgacccccttccctatgtaaatgcagcacattgtcatactctctcaacacactcttatttctctttatagaggtcaccagatttttaactcctttacaggattttctacttttttatagggtgagcggtctatatctattttattgtcactttatcctttcactcctcaactgactacatggtaggtattcaaaaaaaacatttgttgaggccgagtgtcatggctcacgcctgtaatcccaggacttttgaaggctgaggcaggcggatcacctgaggtcatgagttcgagaccagcctggccaacatggggaaaccccatctttactaaaaatataaaaattagccaggtgtggtgtcaggagcctggaatcccagctacctgggagaccgaggctgggagaattgcttgaacctgggagttggaggttgcagagagccaagattgcgccactgcactccaccctgtatgacacagtgagactctgtctcaaaaaaacaaaacaaaacaaaacaaattgttgaataaatggtcctctagtgttttaatggcttttacttttgcttctgctactggtccttattcatccatctacctccccatctatctgtccatctacccatgcatctatgtgtctgtccattcatccactcattcctccatctatctacctacctgttcacacatccacctatccatccgtcctccttgaagacatacttaagagtacctagcaatccttctggagttccacattctcctctctattttcttcagcctgaagtcccaactggtacatgggcttggtgtgagggaactaataaatgcttatcatgagaataataaaagctaagatttatttattgagtgctagtcacatggcagccaagctctaaatgcttcacatgcattaagttagtaagtgtaggaagccctctgcagtaggcatttgtaatatccccaccctgaggatggtgaaactgagagacagcaaccatgggaacacagggagtaaggctgggatgaatccctggcaagcgaactgttaattctatgtctcctaccttcttgttttccctagcctgctgcaagtccagcttaaaggaaggaaagttctaataaattgaaaatgttaactctgtggactagacatcttcacgtgcttcgtgttcaacatgttataacttcaccataatacaaattaccatcatgagtttatttttgtatatggtgtaaggaagaggtccagttacagtcttctgcatatggctagtcagttatcccagtaccatttattgaatagggaatcctttccccattgcttatttttgtcaactttgtcgaagatcagatggttattggtgtgtggcattatttctgggccctctgttctgttccattggtctttgtgtctgtttttgtatcagtagtgccatgctgttttggttactgtagccttgtagtatagtttgaagttgggtaacttgatggttagaatgttctatttgcttaggattgccttgactattcaggctcttttttggttctatatgaatttaaaaatagtgttttttaattcctatggtgggaagaaagtgtggataaaaaactgcctatcagatgctatgtttatcacctgggtgacagaataatctatacaccaaaaccatgtgagatgcaatttacctgtatgacaaacctgcacatgtaccactgaccctaaaataaaagtttaaaaatattacccttttgtttgcttcattttgcaagaaaactggttggctatccccaaaaagatgcaattactgtcatcttcactgagtggtctgtaggtaaacaagcatctggagatgagtttaagtcctcatggtttaggattttaatatatactaattaaaacgagcaacatgttattattcaataaagaatagaagcaattgattttaaatcatagccaggtgcagtggctcgcacctgtaggcacatctacttggaaggttgaggtgggaagatctgttgagaccaagaattcaaggtcagcctaggtatagtgagacgccatctcttaaaaaattaataataataaaatcatagtatataatcatgcttagagtaaagatctggaaggatactcaatatactaggatttccaggttagaggggcaatgggggttaaggatagtgatcacatgcaactttaatcttgtctacaatttttctaacaaaaggtatttatgtattgtgtaattaagggcatgggacggtctgtgaattctgtaatcttttccttttcttttcttgcagcacagtctcactctgtcacccaggctagagtgcagtggctcaagtgtagctccctgcagccttaacctcctaggctcaagcgatcctttctcctcagcctcctaaatagctgggaccacaggtgcattccagcatgccccactcatttttttttttgtaaagatgggggtctcactgtgttgcccaggctgatctcaaactcctaggctcaagcaattctccctcctccgcctcccaaagttctgagattacagactggagcccctgtgccctgcctgtatattgtttgagaagtcatattcttcctcttctgcccgcccctgctggctttcgcaaaagagaaatcatgccgcttttttaggtaatctgtgttctgtggagggtttctaatttacttttaaagttagtggtcctcgacatgacttgtcccagttttgccattgaaaagaccccaaatgtgcatgagaaacctactgtgaaatagatttccagttttgacctgagctttgtcccaaggactcatctgtgtcagaggaggagatcctcccaaaatgtgctttccatggatgaggaagaccagccatttccctttgacggcctccttgcattttatcattccctgagccaccgttccaaaggaagagagaccattggggaaatgattttgagaagaggtctatcaactattccatttcttttgaaccccaggtggcacttctcagcaacaaggaggcatttaggcaaagagggaacagtttctatgtaaaacctaaaacgcttggactcacagagaaaggcagaattaatcactctctaaagtcaccaagagagaaactgacatgctcactagacattagaataccaacagtagcaagcattccactggaagcttgaaaggagttattttaggagaaataaaagaaagggctagttttgaagcaggtaggtcatagataagagctctggaattcagctccttctagtttttattccaagttctccagtgctgggagtttaagatcacaggcattgcatcttatcctatgactcagtttcctcatctgcacattggaaataatgacagtatcaacctcatagtgttgttgtgaggattaaattaaattatacctataggaggggctggccatggtggctcacgcctgtaatcccaacaccttgggaggctgaggcggatcacctgaggtcataagtttgagaccagcctggccaacatgatgaaaccctgtctctactaaaaatgcaaaagttactaagggatggtggtgcatgcctgtagtcccagctactcgagaggctgaggcaggagaatcgctggaacccgggaggcaaagtttgcagtgacttgagatggcaccactgcactccagcctgggcaacagagtgatactccatctcaagaaaaacaaaacaaataaaatgaaacacacatgaaacccagtggattccttagcacctaataagtatgggcccatacatatatcatcatcctcagcattactggaggttattaacagaaattggtgttaataaagtttaaataaacaggtggatttggaattcctttccaagtaaaacatttaaagtaactttgagggtgaatatacaaataagtgaagtcaagatgctaaatccttcatgggtttgtaagtgaccaggggatatttaggacatctcccttatttctaagagtaggagctcatgaaactccaacacctcactctttttacggcctgtgtctgtgcactttctgtggagctgattggacccttgggggatggccttgcaggtcagacagtcccagcatcttcttttcactctttctctttcagtttctgggttttcacagccaagggaaaggtaggcagaactggaagcaagtggaaatgctcggtctgccattcatctaggaaggcagacgcctctaacaagtttgaacctgataaagcctctgcctgtgcaaagaacttgggaagcagccagcaccgtgcttttttacctctgattagttcttcttccattctctcttctgcgatggaaagaaaaagaaaaaaaaaaaaagacatggagttgagacagcagagaaagtccaaaactgggtaattcagaggggcaggctaatgacccacctgagtctgggatcgttaccaacagtgcctggttttcactgtgacaaatatgaaggtaggcccacagttagtgagagagttgccttgtctatctcctggcgtgccttcccacaggctcccagtggagtctggtcatcagtcttctccctttggagcttgggcccagatctcagccacccaggccacgatggggaagagcctggcctgccccaaaggtggccctttcagagtttaagacgatggagatacaatggaagtctcatcatgtgtcactttgcctttgactccgtgttgccatggaaacagaacatggcttgttcatggtaaacgaccttgtcattgatttttgtatatgctcttaattattgtggcatagttatttataacctgatggggaaggaaatcccaggagaagagcattgtcctgctgaattattccatagtgggaaggagaaaagttctgtcccaaagaaaagaggagaaaaggaaaggaaacgaagatgaaattttcaaatataaataagtccttcaggaaaatcgttccccagatgcattattgcattatttaggaccatgtgcaccccactatgtttgctctcgacatttattttggggggttttgtgtagccgtgacagcatttcctcacatctctttaggactgctgatgccctgcatatcccctgtagaactttgcggatagttcatattttagcaatgattttggaattcctggctgaaataagaggctttgtgaattctctactcctatgatggcctttgaggaaattctggatctttggtttggaagttttgggattctgtgaaccaacactttcttttcattgggtttgatacagtggcatcaatcttacagtttatcatgtaccgatgtttaaaactctaaccattggttatctggttaccatcattgtcactacgaaataaaggattagagctataaaaatactaaaatagataatacccttgattatctaccctgtgtcaaatacatgaacccaactgctcaaactgtcattcattggccaggtcatcagcctccgctgggaaggagttggcactgccaagtcccagacccttcctcagacctactgaaccacctgttgcattttaatgacggctcacccctctgcactcctggtatggtttggctgtgtcccacccaaatcttatcttgaattgtagctcccataattcccatgtgttgtgtgagggacttcgtgggagataactgaatcatgggggtggtttcccccatactgttgtcatggtggtgagtaagtcttactagatctgatggtttgataaggggaaatcgctttcacttcgttcttatattctttcctgtctgctgccttgtaagacgtgactttcgctttctgccatgattgtgaggcctccgtagccatgtggaactgtgagtccattaaacttctttttgtttataaattactcagtctcatgtatgtctttatcagcagcataaaaacagactaacataacccccctttcttcctacccctgtgatttgggtggatattaaaattttgcaagccgccactctagagaagtaccactcaaaccatggtctgcagactaccagcattagcaaggcctgggagtttgtgagagatgcagattcttggtgcccatccaaacctacagaagcagaatctctggtggcaggaaccagcaatctgtgctttcaacaagctctctgagtgcttcttctgaatgttaaagtataagaacctctgctgcacagggagacctcactttcattattctcatttcacagatgagaaaaatgagtcagtaggaggaaaagtgattgactcaagtgcttaataagtgtctaagctaggatttgaccctagggcttgtgaatctggagcccatagactcaactcctgtgctatactgcctctgtgtctttggtctgtgttctcttctttttttttttttcttaccaccctccaaaattcttatttatttattttctatcaccgtacttactggtggagtggaagtcccttggaagtgggggacgtgtctgatttgtgcatggctattttgcgatttgccattgctggaatatttagcaagcatcaatgagtcctggagggcttttaaaccatagatgatcagggcccctgcttggtctaggatggagcctgcaattttgcatttgtgacaagctcccacggatgctggtgctcacttggcatagcaaggggttatgctatttttcaaaggcaagagaagtgtgcatgtacttgagaggagaaggggtcggtcaccatttactttgtgcctcttgctacccttcgttgcctggagttctacacactttgcaaactttacctcattaatcttccccaccctgggagggcctgtgtgacaggcactggtacctttatttcacagatggagaggcagcagtgccaaggggctgtgacaggcccaaggtcacctggcaagtcccttgcatggacccagaatagaaacgccaccgcctgccacaaacccctctcctctggctcctgtgaacctttgagcccccaagcctgttaagcctcttcctgtcctctctatcaatgcccacttgcactgcctcctaaattagctttgtgtctttaaccccagcctcgggaggcccaggttcaaggttagcactaagcaccttttgagttccttgtaagttggacgctggaataattctaagtcaagagcaattaattatagaagcattagtcctgcagaaaccctgcttcagtcttttgtttctggctgctgccaagggccatgcacattctctgtattatctttctctgcatgccttcagagtttatacattcatttccaccaaaaagctcatcatctgagacccttactacgggtacagatgtccagacaccacatccagctaaaaatccagaatcaatcactgttttactaacaagttcctcaggggactctgagacacacccatcccggaaaattcctaagtggagccaggtgcatcagtttccaggagcactaagtgtccaaccctgattggctggtaaataattgggagggatgtggcttgggttgagggatgtggcttcgttgaaggacggcctggactgcacttcgtaagccaccttctgtagttctgatactattaattcatgattcatatcaacagaggatgggctgggtagtcgagttcctggttctttattaggcagagaatgtttctccatctggttgagagtctgtcatgttgtatgagtccagggggcgacacattttagaatttgaaaataggtcgaacccgatttgctttctttattaggcagcactcacctgggggaatggataactccatttggttcagtcaaaatgaaaattggccaaagaaagtgttaagagggcctgccatttgtgtgagttgagccataaacattggcctgctttttagcttgtggttcattggtgtatagatgatttcatgatgacgtcagtaaagggtctatgagaacacaaactacaccgaaattgacatctgatagggtcctgttgtctatgtagccacaggaggttagttctgagtgtcttcatggttaaagaagaattcagtcaattgattatgtgattctatttttataaaatatccagaggaattaaatccatagaggcagaatgctgattgctgattgccagggtctgaggggatggggaagtgagagcaattgcctaatggttgtggggttttcttttggtgtgatgaaaatattttggaacttgatagaggtagtggctgtacaacaagctgtcactgaagtattcactttagcatagtacattttgtgactgtcacttcacaaacagagtcacaaacaaaattcatgactgtccttgattttgagaggagactgtatacaggaaagtgctctgtgacttttacgaaataagacaaataaaataaaccctaacccaactccgggcatccttcccttttctcaaagacctcaccctaatttaagagaacatgaataacaaatattttacttccatattaaaggagttcttttctctgtatgtcatttatcatagcaaacaataaaatgggtatgaatcatcatctttacaagaaggtggtgtaacagcctcattctgaatccaggagccatctctagataaaacaagatgcatggaagatgtgacttaggaatgttgagcacatattattctttttataaaatagcagagttgaatgttggggatgctctaaagtagtcaacttcagcttaattgaaatgtgatgcaggcttattgcattattgttttttttgttgttgtttttttttgttgttgttgttttttgagacggagtcttgctctgtcacccaggctggagtgcagtggcccgatctcggctcactgcaagctccgccttctgggttcacgccattctcctgcctcagcctcccgaggagctgggactacaggcgcccgccattacgcctggctaatgttttgtatttttagtagagacggggtttcaccatgttagccaggatggtctcgatttcctgaccgcgtgatccgcccgccgcggcctcccaaagtgctgggattacaggcatgagccaccgcgcccggccggcttattgctttattctaatgtgatgctttggtagacctgagcttcctccacacactaaacacaaaccttgcacttaatagactttgattgaaggtgcattcaaagttcaagatgatcagtttggattctctttttttgtcacataataacgaatatttattgagttgctatagtagggtccatactttccatacattgatctatctaacattacagcaacaccttaatatagagactattattgtttctgtgttttaaaagaagaatcccggtccatcaatcttaattaacttgcccaggttaacagtgtttgtcaaaatagcaaagttgggatttgaaccctgggtggcctgaacaccaaagcctgtactgttaccatcaccctcttataggaatgttccttaagtgttcttatgtgtaagaagagtctgagatgaagagtttcagagggatgactgtgtggccaatcttccctacaggcacaaagggatttttttccgtctcgaaattgtcagcctcctattctaaaggtacaggttcctcctatagagttttagggtcagatgtcagttttaccccaagtccaccactagctagcagtttgacctttgccaagctccaaaaaccatctgtgtccattttcttcctctgtaaaatgggtataatactgacttctgagaaaggctgttacaagctttcaaagaaatggtatttatgagaacatctaaaggctggagtctccggacccactctctcactttccccttctctgtcctcaaaacagcatgcaccttcagtgggtgtaggcctctgggtctccatcctttccccaccaaataatcacatgcagacagttgtaaaaaccacagagcattttcctgtacacgatgtcctcatactgaaccaagtcgttagcatccatgtgtggctttattttttctcacaaggcagcctggaaagaacaaatttatttgggtgtgatggttttgtatcttctactttttaaattattattattattttattatttttatttttttgagacagagtttcgctcttgttgcctaggctggagtgcaatgatgtgatcttggcacactgcaacctccacctcccaggttcaagtgatactcctgcctcaccctccggagtagctgggattacaggcactggccaccaggcccagcgtggctcatacctgtaatcccagcaatttgggaagctgaggtgggtggatcacctgaggtcaggaatttgagaccagcctggccaacgtggtgaaacctgtctgtactaaaaatataaattatttttattgtcctggaacactcctacccctgcccaaatcctgcacatatccacagctgcccttgccctcatctgccggggcagctgtagtgggaatctgtggggccagattgtccgttcctgggaggtgattatttggccagtccacgaatagtgcactgcagtaggcctggctctcggaggcccagggtgggagctgattgctttggcttgatcacatttcttgagagtttcacattctaataattaaaacccaaaatggtgtgactgttgcattggctgcattttgtttcctatgtgtgtagcagggtggtctgatttccttccttataattcaagtattctgaacagcagtatgagtttcggcctgaaggaatttattagggtaatcttccctctttcagccaaaaaaaaaaaaaaaaaatgcacccagaaatgcatttagtggaaacctctagtgacaagcaatattctttcttcctttctcctttcttccctctcactatctttccttcttagaaagaatgttgtgacatcattaggtctgtagtaagagtttgttaatttttctaagaaattatctttaacactgtataaacccagtttttatttcatatgatcagatttaagttggtgcttcagtctctaagtcttacaacggtgtcatttgcaacaacatcaatcattgaattgcacgtcaacggctgaggacatctttctctgcacaggaaaagtttcctttcaggcaggttgatctggatgttagtttcaggataattctctctctctctccaccctcccaccccttccagcagctcacgccacgtcttccctctccctctccttttatctacctctcatttttatgtaaagcattgtctttcagataatattgttcccttgtgaattttatagaacggttattgaatcattttcgcctcgatttccaagtgtgttacctttaccttgacttggtgaatcacagctgttaaactgtgtctcgtgattttcattttagagtaggtcctggtttttattatagaatatgctcatcttttctaagccttgtgtcctggcttgtaggacagggttggggttggaagtaacttggggtcatttggggttttttttagaagaaagtgatggagtctgggaatttctctgcaggcttcttagagtgttcagggccattctaatgctttcccttggttcagtcttgcaagactttcataattgtgagcaaccacagtgtcttcccctcttttggacaattaagggatttaaaatatagatcgaagttggacacttgttggtgatttaggagatgaacagtagcactgtgtgtcagatatctgagaacatgcaatatttgctcagtgggtagtgggataagccagttccatccaagtcatgcagcctaagaatgaagaggaggcttggggtctgaaccctgtgggtttaattctgtctctgacagttaccagttttgtgactgtgagctattactttcattctgcagtactcatatgacaaaagatgggagaagtgataatggtattcccttcataagtatttttgtgaaagttaaattagatgacatatgtaagatatctaacatatgtctgatgtatcacggtcacacaataatattataacttattaaatttattattactgttgttgtcagtcaggctaggttgatgctgtaacaaacatcccccaacttttcaggtacttaacagcatcaaagttgatgccttattcatacaaagccatgaacaagttttctagatcaagtgataacaagcagattcaggctccttccatcttgtgactctgctgtttcctggcttcagtcacccttgaatcatccaaccaagagacagaagcaagagccactgagctaaggatctgggggtgggaaatgtggaggtcaagtctggagtggacattcctcacttccacctgcatgccattggccagaaccagtcatgtgacctccatttcaccacagagtagcatgggaaagagtctccctggggccctagaaagatgaaacaggattggtgaggtccacccgccacagggttactttttggtacctgaaattccccttttttgctctgttccaatttggaagaaacttttcttttgactctgggctattacttcgccctagccattggggctcagcctctgtggtctcagcttattgtcctcttcctctgttcccagttcttgccttgaccctagagaatttcaacactctggtcctcagcctagcaggattgtccactctatcctgaatagcaacagtcatagccttctaattagggacatcataggtttctcccagttgaaacacacacacacacacacacacacacaatattatttttaattgacagacaataattgtatatgtttgtaggatacaatgtgatgttttgctatctgtatgcaatgggcagtgattaatggttccatttaaaatacgcttcttaagtataaggagaatatccttcatcagtactctttatattgcaatattaagggaaacctttagaacttaaagaataaataccttcttccaagagtcaagtgacactatcttggaaataaggtaatattcaaagtaggtttttaaaatggttttatagaggtataatttatataacataaaatccacctttttcaattttacaattcaattatctttagaaaatttacagtctaattttagaacactgtcctctccttaaagagagctcgcctccaagcccatcttgcagtcaatctctgttcccaccctcagccccaggcaaccactaatctatcgtgttcctagcagcataattcaaaatagcccagaagtgtaagcagtcaaaatgtccatcaactggtgagtcaacaaaacttgctatattcaaatactgtaatacactttagccaaaacaaacaaagagataaaacaaaaaaacagaatacaaatagaagctacaccacatagatgaacctcggaaaacattatgcacatattatgcaaagtgaaggaagtgagctgcaaaagactacttattatgagattcctgtttatgaaatgtccagaaaaggcaaacctaacgttgattttgattgcaattttccattaggcaaatacctagaactttcttttctaggagcctgaactactcacatgccttgggcctttggggctaattctctttaacataagaatggctaatttgttgcttcttagatttgctttgtcattttgtctaccaagggaagaaattcagaagccaagaaggagatggtgactttgccagagccatattaaaaaggaaaccatcttacagctcatcattcctctctcacctgaatcttgtttgatttctcaaagcccatgtgggaccaccctccatttttaagttactgttttggagaatatgtacagtgtctactggcacctggtggcaggcaggaatgtttaagctgatcatttgttttaaacgtaatccatttgtaacgcatgattcatctattgctagaaggtacttggcatcctttgcatataccgtgactcaaactgtgacaatgtttatagctcagaaggtaaaaaaaaaaatcagagttttgttcatcagaattatcacaaattccacatttttggaattgaagataatgccatcttagcctatttaagactggcattctagaaagaggcatgctgatgcaagcaaagcaaagacaatcccaaaaattaacctgttttagaaatgagcagccaaatgtctcctaaacttctatggttattttcatggacactaccttttattttattttatttttttgtttttctgcttataaaatactatgtactaattgagaaaaacttggaaagtagaaaaaaaatatatatatatatataaattaattcccttgtcattcctgtgtctagaatagttaataacatcattctgatggatttaccttttatttatgttttcctgtatgtatgtgagaactcaggcacttaattgggcttaagctgtatatgttccataccctgctattgttgcttgacattttattatggatattttcctccatgtcattaaatattcttcaaaaagataaacttaatggtcatagtaacccaacatttttggatacaccatcccacttgccaccccccagctctttacactaatattgctttagtcttttttttttccatcctagttaaaagctgagatgaaaatttgtaagtagagatggctgagcacttctccattttccttcaatggctcttaaaagtaaaataattggctccaggtatagacaatattaaggattgaaattgtctgtattgacttctttatcaagaatcaggtagttttggccgggcccagtagctcctgcctgtaattccagcactttgggaggtctaggcaggctgaatcacctgaggtcaggcattccagactaccctggccaacatggcaaaaccccatctctagtaaaaatacaaaaaaaattagtcaggcttgatgacaggtgtctgtaatatcagctactccactagggaggctgaggcaggagaattgcttgacccctggagtgggaggttgtagtaagccaagatcgtgccactgtactccagcctgggcaaaaagagtgagtatctgtctcaaaaataaaaaaaaaaaaaggtagttccatgctcttataaataaagaatagtactgcgttagcacataaaaatgggttgaccttcaatgagacggtcatggactttcgttcagaaagactttaggaaagtctcttcattgccaaggggtatggtccatctcttatggaagtatgcatatcataaggaattaaaatgactctccttcttttcctttttttgagacggagtgtcgctctgttgcccagggtggagtgcagtggcctgatctcagctcactgcaagctctgcctcccgggttcatgccatccttctgcctcagcctcccaagtagctgggaccacagatgcccatcaccatgcctggctaatttttttttcggatttctagtagagacggggtttcactgtgttagccaggatggtctcaatctcctgacctcgtgatctgccctccttggcctcccaaagggctgggattacaggcgtgagccaccatgcctggccacccctccttcttttaaaaaattcctgcagtcactctgaagaatgccatttagaacattcgagtgaaccaaacataatcagcagcccagagaagacctcttttacctgcctcctcttatgttgctgctgagatgaacacagtccttggaaagtggtggttgtgcctttgcttttttgtttttttgtttttttagttatgggccttgccattggtttcttctgggtccccatctgtggcctctttgcttatcatggcctggtgaccccctagtacctgatgatatctatagtaggtctgctaggaaaggcttggagtcttcctttcactacccatgaaatgaccctccaggcaagtcactttcctaacacagcattaataggtgttgcttctttgagataacctctttcttatccacatgctcagggtacatatctttgtgtttttgtttagtaagacacactcctctgaagctaaacttaatctgcggagatgtcggatgataaatttgtcccctactgtagtgtcataatatatcctctatgtattaattaaaatgaagttagatattgcttttcagacaacattagttcaagatgctttcagtacaggattaatacatgtatggatgcacggatggatggatacatagatgaatgggtgaatgaattggtggacggatgaaaggatgactagatgcatgggtggatggataggtgggtgggtgggtgagtggatggatggatggatttgtgggtgggtgggtgggtggatggatggatgggtgtttggatgggtgggtggatggatggatgggtggatgaatagcaatttctagatcttactgtctataccttactttgagcactgagaaggaaataattaatagttgattctattaatttatgcttccaccagtttcctggaaattgaatttcagagttttagccatgtttcctccaaaaaaatcattgcctttcttgccttatcaattaagattagtcttgaaaaaaatcccacctgtgatgtcacacacagctaccttttgctgttaattctggtgaaaatattaggctcactattaatatcaatacttaatggatcataagaatcaaatatcaaatgaagagaccaacatacatgtattacttcttaaaaaaatctttaatgactaggaatgtattttaatattggtgatacctaaatttaatgcaatatacatgtctctgttgttttttagacccaagctttttctccttgagataaagaatgatgctcagggtagtgtagcagagtggttatagaagagggccccggaatcagctttctgagttctgacagctctgtcatttggtactcgtgtgacaatggatctctgtttcctattctgtgaaatagagatactaacacttgtaaggtggttgtgatatgagggtgaaagaatgcaacatagctatgtgtttaatggagtgcctgtcacacagtaaatgctgctacagggtaggtggtgctgtgctattatgtggcattatcatcatttcctttattattaaatagcagaagttgggatggattaggaagcagacactcagaaaatatggtgagcttataaatgttctttggtgcaataaattgtcacacagttggtggcttagcacgacatttattctttcacagttctagatgacagaactctgaagtcacatagaggtgctactgggcctatctccttctcaaggtcctgggggagtgtctcctccttcctcttctagcttctggtgggtgctgcccttgactggcttgtggccacatccctgactccttccaatctatgtccccatcttcacatcaccttttcctcttctgtacacgtctgatctccctctgctctctcttatagggacgcttgtgattgtattaatatttcggacccacctagataatccagaataatcaccccatctgaagatcattaattgaatctcatctacaaagacccttttctctcacaagttaacatgtacagactacagggattaggacctgatatcttcgggtggcgattattcagcttaatacagtgggttagaaataaaacttgattttccattgtacaagaatgggggtttagtcttaatggttttatcatgccatgtacataaccactgtcagtatcagtgggggcgttttctgaatcgtggcttttgttttctgtgagctcattgccccctttcccctttaatattctagtaaagcttattttacaaagaaaaatgcctgcagtgaaaagcatttcttgatcatctttggatcaatatgtaatatttatatttcactgaatcttcatgccgtgtttcaggtttagcttctgtgtcaattttgaaatgatctgtggtaaattccatattggaaagacatgggtctcctctactgacttattttcttcttattccctgaaaagcctttcttatcaccccaggaattgtggagataaattttttcactcatgaggcataatatagttagtcgatgatatatttgttgtaaaaaactctttttccattgtagtccaaacttaaatttccctagtgttcatttgctttctctattttctagtgcacttaaaaatacatttgcagtcacgattgcctgggtaagttataaatcctagatattagaatttttatgctttagaaataataaatgagggcttaccaattaaagataaaaaattacttgactggggatagtagaatattttatcagtattattaaaatttaagggcagctgaaatgccacaggaatccttgtacaacattttggtttaaaaagttggcttaaggataagttacattcttttcttcaattttacatcaaataggatattatataaatttcttaaaacagagcagaaatcttgttgaactgaatcaaatgcagagcttttctccagttgtagccctgtggttttactttttatgtttggaaatcacttttttatgtatcttgggtctctaataattaccattattactttatcaaaataatgttaataccacacatggaataaataacctcatgtgatttattgtaaaaccaaggatttaaacaattaatatatttaatccatcagcacatctactgtctatggataagtacatctattttgtggatgatcacaacaggtttttcactctaatttttggttttctgtattttcttcttcttttttttttttttttagttcattattcttttagctctctggtaccctggcttcttctttgtaggtcattgtgacttctttgcagcatcatcacaattctctatagcttgataaataacctctctggaaattgatgattgctagagaatagcacagaattctaggtaggcactgaaaaaattataaaataaaataaaagattgccttttcagaagatgatcctattaggagaagcagaattctgtatcctgcacaaacacaattgatacctaagtagtgtgcatttttaagcagtcatttgtgaaatgatgtggacttaatggcagattaaaacaactacccgctgggctgtttcaaaaaacaaaaccctccaattaagatggatccatgagaatgtgaaatcaatctgccctaacattgagcactttctgtgtgaaggacactccacgagtggcatgaaataggaacggaggagttgaatatcatctcagtcctcaagaactgtataatccagagcagtggttctcaatgggggacagttttgccccccgccagaggacactaggccatgccttgagacctatttcactgctgcaaccagggaggcagtgctgctggcattagtgggtagaggccagagacggtgctaataattctccagtgcacagcaccagcccccaccacaaagaattacctggctcaaaatgtcaatagtgttgagattgcaaaatgctagtgtggagtaaagggaaaagcatgtgcagaaaacagtatttcaaggaagtcatgataggtaccagcatatttatgagggttcagtggaaggaagagattctcatgggttatacaggggtggaatggggaggtcagacctcatgctagacttaggaagtgtgatttgccttgaaggatgggcgagagagggagatcatgagggcatttcataaagaaaaatggcaatacaagaatgatattcataattcttaatgaaaagtacgccacatacactgacttgctggaacagacgtctcatcagtcagaacagaaatgcaatgtcaccccattgttggacatacaggtctcatatcagccttgtgacaaccactctgtctcaagactcaatcagctatcttgttagaactagttttatggtgaactgggatgggcttattttcttgaagcccttcaataagaaaattggactttcctgatacacagagtgggctgtgaaaccaccaacaccttttgagttaaggagtttccaagaaagtttgtcattctacttccacccactttgtcagtgaatttcttaaaaggatattaagtgtgtgatggaatcttataggcatgtcccattggagttacagagcaaagccccaggactatggcttttgacaaatgtgtcatcaaaataaactgggtatttctaatgtgagtcattggcggtaacaggataggagaagactgtgatgatgaaggcagtatttcaaggagtttaattctggggcaaaatgcagcatgatttggaatgagaagaaaccaaggaagacttttgaaaattgtttgggtataggtagtggggtcagaaattcagacatacattagtggtatgattactaaagaatcagtaccatctaaactctctcatcttcttttaagtgatttgacaaaaaggggtaagtgtatggattgatataaataatccatatacaatacttggctcagaggataagtggttttggacttaagaaacatatgctaaaggtgtgattattaaaggatcgctaaaacttaatctgtctcattttccatttagtgatctgataaaaaaaaagtaggtgatgttatagattgaatgaagtatttcacatgaaacacttggcccagtgtaagagtggtttggaagccaataactggtatattccagaccaattagctagctggagccaattaaccattaagttcttcattgttatgaagaaggtaatacattctgtggactttaagaacttctgctataagggttataggatgaaatgcaggtaggaattgagaacagtgtctggaatcttgtcagtgttaaataaatgaatatagtaaatggtccttcaaatgtttatccgatatgtgcattctaatagagaaatcaaagtttaccttgacatgttgagtagtagtcacttgagtaataaaggttcgttaaagaagtccgaggctgggcacggtgactcacgcctgtaatcccagcactttgggaggccaagatgggcggatcacctgaggttgggagtttaagaccagcctggccaacatggagaaaccccgtctctactaaaaatacaaaagttagctgtgcatggtggtgcatgcctgtaatcccagctacctgagaggctgaggcaggataatcgtttgaacccaggagccggaggttgcggtgagctgagatcgtgccattgcactccagcctgggcaacaagagcaaaactccgtctcaaaaaaacacctggagcaagttctgaggtgagagatggagtggaatcgttttcacatgcccagagtttgatataaagaagggacatgtctgagtgaaatacttagcgggcatttggaggattttgtatctgagagatcagagtaggattgactggtttggaaatctttgtagaggggagttggaaagtgttggaaagtaatttgctacatcagcttttaagtatctcctgtttattgtttgcatttttaacttcatttgggcctagaaatggcaaggaagcaccattgaagccaagaaaaatgtatcagacagctattgccaccatggttctgtgtaacaaaccatcctaaagcatagttcctcagataactttgcttactcctgagtctgtggataagcaggcatgtgagtgctatgtggctagtccggactggattgtagactccaagatgcaagttgagttcacatctgccctggtgtctttcatcctccttagaccagagacttctttggacattttcttctcttggtgaattacagatggacaagagggtgaggccgattgcaaaagggcattttaagcttctgctcacatcacttcctctcacctctcattggccaaagcaagttatgtggccaaatccaaggttaagcatcaacatagccaccattaggctatgatactgatgtgttttttaatactacttcagggaagtaaagagccagaagaaccacagcgacataaaaggaaatttttctgggtgatgaaaagtgcaagattttgtgtggacttgttgatggtactgtggcagccatcctgtgggcatgatgagatggccaggagcatcacagagacacagctcttgaagcaaaggcagaaattgcctgtctccgcatttgttgatattgaagccgtgaagtcatgctctctgttcctcacagtgaagggcaagactaaggacaccagaggggtatgaggagggagaaaagaagaagctgaaactggaccttgggcttcacccacatttggagttatgggagtggcagaatgcctagcatgtaacatacactctagaaatgtttgttgtcttgaattgatttgaaggcgtcagacaggccgtggtctctgtgtctttttacatctgttattccactgccaggccgttctcctttgctcccatcccagagaaacctgtatcaccaccggcataataatgacatttcattattacgatctgatactctagggctggtatccagctgttctaaatagagcaggtttctgtcaaagaggtttcacttaggactaagcatgactattcaaactactgccacctggggagaaattatttaccgttcttcctagttgtcaatctctagataggtatgttctcattattttttttctcccttcatcttctctcatattcacaaagaaaaaagttttgtgttattacagaatgatctgattttagcaatgaacttcttctcttgttggttattttacagttagattcttggatgaatattatttccatcttatgcaattaagagtgatctctcatctgatttcagtgaggaaattcttctgtcgttgaccattttacggttacagtctttgaggaattttatttccatcttatgcaattaagaataatatctcatgcggcattaaattgttggactgtctttgaaattgaagacaatgagaaaattctagcatgagcatcacctttttgtgtgtacgtagctttttggatctcattacttacagtataaaaaggcaatagttgctgcagttatatttatagttgtttattcctcatttttctaatggaacttgtcaattagaatcaatggcataaaagttttcttggagggggcgtaacttatggactactaacactgcctttagttcagtctttctgatactgtttttatgagacaaacaatgatatgcttgccttgtctgttggcaccaaacccctttgaaatgtatgttagaatgtattaaggtttaggatgactaatggctagtgatgcaggacgggcaagtccaaaagttggggcttagcctgggaggattattggcttcacctgcaaaagaattcatgtgcaagcagatggtgttagacagcagtcttctattgaatgatatggctccttgcagaggagggctaactcataggcactgagcccagagttggcaacatacgggctattcacaactatatttacactgacttagaccattttcagttacatgcaaattaagggacaagttaatgcaaactgaggggtgggttatttagaactttccaggaaaggaacagtagcttccaggttgttgtcatggaaaggggtagtaacttccaggtgattgccatggcatttgtaaactatcataacactagtgtcttctgctaacgagccgtgagggtatctgggtattgcttttatcaccatttactagttcctgccattttatttttacttcatcctgtcaggacccagaaatatgtcctgccagtctcctacctaactaggattcttgtaagaaatagttggcataatgtggagtataaactttaagttttaggatttcactgccccttagaatgtaacaagtacaaattaaagggcttgcataggattgcatgctttaaatttttccagagaaaaggcaaaaagaggtctttattattatgataattttataaaataaagtgaattgaagccatatgcagtagtgaggatgtcttaacagagtagccctttaatagatttgtgcatattggctggcccaaggggtgggctatagtgagatctgtacttgtctgcataacgtctgttttttttcccctctgtccttgcatggcagccaggtggtataagattgctgagataaattccaagtatagcatatctttactctaagctagtggtcagcaaactttttctagaaagacccaggatttttgtgttgtgggccgaacagtctttcttgcaactacttattgtttatttgtgaagtttatttaccaagctacacagtgggctaggtttgccttgtggtcataattccccaatccctggtctacattacatatgataatctccagggactcaggcctctgctctcctgagctgtggtattctcctgacccacacagatttgttaaggaataggaaagtaatactatgtgcactagtgaggtataaatatctctagtacccaaaggattataaatcactctactataaagacacatgcacatgtatatttgttgtagcactgttcacaatagcagaaacttggaaccaacccaaatgcccatcagtgatagacttgataaagaaaatgtggcacatatacaccatagaatgctatgcagccataaaaaaggatgagttcatgtctttttagggacatgggtgaagctggaaaccatcattctcagcaaactaacacaggaacagaaaaccgaacaccgtatgtcctcactcataaaggggagttgaacaatgagaacacatggacacagggaggggaacatcacacaccagggcctgtcagggggtggggggcaggggaggcatagcattagaagagatccctaatgtagatgacaggttgatgggtgcagcaaaccaccatggcatgtgtatacctttctgacaaacctgcacattctgcacatgtatcccataacttaaagtataataataatttttaaaaagctgttaatcaaagttttcttattaccaagaaggctgtaggaagatactaccatgcattgcagtggagattttcttacatgaatatgataaccacaactgctgcagccacttacccacctgcttggagatgaagccagtgcaggtgaggagaggagcagagtgaagaggaacttctgaagctaaaaatatctgctagcttgtataaatgctagagtgcccagggtttcctgttatgtgcgacagcatctttcattgccgtttaatcaagtctgagttgggcttcttgttatttgcaagtacacatacctcagctgataggggagaaaacagaactcccgtgaataagatattactaggaatttagagacatgggacagcagagaagagatgagatgaaattgggagacagagggagagagaggctggtggctgtacagtaaaggtattgagaagagataagatgaaattgggagacagagggagagagatgctggaggctctacagtaaaggtattgggataatctccgttggcagatactagaagtcctttcaagagctagagtattaaacatctagttctgaatagggtgtgtgtccaagatttaaaattcctctgcaactccaaacttcattaaagtctgatgccctcaccaaagccttcttggagtagttgtagataaataaaggctgagatgctgagttccattcttgggtaagccagacccaaatgaacgggattccctgtgaaaagggtgagagttcagggggtaaagaattaaagccacaaattactatgagtgtgtaaattcctaggaatttgtggacatgtttggaagtatgctaaacgtacaaaaaaaaatatgcatgacaattacctttaaaactcagaagacagcttcaccttcgtttccaagttcattatgcatttcaaatgatcagaactaataacaattatgttcaccatacaatattagatcacctttcatggtttgaatggttccgctccaaaattctggtgttgccgatgtgataggattaagaggtgtggccattcagatgccattaggccagaatggctcctccctcataaatgagattaagcccattgtacaaagaggcttctggtagcatttggctctcttggccttctgccttttgccgtgtgaagacacagcattcctctcctctggaggatgtagctttcactcaacaactgagcctgctggcacctaggtcttgaacttcccagcctccagaactgtgagaaatacgtttctgttctttataaattgcccattctcagttattttgttatagctgcacaaaatggagtaagacgctatctaagatgagttatctttaaaatatttggaaaaaagacatagtcaagttttctttaagattttttatgtattctacttcccctaatgatctagtttccttcccaccaccatgattaaatattttcttctaaacacagtgaaagcagtaattttgttggtgataaagcgaaatatttctagtaagaacacaagatggacatctgtaacttttgaagtagcagctgtaaataatttaaaaattttttgagataattttgcactttcataagagttgcaaaagtagtccagagaatttctgtatagtcttcacccatcttctctgagtattaacattttatatcaccataatacaataatagaaactaataagttagcattaagaccatgctgttaactgaaatatatacttcattgagtttacaagattttactccagttcttttactctttttctcttccaggatccaatccattattccacattgtttttagttgccatatcaccttatgtctcagtccactcaggctcctattatgctattacaaaataccttacattgggtagattttttaaaaagaaatttatttcttatagttatggaggatggaaagtccaaaatcaaagcaccagcagattcaatgtttggtgagtgctggtttccagaatcatagatggcatcttgttgccatgtcatcacacggtgtaagggtcaaggtagctgtcttggatggcggcagtggctgctgctgccgccgcctccgcctcctccttgttctcttcctttctctttctctttctctctctccttctctccctctctttctctgtctctcttgctctcctccctccctctctccctctctttctttctctttccctctccttccttccttccttcttccttccttcctttcttccttccttccttctttgtttctccctctttctctctctctctctgtccttccttccttccttctctctttctccctctctttctccctctctttctctctctccttccttccttccttccttccctccttcctctttctctctttccccatcttcttcactaatcctgcacatgagggctcttgtcccatgacctaatcatctcccaataccatcacattagtgattaggtttcaacatgtgaatatggggagggcactaacattcagaccattttaccttagttccctccagtctgtgaatctgtgacaattcctcaggttttttttttttttgatctttcatgactttgatacgtttgatcttgcttgccatgggatcttgggtgggtcatataatatgtccgagtgtcagtttccacataggttttacagatataatggcattacctacaccatgtttcttagatggggattatataaagaaatcattttggctcaatgaatatgagctgtttataataattattgttattaattattaatattaattttagaatttttaaggggatatttctcagctcagattatctgctgtttgaccctgagtagaatgaatttatgtgttcttggaagggatgccacaaaagtgatgtgtccttagcagatcacaatggagggtcaacgatgtctttatatcttattactagtgatattagccttgatcacttagttgagaaggcatttgccaagtttcttcatggtaagattgtttttaacctttgaacttaaaagtacactaatttattactttgatggcccaatggtgattttcaatttcctctcatgccctgtacatgtattcattggaacacttgtgtaaggaagcatttttcattctcctccatttattcagtatttatatcattattgactcaacatttattttgaaggtgagctataatctaaaactgtcattatttatttttgtggctcaaatcattccacagggtatccacaggctggtttcagactcgtgaccctaagcaatcctccctcagcctcctgaaacactaggagtagaggcacaagtctccatgtctggccccattaacctttttagagtgcacatttcagtggaatttagcacattcgtaatgttatgcaaccgctacctctatccagttctaagacatttttatcaccctagaaggagaccctgtatccagtaagcagtcactcttattccttctcctctgccccagcccttagcaatcactaatctgctttctctatgtatagattttccttttctggatattttgtgtaaacagaatcatacagtatgtggctgtttgtgtccaacttcttacatttagtatagagtttttttgaagttgagccatgtggtagcacacatcagtgcttcattcccttttatggctgaataacgttccactgtatggatagactatgtatttatccgttgattagcatttgcgttgttttcattatttccttgacgtaaatagctgctatgaatatttatggagaagtatttgtttgagtacatgttttcagttcttttgggcacatacctaggagtggaattgctggatcatgcagtagctctatgttcaacttactgaggcatcagcaagctgtttcccacagcagccaccccattttacatttccatcagcaatgttggaggattccattctctttgtaaacaaatttcctatgttgtgctttcctaagggggcactggagtgaatggcatcctctccaccatcttgcttgtcatgggatcttgggtgggtcgtataatttgtctcagtctcagtttccacatgggttttataggtacactggtaatacctaccccgtgtttgttatatgaggattatataaagaaatcatcttggctcagtgaatatattagctgcttataataattattgttattaattattaatattaattttccctttccttctcaggctcttttatgttcttgcttgtggctctgaattcagatgtctgagtaaccttttagcaactcagatctgtccctgcgtttctcctctttgtaagacgtcagttctggtgctgctaacattcactgcagcccctcactctcttttttatccaaacatttctggtgtacagaacacatgcttctggatttatggtgggggctggtgaagagaagagaggagaacgaagtctggggctgttgtgtgaaacagcttgttcttcctgcagatttatttctattatttcctagagttttcacacttgatcttacatgaatgcattttgtaattttacattctactttatgatttattcatgtgtgtcctaatattacaatcaaccatatcttgataacaaatcttcctgtccaactggcctgttgggagtgtgcacctggtgtgtcctgtatgtccaggcacagccctgccaacccatcaaaatacatgcactgcaggtttatgggaacttcagtgtgtacaagacacgcctgaagagctggtcaaaacatgagactctagactctgctttgagacacagacttaatgtgtctgtgagggcctcaggagtctgtattctttacaaggtgccccagtgggtgtgatacaagctggcctgtctacatggtgggccacctgtagtgtgctgagtgtgctgtggaccacctttggagaaacaccagggaaagtgatgatgcttgaaatccttgatcctacctgcttctcttcatctcaggccactgcccgtacccagtacccccaaattctagcctccaggaatgatccagccacattaacctttttgtttttgctgtgtctgactgtgtcactccatttgcttgtacactgtgcctgccttgtctaagggagcattcctgctcatccttctgaggctcaactcagtggggacatctgttcctctgggagcttagtgtagcatggtggttaacaggtggggagctcttaaggtcaagggtgtcagggctagtctgctttctacatttaccagctgggtgaaggtgaacaagttcattgatctctctcagactgtttcctcctctgtaaaagaaggaataactaatggtacctatctttaaaggatgactgtgggattaagtgaggcaatacctgtaaaatgcctaagacagagttagtagtcaatgactctttttgttattttattttatttttgagacagagtctcattcactgtctcacccaggctggagtgcagtggcatgatctctgctcactgcaacccctgcctccggggttcaagcaattctcctgcctcagcctcctgcgtagctgggactacaggcatgcaccaccatgtccagctaattttagtgtttttagtagagatggggtttcaccgtgttggcaaggctggtctcgaactcctggcctcagatgatccgcccaccttggtcttctaaagtgctgggattacaggcgtgagccactgtgcctggccctttttgttattttttaatgtttttattttcttttaattaacgtcctgattgtctcatctgctagtctgtgagcctcttgacagtggggaacagtcctcaataatttgtgtatttctgttatttataacagaaccttgtgtctaaaagataaacacacacacacacacacacacacacacacacacacacatttttaaaggagctttcaacctgctgggaattcttgaatgaacaaatgcactttatgaattccctaatccttttctttgctattttcaccactttctcattcgagttaatctctgaagacataataccctgccatggagcctcatccctgcatgggctatttgtcacatccaggcttatattgtgctgactaggccttccgtgtgacacccgctccccattaatgattgactgacagtgggtggccaatgtgctgagtcagcaccctggggctcactggctcttcccttattgaaggggaaaggagtaactttatcttttcagttaatgggaaaaaaaagccacgggacctttgtcatccattctgctgggttgcggaatatgatctgtgtggctatgtgtgtgtatgtgtgtgtgtgtgtgtgtgtgtgtgtgtataaaatatactctctgattaaagcaccaaagttactgccaataagcttcaggataagtagaaaagatattagtttaaaagactgaaataccaccagtagaaaaataaaacaatttttcagcaaaccataaaaaaaaaaactattggaaatatgtaaactgctgttctctggagaatattagcattttaacacacatggctatcagaagaaaatctttgcataacttagggaggtacttaggaacattgcaaaattttaggagatccctcaaaaggctacacctaaaattgccttatgatgcagcatttccattcctatgaatacacacaaaggaactgaaaatagaatcttgcacagatacttgtataccagtgtttattgtagaattatttgcaatagccaaaaggtggaaacaacccaaatgtccatccatggatgaatgaataaataagatgtggtacatatatacagtggaaaatcatttgtccattataacataataaaattctgacatgtgctataatatggatgaaccttgcaaacattatgctaagtgaaagaaaccagatataaagggacaaatactatatggttctacttctagggatactaaagtagtcaaatacttagaaactgaaagtagaatagaggttaccaggggctgaaatgtgaggaataaggagttattgtttagtgaattcagagtctcagtatgggaagatgataaaattatggaaaagggtagcagcgatggttgtataacattgtgaatgtactcaatgccactgaactattcacttaaaaatagttaaaagtaatttcagcactttgggaggctgaggtgggtggatcatttcagctcagaagtccaagaccagcctgggcaacatggcaaaatcccgtctttacaaaatatacaaaaattagcccggcatgttggcacatgcctgtaatcccagctcctcaggaggctgaggtccagggatgtcttgaccctgggaagtggaggttgcagtgagctgagaatgtaccactgcctgggcaacagagcgagactccctcaaaaaaagaatagctaaaaggtaaattttatgttaggcatattatatcacaagaaaaaaatacaaggagaaaagcatataccgcttaaaaaaatgaagtcttgcttggccacaaaggttcattcccttcatggggggctcattggtttctagctgccctcgagtgtgagacataggctggagactggtaactcgtgggctggaactcacccttctgggtgttttgtttgcaccacacagtttgtattatttgtcagcatttcactaagaggtatttggcatcaaaaactgaaactggattcccttttatgttggatggtttgtccatgctgggtccacattctcctttgctacccagctccctctaaagagagtcttcagtctccatgggcacctgggccctacagaagcttgcagttatagccccagcgtgaaagttttcactctgtctcagagctgaccctctgctattggagtcattgcctttgtattgtaggatttgattattgtaatgtaaatgagcctaagatgacccctagggattgacccctgggttatttcttcactccagactgggacctggtagctggaaagcccattgttgcctaactcaattttttcttttttttgagacagtctccctctgttgcccagactggggtgcagtggcataatctcggctcatttaaacctccacctcccaggttcaagcaatcctcccacttcagccttccgagtagtgaggattacaggcatgcaccagcatgcccggctagttgttgttgttgttttttgtttgtttgtttgtattttcagtagagacggggtttcaccatgttggccaggctggtctcaaactcctgacctcaagtgatctgcccgccttggccttccaaaatggtaggattacaggcatgagtcaccgtgcctggcgccaattcaattttttaatacatccaattattttttaaaaatagcccaaacaagcagatttttaaccatctacaaccagcctgctttccatatttcacagtgcctcaccagccttaccatttggtgaaataggtctttgtagttacaaggctccaagttgagccaacgctttggaagcctccaacccagagactccccaaggggctgctgaatgacatcacctagacaagtgatcccctcctcagagttccccatcctccacatccactgctggatgatgacttgctcacacaagcctctggatggtctcatactgtaagggacattgtgcagctccctgtgcatgtgttacctcctcttacagtcatatctttgtcaagcccccaaatccttaagttccctacaattattacaatgtttttttcttatatgaaattataaataataagtcactagatggaggaggatagagatggaggagaagaagaggtgggtctacttaagagggcctttttctcccctgttgagataggaaaagcaatagaataggtgttgggaatgctcttgtttgccagggccaggagagagcatcttgtttgtctgctttgggtacatggctaggccttccaagagtcagcctcatacacatttgctctttgatgttttacaaggggccctaaactgaggataacccttggagagttaaacaatgtgaatgccatatgcctggagtgcacttctcattggtcaaggattaaattcatgggaatcgtgtacccaaagcagatgcagcctcattgtaggttctgaatccagggtgaaaaggccttgggagctgactgcagtcagcagaaatgcgtgtctaacctggattgatggttctggttgatcaggatttgcaggaaatagagtaatgcaattaccatccttggctcgctctctgtgggatgttctcacagatcagtggcaaagggttggtaggctattttcctcccattgtattgtgagatgtacaaaccttcctactgatactgccggggagagattttctgaaggattatgaggctgctatttaaaaaagtgatttccagttaaatacctttcagtattaaaatggtaaagctataaggaatggggggatagtcttccataataattgcttctcaaggagcttagtctgattgtcttattaacaactttaacttcatccttttcctatgacaaatgagaaaagaattctgtgattcattgaacagtcagatttccaatatggtgtttacttgcattttcgtttccacttcagccaggaaatcaaatccgagggattaaataccccatttgaaatgtaatggagaattacaccaaaaaaggaaaattcacccacaaactagagcaacttcattcaaaatttcagatagtcaagagcgccagcgcatcgaggaacagtgacctaaccttcgcaggccgttggtgttagccctctcttaccttcctactggtgccatgaaattcactttctggcagtcatcatagctaatagtggccatgcattgaatgcgcactatgtgccaagtctggtgattcttatttttttttaatttaaattttacaactctgtgaagtagatacttccagtgtcccattttagaagaaggaatcagacaaagatagttatgtaatatgccgaagatcacagacatagtacatggtaaagtcaagttccaaactatcttccatatggctttagactgtaatccaagtcagcatttatgtgcatgctaccaggtcaggtatgatgggatgcctctttttacttaatatgtatattctgggggtctggctcctcccctggttttcactagagcaggttttgttctttttttacaccagaactctctaaaacccaaaggcataacattcacataatagtcaacatgtatgtatctcaagggtctactagagaccaggtaatgagctaggagctggaggaaggaaaagacattaaaaacaatggtcctgccttcatgaggcttacactctcctgagaagccagcttacaaagaagcaaacagctcagaaacaggttatgccttatgccaggtactaggaaaaaaatcaatgtggttgtgagataaaaaacaaggagggtttcatcgatataggatggtcggggaaggctctctgaaaagacggtgtttccactaaggcttagagagggggaaggaatcaagctggacccacatccatgggaagaacatctcagaggtagcagcaagtgcataggcctcaggttaggaacaaatgtgacctgttggagaaactggaaggatgtcaacatgggttgaatggagtaagagggtaatgaggaggactgccctagatggagtcaaaggtttgggtttaaacagcagaacaaacctattccatatctcagattattttgtctctctctttttttaaaaaaaaaaaaaattgttttccagtattgtttttctcctgtttcaccttattcaagcacctgctctagttcccattatttttttttaaaaattgctctctgttcatgtggaccttttaattcaagaaatgtttgagcattatatgccaagccctgacgtaggcaaggcagggatttgaaagatgtgaagtgatgtgtctgtgggccttagaaacacgtagctttgaattccgaaagtgagaattaagttgaccttgcagaaatgaattgcaggttaggtggtggtaagtctctaaagaagattcatgtgggaccttttcaaataattctgttctccagtcaattttaaaccaccctgcgtcccagcaaggacagtttatggctttgttcacatcatagatttagaaatcaagacctaagaaaggtcacaccattaaataaatgttcaacactccgggaaaaatgggatgttaataacaaattctcagttgagtgacattgacttgctacttttgtaacagctactttggtttgcatttgtaaaacctaaaaaaaatttttttctttacttttgttggagaaaagggaagtttttgacctgagcattttctcacttcagagaattgaataagggaagcgtgcattgattaatattcttgggggtgctagaaatgtatctgaaaacctctccagtctagtgtttctcaaattttaatgtgcttaaagatatctggagctgtgctgtgaagtcactaggcacatgtgacttctcagtacttctgaatacttgaaatgtagctagatgaaattgaggcatatctctaaaatgcacacatttgaagagttactatgaaaataaatgtaaaatatcttgacaatttttgtatcaattattcaatagaataaacttttgatatattgggttaaattcaatatattatttaatcaatttcatttatttgttttcactttttaaataaaatgcagctattagaaaatttaaaatcgtatatatcttacattatgtttttattttaccctattactctaagaagacttctgtgtccagccatgatgctacaactgataccaggttggtcctcagactgaaagcaatgaaatacctaaggctactctttttaagcattgatcaaaaggcagctctgtgatcttggagagaagggagacacctaaggtgagcctcatgaaagctctggctttctgtccaggagcccttttctgctgcaaggcaggtagttggtgccaagcactgtgacgttctcactgagctgaagatttgaagagtagagttctgggattctgaagtggaatcgttttggggtcaggtgccacaaaagaggaatatgtgcagggggaatgctcataagtctgcatggaattttacagctggtccttggctgactatccatgtccagggtgacagacttcaccggagatcagagatcagttgatgcagtgctctgagctagatggtaaaacaagaatctgtgcagtgctggggcacttgggatccaagcaacccagagttgggagaccttatgcaacaccttgtgcaatcaagtggaaaccccagaatgcccatgctgaggactaagttccagtttcactagaataagaccatgcctgttgactaagttcaagatggaaacagacccacctgacaaaggataaaacctagcacaacaggatcaaatgacactctagtcatttaaccacttgcatgaacaaaattcagcacctttcagaagaaaacattattagcacaatctggatttctataatgcattatgcatcttgttcaacataccacaaaatttattaaacatatgaataaacaggatcatgtgacctatagcaagatacaaaataaagcaaacagaaacagaccctgatgtgtcatggatattagaataatcagaaatgactttaaaaccacaattgtaaatatgttgaagacttaaagagaagattgtgttacttaaatgaataaacaagggatcccaggaaaaaaaatggaagtcataaaaaggaatcaaatggaaagtttagaaaggaaatgtaaaatatttgaaataagcaaggcacttgaacagtttaacagtagattgaagactatagaagaaaggactagtgaatttgaagacagaacagaaaattattcaatctgaagaatacaaaaggaaacaaaggtagtaaaataaacagagtcagagatctgtgggagagtatcaagtagtctgatatatctgtgattgaaagcatagaggtagggaggagagagagaataggatagaaaaaacagttgaagtaagcggtgaaaattttccaaagttaatgaaaaacatccatttacaggtccaagaagattagtagatcaggttaaatacaggtagaattaaaaaaaaaaaaaagaactaaactcagacatcagtcatattgacgaaaaaaaaaaaccatagataatattgaaaacagccagtgaaaaaggaaatataaaatgcaggggatgaatggtacaaacagtaactgatttctcatagaaactgtggaggccagaagacaatcatatgacatctttaaagttcagaaagaaacaaaacaaaacactgtcaacacagaattgtatgactggcaaaaatattcttaaaaattaggtgaaataaacacattttcatctaaaggacagtagagggaatgtgtcagcagcacaagaaatgcaagggacatgatcaaatatgaaaggaaatgagagcagaaggaagctctgatataatgaagtaaaaatagttgaaatggtagacacataggtctaccataggtatattaatgtatatgctttcacttctcttaatttatttggggaaaacagatagtttacaataaaaatgatacagttttattcttgggtttgttaagtatacacatgtaagatttatgactactgtgcaaatgtatgatgctgagtaggaaatacagttttattatagtttttatattttaacagaagccacataatatgaactgtaaaaagattctgataagttatggatacatattgtttatcctaccatgcctaaaaatgaatagaatatagctttaaaaataaatgtatatgtaatgcaaaaaggatttgcttaataaaaaagaagtcaagaaataaggaataaaatgaaacatatggatgtgaaaactagaaggcaaaagcttgaaagacaaccatagaaataatttcaccaagtgcaagtggactaaacactccacttaaagagcagagattgtcagactataataaaaagcaagaatccgttatttgctgactacaagagactcgtcttaaatacagagacacagttagattgagtaaaagagtggaaaactatatcccatatgaatagtaaggataagaaagctggtgtgtctgtattactgtcaaagttgacttcaggggaagaagtattagcaaagtggaaaagagacatttcagaatgatcaaatggttaattcatgaggaagatataacagccctaaatatgtatgctgctaataaacagcttcaaaatacatcaagcagaagttgacaaaactaaagccagtaatagataaatctgcagtcatagttgtagacaaatttgcaatcaacaactctctctgattgaaaaaacattcataaccagatcagcagtgatgtatgcactgatgtggatgaatctcatatacattataaagagcgtaagaggccagataggcatgcatactctatgtttccatttatatgatgctcaagagtagaaaaaacaaatttatggtgagaaagttcagaacactcattcctttagagctttgggttctgactaggaaggggcaccagaggactacctagtgtgatggaaatactctgtgtttgatcggagtgttagttatatgtgtgtacacatttatcaaaagtctttaaatctttattagcctaagccccatgtattgccacttgtttttgtaaacaaaatgttattggtactttgctgtactgatttatctacgtattgtcaaaggctgcttttgcactaaggtaacagttgagtagtggagatagagactatggcagaaaaaacctaaaatatttatgatctagccctttctagaaagcttactaccccttgctctagagtcacttatttaaatgcagcttctgaaagtcaccctctaagattctgatccagaacatctggaacagagggaagcatctccaatctattccactccccagatgactctcaagtttataaaactgtgtggacagaagttgcggaattgctcctttcaagattcaccatatcaacatagtagctactctctttggtcataaaggtattttactgactaatctcattgaatcactctggagttataaaagcccatttcctccccactggccttccttggaaagtgagaaaaattccttctcatcatagttatgtaatcatccttcataaatgtggagaggctcacatgtgctgctggtggtaacacattctcctgccactctctggctctctgtaggcggctgtttgagaggttaaagataggatgaaggaaaaattcacaaaacactttgtatgcacgtctggcggataatgacacttaagaagctttgcttaaaactgatctgccttcgtgatgatttgagcttgctctttaattagcttttaggagcatatattgtttagtatgattattttattttgccaaatagaagcttaacacgctttagttcacaaaggagcgagatctactttataccagcttttaacgaccaattgagagagaagaaaatgtctgactgccctggaacctttttccccatgggtggtatgtgactttaagatttcacgatcatgggggacactttcggcagcaacagcaatgctcagcaagtattcccttggctcttctctatttccagccccctggcagttaggtggagctctgtgactagttttgctcactgaaatgtgtgacttgtccattgtttcttctagcatagaatcatgcgaatgcatgatgcagttaccacagcatgtagataccacagatacggttaccacaggtgtgacatgaagcagcttgaattcctgagctagttttactgagcaggaaattgatgtttgttgcgttcatttatcgaagtcttggagtcacttgttagtatggtatagccttctctttcctgaccagtacggtacctactgccataagttcagttactcactggggaacatagtccaggagtacacgtgaagctagtaaaaaggcaccatttcaaattagcgaaggtggcatggactgtgagttaacagaggaaggaaaagtgactgtatatttgggaggaaaaagtgagatctctttcttcaactatgtaaaaataagttatatcccagcactttgggaggctgaggcaggcggatcagtaggtcaggagttcaagaccagcctggccaacataggaaaatcctgtctctactaaaaataccaaaattagctgggcatggtggcgcatgcctgtagtcccagctactcacttgaacccaggaggcagaggtcgcagtgagccgagatcatgccactgcactccatcctgggcaacagaacgagactctgtctcaaaaaaaaaaaaaagaaaagaaaaaaaagactattgcttttcaaaaggtctctgctgtgcattatgttgtgtaatttttttttttttctgagagactgcctcaaaggatgcaagttattcgtctccatgtcattttaaaaatgtcttctctggaggtatctggatggaagagaaaacttctgtgatgctggggctcaattctcttggggctctctataagacaggccattatatcaattgctacatctagcatctcctgtgctgacaaaagtcccctgattgctccactgccctgcagagttgattgtgctatcttcctcgcttgcctgatactggcttccacgttgctctctctagcatgtggacttcagaggcagagcctgcgttcttcatttttagtgcctatcaggcatgtggctggcactgaacacagggttctgaatgaataaataaatgaaatgcttctaccacttacattccctgcctcttgggatggcaccatgcccagtgcaccaccctgatttaagttagtgtcagtcaaccctgccttgattcctgcgatcacgctatgtttactgttacccctccccattagttctttcactgaagtcagggaagatctgtttaaaatccatatcttatttcactccctacctaaaaccctttggtggcttcccattgctctttgaataaaggcccaagtctttaatgtgccacataggacgccatctctgcatcctcaccttgctcacacctggtagtcaggaaagatttattccttacagttgctgaaacacaccctggtctatcctgccacagggtctttgcctgtgctgtgcttcatgcctcatgtgccccaagcaatagtacacacacacacacgtttgcttacctagtctacttctaaattactgtttagaccccagctcaaattaggggacattcctcttttatataatttgtaatttctttcttttctttttttttttggaattggagtctcattctgtcacccagggtcaagtgcagtggcgcagtctcggttcagtgcaacctctgcctcctgggttcaagtgattctcctgcctcagccccccaggtaactgagattacagatgtatgccaccatgcccagctaagttttgtatttttaggagagacagggtttcaccatgttggccaggctggtctcgaactcctgacctcaggtgatccacccacctcagcctcccaaagtgttgggattacaggcgtgagccaccacacccagcctaatttctttcttatagtattcagcaccccttgtttgcagcagatattgtggttgcagttttacgtatatttttacggttattggattcaggtctgcaagcacaaaagaggatttgtctggtttcagtgtaatcttgcaccccaagaaccgattacaggatctgatggatatccactcaacaaataatcttgtgtaaatgaatgtcttgttaggggtattgtactagttccctgccatccagggatgcatagtaaatctgcctgatcctgtgagctcggggaaacctaaagctttctgcgggagtggtaggtaccaaagacatgacattagttctgccctactcagaaggtatgggctgggacaggcagtgagggggtgaaggagactaaccgtgaactgtcagtgccccct[136 bp omitted]aactcagagtatttcttatgtgaggggtccattctctagcatcttaccccaggcaggccattttttttttattattatactttaagttctagggtacatatgcacaacgtgcagggttgttacatatgtatgcatgtgccatgttggtgtgctgcacccattaactcatcgtttaacattaggtatatctccaactgctgtccgtcccccctcccctgaccccactacaggccccggtgtatgatgttccccttcctgtgtccaagtgttctcgttgttcaattcccacctgtgagtgagaacatgtggtgtttggtattttgtccttgcgatagtttgctgagaatgatggttatggtagtaggttttcagaagccatgcttcagttctgactggctaagcattcagaaatgggtcctaaacagcaaaatatagatggcattccaatgcacccacagaagaggttttcagctgcagaacaggcattctgagttaaaatatctggttgttttctattggaaagcattggctgtactttgaaactctttaggcttcattctgataagagaatgagatgacaaggtaccatagaattcagtgcaggtattattattatttacattttgcatttagcttgttttaatgaggaagagtggtgggagtgtataaaattttgccacttgtcctgaatcccatcatcattttgaggcaaattggagggatcacagattcaacagggtcaggtgtgaatatggggggtattcattggatatttgaatgaaaacattggtctgtttatttagggtttaaaagtatgacttaaatcattgcatttaagtgtaggtaaatcagaatgtctgaaaaaaaaccatgaacactaatagttaatggaacaatgactaatcataaggaataaaaagtgggagtagatttaaacaacaaaaatctcaagtgtggctgaaggtggcaggggaattcctggagatggcactcgtttcgactttttttttttttttttttttttttttgagacacagtcttgctctgtcgcccaggctggagtgcagtggcacgatctcagctcactgtaccctctgcctcccaggctcaagtgattctcctgcctcagcctccccagtagctgggagtataggtgcccgccaccatacccagctaatttttgtatttttagtagagatgggttttcaccatgtcggccaggctggtctcgaactcctgacctcaagtgatctgcttgccttggcctcccaacgtgctgggattacaggcttgagcctctgtgcctggcctgttttgacctttttgccattgactttaggtactttgttagaccattgctaagctcgcgatgataacacctattagaggaagtcttctgaaagtaagacctggagattcggaggcgatgtgtacttgcttccccagcagtccaaggtgtatgtcctgccctcctccggcagggccactaccatgctggctccccttggtttaggcttgactttgcctttgatacaaccttcccccaaggcaccctgtaatcgcagttgagccgtattccagatacgtgtgagccatatgtctcaggtgttgcagagtaggaaacaagttgagacatactgaggcaattacagaaaaaaagaaagcatggagaattgcggtgataagggcttacgcttcattttttatgctgtctcttttctgaccatattttagatttcctagaaactacccattattatgaatgcctgagttctgtgcatttcttcagagctcaagtctaaactaatttaatgtaaattatacatttgcaagtaatattccagaaaaacctttatggggcccacaaagacaaaatgcacaaaaggaaatgatgatgtgttttattcataaggaagcatttctcttcaaaattcttctacagccccccaaaatacctaatgcatcacaagccgacatttgtactgctggctttccatacacagagaagtactgttccttttaatcaagtaagtttattttgctgtgaaaccctttgtataatattgaaaaatagttgtgttccttggaagctatttcagttttctgaaatgatcatttttaatcagtctcctagcaaaacaatttaccaagcagtggaggataacgaaccataaagtttaatttgccttttttaattgagttgttaattatcacccctccaccgctggaaactcccaacttgcttttttgttttgcttctgatccgagacgttttcaagaatctaatctatcatatttcctctgtccaggtactttcatgaatcacatcaataggtgattattttctaaatctgttaaagcttccacagttgcgtacaaattttgtcagtggtaaataattagatagaaaacatccagtggtggtaagttgataaagatatctgccatttattgaattcctactatgtgccagatgctgatctaacttcttaacatatattatttatctttcacagcatttttgtttgttttgttttgagatggagttttgctcttatcgcccagggtggagtgtagtggcgtgatcccggctcactgcagctgccttctcccaggttcaagtgattctcctgcctcagtttcctgagtagctgggattacaggcactggccaccacgcctgggtaattttttgtgtttttagtagacacggggtttcaccatgttggtcaggctggtctcgagctcctgacctcaggtgatccgcccacctcggcctcccaaagtgctgggattataggtgtgaggcactgcgcctggtcatttttttttttttttttttttttttttgacagggtctgactctgttgcccagactagagtgaagtgacacaatcatggcttactacagcctcaacttctggggctcaagtaatcctgccacctcagcctctcaagtagttggatgtatgcaccatcacacctggctaatttttaaaattttttgtagagacaggttcccactatgttgtccaggctgctcttgaaactccggggctccagtaatcctcctgcctcaatctcccaaagtgttgggatcacagacatgaacccgtacaccaggccttcacagcattttgaggtacaaacagttatctccattttatatgcaactaaactgaggttcagttatgttaagtaccttttccatcacaatccaacttatcaggactggagcaacgcttcaatcctaggtggtctggctagtggcctcacaggttatttgtttaaccctaagctgtatttttgagatccctgatgtcaaacaaacctgcatttgaattctagttctatcgttaatattgatattaaattaacagaatatgacttagggcccatttgatgggtgtgcggtctgggcccctgcccagccacaccctgcacttggtttgatgttctgctgttgcctttctggcaactctaaatcattttgaacaagggggccccatgtttttattttgtattgggtcatatgtaacataggtagccagttccaataccattattgttttaacatctttagaggctcataaggctgaagtcaacgtgtcagcctggttgggttcacatatggtggcttaactggtatagatctacttccctgctcatatggtaacattcagttccttgcagtcataggatttgtggcatgtttgcctttttaaagccaggaaggggagagagaacgaccagggcaaatctgctgggaagatggaatcttatgtcagataacataataataggagcaccatggtggctcacacctgtattcccagcactttcggaggctgaggcggacagatcacgaggtcaggagatcgacaccatcctggctaacatggtgaaaccccgtctctactgaaaatacaaaaaattagcaagggttggtggcaggcacctgtagtcccaggtacttgggaggctgaggcaggagaatcgctggaacccaggacacagaggttgcagtgagccgagattgcgccgctgcactccagcctgggcgacagagtgaggctccgtctcaaataaataaatacgtaaaagagcagcatccaatcaccttcgctatattttattggttagaagcaaattacaggacttgcccacactgaagaggagggagtcatacaaatgtgtgaacatcaggaggcagagattgtggggcaccatcttgaagtctgttacctgcaattattattattactatatacagttattagtgttgtttttattaccgctattgttattgatagcagttctatagagtactgtgtcccaggctctgctgtgtgagctttatgtgaattaaagctttctgtgttcagcagggaccatggtcctgaggactgaatccaaggacatcccctctctgcccactgaaatcagtagttttcaggccaactaagcatgaggcaactgttattttcctgagtgatacgatcgtttcaggaagtataaggaggtggaaacacagaattctgcatcacacagaccaaggtgaggtcccaactctgctgctttctggctgtgtggtcttgcccaagtcactttctccatgtgggatgttccaggagacttttgaccacccgctgcaagagaaatctcttacaacctgcccattcagcacagttcagcctgaagagagtcatgtgtttgtatttaagatactattaccctgctcaatcccaagagcccactggtctcaggctctgcatggtgtttgaaacaaaaaaacacaatgaagaaatggaaaagttatcccccaaattgtcagcacccatgtaactgctttctcctctcctctgtgattgtccatgaatatagattggcttggccatgccatcttttctctactagcctctttcttgctctcttcctcactctttctgtttcttggtcgtttttttcttgatttctccttatgtatctgtttttgtttctccttctcctgtcctgttccccatttttatccaaatgccatgtcagtgattctcccttctcaggaggaaggaagcagaaaagggtggacaaaggaaataattgaatagaattccatcagtctctcttagcaggtgtatctctgaagctcttcaaagatggtcttgatgagagcagaggaaggaactgctcctctcaagattcagctggaaaaaatacggaatattgtgttaatttgtcttaccaaatgctcttctccccacgttttccctttgatttctctgaatgtttgggaggcatgcattttgctgcagaagagaatcaagtcttcttacaccatctttgttaagatactactgtctgataattcgtaaacttctaaggttttttttccactggaaatgacttttttttttttttttcttttgagacggagtttcatgcttctcacccaggctggagtgcagtgactcaatcttggctcactgcagcctccacctcctgggttcaagcgattgtcctgcttcagccccatgagtagctgggattacaggcatgtgccatcatgcatggctaattttttaatattttttttgtagacacgaggtcttgctgtgttggccaggctagcctcgaattcctggattgaagtgatccacccatcttggcctcccaaactgctgggattacaggtgtgagcccctgtgcccagccagaaatgcttctactttctcctgtagggtggcctgtagcaggatcatccattcacattcccaagtatcctctgttcattcacctgggcaatgagaggagcaacaattaagccagaaaagatttgctgcctccctgtcttgatcccaactccttccctcctgtctgtgtaacttggatctcttacttgtcccctttgtcaaggatagagtcaatcccattccttctagtagatcttcccttctggcccaggagtacctcatcctataagcaaaacatctttagcatctttcatttcttcaagctgtgtttccttctcacttctgaaaaaagagcaatctgtggtttggtttcttatctctggtcacccatttactacccttttaatctgagtgctgtgcaaataaccatctcacaggtgaccaagggacactccagtggtcaatgtgtagtctcagctcgtattctccccaagctctctgcagcgtcagaggacactgacccacactgtgacttgactctctgccctcccacattgttgtgagactggagctctgcgtcattttcatcctcttaattctctgtgtccatccccatgtcttctctctcaggcacaggctaaatggaggtggtgctcctgaacttgaccctcctttgtctttttgcatttccctgcagtaccttagcccatcaccatggccgctgcttttggagcaccttctaaatgtcagcctcttttctcagtgccctccatatgtaaacccttctaatcctccctaacactttatgagataaaaatgagggttgttcttttacaagggcgatacggaagagctgagaggctattcctttctttcagatctctgggcataaccctgactgctctcttagattgtctttgatttctgcttgtcgcttgtctcctccccctgggttatctgttagggaccacactcaaaaccaaactcacctccatttctcttccaactatgttcatcctctgcgtcctgtggttttgttcatatactgctctaagttccattcaacacttcctacatcatttttgtgacttcctgtctttccctgcttgtccaatccaccactaagctgtgtttatttcactcccaaatattttcctttctaatttcttccaaattccaaaatattcttttcagccctctttaattctcttactgtaatattacaataagtttcttttaaaattaatttcatttttctccattgtgtaattattgtatgctgatctatttggagaaaaggtgaaagaactcttttttaaaaatctgtaatctcagcacactttgggagggtgaggcaggcataacacttgaggtcaggagttcaagaccaacctgaccaacatggtgaaaccccatctctactaaaaatataaaaattagccaggtatggtggctcatgcctgtagtcccagctgctcgggaggctgaggcagaagaatggtttcaacctgggaggtggaggttgcagtgagctgagatcatgccactgcagtccagcctgggtgagctcaaaagaaaaaaaaaatctataatctcatcacctggaatactgcttcttgcttctggcctgtcttacttctcgatccctgattaatttctctaaaaaatcagcttttctatataacccccttcagagatccttgttgctgctgctgcaaaaaaaaaaaaaaaaaaaaaaaaaaatccaactcttttttttttttttggagacggagtcttgctctgtcacccaggctggagtgaaatggcgtgatcttggctcactgcaagctccacctcctgagttcacgccattctcctgtctcagcctcccgagtagctgggactacaggcgcccgcctccgcacgtggctaattttttgtatttttagtagagatggggtttcaccatgttagccaggatggtctcgatctcctgaccttgtgattcgcccgcctcggcctcccaaagcgctgggattacaggcgtgagccaccatgcctggccaaaaaaatccaactctttagaaaaacactcagaacattccaagttcccctagaagataactttcaggaaggcaatggctctgccttttgaccagcacatagatgaatgccagaaacagagtgagtactgattggttgaatgaatgagtgaatgaaggaatgagtgaatgaggaatccatttaccttctctaatctctggcttcatctagaccaaattactgccttctcctaaattgttccatattttccacttcttctcacttactgttagtagctgagatctcctcctgtccatctcctttttgtttgtagatcgtctctgtcattcaagactcaactcattcttcggggcttcctcaaaattcccctgatgttctctgactgcaaggagctcttccctctcttccctcctctgttactcctgaagcagtttttagttttcattctaattcctttctcccagctcctgagcaaggtaatagtattttttcagctcggctcttggtagatatttaatatttgttaagtgcatgagttcatgaaataaatatttgggataatggagctgaagttaaaaccagtaagctccacttacttctgtgtctgggccacactttgtccaaagatttccctcttaacgtttttgtttacaaatgctcttcaggaataacttgtaagagaaaggagctgtcattgagtgccttgaaaagtggaattgcatgtttctatggaaacagagttgagagctgagttttctgtacatgatgttttaatgaaaacatattcttagccattatagatgggtttgtgtaccagatgagaagtgctttatcttaattgaccattatgttcataagtcagattgatggtctcaagtattatttcatcaaatcacaatgcattactgtggtttcctttcaggaggtgatcccaatgctcacaaaatgaaggctgtccttgtttgtggaggaaaatgtttctatagacttgctgttcttccctttgctattgagaagtggcctctttatttatagctaaaggacacttaccataagcatccaagtgattctgttctctcttggaggatgataattgccccaaatcatgcatgtatcttatatcatatgaacaattgttaagcagttttagggactccaggatggtggtagcagcggtagtggtggtggtgatgtgggaaagctcaaagtttgctcccaaactcttaagtagaagactacctgtgcacctgatacttttgcttttcacttgtgtgtttgttggttttgttttttagagacagggtcttgctcttttgcctaggctggagtacagtggtgcattcactgctcactgcagcctcaaactcctgggctcaagcgatcttcccacatcagtgtcctcagtagctgggactgcaggtgtgcaacaccatactcagctatatatatatatatatatatatctctacctacctacctatgttgtccaggctggtttcgaactcctggcctccagtgatcctcttgcctcagcctcccaaaatgttgggattacaggtgtgagccactgtgtgtggtcacacctaccatttttggtttgtactagttctgaagcatgtattcctatagcatggatcaacaaattagactctacagattatatccattagaatgccatggactataagtgctgggatcataattagaaaattattctctttttaattttctgttaatgataatttattaggcatattgttcctatccagagatgggcttcctgcttcagtttgtggcaaatttagggtaccattttgcttacctcttggagatctcttttaatgcagagatctaacacatcattctcctcaagtaccttttaataggaaatttcccaataaacctattaaaagcataatgaaaacctcattcagtcttctgtcaggctttggagctataagtggcttctaatttgcacaagatcggaatagcattgaagaattacagtaactaagtgaaacatgcattggattttcaattttctgatagcatcccatgtaatttcttgtaatgcatctgtagccaagggaggtgacacatgtcaaggctcacgctgcagcttctgcccacatcagtcttccgtggagaagcacgatgctgtcagcttttctcatgagcaggggccagataggtgtctttgtttagccttgatggatattccattatgcacagtcctctgagcaatagccacataatttaaaaacagctcagatagatgtttttgatgcttgacatttgacttcacatatttattggaacaaactgtgaatcatccctcttatgcaagtgcttgacagaatagtttgtccacctgtggtctgttgtacctgtggagtctatttgtattctggaaaatgaattccctctaggaaaagccaagagaagtcctggacatcatggctacaagccagtgagataagaccctgcattttattttttttaatcatagtatctcttttttttttaactttaaagttcatgggcacaagtgcaggtttgttacacaggtaaacttgtgtcatgggggtttgttgtaaagataatttcatcacctaggtattaagcctactgcccattagttatatttcctgatcctctcccatttcccaccctccaccctaggaaaggccctgggtgtgttgttcccctctatgtgtccatgcattctcatcatttagctcccacttataagtgagagcatgcagtatttggttttctgttcctccattagtttgctaaggataaaggcctccaactccatccatgtccctgcaaaagacacaatcttgttttttttaatggctgcatagtattccatggtgtatatgtaccatattttctttattccatctgtcattgatgggcatttaggttgattccatgtctttgctattgtgaatagtgctacagtgaacatatgtgtgcgtgtgtctttgtattataatgatttcttttttggggagtatatacccagtaatgggattgctgaaaatcctatatttcctttggcatatttcattttatccagatgaaattatccactttccctcttagagagcctaaatgtttgtttttaacctgaaagagggagtctcttgtaccttacctgtagtattttcaatgtttatggcatacgtccattatttaaaacctcaggaggagaaaagccagtagtatatttaaaaatagactaatcacagtttgcaaaggaaaaaaagaaaaaagaagccaaccagactttgtaatcattaaaataattaatggtgttgcttttcttgtatgtggccttgacaagactctctcactcctggggcaggtattttgactgatttttcacctgactgaggatgaatttgcactaatccagctctatactctcccaggatctcctttgtgaccaaaggcatttatttgcaaggtagcagtgtggaggttaagatgataatctaaggccagagacagcgtccagctaattggctttacatggggatccaagctgtgttctaactatggtgcttacgtagcctgaagcacctttctgaccctttatatcaccccgaaaacagcaaacatttgttgaattcccatgggtctggtgctgtgggagggggtggaggcaggagaagccaggagagactcagcttggcacagcaggagcttcttgggtgctcacagcagataggaatccacgcttctttttaaaatacactgaagaaaatattatttgagtctttccatttttagctgttcaatgggtgataatggaaagtaagtccagattagcctccaaaattgtagatcagctgttttcaacctcaacactattgacatttggggctagatgattttcactgtgggagctgtcctgtacattgtaggatggttggcagccgtagatgctggtaaaaccccctctagttatgacaaccaaagagtgccttggctgagaacccctcctctggatggcttcccagtggctactgatactggcattttctgcttttagagagagtaggtgactgttttcacaagtgtaaaatataaagtccttaggacgatgctgggcatggaataggattcaaaagtaaaagggcaaacttttcactatactgaatcaagctgttatttttttgaaagtgatatcatcatctttgctgttcattatacctttactgaaccttccggagtgtccctgtcttaataaagaagtgagcatcgtctaagtactgttttgagctttaagtggcgattcaagctccacctcgttgcagaaacatgggcagtaaaactgttagtatctgagaggcatcaagaaatggtagacgattctgaagcatggcatcacgtggctcttcatgtttatctcgccacaacatccttagctcctcctcctcccactggtcgtgcattaaagcttcaccaccccaagggccatctgtagactcactgcatcagcatcgccttgggagcttgttagagatacagagactcaggccccagcttccacccacggaatcagaatttgcatggatagagagccagagaaatactttgttgaagggccttttccatcccactccaactgttacctaaaaggacctcttcagagcctcctttcatagatattctgtcttgctggctgcatgctctcttagcgtcctctgctggccgctgttgatggtggtgattgtttttcatacttttccttccttaccattctgtgctctcataagtacaggccagttttgcttttctgtgatcccaagctatgacctaacacaaccctttcccatacagatccagtcccaagcacccgggagcattccagggtccctggacatggttctgcaaaactcctagctactcagcatgccagaattctaattcactcatgggtcaaagccagagaggctgtgtgtccacctctacacatatgtacccatgttgaatttaaaggtccccaataggagctacctcaaaaacacccaacaattaaaactagaggggatgggggcaagaaagatgaaaagaaattgattttcaagatgccatcaaggttggggaaaaaaagaaaaaaacaaggaatggaagggacatcagacttaatgcctccttgaacatgttacgttcaactcaaaagcctccccagtcctcgcaccaaaatctttcccaagtttgtaattggtgtcaccatccactcagttgctgaaattaaaacctaggcattatgattgattccttctttctcctttcagtctatcaacaaattgtatgtttctaccttcaaaataagaatctcaaatccccccacttctagtcatctccattgctatgaccttgccttcagtcccagctctcaagggtctcctacagccttctcctaaattgatcttcctgatccactgttgccattctcagaccctccctttggcagaagccaaaggctggtttctaaactggcagtgtagactgggcacggtggctcaagcctgtaatcccagcacttcgggaggccgaggcgggtggatcacctgaggtcaggagttcgacaccagcccggcaaacatggtgaaacccgtctctactaaaatacagaaattagccgagtgtggtggcatgtacctgtaatcccagctacttgggaggctgaggcaggggaattgcttgaatctgggaggtagaggttgcagtgagccaagatagcgccactgcactccagcctgggcgacggagtgagactccgtctcaaaataagcaaacaaacaaactgccaatgtgctggtcatacttccttgttcattttgtttcacttttctatttctcaaactcctcaagctcattctagtcttagaattttgttctgctcccacctcctggaacactcatcccccagctactggcatggatggctcattcttctttgagtctcaggttgaatctcaccaccctcaaggcaggaaaaccttatcaaattaggaccaataagagtcatgttcctggcacctaggtagtagatgaatcccctttgactaaggctacctcaccgagtgactgtgttctctaaaatgctggtgatgtagaacaggcaggacacagttagcatgggagacccagctagaaaaagctggagagatccagagtaaagttcatttgccatacttcgctttatctaatagtgagaaagattgcctatcaattaaaaccacaagggtggagtggggatgttttccctagagatttgaagtagtttcatctaatgtggagcagttttagaattcaataatgcaatcaggttttagtatttccacccccctccctgccacgtaatgattcatgtgccttgaaattttttcattaaaaaattccaaggctcacaacgtagaagaaaaaaaagaaaagggggcctcacacctcatttgttcagccatctcatcgaggccccaaatgtagatcattgaaatggagccttggaattttaaatcaagttttactttgcaaatttaatgaaatgcaaacaaatacttagcagttctaaagggcatgaagtcattaaggtttctcattttgttaggcgctttgggggcctccttaatttttggagtaaaatcaattaagttctttgtgtgtgtatgtgtgtgtgtgcgcgcgcgtgcgcggatgtgtgtggctgcttgtgtagccagtaaatagacgaggtgtactttggatttgaatgtctgttgttccctttaccagatgtgtgtccttgggcaagtaacttaatcttgcctcctatgtaacatgaggaacattgaagttttgctaggaggattcattgcagacgcacaggtttctgttcttagaagtacccgtgtatgctttaatgctttgcttttaccatcttgaaattcttagtaattattccgtgatgggacatgcattttcatttttacataaggccccagaaattctgcagctggtgctgactgggtgaaataatgtgagtaaggtgcctgtgagcatcccttagatgaggcagatgctagatatgcattgggtctttttcttccaggtttgaatagctgtgtcttgctgctttcctgggttgggcaaaatgtagaatactgacactttatacagccacccccataagagatgcaggttatctgttgattacctttaagactggagaaagatagtcgattctcttacctgcactttagcaatgttgggaggatagaacttatttggagaacgtttatggcctaatagcttggtaaaatgtgaatcttcatgaaagtggtttgccaactctaaattgctatacaaataagtcctgattatgtgcactgaacaaaaggcttattgagcagtaactgattcagatggaggtaagaaaatatgccaaactcttaggggatcgcagacattcaaaatcatagctcctgaaatgtgagcatttctctgtcaattcagcagatgtagagcgcgattctatgcactgtggggcaaggtgttggaatggtagatgatgaaaaatcatggcttttggtcataggaaattatgtgatgttagcagcctagagctcacagctgaggctgctggaggtaatgctgagaggaagcatatcgtgagaccagagagggttgaagagaggatcttgagatctgtgtgcacctgaggtcctcaattttggattaacagaatccccaggaagtttacccagattgttatgacttttacccagagtgagaaccatcattgattaacacttaaagggcctggcagagaaccaggagagaagagttgaagttgtgaggatctatctcaaggcatgtgtaaacaacagtgcccaggtgagaagtggagctctacttctggaaattctttcctttctgttttccattaaaaaaaaaataagataaaattagtgcctatgttgaccagctctgttctctatgttttccttcccaaatgaaccaaatgaatgctagctcttgcaaggccaacatcacagagaggtgttattcctgtccccctttattttctctgcatattctgtttatttcacccacagcatgacacacttacggaaattatctcattgctggtcctaatgatcttttcccttcctctttccacggctggaatctaaaccgcatgagagctggggaatgggtcttgtttatctatctctctatccctaagagctagatttgtgcctaggacatcagaagcctccacatatttcttgaatgaatgaatgagccagttttcctcacctgagaccatttgcagcatgtcaggttgtcttgacgtgcagctgaattatttacattttccggcaattcattgattgacaccttgggcgccctacatttgtgctagcctcttggtattttttctcccagcttagatgttcctgctgttctccaggatgggtccttcttccttacagattcagaaaggagaatcttctatgaaatctacaagatcctactagaacgtcaggtctgaagggcaggactatgactatggtttccttattcatcatccctccataaatacatatttgctgaatctcttttcctcccttactcttcctgtatatagaagaggaggtggacatctatttggggtgttctcccaagtttgtggccaggcttaaggaaccccgcgacaccatttgttttcaggaa[134 bp omitted]ctgctgcctcagcctcccaagtagctgggattacaggcgcgcttcaccacacccggctaatttttgtatttttagtagagatggggtttcaccatgttggccaggctggtgttgaattcctgacttcaggttatccacctgccttagcctcccaaagtgctggggttacaggagtgagccactgcaactggcctataatcagtcttttatgtcattctccatcttcatgcatttaatagattacagcccaaatatcacaatcgtaattgaaacagatttgtttgttagaagagggggaggtattaatgaggctacacaggcactgctgtgaaccaggaaaactacacagtgtgggtatgagggagtgaagaatacatttatgttttaggtctcacttctttctttgcctgtattaagtagtaagggggagaactaacaaggtacctctgcatttaatggttcttttgcagtttggctgaactgtgtcttgaaatccttgaagagcattactaagatggtatagaagttacttgcttaaaaggagaaaagaaaaagctttaatatagacaactcaatagctgaactactcttgcaatgtgaatagccattccttgggtttctaaatgattttcacacttcccacacttgtttaaatttgtaatatcctttatggttttcctttattggccaggagaagaaaaacaccctgaagatctaggtatccatcaaagctgatggaatacactaataaaatcctgtgtcatattaaaatgtaaaatatatgctggcataatattgtctgagtcaatccaatggaataacataattaatagtggctttgataattaatttataggaggaagaagctgaggacagcttagttctttctgtctctgtattcctcccaccccctcatcttttctcctgctctctgtctttctctctctctctctttttaactagctgctgtttgcttcatccaaatatgcatggaaaagttttaagtggttgttgaaactcccagaggcctgtttacttcaaggtagaagcaggaaagctgccataattcagaaagcagcttctggcatgagatgaaagtcagatcagctcaagttggggtcagaatttagaggccccactggagtgtttatgcttgtatctgtagtccagataagttagtggaagaaattgttccctgtggcaggtcatgaatctaattacactagaaatattactacaagcgcttcattgaaaattgctaagcaatgtatgctatctatggctttcgtaccttcaaatcacatatgatatgtggaacacatcttccacgtgggcccacagacccataactcaagccatggtttctcagcagaaaacagaccccagagagctcctgttcctgaacatctgtctaaaaaaatgccctcttagagatgagagaaacagagaccttacttgaacaaagagagaggagcactgaagtctcaggagctgatcaggaaacacagaaaggaaataagtcgatggttttaagagctagctcagtgccacccatgttgcaatgtaggttctggatctaggcctttttcctgttttatgactattggatatctctcttaaaaggggcatagttattttctgttttttttttttttttgttaattttatgtattttttatttccataggttttgggggaacaagtggtgtttggttacatgagtgagttcttgagtggtgactcctgagactttggtgtacccatcaccagagcagtataccctgaatccgatttgtagaaacactaagcaaaagaagttccagaacagaattaaaactatgcagcattcctatttcctccaataaaaatttataattgacccttgttagcaaaaattttcaacaatggaaacattgagaatattcagtaaaacaaaaaacaaaaccattttgaatattaaatataaaatattgttccttgctaattgaattcttttttaaatatggaaacacacaattgctttttattaccctttcatttttttacattgttttgtatttgttcttatattcaaatgaacaggctattttcaagttaacacacagtcccactccttcctccaagttcccaaagtccattgtacgttttttttttcccccttgggatggagtctccctctgttgcccaggctgaagtatagtggcatgatctcggctcactgcaacctctgcctcccgggttcaagtgattctcctgtctcagccttcctagtagctgggattacaggtgcccaccaccatgcctggctaatttttgtatttttagtagagacagggtttcaccatgttggccaggctggtctcaaactcctgacctcaggtgatctgcccacctcttcctcccaaagtgctgggattacaggtgtgagccaccatgcccggcccattatatcatcttaggcttcgcattcttgtagcttagctctcactgatgagtgagaacatacaatgttttgttttccattcctgaggtaaggtgacctcgttctaattttatcaaatacagtatgtcaagcaacaacacaataaaacaaatgggtatagttatatctggtttgaatagaggctgtgggttcaaaatgaggataagtccagacctcatggaaacctccactggcatagcctggtgattcacacaggaagggttttgaaatcagatgttcctgcgtcataatctcacgctgacgcttactaagcctgtaacatcatgcaagccagttatctctcagcctggacttggtcatctgcaaaatgggtaactgtcacattacttgccttgcaaggttatcaggttggtacaaaagtaattacggtttttgcttttaaaggtaatggcaaagattgcagtcacttttgcaccaagttagtataaagataatggtataagcaaggttatgaataagtattttctatgttgataattctagatcagggtattgtatgacatgtaggcattgtaactgtaaaataactatgacgtaggcagggtattgcatctgaataagccaggtagtgaatctattatcctacaggtagattctttttttctgtaaggtctttgaggtaaggtaggaataaggatagtgggagccagcggtgatgaggatgacaagatggtctaaatcttctccctctctggcattattgctgtttatttccttggagagagaatctactcttggtattggaatcagaagcagggaaactaagggaatgaatatgaatgtcaaagaagaaatgggatgcgggtttgagcaaagaaaatattagttaatgaatgttttaggaaatttgcaatgtctggaaggtaaacgtctttctcattactaatgtgactacaggtcgtactgtgtgttaatttgaaaatagcctgttcatttgaatataagaacaaatacaaaacaatgtaaaaaaatgaaagggtaataaaaagcaattgtgtgtttccatatttgaaaaagaattcaattagcaagcaactatattttatatttaatattcaaaatggttttgttttttgttttactgaatattctcaatgcttccattgttgaaaatttttgctaacaagggtcaattatataaatttttattggaggaaataggaatgctgcatagttttaattctgttctggaacttcttttgtttagtgtttctatatacattttctaggtagaataaaatccattgtacatattttaaaaaggaaaaagtagtccggagtgagtccttcccattgactgctttggacattacaatctgccatctcttcctctggggcatccaggagacaagccctaggagactgagacatggaatggtgatttcataataaaacaagagacaacagggcaattcagtgttcagcgccgtggagctgtgcactgttgaggaacacatcagggcagcctggcccacagatttagaaacagagtgagactagaagggccatctgctgagtaagtagagacctcaagatgtacagcgtgtgttttatgatccggaaggtagattttccccccgttcatgtaaagcacttcaaggacttggtaatgggacaaggagcttttaacctccaggttactggttaagaaatgtcccacatcgatagtgaccagaaggcattgccgtctgctggctgcgcagtggcctatgtaaatgactttaaggtctcaaagcaaaccattatgggccgactttctatcccaccaactcttaactccgagtacaatgacccagactcagactccttgaagtagtccccgtggagcctgatgggaggacggcaggtggctaacagcggcggcttccatgtgggactctgctgtggcaatgtttttttttggaactcacttatttttatagtttaaaagaacacactttatttttcactctggtgagagactttttaattatgtcttttgctgagcatttcaagatggtatcagcatctgacatttgaaatgccttctttgccaggcactctgataagtgcttaacctgtagggtatcatttaatcctccccactcttcgtgagttagaactctgtttcttgttttataaagtaggagactggggcagagaaaaatgaggagatctgcctgaagccacagaagcagggtaggattcaagacctcccctttgtttagctaggattcatgttcatttctttattccatccaattttctaaaacatttttaagaatcagtgtccctttatgtttttcctaatagaggtttctgtgacctcttagcacacatgaactaatgcaggaatgtgcagacactgtccgtcaccttcctcacagttacctctcctgcttcccccacagctaatggaacattgattttgttaaaggattgggaagccatttgtttcacaggggccttttctagccccacccagtgaatcatggttggctttgactgatcgtaaaatgctttgaccaacaataaaacatttccttgccagtgatttgtcttggatgaacatgcccatgtatgtgaagagctcagatggggcatgcccttgagaaggtttcttgatcttcacagagctatagaaaagagaatgcttattttctttcttttggcaaagttgtgtggggagctgttgagtccaacatgtaacagtgagacgaggtggccagcttggccacctgtgggacaatgctgagggttgtggggggatccaagaggacttccctccccacttcccagtggccaactctgccactgacctgagttgttttccttccttgtgtggtagcatgggtgaaaccagagacgtgcttatttcagtccattgggggctcttgtgttactcgtaactgggcattcttgctgaaatgggtagtctgtatactatgtttatttaaatgtattttatttcttattattttaagagacagggtcttcttacgtcacccagactggatggcaggggcatgattatggttcaccatagccccgaactcctgagctcacgtgatcctcccacctttgcttctcaagttgctgggactgtaggtgggcagtgactaattgtttttcgcatttttttgtagagatggggtcttgctatgttgcctaggctgctctctcactcctggtctccagtgatcctccaccatggcctcccaaagcgctgggattagaggtgtgagccaacacccctctaatataaataaatcattttataaattatttataaaaatttatttttatgatttgatttatttatattccctttaaagtgtacaaataaaagagacataaatgtagaggtgatgatacaactttcagtgtacacagcaaacaggtggccaaggtaagcccagaaaccatttgccctacttctctgggcaaatggttgccagatacaacacaggatgcccagctaaatttgaatttcagagagtcaatgaatatttttccttagtatcagtatggcctaaatatttcatgaaggcctacttacaccagtcatttcagttgtttatctgaagtgcaaatttagctagactttctgtatttttatttgctaactgtggtaatcctattctgccaggactacatgctttttatcatttgtcttcctatttttggactcttatttgaaaatactaaatacccagccaccactaacttaagccaaagaagtttatttgtaagcttaatttctaggtgtaatttatatgcatatataaatacaagttatatatatatgcccatatataaaatgcatacataattatattgtaattatatgatgcaaaattgaatgtataggtttaaataatttataggcttatgtaactctgctctctgttatatttcttgccaagtggattttgctaagataattatcagcaatgttagacttatgtcctatcatctttgtgaactccagtgaaaagaaagctaccttttttccaagagttgaaagcaccaagattagatcctattggatggatttaagtcatatgttgattcctaaactaattactatgagcagaaagatgagatatactaattggctgaacctggtcatgtgaccacatttgaagatggaggataatgatacagcaaatcatatccaaaccaatggaaactaggagcggggagattccccgagataaaacccgaacgcttttacaaaatgaaagtggagtggcttctgggcaaccaataatgatgtccactttagtcactaggtatcagacacaatgctggtctgaagaatgtgatgcttgcaactgtccggcggggccttggacttgtctgaatcggtattttgctgaaagtgggtggagggaagtgaaggttctgcatcacaggcgatgcacctacagcaatcagatatttgtgaacaaggctgttttgttctgtgtcagaagttcagtggggttcagcttgttagtcaatagtgaaggaaataatggcagcccgttccagtctcgccgtgcctgtgaggcctcctttgatttttccctcgtaaagaatctcatttgatttttatataaaactcagatttgaattttattggagtacttatacatgattgcctttcagtgaaacttactgtcattttagccgtaatgttctagcaaatggagtggtgttttttagtttcttttaaattgtttcattaagcaaatatttattgaccactgcacatgagttaggcattgcggatgacagagaaaaagtcagacaaaagtccatgtcttggagagcttacctgaagacattttgctgtgtgtatgacagaagtaaacggtccaagtttctgcatttaaatattatgttctctacaattatattgctctgggaaactggggagagggcacgtctgggaatttgaattctaagagagaatagacaggcacctattaaaagtgaagttggttttctagctttttctgactaggtgaaatttctctgtcataggtttgttttttttttttgagacagtctctctctgttgcccaggctggagtacagtagtgcactctcggctcactgcaacctccacctcctgggttcaagcaattctcctgcctcagcctcccaaggagctgggattataggcaccgaccaccatgcccagctaattttttatttttattttttatttttgagatggagtctcattctgtcacctaggctggagttcattggcgtgatctcagctcactgcaacctctgcctcccaggttcaagcgactctcctgcctcggcctcccgagtagatgggtctatagacgcacaccaccacacccagctaatttttgtatttttagtagacacggggtttcaccatgttggccaagttggtcttgaactcctgacctcaggtgatctgcccgcctcggcctcccaaagtgctgggattacaggcgtgagccaccgcacacggcctctgtcataggtttttggggggagaagctcctttcttcttagtggttggaatagttgtgagcaaagaatgctcaaagatgggcattctttgaggacatttgtgttcaccagaggacagcaagtgcttgaaggcagaagccatccagttccagtgcacacagcacagggtctgccctaaatggagaacccaataaagacttgttgaatggaggaaagtttgccttcccctcctgcttttttcactctggccattgaccttcccacgtctcagacagatgaggaaatgtcatgttaatatcaagaagtatgtacagtgaatgtgctcttaacctcatttttctgcagcttcattctatgtttccttaaagatttcgcagggatgtgatttggttccacccattgcccacatgtacaaaaatgacagaagactgacttgaagtgggcatgcaaagtaacattgcttttccaaagtgccaagaggaggatattcggtattaaatcagtatctccttaaatttgtgctgctcttttcttttgccagccttaaggtgctttaataactgtgagacatagtagccaggtgcttcctaagggaacctgagacttacttaaacctcttcccaccacaggtcaatagaatatacctgtgattgttcttaccttcagtgaagatgcttatgccttattgaggcatttactgatacaaaaaaatgccaggccagtctgacatcttaacctaaatctacagggtttataaggtaatgtgtacctgcaggaatattttttcctaaccttaattaaatgcaaggggaacaattgtaataggagtgccattttagggaggaagtaggaggtctgatttatggctgtcaattgttgcctctgtttttttcttaatgtgtatatttgaggtgtatgcaacatgatattgtaggatatatatagatagtaaagtggttatgatagagaagcagattaagatatttatcatctcacaaactttttttctgtgacaaaagcagctaaaatatacttgtctaaaatagggaagtcaaccttgatgcttcacttcccttttgtatctggggcttgctcacctcttggcccctccagcaccatcaccctgggcaaacaccgtcatctttgagtcattaccaccagagcctcatacacagatcctgcatctagattctcctccatccagcccgagtcatgctttaaatgcacgcatcttctcctgtctgttcccagtggctttatcacacaatggttttgtgagaacaaagctggaggtcctcatccttgcttgcaaggctctgcataacctggtacctggcaccactcccatcttgcctcctgcaactgcagtcgttcctctaggagccatccttattccatcccgtcttgggcctttgcacttgctgatctctcttgatcctctcaagatcagctctgttgtcccatgaatgccttaatctcgagtgtcctttcctcagacagccttttctgagattgccctcatcgctctccgcacacgatcctgctttatcatatcatgactagaacattcgccccttgttcatttgtgttctatctctccttcttcctaccgacaatggaatgcgagctccatgagcacagtggtgtttcccagctttattctgcagccctgccccttgaacaggctttaataaatcattgttaaataaataaatggagaagtgatcactggctgggcacagtgactcatgcttgtcatcccagcacttggggaggccgaggcgggcagatcacttgaggtcaggagttggagaccagcctggccaacatggtgaaaccgtgtctgtactaaaaataccaaaattagcttggcatggtggtgcacgcctgtaatcccagctactcagggggctaaggcaggagaatcgcttgagcctgggaggcaaaggttgcagtgagcgaagattgtgccactgcactccagcctgggcgatagagtgagactctgtcttaaaaaaaaaaaaaaaaaggattgattagttcgtcagtaaattatcttactctctctccatcccattggctggggcagctgactaacaaaatagcccacacaagggaagcaggggttttgtcctgcagagaaaacctcatagaatttaacatccgcatccaaacataaacactcaggaaatatgtctggaaaggaattgcatggcatctgcttccttccatggtgactttcaaatgacaaatgcccaacatcatttagggtggtagagcccctttgaaagagctggagctgattgcttctatcatgcccagaaaaagtcattgtcatctacacacacctggcttacatttggagaaaatgagcttctggtttctgtcttgctccaagattgaaatttccgtgctttgtgttactattaccaacagatacttttcttttgtgaagcgtctagccagctccctaatcactgggaacaaactttgagtaggttgaaccaaaggaggtgtcagagtacatgctttccagccaaataaaccttcagaaactgcaggggctggaggccctctcagtccttcacagccaactaagggtacttatttttgaaagttggactttttttcttagttattaaccagcattagctgcaaaagcattataggaaagaaaacgccttttctatgaaggtcagattcacacaatgcagatttccaaagaacaggatttctgtatttttaattgtttggttttggagactgggcgtcactctgtcacccaggctggagtgcagtggtgtcatcttggctcactgcaacttccgccttccaggttcaagcaattcacctgtgtcagcctccctagtagctgggattacaggcacaccactacatccatgtaattcttgtatttttagtagagacggggtttcaccatgttggcaggccagtctcaaactcctggccttatgtgatccacctgcttccgccttccaaactgctgggattactgtcgtgagccactgcacctggcccagatttctgtattttaacaggaagtgccaggcatgcttatggcttgatttttaagtgggtggtgcatctatataaaatgtgacaactattatctgtttaaggaacgaaatgcagggccagtgaaacatagatgactctcagtgaaatactgcagaaggtggttcttccttcacccaacaacagtggtaacagtgtttccaaggaaagaacaactcaagggagacatttaacccccaaagaaagttcataatgttatatgttacaagatgttggtaaaccacacatggaggggaatgggcatacaatgtgcttttgcctttgtgtgtgcgtgtgtttgagatggagtcttgctctgtcacccaggctaaactgtagtgacatgatctcggctcactgcagcctccacctcccaggttcaagcaattctcctgcttcacccaaccgagtagctgggactacaggcgtgcaccaccatgccaggctaatttttgtatttttagtagagacgaggttttgccatgttggtcaggctggtctcgaactcctgacctcaggtgatccacctgcctcaccttcccaaagtgctggggttgcatgtgccaaccactgtgcctatcccacaacgtgcttttgagcaacagcaataactccagacaaaatgagacccagagaaggttaattgtgaatcaccctttagacacagcactgaaggaagggttgtggtgtaagtagatacctagaatgggatgcatattgcctgaaaagataatttctggaaatgatgagactgggataaggccaaggggactcacctggccaaaatacaaatagagtgtttcatacgttacttttgcggggaggtaaagaccagagaatgagtgtcaaggcacttattttttgagaaatgatgaaagatgaacagcttttgggagcatgttaaaacagatttcatctgggaatttcattttgcacaaaggaatcctgtttgagcataagcgattggtaagttcattgttgttatagcccttggttatgctaaatacgttagtagctgaaagtttccaggacttgacaaatcagataaatcatggagtttttcttttctagtttttacctgattttggatgttaatttgttgttcattgacagtgggattttcatgcaaatgttgggtgttctgtaagcctgagaagtctcttggtgtcttagcctcaagatagcagagactttactggttattgttatttgttctttccaaaatgtttccgcagatcatatttttaaataaattgtaaaaccagtgatttgtaaaaatgccaggtcagtctgacactgcaacctaaatcttcagtatttataaggtgatgtgtacctataggaatattttttttgcccaatcttaattaaatgcaaggggaacaattagaaaggcccatatagggaggaaataagaggtccaattcttggttgtcagacgttgcctctgtgttttcttattgagtatatttgaggtttacaatgtgatgttatgggatacatatagtaaggtggttataatagagacacagattaacatattgtcacagagttacatttttgtgacgagagtagttgaaatcttcttatttaacaaaaattgctgatagaattttattaactttagtcctcacgctgtactcaatgttgcctcttttgttgtgttttatattctgtgaccatacgttttgtaacattaatcatcatccaaagactacactgcagaaggaattgtttacttggacattagtctacatatgcaaaatcaggcagatatttgtacttctgtatctttgaattatatgtaatgtcaattgctagatttttaaaaatataagcctgataatactataaataattataaattaaactacatttctgaaagctaactcttcaagtgataggattgttctttgcatacctatttgtatcctgaggaatcttgcatttccaaaatatatatatattagttagaagtgatgttttccacagagttcttttttgcattgttatattgatttttttttttttttgagatgtagtcttgtttcattgcccaggatggagtgcagtggtgctatctcggcccactgcaacctctgcctctcagattcaagcgattctcatgcctcagcctcccaagtagctgggactataggtgtgaaccaccacacctggtaaatttttgttttgttttgtttttttttagtagaaatggagttttgctatttggccgggctggtctcgaatttctgacctctggtgatccaccccccttggccttccaaagtgctggtgtgacccaccgtgcccagcctatatggaaatattttaattgcctgtaaacacactcagtggagctcgttacaagaagactgtcgatgtacttgaaaagtttacttctgcataatgctaaataccatgtcagaaatcacagaatcctacgaagttgaatttttcattaaaggatcataagtaaagtttggggggaaagtgtgcagttcaatagatctcaatatgaaatggcatattattgttatttatatgtatatttaatattatataaaacacttttgttttaacttaagcatttggattctgattctttgaggcgtgattatggttttgtcattcacagcttagctatgtcatctcagataaattaatgaaatgtccaagcctcagctttggcagtttttaagtgggagtaatagtattaatacccacctgacaagattaccctgtagacggaacaagataatgtaaaatgatgaatgaaaggctttacatacagcaagtgcttaataaatgacagctcattatcattattgtttttatatttacttttttttggttgaaaatattaatcttctgaactacccttaccagtgccaaaacaaccgtaaagaaacaatcgtgcagtcctgttatccacgtggcatgagttacagggttcattatactgaagacaataaaaaccaaaaagaaagcagcacctaggaaggagctatttgcagaagtctcactcaaaagagttcaaaatgagagttccaaacctaataaagataacacgtttgccctctggtggacattcattttgagttagaattttctctgctaagactagagatttttcaacctccctaaaatgtcagggtgttgtagctggagtagcaaacagttctgcctgcttcgtttgaattttgtctgataaatgtgcaggtgaacgtctaaacgcacaacatgcatgggcaaatgaaatgttttatggctacagcgtaatgctctcctcatttttgttcagctccttcaggagttaacaattgctaagggttatttacaagaaatctgagctgtctgatcactcaactgtggaaggtaaatgagatttttaaggtgaagggaaaaggagaggcaaatggtaaaatgggccaatgcatgaaaaagagggagacgtcaaacttaggtactggaattgccgggatgttgtcatcaacgatttgatttgatgggaaagggatgcttaatgtttcttctgtgaggtgtgtgcctgtaccacacacatgtacacatacagtggagtggaaagtattcctgcaaagggccgcaattctcagagtgtagtcttttctcttcctactcgaattggtaaaaataaataatcaagactgttttggtggcttctggttccccaagtagaaagcatcttagttggcaattcagtcactgaccttgaaataggacaccagacctattgctaaaacgtcttccacctcacaggccttccctgcctgctgtcctggtgaacttgttgactctatgcacataaggactctctggggtccaaatgacggggaccaagctcgcacacatcattcagcgaataggctggctcagctaaccaaaggttccatgggctcatctagcttaaggtggctgtattccttggggcggggttgggggggaatgaaaataaggtcatcaaggtgtctctctctttctctctgactctctatttctctctccttctccctccttccatcacatatctctgttttctttttccatgttggtttcattctcaggtagacagtcttcgtgtggtgacaagggtgacctgagactccaaacctctgtcttcatcactgcctttgttttcaggaaaaggagagactcttactctgagcataacgccggtccctgaataaggacagcatctctctgtctgtatcataagcccactttcacaccagttacctctttggtgggagtgggttactctgaagagcctcagtcatgtgcccagccccgtggggtttttgttttgttttgttttttttgagatggagtctcactctgttgcccaggatggagtgcagtgcctccatttcggctcactgcaacctccacctcccgggttcaagcaattcttccgcctcagcctcccaagtagctgggactacaggcctgtaccaccacacctagctaattttttttatttttaatagagtcggggtttcactatattggctaggctggtctcaaactcctgacctcatgttctgcctgcctcagcctcccaaagtactgggattacaggcataagccatcctgccctgccttgcctgtgttttgggagtcaaggcgagatgatgagaagggagggtatttgctgacgaatagtggcgttgtgttgctaaaagaagggcaaagggtgttggatgggaagagccgaaacacgcatgcgtgatgttcagggcccttagtccttgttctttttgtctctgcaagtttgccgaagttgctctttgataatctttcttacctttccaaattgcacctaccctttgacgtatagctcaagttgtactttctctgtggactttttctcccagcctggcttcagcttgccttcgattttaagctgagagcacttacctggtgtacccactggctgtttaagtgctaacggtagctcctgctgttattgttatctcttattccagccttctaacattttttccactgtttcattttgttttttgtttaacggttttattactctttgttttggggactgacaaatttttggatgcccatcttatctaacacagtcagtactgcctcttttgatgatagtgagataggaatttcaggagaccaaaagaaagagcttgctcaaatattataacttgccctttagtcacttttaaaatgcaatgtccaaccaaccttttagttcttaatggaactcttgtcagcaatctgcttgaaggtcagcctcatcattcttggatgtggtcctggggcctcagagtgggcattgttcccttagggagtggaggccagaagatgtagggtgccccatagcaggcatctaaggctttgggtgctccaagcactgctccgggatggggtcaaggaggagaagttgcttgtccttttaaaaatttttgcctatgctgcaaagattatgggtcaaagtgaaggtcatttataaactccacccatggcaaaatccaattataaactttaaccttagtgaaatgtcattagagcttggcttggctttatttgggatggagactgacagttttgtctgtgatatattcagggagacatatctattaaagctagtctaacaatgggggcacacgcagatttgcattttaattcgttttccctcagtgctgatatgcggcttatctttcaagaacaggctcacatcaaccctgatatacgttgcttaagaataatgctcataatctattagtttaatctgttcacatgagaaagaaagaagaaatcgtgcatggtgcggagggtttcaggccccagtgggcgattttttggaggatttcccattacaactgttttcaacttgtgcttgttttcctttctctagcttaagtatgaacagcttaaggagaggtcatgtcttccttctacgtagagccaggcaagctcacattacagtcaggctcccaaagatgttggttatatgcagacttctgaacttgggttccagtttcatgatctgcaatgagcctatagcaattcaaccttgaaaatgggttttgatcattaccgattatgtataaaaatgacccatcagaggacccgtcagataacagataatcaatatttttatttttctggaagtaagatcgctgctaagacctttagaactttctgatacctgcaatactttgtgctttttctctcacctctgccactcctgggggagggaaggggtcttttctttgcaaagtgtgtttaatattggaaggagttgtgtttaactctaagagttctatctcactttgcccagtgttctgcattttcactggttctttcacttttttactttttttttttttaaacactctcccagtggattctctctggggtccagtgaccttgatgtttttcgtccagggaagatggctgaggcatcccagcagggagtcaggagtaggaagaaggtctctgtaacagagaagttttggaattgccgtggggtgctacagcatgaatttagagttgggcaaaagtgcctgaaaagcaggccttctcatttcataatgagcgtcatataaaccatgtttatcacttcgtttagccacattcggatttgtagaaaaatggatagaagggatgactccaggcagattagcaaggggattgcattgatcttggggtcattggagtaaagcaaaacatgatcactgacctttagctctagggtcattgacttggtagatggaacttgaaagcaagagtagaactcggcaaatgtggaagttaaagataaaatgtggcctggagagtctaatggaccactaaggattaatgcactttgttatcacgttggggaaagacgagaaggagtggagagaaaagaaaatttcgggatttgaattcttatacatggaagagttcagagaggttatgtccctagaaggctgagatagagaaggaggtttctgatgaaaaaaaaagcttcagccaaattaaatttaaaggagttaattgaacaatgaacgattcctgaatcaggcagcccccagaatcagggcagattcagagagactccagcacagccacgtggtggaagatgtatagacaaaaaaagggaaatgaggtacagaaattagaagtgaggtacagaactgagctagattggttacagctccgcgtttgcctaatttgaacatagtttcaacactcagcagtgtatgagtgattgaggtgcagccactaggattggccaagactcagttgttgttacaggcacatgctcctaagttaggttttcttatttatttatttaggtggagtctccctctatcacccaggctggagtgcagtggtgcaatctcagctcactgcaacctctgccacctgggttcaagtgattctctggcctcagcctcccaagtagctgggattacaggcatgcgccaccacacctgactagtttttgtatttttttttagtagatagggtgttttaccatgttggccaggctggtctcaaatgcctgaccttaagcgatccacccacttcggcctcccaaagtgctagattacaggcatgatcttatcgacctattaagttaggttgcggtttgtccacaaggactcaaatatagaagtggggagtccttctcaggccacatttagtttgctttaacacagctgaattatatgtgtgaggctatggcatgaggaagggtatcatgaagaggttgaagtccatgaggtaatgagagactatgaaagccgtgttcatgtccagtatttgccatttgcttgtttgttttcttacccgctgggttccactgtagtgttaagtcctacgagaccctggtctgtcctgctctctgctctttttccaatgcctttgacagttcttagcatgtaatcaatctgcagtaaacagctgctgaatgagggaattaataaagtcaccaaggaattgtgggctcctcttctgctctgagccccgtggatgcattgttatgcgtaataagtgtgaaatgagcatttgttgattgtattccatgtcaaagcaaaaaataaaaataaaataaatgtcagaatacactcatggtgctattaattatgatgtagagctttttttcaaacttttattttaggctcaggggtgcataagcagtttttttatttaggtaaacccgtgtcacgggggtttgttgtacaaattatttcatcacccaagtactaagcttagtacccaatagctatttttctgcttctctccctcctcccaccctctatcctcaagcaggccccactgtctcttgtttccttatctgtgtccctgtgttctctttagtaccgtttattagtgagaacatgcggtatttggttttctgttcctgccttagtttgctaaatataatggcctccagctccatccaggtctctgcaaaggacatgatgtctttcttttttgtagttgcatagtattccatggtatatatgtaccacattttctgtatcttgtctgtgattgatgggcatttaggttgatgccatgtctttgctattgtgaatagtgctgcagtgaacatttgcatgcatgtgtctttatgatagaatgatttaaattcttctgggtatatacccagtgatgggatcgctagatcaaatggtagttctgtttttaggtagagcttgtcaggatctcttcttccctctctccttctttgtctatatatgcaggtataacaggtaaaacatatgtgggatgattctacatattttgtaaatattttccatgtcaacatatcaatctataacaccaatttcaaggttttgtagtccagccgcaccacaacaggttttcatgcatcccctattgttgagcatttaggttgttctcaattctttccactttcaatgcataaggagttcaagactcgatttagagaatgcctcaaaggtagcctttggccaaatctagaactagagctcaacagtgccacagcctaaaagatgaaatttagacacattcctggagtttggtgggatatttggctcattggcttgttggaccagcagttagatttggagtggttctgcaaatgtcttgccatgaacatatgatataatgcttagagggttaaaaagcatacctggattttcaagggttaaaagtagacctggattttaggtcccagcctggcctagagcataagtgacttgtggacatcctgaaaaagaaacccattctttggaatagcagaaaagcggcatacatcttcagatgaatagtaagagtgattgtgaaccaaagggtctgggtgacttggctgtttttatcttatttttattttatttatttatttatttattcttttaagacagagtctcgctctgtcacccaggttggagtgcagtggcatgatttccgctcactgtgacctctgcctcctgggttcaagtgattgtcctgcctcagcctcctgagtagctgggattacaggtgcatgcctccacgcttgggtaattttttgtatttttagtagagatggggtttcactgtgttaggcaggatagtctcgatctcctgacctcatgatatgcctgcctctgcctcccaaagtgctggtattacaggcatgagccaccgagcccagctagctgtttttttatcattggtcaaggatgtcacactgcatggtggtggacaaaccagtgctgagaatgaggccttgcagccaagtgtgtcactttgcagcctgtgagctaagatgtcacttgcaatcgtgtagggagagtgggccccggacagcggggagatacaacgtcctcatcttctgcaagttgctctggtgggaaagaagggaaagcaggaatgagtaagggaaacagaggaaactgagctctgaagcccaacctctgcttcatctctcgtttacagttccatccctgtgagcaaacccttggtgtctggagagcagaaccatcacttcccatcttccttggctgtcaaccaaaaattgcccctgtggccccctgtagtgcccctcaacttcatgtcctacagtagaaagtcctctgtaagctcttcaggatgcacagtctagaataatggatgtgatgcagcctcagtggtggacttcctgagttcaagttctgtccctctggattattcaatgtagaaacttcatcacattgtttaaccttcctagatgtgtttgctattcttcacaatcaggatcacacatatagagtacatcacaaacaatgtaagctgcaggacagaagggttttgtgttttccaatgctgcatttatttttttattgctgctataacagattactgcagacttggtggatacaacaacacagatttattcttttacagtttgagtggtcagaactcgacactagtctcacagtgcgggcagagctgcactcctttctggaggctgatgtggagaatcttagccttttccagcttcctgaggcatcctgcagaccttagctcatggcccctttctccatcttcgaagccagggatgtagcccttctccatgcatttctttgatagtaacagcaagaaaaggttctcagattttaaggactgatacgatgatattaggcccacctggataattaagactaatttttcccatttcaagatccttaacttagtctcatctgcaaagtccctttgccatgtacggtaacatagtcacaggttcccaggattacagcggcgtggacacttctgaggggtggggtaggcattgttctgtgtactatgactgccaacacccagaatagtgcttgacaggaaaacagatctcaaatatttgccataggaattaacggtgattattgaagagatccaatgtctttaaagtgcctagtgggatacctggcacatgggtgagaccttggttagtgttacgtgttatttgcagtcatatgcatcactcaaaggaaaatttacaaacacacatgtgtgcatgtgcacacatagacacacacacactccactcaccagtggatattgtttctagatgcttactccctgtctacccaaatcgattgttcctgctgcaggggcaggagacaaagctattgaattgtatggagtggacactgaccactccctttttttttttttttttttttttgagatagagtctcattctgtcactcaggctggagtgcagtggcacaatgtcagctcactgcaacctctgcctctcgggttcaagtgattctcccgcctgaacctccagagtagctggggctataggcgtatggcaccatgcccagctaatttttatattttcagtagagatgggtttttgccatgttggccaggctggtcttgaactcctggcctgaagtgatctgcctgccttggcctcccaaagtgctgttttgtttgtttgtttgtttgttttttttactaattatgagtcagaggaaagagctgtcccttttgaagtcattaaagttacagagtccttcacagtgatctcgaaaccttggagaactttgaaaataacccaaattctcaactctgtagtagcagactcccaagacactgcatatacttttttattcccttgagttcatcaccctgtggttgagaggcaacttaacaggttactggagctgtctgacttggtttgcacttctatgagtcggcgtcatgttgggtacactttgcctttattcctcgaatttgctggttttttggtttcagactgagtggtggagaggaggcaagatcaatacctcattgtcctcactgttgcgctgtcatcagaaagcaaagtgtgtgtctcctgttgagaatacaaaagttagggccgggcacggtggctcatgcctgtcatctgaacactttgggaggccaaggagggcagatcacctgaggccaggagttcaagactagcctggccaacatggcaaaaccccgtctttactaaaaatacaaaagttagctgggcatggaggtgcgtgcctgtagtcccaactattggggaggctgaggcacaagagtcgcttgaacccaggaggtggaggcttcagtgagctgtgatcatgccactgcactccagcctgggtgacagagtgagagcctatctccaaaaaataaaaataaaaataaaaaaataaagaaaagaaaaatataaaagttaggatatcagcacaagaacttcagtgttgtagatctgctctgattcttcattcttttcaagacatgatttggatgttctgcacctacgtctcatgctggatggtgaacttcagtgcatatgctaggatttgtgctccttttgcatcctgtggctaaaagttcaggctgatcagctaagctttctctatgtgccaatctaaggatgcctttgagaatagttgggaggtcatttgacaccctttccaatagtctactgcttaaaaggaaggctctggtggcagatggccagagctaagctcctgtatccactgctcactagctgtgtgaccttgagcaaggtgcttaagtcatctctcttcctcagtttctttaaccatagtgtggtaatagaaaccatacgtatctcccagagttgttataaagataaaatgagttatcacagtgtaagcacttagaactatatctcatatacatagtaaatgcttgttaaaggcttactgtgagtccgtgactacagcttatattcatattcataagcaaatagcaaagcaatagaacctgactatgaaaaaaggtagccatgagggaaagaaaaaggatggtctcctttggataaacattttccgtaatacgtccctaggaacacattgtccacaaaagatgttaataggagtgctgagttacagggtaccacagtcataaatatttgggaaatttcttctcctggagatttatgatgcgcattagtatgttaacattacacgttctgctagagctcagagtagagacactaattttggctttatttaatccagttggtcccagatgtgtttgaccacccggtttttctgtaggtcgggggggtgggggcgagaggatgggcttagaggtggttgtaatggttgcgcttttgttgtgcatagcacctagtaatagctgtaggaactagtgtttcctctcaagggcacgctgtaggatagtactagaatttaaagtgcatatagggatctgagtaaaatatagatttggattcagtctggcatggggcctgagatcctggatttctaagtggttccccattggtgccgctgctgctggttgtactggtctgtggactgcactttgagtagccagactttcgggagcagtctcttggtgataagaagaggacccacacggggacaatcagaaatgttagcaattgtgcagtaaggagagaggagagcctgaggcagaggtttgcaaccttgactgcctgttagaagcacctgggagaattcagaaagctgctgtttggactccacccccagatatgttaacttcaaaggtttggagatgagtcctaggtattggtatttctttttcccacaagctttccaggggaggctaatggaccaccaggctgcaaaactattggtttcatagtgatgggcttaatttcttaagtcagagagcctgtttctaatcccagccctaaattactacacatcattagtaatttatttattttttatttgagacctagtcttgctctgtcacccacgttggagtgcagtggtgtgatcttggctcacttgcaacctcggcctccccagttcaagtaattctcctgcctcagcctcccgagtagctgggattacaggtgcccaccgccatgcctgaccaaatttttttttttttttttttttttttagtagatatggggtttcgccatgttggccaggctggtctcaaactcctgacctcaggtcatccgcccgcctcagcctcccaaagtgctgggattacaggcatgagctactgtgcccagcctcaggattgaggaatttagttaaagttgctgtgcctcctttcttctcattgtaagaggaggcaatcagggtacttaaacttcaaagagtcttgatggagatttgatgataccatgtttgcatcccaaaagactggtgtctaacacatggtaagggtgcagtaaatgtcagttgtaataacaattattgttatgagtattattgttattatttgctaacaaccattcttaggtcatttttttttttcttttccaatctgaccaagatattgtattggttacaagctaaaaccagataaacatgtatttaattttcttaataagtggagaattgtgttaaatgtcttttgggtacatgtgtccttactgggggagtgcttgcttctagcctaagttgcctccagcaagcattcatggaggctgtgattgccgtgagaacaggtcaaaaactgtttttgtttactgtgacaaccccagtgcctggacatagtggttcaacctgtcttggttgttggcgttgaataaatggatggtaaccattccaagtggagatatgtcagctcctgtctgcatccattcatttatttcagcaactgaaaacaacgtaatagtcatttaaaaaactgaggaataccatattttggattatttgttgttccggtgattttgccaagtgtggatttcctttgctaattatggaagtagacaaccaaatctcatttcttgtttgttttttttttttttttcctttctagaagcagctgtgttccttgccctctgccaccatcccactcatacactgtctaaaataaatagctttttctttttctgccctgtcttgtttctttctccctttgccctccacccaatttcctcttcccagtgaagtctgtaataatgtatcagtttacttaatgcaattcccagccctagctttcattgatttttttcttatttgactattggcttatgatttgtggggtagaggaggtggtgtgcatatcatgtgaatggaaaggcttaataattttcatactgtttcataacaaatatatattgtattcaggttcagtgactgcctttatagaatcatgtcagaaagtggatttctatcctgtttcatcttctatgaaaaacggaaaacaagaccttttcccctcactgtcatcccagcaagatataaagatgctcaaatgaacatttgtggaaggacttgacaggtgcccttggaaaggaagcaggattttactcactgatattttgaatatcatgagagttagaattacgaatgagtacacccaagcacgcagtcggttaaggagactttcatactcattgtggacactgctcacaggcaaaattgattgtgcggctccagttgctagagccacggggatttgagaccacagctacatccatctaattcaggaagaacttgaaatagctcctgcattttcagtgggggtaaaaaaaaaaaaaaagagccttttcacatttatcctgaagatggagccatttaacattttggatactttctgatttttaaatttataactttaaattgactttgttttgagacattagtgtttcaggattttatttttccctaaaatatgattgcttcctaaccaacagaaggaagagtagtgtgaatatttggttatggtcatggacacctggggaccagcctgtgtccttgcccatatttccaaaggtcactcttttttttttttttttttttttttttggagacagagtgttgctctattccccaggctggagtacagtggtgagatctcggttcactgcaacctctgtctcccaggttcaagtgattctcctgcctcagcctcccaagtagctgggattacaggcacgcgccaccatgcctaactttttggtatttttagtatagatggggttttgccatgttgaccaggctggactcaaactcctgacctcgtgatctgcccacctcagcctcccaaagtgctgggataaggtcactctttcttgtttacctgtttctgcccatatctgtagactcagaaattatttactaagcatttctaaaatgtgtttagaattcccatcactgatggcttactatgaaggagagcatatttttaaagccatataaaagaaggaatgtgtttagttctgttactcttgtattaatcccttggttattgaatctagaatctttgagcccggatgatcctagagggtatctagtctaccttctcatctcgttcttcaagacttgtatttatgtagctagttgtcatggctggattaaaatatctgtgtttacttatgtaactctcaaaactcactttaattgatctttttagcaagggcctgtttttcacttgcaaatgaaggtgaagtaaatacagattggcattttctgtcctaaacagccaccagctcccatagctgaatactctcatataaggaagacaaaagcaacaacaaattaggggccaaaattccttacttagaagatgagttgtctcaattgggaaggatttaaaaaatatttgtataccactcaacaagccatctggagaccatcatgggctgaactcaggtgagacatcttgataaggtactggaagaacagctgtcttaccacagggagggtggatgtggaaagaaatctagaaacccaaatataacaaggagcccttaaagcagttgtgggcaactcctgcatgcttgagatgagcagtggagacgacagtggggctgtcttctccctttaactatccaacgccgagggtcccaggctctgtgatgatgatgtaggcaatttcttaagaacaagtattgtttttggtagctttactttctagaaggctggatctcagttctctctcccatatcacctgtgtccgcaggtggggagattgatgtttagagctaggtttatctgtataaaggaataattctgatcgtagaaaaactcgaagtactggagacctgaccccatgttgggactctctgatgccttgaacatagatcatcttctgggggctgggctgtagcatcaccctcatctcacagtctgaagtcctggcttggagccctactgggctcagagactgtggtccgcagcccactagtgttatcaatcccatcagcatggatgcctacagcaacaagaaccagaacacccaacagcacctgctgctgcctctccttctcctcttctttccccaccctttcctattattattgttgttattgttaatatttatacatctattggtataaggaaaattaggccaaaacttagtgtatcaagatcaaaacacattatctttcatagtttctgtgggttgagaatttgggagcagcgtagttgggtttcaccatttagtgtgataccagctgtagtattttgtagatgccctttataaagttaaggaagttctttctattcctcggttgtgagggtgtattttgtcatgaaagggtcttgacttttgtcaaattctttttctgcatctgttgagatgatcatatggtgtatgtcagggtttaaagttttttccatgtgtggctgcatttggtttgccagtatcttcttgaagatgtttgcatctatatttataaaatatgtagatctgcagtattctttccttttgattttttgtctggttttgatatgaggataacagtagtctcagatttcttcctcttctattcttttggaaggtatttcgaggtgttagtaataattcttctttgaaattttggtaaaattcaccagtagaggcactggggtctgggtttttctttatgtgaagttttttttgcctactaattcattctctttgcttggtataggcttattcagattttctatttcctcttgaaattttggtagtttgtgtctttccagaaatatttttttcattttatctaggttatctattatttttggcctaaaattgtccataagatacccttataatcctttctattctataaaattggtagtaatgtcccctctttaatttctgattttggtaatttgagttttctttttttttttcttggtcattctcgtctctctgtttcatttttgttgttattgtcattcttcttttttcttttttgagatggagtttcgctttgtcacccaggctggagtgcagtgttacgatctcggctcactgcaatctccacctcctgggttcaagtgattctcctgcctcagcctcctgagtagctgggattacaggcacccgccaccacacccagctaatttttgtgtttttagtagagatggggtttcaccgggttggccaggctggtctcgaactcctgacctcaagtaatctacctgcctcggcctcccaacatgctgggattacaggtgtgagccactgcacctggcctcttttgtttttaatcttcatttctgaaagtttttatattatctatatagcttaaagaccagccaaaaatcagctaagattgtgttcagacaccttgagcactaagaagtctcctgtcctctactgatgggtttgtgtgtatgtggaggtgtgcattgaaatttcaggccattttcaaatctttccaagtatttagactctactggttcctttggtatcacctctgcatctgcacactgcttcaggattaatctgaaatgtatgggctggtaaagtcattggctctctccagttttccatcactgagaatataatcacttctaccaataatgctgctggatatggtcacggccttctacctgaaaacacatgagctccttttggaccatggcaactgagctgccagtactcatagcctactctacccaggcagagcctttgtgttaactagggatgaagccctcatctagaataccaaagagtcccactgttcttgcctaaactccagtcgatttttggtgaatacttgttacattattggaattctttggttgatttttagagtgctgaaattttgggggggtcagttttgtccacaaggattattgctatttggagagaggaatgtctgacttcctcactcagccatagctggtagtcccaaatatttttcacgtgaacttgcatcctattagccaggaaagggcacaacgcattgggaaaacttgttttaaaacagtaaccgtagtctattcctgtggtgggggggaggagggtccccacatattcacattagaagtcttacgtgaagccattggggattttcctcaaactttacccacagcactatggttctacaggataagatcctgtcatctattagtgggtatggagaacattatgtgcatgcagttgacccacaaaatctcagtgatgccgtataattaagatgtatttcttcctttcatcatggtctgatgtgaattgggtctctctctggttgtaggttccttccagccgtggcaatatcatcttgcaacattttggctcagtttccatcgatggggatgccgagatcattggcaattacggaggatgtttccagaaagcattttatatcatttctgatcatactgtattagccagagttcagtcacatggtcccactaaaatacaaggaagactgggaaatgtagtattcctgtgtgcccagggaaaatacaaaagcaaacatttggtgaatatagtgcattctgtttgccactcattctttggagatcctatcacattattaagcttattctctgggaaagaaaattgggatgcagaaatcgtgaatgacttaagatgtgttgttttaagtaagttactggaagattaggaactggaaatatttattggcttctaatttagttttttcccccaattttactctgttctctctcactttcataaagtgttgcttcttaattgacataaataatacgacctaccacagccactttagaataagaatcattcctaattccaccagtttaagattaatgtatgcatgttttctttacagatgtacgtttatataatcaaacagctaatatgcatttgttttttattgtgtttgccaacacgcacatagtcttcatatgtctacattcttattgtaattactatttttattgccacataactttgtattgaattggtctaatatttacttaccccttcctcctattattagacatatagttgtttcaattcattttaacctatataacacattgtgattttaaatatgttttaaaatatatttttgcaacaaatgctgattaaattgcatattctgaccacctgtggacatttaggaacgctgtagttaaatagggtacctctaacttacatcctttatgctcttactgaaacatatgtgaatatagtatagtactatttttacataattcttttttaatgaaaatatttagcttgtgaagaatagaacacattctcaagagttgaatgaacctgttaatgtacttttatcagctttgtaatgcagtatttcattaaaatgtgtttatactaatttagtagtatggggcgaaggatgaaaagaaacccagaaatgtcagatcatatacattaattcactgacaaatgtttttgagtgtttactaagttccaggcagtcttttagaaactaaatatatagcatgaagaaaaatctttctctcaggaaatttgtgttctattgggtgtcaggtggcatgtgaggatacaatgtttgtattaaaaacaatgtattaatcgccatgaagaagaataataaaggtaaggagggctgggttcaatggcctacacctgtaatcccagcactttgggaggccaaggcgggcagatcaggaggtcaggagatcgagaccatcctgggtaacaaggtgaaaccctgtctctactaaaaatacaaaaaattagccaggtgcggtgccatactcctgtaatcccagctactctggaggctgaggcaggataatagcttgaactcgggaggtggaggttgcagtgagccgagatcgcgccattgtgctccagtctgggtgacagagcaaggctccatctaaaaaaattaaataaataaataaataaataaataaataaataaataaatgtaaggagaataggatatgttcgattgggtaagggatgctgttatatatgagagaggggtctgggaatacatctctgatgtgtaacatttgtgcagaaacatggaggtggtgaggaaaagattcacgtggatgtctagaagatcagaaagaaggaacggccggtgtaaagacacctggctgcagacttcttgtcatatccacagcaaggagtttagtgtggctggagcctggggtaggggagaaaaagagacaagagtggtaccacatgaggtgagtgttagctggggtagaagctaggaggggactggagcatgtagggctttgaaggtcatagtatggacctgggatttagctttgagcaggaaaagaagccattggaggatgtattagtccattttcacactgctggtaaagacatacctgagagtgggtcatttataaagaaaaaagtggtttaatggacttccagttccacatggctggggagaccgcacaatcgtgccagaaggcaaaaggcatgttttacatggtggcaggcaagagaaagagacaaaggaaagggatttccccttataaaaccatcctatctcatgagagttattcactaccatgaaaacagtatgggggaaactgcccccatgattcagttacctcccatccggcttctcccataacatatgggaattatgggaactacagttcaagatgagatttgggtggggacacagccaaaccatatcagaggatgttgagcacatgagcaacatgacatcatgcccatttaaaataaatactctggctgctgggtggagaataggtgtgggaaaggatggaaccagggaatccagaaggagacattacactcatgggggtgagaagtcgtggtaaatggaacagaacttgcaggtgtgagaagtggtcagagtttggatatatttccaaagcaaagactatatgatcgtatgcttaggtaatggtttgaacgtgagatgtgaaagagagagaggggtcagtgtttactatgggaatttttattattcttattattttagacagagtctcgctcttttgcccaggctggagtgcagtggtgcgatctcagttcactgcaacctccgcctcccgggttcaagcaattctcctgcctcaccgtctcgagtagctgggattacaggtggctgccaccatgcctggctcattttttttttttttgtatttttagtagagacggggtttcgccatgttggccaggatggccttgatctcttgacctcgtgatccacccgcctcagccttccaaagtgctgggattataggcatgagccaccgcttctggtctactacaggaatttaagcttgagcattcagaaaattgaagtgctagttccaagatggattgcaagagaagcagctgttcagggaaagagagagagaagaaggaagaggaattgcaggtttacacttgtgtgaattcggcatgaggtgcccattggatttccaaggagagatgtcaaggagacagctctgtgcgtctgtagaacaaggaagaggtttgatatggagatatagatttaggactttccttcttatggatggcattagacacctttagacaggaccagctcacatccttcaccatgtgcacaggctctaatatattcaacatttaaaaaaattaccctgtgactctatttcctctccatctgtcactctctttctctgatttcctttacaaaactctgaaataaaacttgtctatatttgctataatttcttttccttccattctctcttgaattcattccaacaaggcttccctcctgcccaccttcgaggtgatcttatcctgtttcaaggcgttcaataccgacaataagctgattatctccattttacaatgaagaaaccgaagttcagaggggttaaagccacttgagtattcaatagcagaactcaaaccagagccttgctttcctttcctatccccagcctgtctctttccactgcatccttgttcacgatgaaatcgtgtttgcaaacaagggcttggaaggtgatcagcgtgggtttaagtaccaatgtacacagagcatttaaaaaattcctcatagctaaatagaatataatatttcacccctatacacttgtgggtctaaattgttaatgtctgttttcttacaagaaataaaacttggagaaagactgtggacttgttccttaaaacactataatttcatgtaaatcattaaattttttaaaagtctgtgataatgacatggttgatgagcgtgagagtaggagacaggaggagagttggatcttctttccttgacatcctaaagaagaaggaagacaggaacctttcagagcatagcaacagggtgtgttaccctccttagagctaaggacaggcagacccacatcttctttcttacctaaatagctatgacttaaagtcaatcttgtactgctgtggcattattatttctctattctccttggatgtgtgtttcttgcaacggaagtaggaggattgtccagaggatttgaaaaatatttttttctgacatgattatatctgtatatgaattcatttttttggctgtgatctgtaaactcaacaaaacaatgccaaaaaaatcaaatgtggtgaagtgctttttttaactcctgggttcgtcatcatcagtctaaaactcagtcatttatagactgattcatgaagaaatatacaactgatgactctgggttagagtgttgttccaggggatgatttttctgtgcaagggaatttggagtgagtttgaagaaggagaggttatgaattagtaaagataaatagagaggatcatctgcatatggggaatgttccatgccgaggtgtgagcacaagaatgaatacattgttcataagggtctgtaaagatacttgcttggttagagagtagactgcagaaacagataactaagaatggagatggatatagtgaggagaggggcggggaggagtgtgaggtcagggaaaagaactggacattgccctagcttcacgttgaaagcagagatagggagagtgtggcttggtgtggaccatgccataggctgtatttggatggattatgggttagtgtgaggaaagactgaagtcaggaaacaagatggaagctccatagcaatgggcatgtctggagatgacgttgaccttgcctctaggaggggagcagtgaacatggcaacattggtgccaatggggagtgaaaaggagatggaagaagaggtcaatcctccatgtgggcagtattgggcatagcagaatatgcagagaatgtagggtcacactggtgaacaaaggcccccgagttgggagaaatctaatcttcgctcaatactctcgtggttcaagatcctcacaagtcattggatgtttctgaagctccattgatctctttatttgggtatatttatctgtgtatctagtcagtgatactgttgaactgtaatgatttgatatccatttggcatgtttttgagcatcagttatcatggaccagtagaggggatgcaacactatatcagagagacacttttatcgtagatgtatagttagaaagttattgtcatgcttggccctatcatacaaagccctgatgctttcatgggggaaacaggaaccctttggatgacctgtatcaggtcatagaaagcattctgccttctagggaagtgagttgggatgacgatcgatgttttcttggagagatgctttggtctaagccatgagaggaggaaagagtagaggagggatattttaagctaaggtgataacagcatgcacaacacccctagatgtgacgaggctgagaaactagaggaagggtcagggcagagataacagggataaaagattgggaatttaggcggaagtcagacagctcagcattttctaagcttttctaatgatggggaatttaagaattactgtaaccaaaaataactagctctcacaagtattgtgtaaggtgtctctggaaaacagattggagaagacccagctggaaccaaggatatcagttaggagattttcatattaatccaggctggagatcaggatacaggtggttccagtgggaactgagcaagtaggtagttttaatcaaaatttagaaggaaaaatgcaccttacttggtaactgcttggatttgatggcaaagtgggatgtagagagtgggagacggaggggcaggctaggataacattaacaaacgtttgccagacacccagagcaaagtcagctttcctctctggctctgatacgaatgtgaccattgttaactgtttggcacatgtgttaaccttagaatgttaccagtgttaactgttttgcacatgtgcgtgcatatgtgtgcacatgaatgtgtgtatttaatctcaactattcttattttgccatgaaattatttaacacacatgtgctgtgtgtatgtatatgtgtatacactcatccctcagtgtccacgaaggatcctcactaataccaaaattctggctttgtgggatccacgtatacaaaaagttttccctctatatttgtaagttttgcatcccatgaaaactgtatcttctatgtatgctcagttggataaaaaatccatatataagtaagcctgttcagttcaaactggcgtgatccaagggtcaatagtttacgtctacccacacattaactagtggctgtttcaaggaggcagactgagtgatttattttcatgcttccttcaattttttctaagtttttaccatgagaaaaaaaaaaattttctccagaagaccaagaaacaattagagctttgagaagaaatttatctgctgttattgattttgttttagccaaaaaaaaaaaaaaaaaaaggctaaacataaaatacagtgttcgtaaacctggctggcaacctttctctgatgttattgtctatttcagacaacgcaaagaggtgtatgaaaccagaaaccttcagctatgaggaaaacaaaataacaatcaatatattttgtttctgcttacattttctgctaactccttgtttcccagctaccagagagctgtcaacttcaggaattaaattaaaaagtataaagctgtgaatgaaaaaatcttggaagtaatgagactacactgaatgaagtggaggcgaaaaaatggaacacagtaaatgggcacctgtatcagtgtcatctttaaatgcaaatgaaaatgtcccaaaccttcctaccgctgatactttgaagcacatacagttcatttttagccaggtgtatcagttttgcattgccaaaagtagtagtggactaaaacaccagtctgcttttcttttattaagagatctgtaataagagaggttgaaagaaattttgcagtgccaaatgagactccaagtgcagtgcaagatgaagctagtcaattctgaaatatttgaacatgtttatttatctaaccctctatgaacctgggcacagatgctaagtcttccatgttttatgtggtttcagatgacctctgaaaattacctgtgccattctaaaccaccaaatggttccattttccatctgttgtcatgcaattgttttgcttaccagcagctgtcagatggatattacaatgaatgctttcatagcaaatgttacaacatcaaacataacaagcattgaggatgaagctgatggcacagggagatacagagagcttaccaaaggactggaaagggggccctggagtccgcatcaggacactgagtgccattcccggagtgcattcaagagtctagtgcgcgctggttcacaggtgtctctttttgccaactcatcataaactcctcagctgttaatgcagagtcgcttgctgcaacagtgacagagaactgttgggttgccggggctaattgctatttagctctttcagaagggttaaatgcattggttagcttgctgaaggtttgggagatagcttaggtgcgggagcactcaaaccacagggacgtggctgtcccacctgctctcgttgttgggggcattttaactcatcacctgatgctattggaagtagctataaaggacagctggtggttgcatttatttggagtcttaattcacctgttgtctctctccagttgtggttgaggttagaacactctgactcctagaattcgtacattccactaaacaagtaatatatgatattttttaaaaaaattattccatggatattttctccctttctgtggtttgtcttttcacatggttaaacatatattttgttgtgtagaagctttttcacttgatgtgatcccaattgtccatgtttgctttggttgcctgtgcttgaggggtattgctaaagaaaatctttgcccagactaatgtcctggagattttccccaatgttttcttgtagtagtttcatagtttgaggtcttagattgaaatttcagtgaaagagataaacattttgtgaagttatctatgtttgtatatgtgtgaattcaggtgtgcagttttattattttttgctcaaagtggaatactattttgattagtaccctcaaaccgaaatagtatttatgaagtccttagtgcatactcctgtgcttcaaattctgtagatgttcaataagtatttaaatcaatgaatgaatgaagggcagttatttgaatgactccattttggcttcatgtcttgtttggggatgttgagttcaaagttattacatccaaaccaacactaagtagtaatgttaggatgtgtcctatagacgttgttctgtatatagtatcaacagaattatgtagtgtcaggtatgtagcatccggggtcctacagcctatgtttgaatcctggctttatgcaacagactaggcaacctggaatggaatgaactacttagttttctaatcctgtgttgattatttcagaaaattaggataataaaaggacttactccataggattgttatgaagttgaatgagaaaaatcgacttaaatctttcagcactgcctgtaacatataagcacttgatatatcgtcgatggtactattattatttgcctaacattttgcttttggggaacacacagccaccaatttcccctctcagagatgccacttgacttagtctctgttggtcccacccttaaaattattgaaccacgtgctatcaggcatattgcagcaaaatatggtgctcagaatatcatggcttatgtattttatcttgctggcaaagaattctaaaaggtttaaagcttaaattagagcccacatttaaaccgagttgggagaaatgtaccatatgcctctccatcttgtgtgtggtgtgactgtaagtgagagtgaatgacaacacgccgggggctccagccaaaacttgaggccggcagtctaaatccagatcgggcagcctcccagcctctcccgattctgtctgcttgtgcatttgaccttgacagccaaggtctgtgtggttcctctttgctttctgtcattaatcagtcctgaagcatcttctagacagacagcttggttggattgaataatgcgtctgtggtttttttttttttttttcttcatctgatacaggcatgagttaaactacagtcgcctccattgctgaacttggctattgggctgggcagtattttcaagcggtgttttacctgaaaatgttctataaatgagttctgaatgttgtcttctccctgtcatagtgcctgtgattatgataacccacccttgtaagctttctcctatagcagaaattgttgccagaggaaggggagggatggcatgtcctttcactggcaagtgaggccagattttgactttgagtcactcttgagaatttagggggtggtcacatggtactgtgcaacaggaagtgatatttatcatgataagtgatgtttaccatgccccactttacaactgccgtgtatctcaaatgttatgagtataccactgaatgcattctttattggagagaaaaaaagttagcaccgtatagagaaatatatagttgctagaactgagaaagggtaagaaaacaagagtaatctgtaatttttttgttgcatggtccaaaaggcaatttctgttgcctttttatggtgatttggagtttttaagatgttttgacttatttaacaagctggaaactcatggcagagagaatgtttatgacttaccgaaaatcttatggaagttcaccacagagctttccttggaatgcaggtatcgagacttgattttcagaattttgcactagatttcctaacagaaacctcgtgatttgaaggggggagaatcatctctgcaattatgtcactgctaagctgacatagtaaccaaggggttagtatcagccttggaattctgtaaatatgtcttgggacaaagtggtatggaactacatctagtagattgaggaagaaggtcatggaattagaacatttctgttacttctaggcataattttcaggactaaggaattcagcatgagctgcatctgcctcctgctacctcctgctctctcccctgtatcaataactattaattctgtttccttccccatcgcaatttagtttggaagatgtcagtgctatttaacgcagcgagatctccccagcacacccctcgggaccagtccttgggtgttgggagggcattctaccctattatctgtagggtggctgtgcttgttctcatgccacatcaaaattggcattggtagctcgctaatgagtaggtagagatgggcttggcattttgtcttctgaaggaacggcagataagatgaataatgtcattcttagttctagttttgtctcttcttactgtctttatttgagcccctctacctccctcatttcttcttccttccctctccattttccccttccttcctcccaacacccccatacacatgcacagctcacacaccgttttacctatctcttaactgacagctttaataaggatggtcactaagcatcttcttataatttatgatagaaaatggtatgcaaacttcagagatacggtggtggagatccaagtttatatcttgagtctaccatgtaactctcaatatgtgctctagacgctctgtgtctgtttggttatctataaatcagcaatgataattgtactgacctcataaggttgttgggatgagtcagtaagattatgcatgtgaaatgcttagcacaggttgtcatgcactaaaagatttccgtaaacattgtttattatcattaataaaaagcatctttattgagatccatctcataagatgcaacaccaaagctaatatttcataacagacaagcactctttgagtgatatattatgtcgaaattcaattaaatgtcccaactcagtgtgttggaactggtagcctgaaaaagtcccattcatctgatggctgtgaaataatgagaatgtttatctttgttccatgaagaaatgtataattaaagcagtttgtgacgtacctcccgaagattcatctctaactctgtaatacatttagtgatttcaatgcaaatgaatcgtgttggtgaggcaatgtgttcatcctatgtccttatctgttctttgaaaacctcatccaaggctctggggactctcgcagcagattgaaaatccccttgctggcaacagctgattagactgaggagagacatgcatggggctggccaatcagattatctcttcgtgggagttaagaaatttgacacagccccagtgtccatattctttacatatatatacattatatatatatatatatatacattatatatatatactatatatatatatatatatatatatatatatataaaattcagtgagaaggttagtaggaaatgaactctaggaggacaagagttggatagacattatcatttactggctaagtgacctagagcaagtcacataaccctgggaacctcggtttcatcaatggcaaagcaaagatgctaataggggctacttttaaaaaataaagaataaacacaataaaacaggcaaagcattcagtgacttgggcagcagtgagtgtgcagtaaatgctaaacattttgaattgtattcagccttcatttttcagcctgatttttaccttgattctcacattgaaactgcccatttctttgggtattttgggtcttttcctgttttaccctccccactgggtttgtcactgcacatccctccttccttttgaaagctctgttcttccttcattctcctggtaaacttgccgagtctctgcctcattgttttctggctttttgcattgcctcatcttcctgtgttcacacctaagcgaagttgctctccaaggttctgacctccgcctcttggctttccattgtgttttctcatgggtgacctaattcacacaacatgcctctaagctgatgaagcctagaatctcattcctgtatactaactgcctcttggatgtgtcttcctggaactcacacattctaagtaagtggaattccacatctggtcatcatttcataccgttccttccctcatcctctctcagttgatggccctcaggtcctcagtttagaaacttgttgttcaggctctgcagctcccccatctcaacctgaggtcctgcattacctcctgaagagccacagaatccagcatttgccttattctcactgttctttgtgaccagttcacctctcacccaggctgctgcaacgagcttctaattggcatttcttctctttccccttcaaatccctcatgcttgaaaataaaaatttggtcatgcctttcccctgtttaagtgttttcaggattatgaccaagcttagtaacgtgacttgttcctctctgctctcaggaacactccttgtttctctctttcaagaacagcctatttacagttcagtgcacgtaatgagcctgtactcatttctctgtctttatgtatgctgctccctggacccaccccattcccttctactatcttggcctgaaaatgtctacttatcttctaactctcgattcagaggcagccttcctccaggcattctttccctgagtgccactggctctttgtctcattttctgggttagggtttcttacattcatgggcactccaaatactctatccctatacatctatcttgatgcataattgtaaatactgtttatctgtccattttcaactttacgtttcgtgtaccttcccttgagggcaagagctttatgtttatctctatccttagtgattaatatggtatgtcatgtgtactaggtgcttaatatctgagtgactactagaatgaatgagtgagtagatatgaatagttttcaagatttttaggaaaccaaccctatttaacttactctgtgatgaatcttttagttcattcttttttaattcatgaagtctgcattactctaggccagtttttccttgcccccaaatctttcagatacggaatcagagaaacataagatgttagggttcacagttttgcaaaatgctgatgtaaaatacccaggagcaaacagatggcttaagaaaggtattaatcatacgacatattttcctttataaaatgccttcttacctaccgcctttttatccccattataggttttctttcatcttggcaatgtttagagtccgccatcttgccttgtaagccagtcttattatagcatttgtgctgtgcctccattttaactcttgacttttgttgctcccaccacacgttccttaaaagtcaatcaggagtttatgtatctttccgtcttctggactgagaaaaatttatggcctttagtagatgctcgttaggtttgtagaatgggccgggcgcagtggctcatgcctgtaattccaggactttgagaggccaaggcgggccaatcacctgaggtcgggatttcgagaccagcctgaccaacatggagaaaccccatgtctactaaaaatacaaaaaattagccaggcgtggtggcacgtgcctgtagtcccagctacttgggaggctgaggcaggagaatcacttgaacccgggtggtggaggttgcagtgagccgagattgcaccattgcactccagcctgggaaacaagggagaaactctgtctttaaaaaagaaaaaaaaaaaaaggtttgtagaatggatatgtgctctctctgaggtcatggggtgagcagggatgccaaaatatgcttactttgagtcacggaagcagtagccatttaagagccttcaaagggccagattgagtttatgtgatttaggaatcatgatcctaacacatctccagaaagagataaacgggcttgagaagaagcagagccatgctgggaaatagattgggtggaatttaaatagaagtctggatttgaagtaagaatcataaagactaggagtacttgtaatattcataataaaaataaatcctatgagaaccattaattaccatacacagtatgcttactatgggcctggtactgggtcaagtgctttgcattcattctcacttagtgcttcaaatagttctacaagttaggcttcattgtctcccttttcagatgcagaaactgaggcctcaaagagttaattcagccatttaaggtaacaaagctaccaggagtttgaattcaggattcctaagctcgtgctttttttacccctgcaccagaggaagttgtgtgcaggtctctgcatctgtcaagttactggatatgttattttgagcgagtgacctaacagggcttcagtttcatcatctatgaaattgacaggataacattatctttcagattttttgtaggtaatttaaataatttgcagaaaacgtttaacacattgcatgggatacagtagacaataaatctggacttttattaacgataaataattagcttcccattctgaaatatttcaatatggatgcgtggctgcgacttaaaaagccaaatccaccccccaaatgtgaattattgcctaactcggtccctgaaactggaaatagagaaataacatgcaattccagcagtatcaacattattattttcatttttttcctgatgctgtcagcttgttatttgtgctatttctttgaataatagaatttattcaggcaatttatccttaatacaagcgatataaatggggctatgcaatccttatatatcatgctaataatgtctggttcatcttttttttttttctccctgtttacatatggagacattgatttcctactccgtcctgtcttttattacattttctgcatcgaggtcatctctgtccgctgcctacactggattccagtagctgaagttgtgtaacatcattcagtgacattcttaaagcatctactatgtgctttcttcaaaaatgtgtgtattagagtggaataaaaaagaagaaagacatatataattgctgtcctcagatatatgttaaatccattagttaaaaatgtccacctagccagtgatttaaggacaaatagaaagctttatattgggaggttctgaaatagtgtcagttaaatgcatgcatgtcaccagaggctgtggatactatgcatacgtcttatttcttcttcctctgcaccctccctctggtggcccccaagcatctcttggtgactccccaaactgagatttctagttccagtgtttttctttttttttccaagcttgagactcatattttatcatccgtatctcccactgacccctggacacccttcattcgttgtgtctcaaactgaaatcaatacccctccaccccatccgcaatctgcaccatggtgaatcacatgtggtttcagcttacccatgttggggacctgcaagccaacactgggttgcttgttctatcatccctgctccacctgagcacaattaatggttaattcccatcaactaacttctctataatttcttgaactcaacctggtgcttctgtttcccgcaaagacaaaaccagataataggaacagtagaggaccaggatcacctgtttggtgcacaatgagtttctttttttttttttaatttttatttaagattcaggggttcatatgttgttttcttatatagataaagtcatgtcatggggattcgttgtacagattattgcgtcacccaggtattaagcccggtatccaataattatttttttctgctcctctccctcctcccaccctccatcctccaccctcaagtaggactcagtgtctgttgttcccttcgtgtccatgagtttccatcatttagcttccacttgtaagtgagaaaaagtggcatttggttttctgtccctgcattagtttgctaaagacgatggcctctatctacatccatgttgctgcaaaggacatgctttcatttgtggcttttctaacacattggaccaaaaggtctttaatctctttcataataatggcattgaattaactaatacttacctgacgcagataatttaacttgtctacatattcacctggtcctgtgcatttcagacttttgggggaaggatgaggggggtgacaggtgagttctcatcatttggcagccacttataagtgaaaacacaaggatgatttttatcatgcttcagacagaccttctgaggttagcgccaagacaagggtattgaatgtgcacacagaaaaagaaaagctaatttgagtagataaaaaggagaaagaatcagcaagacttgatgacaagatacattcaagggaataacacataggcaggaatgctctctaaacataatcagcatattacatgttttgtctatgactttgtgaatgaagcccacgggagaccttcttaaagaaaataaagagggagactctttttaagatgttaaaatagaggacaatgaatgcttttgcgatgagttatctctgtggaactgtgtgaccttgagcatgtcagtaacctctgtgggacttaattcatcttctgaaaacaagagattggattagataattcctaacattccatgcttttaaatagacttttatgattaggaatttggcaggtagaggggtggaagcataacatttaaaagttggtggtgattgagtcgagttagaagtgggttgaattatttttggaactaaagtgtacccttgctgaaatatagaataataatgagtctagtattaatatagcctggcttaagtataatactaatataaacaaaattatattgagggaaaatgatgtttatagagtacaccatcaagatgagctctagaaaaaggaaactaaaccttctctaaacaggtttttttttccctatcatccgcttctttttacattatcattatgttttccaggctggcagatgaatatcaaatctgcttttgactgaacattttttaaatctctctgatagaatatatatattttttcatttatgaaaagcaaataggtcacgtgttttctcttctgcagcaaagaaatatagcaaaagtttctatgctccgttccattttcttattgaaaaaaatatttaatataaatgaaaaatattcatttactttttgaacaaagtttcatcacagatctcttactcgggagtaaatactggttaaaacaagctaaatgcacattcttaataatttaaagtcagagaaccagccatgtgtaaaataggtgtatgttcacataattgactacagtattttgctacatggttaaatgcatgatttcccctaatagaatgccattgtggtctacatcacattttctagttcatgaaagtcaaatgagctgtgaccatagtctcccaaacttaatgggaagttcattttgtgacttctgagtttaaattgtgtctttccaggatgaatcagtagatctaaagcacattaatggatcacgtcaccaaaaggtctaatcctgagtgactaaaatggtagttctaattcagatttagtgcttttctagcacattggaccaaaggtctttaatctgtttaataatatattggttttgtattaactaaataatacttacctgatgcagataatttaagttgtctacatattcacctggtaccgtgcatttcaaacttctttggggagagatgagggggtagcagatgagttttatctgtgaaaaccagtaaagaagtagaactttatagacaggggctcacagtatatatttttaaaaatctgtatgggatgcttgttagcacaacaaatttacacactgctctgccaacactctcagccacagctacctatcagaaggttatgaagactagaagaaaaacacataagttatgtcctggactgtgcgaacactcatgagcacagccagaaactacagctggatgttcaccgacagccagctatccaaggtttttgaccttggacaatgagcaggggttgatggagatagccaggcctagagatggcaccatttggaagatacaaatggagatgtctagagggtgctggcagtaagcttctgcaaggaccccattggaaagggagccaaattgtttctgttatctcagggaacaccttgattctgaaagacagtgagagagcataaggctacctaagacttctggaaagatgaatacaactattaatatcagagctgcggcctcaagaacagccgggattctccctaatgacaagagggtggacggtctctctgcatccctttcctcaagccttttgttcaacgcttttcattgtatgccccgaaagagagcagttttaagcatctgcgatgtagtagggtcacctgatgtgagtgagagagagagagagagaaagagagaaatgaaatcaaatggtgtgggtgattccagttgccttcttgttagcaagagtgtataccatcagttttgcgataacacaacatatgtgttcctaaaaatcaccactctgtgtaaaatcacacaatataaaccatgggacttaaggggaaaatgggattaaaagcaccacactaaaaagtttcatcagtgacacatttaaaaaaatacagttttacacacgttaaatgattaagaaatacataaatactacaggagagataaccctttaccttgaagaagttcacaagtttgcttggggaaggacacgtctgaagggttgtgtcttgtgtgttattgtgatgggatagacaaggggacttacctgaaaccagatggtaaatggtaacaccagatgtgggtgggtatgactcaggaacacatgctgtgaattgacgtagcaggtaagtgtttgaggtgtgtgcttgtgtgtgtgtatttgtgtatttttatgcagctcatttttgctggatagagttttcggtgttaacttagtgaggtttttttttttttttaagtgaaatcgagcatgagcaaatgtgaaatccgcattatgctcaaatcgttccctagtttttttagctcccacatatgagtgagaacatgtgatatttgtctttctgtgtctggcttatttcgcttaacataatgtccctccagttccacccatgttgttgcaaatgacaggatttcattctttgtgtagctgaataatattccattgtatctatggtaccacagtggctttcttcattcctccgttagtggacatgaaggtggcttccattccttggctattgtgagcagtgctgcaatgaacatagaggtgcagacctcttctttataagggttttcttttctttgggagagagccagcagaaggattgctggatcatatggtagttttatttttagttttccgaggaacctccatactgttccccagagtggctatactaatttgcattctcaacaacagcgtataaggattcccctttctccacatcctggccagtattcattattggacttacagagatagagtggaatgatggttgccagaggctgagaagggtagcccggagtggggagagattggggatggttaatgggtgtaaaaatacagttgatagaatgaatgaggtctaatgtttggtgtcataatagggtgagtatagttaactatattttagtgtattttctaaaataactaaaagagtggaattagaatgttcctaacacaaagaaatggtaaacgcttgaggtgatggataccccagttaccttaatttgatccttacacattgcctgcctgtatcaaaacatcacatgtaccccgtacatatgtacatctattttgtgtccatgataattaaaaataaagaaaatttttaaaattgttccatactctgtcaactcatggacatacatttgcatgttcaaaacaagcattatggaattgactacaacttagagcatgagatggggcataaatattgagggtcccctaggtcaactcaggtccccattgtgaacatgtcagagtattggaagagaccacagttcccctctaccttgaatgcaaaccagccccttcatcatgtgcccaactgcattaaaaacaaaacaaaacaaacaaaaaaacataccttgagttgggagaaacacatagctatgtcagatcattaaccagtttctaacggagcaacttcctagggaagggtatgtttgaatccactggatgtttttgctttacacatttatttagagcctaattttcacatggctgtgtctctactgttctcttatctcaggtatcgatgccctgagataacttcattccaacaatcaaaacttgtctaggaagacctgattgctctgagagatttgccttgtgatttgatcatttcttgccatccccattgactggcgatcttcatggcagctttaaaggtgctttgaggttattcaatccatcttctttcttttagaaaggaggacaccgaggcttggagggaaaaaaagacttcactcaagaacttaagacaaaggctgtttcacagataactcatgcacctctagagttttcttatggaaatgcttaacagtatccctgttgggtcagtttctttcttttatgctgaaaaaaaaatcactttattgaggtataattggtattaaaaagctgtagatgtttaacgtatacagcttgataaattcggaggtaactatacatccaggaaaccatcaccataatcaatgctgtatatttgtatttatccatcacctccaaaagcctcctcccacgttctttatgtaatttattttttagtattgatttttcttttcattttgtttctgagacaggatctcattctgttgcccaggctggagtgcagtggcacaatcagagctcacggcagctcaaatattcctcctgcctcagcctcccaagtagctgggactacaggtgcatgccaccatgcctggataatttttcatatttttttgtagagatggggttctcactttgttgccaaggctggtcttgaaatcctgggttcaagtgatcctcctgcttcagcttcccagagtgctgagattataggtgtgagccaccgtgcccagcttaatgttgattttccttttgtggtaagagcacttgaaaaaaaaaatccagcctcatagcaaatttttaagtctacaacacagtataattaaccataggccttacattatacaggagttctccagagcttattgcattactggagctttgtaccctttgactgacacttctgtacttcccccttctccaacccatggcaaccacggttgtactttgtggttctgtgagttttgatgatttcagattcctcctaataatgggatcatgtagtatttgtccttctgtgtctggcttatttcattcagcattatgacctctgggtctgtccaagtaaatccaaaaaggatttacttcctttttaagactgagtaatatcactgcatgtatgccattttctttatccattcattgttgatggacatttatgttgtttccatatattggctattgtgaatagcggtgcaatgaacatggaaatgcatatatctcatggagattctgacttcagttcccttagatacataccatcatgggaatgcaatcaaaaccacaacaggaggtcaccgcacacttattgggagggctgttatagaaacaaacaaaccccccaaacagatgataacaagcgttggtgaagatgtggaaagaagtgaacccttgtctcttgtgtgttcatagaaacataaattggtgcagccacaatggaaagcagtttggaggtggctcaaaaacttaaaaatagaaatacatctgatgcagcagtctcacttctgggtctgcttctttcatctattgtgtatctcaaggcaaagcaacctgcctatgcctgatccctgcatacacaaacacagagaaatcatattaactctcaacctgttggtggctctgccagttctgttttgtttctttttttttttttttcgtgaatgactaacaatctaccatcagaaatgacattcataaaattatttctttctacagttatttctttgtttcttttcatctctaaacatgtcttattaagtacagggtggggagaacacagttattcctattaccactgatgttgttgatactcaactttggaatcttcccttttcctcccctaccctcacctcatctttcaccaaattcttcacaaggagagttttacaagctttaaactgcttccattttacagtggggaaaatgggaatacaaaatttggacatggattggtaatttcatgagtcaatgttgcgacaagattgacagcagcttctgtgaccactcatccagatgtattactgaaaacatgagggtgcaatgttgtggggaatccacctttgttatgtttttttctagaagggcctagaagcttctgaacttgctaggcacttgggagaaaattgattaaataaaaataatgaaatccatcccaccaacaaaaatagactgaattattgtttaacagaaattggaactaatgttctagggaggttatttgaacccaggcatagaagtgggagcatcatgatggtcagggaagaaagcaggtgacattagagactaatttgtaggcacatatacagtgtccttaaaatgagccatttatggggtaaagaaaagctgatcaaattgagatattttagaaagtatgcagtgtgaaggggttgatttctttataatgtttttaattgagttggatgaccttattgacaatggatgccttttgtcagcacgttgtgtgtgtgtgcctgcatgtgtgttcctcataaacccgtagctttctgcaaaaagggcattccaaaagaaagaggtgaaagaaaaatgcataaatgcacgataacacacgattaagttttgaccccatagattgttaaccttcaaagctaactctgcagtagcacaatattattagcaataaaaggaatttgctttgcccttttttaaattaccataaaccgattgactgagacagaatgatgttaatatttaagaagtaggacactagattctattatctcagaagctctgtcaccaggccctctctgtagtcctgttatctaattattgggcttaaattgcattagtgtgctagcaatttgtctaccattggaaaagtaattgacatttgggttactgcttcatatatgggagacttgctagctagttccgaagagtcctcttctgtcagggcagattagcttaatgttgcctagaagaaagggaagctctgtgttttaaggtatgctgcctctgtagctggttgcaatttggtattaaaatttcagttctgcatcaaagctgataagtcacctgagatgaaattgaacaaggttgtcgtgacaaagtaattaatggcattttttgactttcagatgactttaggggaagcacacttcttctctgcgtctgcttctgctgccatgtttataaatatgtatgcacatttacaaaacatctttaactgttgtcagatgtttctgcaggctccagatttatggttcccctgaattaaatagcaccaggtacatttggtgtacagcagtgatctggcattgacggtaaaggctgtgagtcttcataatatttcaatcatattttgcttctcctgacaccacacatcactgataggcactctctcttttttctatttctttgtataaaaatggaaagtggtgtgtttggttattctatttctagactttttttctgctcaactggttttggtttgtttaagagaagactttaagtacattcacaaatattttgcatttccctttgaacaagagcctacgagatcatacttttttttttttttttttggctatgtggagagcgtacctggaaaacagatgattttgatgtttttgatagccagtgcacctgaaagtcacaggcttctttcacttagatctggagtatatgtattctagggtcatctaaagagcagaacatagagatagccagccactattttctttaatgtgcaaactgaagatgaggctgaaaagtattcagaaattgattttaaaagttgatgtttctgtcttttaaggcacaggtcaaatctgactcaggaagaaaacttcttactatgatttgagcctcctctcttgcctctctcccctggctcactttagcgttcttggcttcctttcagttctatgggcaagccaggctctttcccgctgccaggacgttgtgtgtgctgttcctgttacctgggccgctctttcctgcttactttgccaagctagttacctcctatccttcaggaatctgctgaagcatcatgtccttagaggtctggttacttcctgctctgctccagttgttctcaatctcagtgtgattgcttccttctcaattcttgctatgataaacaactaatgtatttactcattttttgtcatccgctttcctcaccaaaacacaggctccctgatggcagaggtatcatctgtcctccttgtccctatatctccaggagctggcgatattaaatgttcaatgtttgttgaatatattaaattaaacctttcccaaatttccaccacaatacattttttaacttttcattttgaaataattatacactcatcagaagttgcaaagataatacaaatgagtcccatatactcatcacccagcttcccctgttgtaacctcttacatcagactagcacaatattaataccagaaggtgcagcaggctctccctcccttttactttaatggtgggtgatttcaacaggcaactgttatttgcttaatgtaatccttcgctattttatattttgggacattttatctccccttttctgatgcttccttcaaggacaacatcagctttttcagcacatggtgagcaccttgtaatacacttaattcttaagatagtgaactggaatgtgatcagaaagctactttttttttttttcaggtgcacttgcttaaaaaaaaattaaaaggtaaacagtctcaagttttatttggagttgctgagaagtttacccagcacacattttagctatgaccccctgcattcctgccaagcaggctcctgacttgggtcacccatgacagtgatcaaaattaaccctgctgctgctggactctttcgtttccctgtcttttccctttagctttctagtgctgttagtggcttctgagactctccttgttcagtgaagcattttgcataaggcacactttatcttttatctccaaagaaatggcagttaatgcaatctatagaaagccataaatgaggctgataaaattatctagcagccaaaaggttgctgcactcatttatctctgcataattcagaagctaaacgacaagattaggaagaggcaatccgtttgacagaggtgttactggaatgatgaaaatcaaggtggtttttgttttttccctcttacattttgtggggaggtggttaagagagggctgaagaagaagagattcaaggagaactcggtttctaaaatttttctcttgggcccaaaacatacctaagaaacagattgccatatattaatttaattatttgcctattgaataataatgcccttcccatttgatgtgcagattgtagaaaggtgacagtagacattttattttattttatttattttttgagacagggcctcactctgtcactcaggctggagtgcagtggtgcgcatgtaagtaactgtagcctcaaagccctgggctcaggggatcctcctacctcagcctgttgcgtagctgggactacagatgtatggcaccacatccagctaattaaaaaaaaatttttttcagagacagcctgttgcctaggctgagtgatgaaattttaaaatgtgactccaaattatcggtttacttcagaattttttttaacattagggagatgttgtagtgattaatctcccttaaaatttttatgtgtgtatatgtgtatatatgtgtgtgtatacatatatatgtgtatatatatgtgtgtatatatatagtctggcggtcaacagttcctttaatttctctgcataaaaactaaatgatagtatataatgaagtgtaacattataattatatatgttatgttttatataatgtagagtatgatccattttttgtaaaactataagtttaaaaaaatactgattactgataatgagtgatacatatttctgggtgatgggatatggaatttttttttaacttttgctttatacatgtgtgctttgtttaatttttttgttgaaagcaaacacctattgcattgagggaatatattacaatcattgggaagagtattttgtcaggggtagaagccgtttatttattcattcagcaagcatgtgcttagtgtaaggtgtgtctgaagttgagtagacatttagtggagggtaagcccaaagagtccctgcccctttggaggtcaaggctttgtctgtccccatctgggaacagggactcttacagacacaattctctcccctttatcttacaaagtgcctgatgtagatcaatcaacccatgtccgctgacggtgttgtgaagaaatacgtagcgctgcacagtggccatgttttaatcgttctgcaatttagaaattcaaatgaatggccactgctttaaagagtcagaaccttccatatttaaaaaaaaatatgcatttctggttcttcttggaaaattggagtctggccaaacactgcattcccttcctatcaaggcaaggattgatgtgaagtagtggcttctgtcttcgcatgaggtatagcctatgtggttttccccagtccccaccacttcctagagtgttccccctacaaggaggctaagtatctgtttatcttcaggccatatattgtgttacacttgctcacttcccccattttttttttgtgacccaactgggtctttgaagcatttatgctttttgtcctgtatcttacaaccttgaaggataattttgaaaatgtttgtgttataaaattggaaactttgcactgttttgagaagaggagaggacaacatagaaagcaggacaaacctgtgacaggagaagtctcagcatttactttaaaggtgaaatctgagcccttactcctcaagtagggagtttggttggtgtgaagctgctggagaatgtgaaggcatcttcacaaacaagcaaaacaccagggaagaggggccacgttttgtggaattaacctaacttttcagctgtctttagcagttggggttacattatgttcccctgggttgtgtgtgtttcttctgcatcaggagagatccctgcccaccttcagagaaacttaataataaacaaagaatgtacatccaaacttccaaacttccttgttaatccgtctatttccttagttgaggttgagcttaatgccgtctcatctaatacacgtaacctctccggtatcaggggccaaggccaagcaggcaatttgcagataaagtcaaacataattaagcagtaaaaactctgaccatacaggtggaatgaatgaatccaccaattgtgatcctgccaccatcctcctgccctaaaactcaacttgcttttctcctgagaccttctgaatagcaggaaagctaagcacagactgtctgatcttcagaaagggaggggcaagccattgtcactggatgattgaattattccttgtctggaagcaggtcgtgaaccagatgatgtctcaggttcttccagcctgagaggttttagctgcttgtcctacagtgaggcagagggaatcgatagaaacatggtatgaaggtctatgctcagtttcttattagtttcattgcttaattcctgcttaagcatctgctgctattattggtgacaagagcttgtatttctgtctctagactttttgtttgtttttttactttaaaagattttatatttcttctccatctaggaacatgacaaagttagaaatcttacaaaggggccaggcatgatggctcatgcctgtagtcacagcactttgggaggctgagaccggtggatcacctgaggtcaggagttcgagaccagcctggccaacatggtgaaaccccatctctaccaaaaatacaaaacttagctaggcatggtggtgggcgcctttaatcccagctacttgggaggctgaggcaggagaatcaactgcacccaggaggtagaaattgcagtaagctgagatcacgcattgcattccggcctgggtgacaagagtgcaattctgtctgaaaaaaaaaaacaaaaaaacaaaaaaacaaaaaaaaaaaacaccaaaaaaaaaaaaaaaaagagaaaggaaggaaggaaagaaggaaggggaaagaaaggaaaggaaggaagaaagaaatcttacaaagggatcagacacagtggctcactcctataatcccagcactttaagaagctgagacaagaggatcacttgagcccaggagtttgagaccaggctgggtaatgtagcgagaccctgtctctacaaaaaattagctgggtgagatggtgcatgtctgtggtcccaactacttggtaggctgagctgggaggatcacttgaaccctggaaggttgaggctgcattgagctgtgattgtgccactgcactccagtgcctgggtgacacagtgagactccctctcaacaaaaaaaaagaaaagaaaagaaaagaaaaaaattaaaaaaggaatcttatgaagatctcgtaataatgcctgattcttcaaagacatgggcacagacttgtcagctccaggcagtccttaagtgaacggtgcaatagccctagaggtgtcagctcagctgataccactttctcttaggaaaacacaaggtctttttttgtgttttctttgagggggccttgcattccaagtgtgcagttgagaaactgaacgttacaggatcagctgaaccaagtagagggaagaaaccctttggttttgacactgaagaaaacacacatagcactggggcaaactactgatggaaaacatcaagaaagatcttagacccttactccaggggatgtggcctaacggcagactggacagtaaccatgagacagagtgtttttgcttccatgagacagagtgttttcttcttctttttttttttttttggttagtgcctgaaatctagttaacttttttttttttttttttgggatggagtctcgctttgtcgcccaggctggagggcagtggcacgatctccgctcactgcaagctccacctcctgggttcatgccattcttctacctcagcctcccaggtagctgagactacaggtgcccaccaccacacccggctaattttttgtacatttagtagagacagggtttcttcgtgttagccaggatggtcttgatctcctgaccacgtgatccacccgcctctgcctcccaaagtgctgggattacaggcgtgagccacctcgcccagccaatctagttaactcttggtcttctacatgtgttagaatggttttagctttattgacagaaaatttgaataagggtagcttcagcaatatgtcaggtccccgtttgtaaagcaagctgagagaagtacctcttttctctctaggtatggcctttcctatctttgagtttaggatagctattaaaaatggaaagttacactgggtcttgtaattgtgcttctaagaattgattttgtacataaatgtgaaacctatcaaataaataacattccatccacttaaaggaatacatcttttatttatttatttatttatttatttatttatttatttatttatttttaacagagtctcgctctgtcactcaggctggagtgaagtggcatggtctcagctcactgcaacctctgcctcccaggttcaagtaattctcatgtctcagcctccagagtagctaggattacaggcacacagcgccatgcctggctaagtttttgtatttttcttttttagtagagatggagttttgccatgttggccaggctagtcttgaactcttggcctcaagtgatctgccaacctcggcctcccaatgtgttgagattacaggtatgagccactgtcctcggccaatatgctgttaagaatgaaacaaaaatctttatatggtattgacgttgaaaaatacctaatatacattgttaattggtgaaaaaagttgtataatagtatatatactatgattacttttatgtaaaagaattgtatatagacacatttgtataggtaacatactatatatttttaaaatatgcaatacatatgctatacaatatttaaaattacagataggtacacatatatgtgtatgtatgcatttataaagcatatatccacggctgggtgttttggctcacccctgtaatcccagcactttgggaggccgaggtgggcagatcacttgaggtcaggagatcaagaccatcctggctaatatggtgaaaccctgtctctactaaaaatacaaaaaattagttgggcatggtggtgggcgcctgtagtcccagctacttgggaggctgaggctggagaatggcgtgaacccgggaggtggagcttgcagtgagctgagatcgtgccactgcactccagcctgggtgacagagtgagagtctgtcaaaaaaacaaacaaacaaacaaacaaaaaaaaaacccactaatatgataatggagtaatctgcgtttttataattgaagatttccatagataagacatactctttaattttttctccaagacatatgtaccctatttgtaacctgaaaaaggtaagaagaagagaccaatagtaaaaaaaagtctgttattaacgaagaattgaagggccacctacttagaatagtcgttttacataaagaggcagacctgaacggccttttcccttaataagtgaagtatgttaattttatattcactgttgtggtcacctggagacatccctgcgttgtaaccttgtaggcttttaaaaagttaagtcacatcttctgtgccaaaaagtacctcattttgaactaaaaccttcaaaatggaagtcttgttattgagtttgatgtctatttattgctatatatttgcatttaaatacagaaactatatatttttttcttttttatgacccagtgtgtctttggggatagctttatgagctctttcttgaacgcttaattatttctttctaggtggctttgtcataggctgtcatgcttcattgaggtatcagctcagctgatctgttccactttctcttaggaaaggcaccattttggggccttcagtgggtaacagatttctgaagcttctcttagccccattctggcaacactgggctgatttacaaccggcaatatggaaaacctcctagacagctgcctcagctgcatttgaactactgcctgagagtctctggctgccttgacactctaacagaccctggcggcaaggcaggtaccgccttctgctatgctgctgatcattgctgaaaagttgcgtaagtcatgccaattgtttataacatgtatttaagccgtgtatgaacctgggagtcatgagtctgtgctcttatttcaatgtaataaagagaagaagaaatactggatggtttaaatcattctgtgcttaagagcaaagctgagaaccaccccaacttgtatccctctccatccctttgtctactgagcgaaagcgcattcaccatgctcagtctctcactctaagccagggttctcaacctcatcactgttgacatttggaactggacagttctttgttatgggaggggatggggtcaggggatgtcccatgaattattggatgcttagcagcatcccagctctctacactctagatgccagtacaacccactctcctaatcatgagaaccaaaatggctctagatattgacaaatgtcccctgggaagcataatcacctctgcttgagaatcactgctctgtcagatgtcccacccatctctcatactcaaataagtgtttctttcactccaagagcatgagtgggtgccttgttcctagttcctcaaatgagacaaacccgttgtcattgagacgttgcatgtgtacctctctccttctctcccactgtctccatctctctcatgtttcccttcttgtacccaccagccctacattgatgtcttgttcttcagaatctttaatatgctagtatgcattaggaatctccaaggatgaaagagtaggagggagagggagaaggagagagagagggggagagggagaaggggagatggagaaagagagtgagggagaaagagtgagagtgagagggagagggacaggaagagagggagtggggagagggagagagggagaaggacagagaaggtgagagggagagcgacagggagaaaaggagagggggagagggagacagggagagagggaaaagtggagaggaagagagggagatggggagaaggagacagggagagggggagagggaggggggagaggcaaagtgggagaaggagggagaaggtgagagggagaaggagagggagaaagacagggagagggagagggacagggagagagggagaaggagagagggagaaggggagagggagaaggaaagggggagagggaaagagggagaaggagagagggagaaggagagggagaaggagaaggggagagagaaggagagagagagagagggagaaggggagggagagggagagggacagggagagggggagagggggagagggggagggggacagggaaagagaaagaaggagggagaaggcgaggggagaaggagagggagtgggaccgggagagaaggagagggggagagggagagggagagggacagggagagagggagagagggagagggagaaggagggagaaggagagaggaagagggacagggaaagagggagaaggggagaggtaaaaggaaatggagagggagaggggagaaggagagggagagggacggggagatggggagagagaaggagaggagaaggagagggagaggagtagaggggaagagagaaggagaagagaagaaggagagggagagggacagtgagagagggagagggggagagagaaggagaggaggataaggagagggagagggggagagacaaagaggggaagaaggagagggaagggagagagagaagggcagagggagagagggaaaaggagagggagagggagagagggagaggtagagagagacagagaggggagggggagaaggaaagggagagggacagggagagaaggagaaggggagagcaggagagacagaagaaaacaggcagagagggaggaggagagggagagggacagggagagaaggagagaaaggaagagagggagagggggagagggagagaaggagacagagtgtgcatgcccatatttttttctgagtttgtttatttcccatgaacgctcccccaaatcccttgggactagcagttgtaaacacaccattgagaacattgcattcctttcttttcttctagatacttttcctccattaaccttgtctttttccttcctgtagatttttgcagcacattttgtctctccctcccttatggattgtttatcctgggtgatgatctgtgggcacatctcattccctaggtgcacacagctcttcgaaagcaagtattctgtggtatttaacccagcctgttttcttacatggagaaaggactgcataaacatcccaatgggttgaatgtgtttataacccagtatgaatcaactcgccacatgcccactgaaaggatccacaagatggttgcagtggagtaaaaggcagtgataactctctaactgggaagatcacagccgtaaaaagaatgagatcatgtcctttgcagggacatggatggagctggagtccattgtccttagcaaactaacacaggaactgaaaaccaaatactgcatgttctcgcttgtaagagagagttaaatgataagaacacatgggcacatggaggggaataacgcacaccggggccttttggagggtggggagttggaagagggagagcatcatgaaaaataactaatgggtactgggcttaatacctgggtgctgaaataatctgaacaacaaccccccatgacacaagtttacctatggaacaaacctgcacatatacccctgaacgtaaaataaaagtataaaaaccccatacagattttaaccatctactagacagaggtgatttcttttattaggctgtattccctctgggtcctcacagagaaacaggcatgagaccatcacgatggctgaaagaacagattctagttaatagttttgccttttgccaacaccattagctccccctcttaatccgaactgctgtatcgctgaagagagtgaccctctgtatttggcttgattttgttgtcctgagtagcctctgctagaaatatccacaagccacagcttcagccttcgagtgagcaaaagcaaagtatccaacaaactcaaatggtaactcaatcctgaaatgctgtaactttgatttgtattttccttctttctttattttttattttttcgcttagacagatatccccttctagctgtgctctctgatcccacttttgtttgtctctttatttcctctgcctactctgcctgaaaactaaaaagcaaattcttttatttctcacgtatatgcctccgaatgatttattttttaaaatgcagcttcacttgaatgttgactttttgaaaactttccctatttcactttttttttttccgctctcccttggaagctcttctttgataatcaggctggtcttctgttctttctacttttcttctgatcgttcaccttttgcccacttaaactgaagccctttggtgtatgcttggaatttcggcagttcaagttcaaaagaaagccctcttcaggtaacctgttctgacatatccgcatcttaacacaaagctttgctagattaatgggttggctaaaaacgtctctttgcttcagtcatagtcacctctgtgtatgagggtagcctcgtgtctattcatttaggggattcttttttttttttttttttgtagaattcgtctgaatctagaagcaaatgttattttattgaatgtcccactttcagagatatatttgagaacaaaaatgttgccaaaaatgtctgaatactaccgtatttcctttattggagcatgcatgtgttttctgtattttaacttttctgaaaagagggaagctgaaaaaaaggggaggatgtctcctacagtctcagtgatctctcagaattgagaaaacgtgataatcaaacatttcagtattatcgggaccttcctgggactgagcacacgtgttgaggggagtaccagggaaataaggagcatggtgaggagttaatttgcagtttgattccccctgctcctttgcatccagaagaagactgtgcgcctcctgtcccaggcccctgggtgtacccacatcgtggtgcatcactttgcatgttgacgggctgagtaacctgcttgtctcttgggaccacttcatttctcactgtgcttcagtatcgcacagacacctgacacctagtaggccctcacaaatatgttgcataggctgggcacagtggctcgtgcctgtaatcccagcactttgggaggctaaggcgggtggatcacttgagaccaagggtttgagaccagccgggcgaacatggcaaaactctgtatctagtaaaactacaaacattagcctggtatggtggcgcatgattgttaatccgagctactcaggaagctgaggcatgagaatcacttaaaccggggaggtggaggttgtagtgagctgggatcctgccactgcattctagcctggaaggcagagtgagattctgtctcaaaaataataaaataaaaacgttgcatgaatgaaaagttgtgtaatcagttctgaaagaaattttaaaaggaatgtgtccttccctttggtgctgttagaatgagtcccatacacattatttttaaccagatcatttgttgagcccacgtgcattttcagtagaataatattaaaaatgcctgcccattctccttgagtatgccaggtgaattctagagtcattcattgagctaagactataaacaggactagtgaagtctttttatttatttatttatttatttatttacttatttatttattgttttttgagacacagtctcactctattgcccaggctggagtgcagtggcacaatctcggctcactgcgacacctgcctccagggttcaagtgattcttgtgccttagcctgccgagtagctgggactgcaggcacccaccaccacacctggctaatttttgtgtattttagtagagatgggattctaccctgtttgccaggctgatctcaaactcctggcctcaagtgatcctcccacctcggcctcccaaagtgctgggattacaggcatgcaccactgcgccggccttagtaaagtctttctcttgtttttaataagaggaaagcccagcttttgcttcacctagttcacaacacgcaggatatcattgttctacatggaaaatttgtgtccgtggaattaaataatataatccctgggaacttccactggttcccggtctccttcttcagatattttatctgctaaatccgaagtcggaatctcagttaagcttattagttaagtcccaaatggagacaattgaagccagaaaaaaaaaaaaaagaagaaggagaaaaagtcctaattatagtttttcttcttaagtgctgcatgcaagtatgaatagggtattaactgtggttttcaacataaaagcataatagtcagtagcacgtatgtcaaaatgtaggcatattagaggctgttaggtgactcaggggccacatctgtggaacaggtacatatttatcttgagataccgagtcattaagaggggcaataaaaaatcaagtgtaaattgagagcaaaggtcacaatctgtggttggtgattttttatatgtctagcaccagcccttgctactttttctttagaaaatgagggccgagtgcagtggctcacacctgtaatcccagcagtttgggaggctgaggtgggaggatcacttgagcccaggagctcaagaccagcctgggcaacactgggagactgcatcactgcaaaaatacgcacacaaaaaagtaatagttatcctgcggtcaccagggcccagctactctggaggtccaggaggtcgaggctgcagtgaaccatggttgtgccacgacactccagcctgggcagcataactgagttgggagggaaaaaagtagaaaatatgtctcggtcaagtctgagcttcattttctattgatccagtcgtggtcttttccaaggaaattattgtatggagtgaactcgggcaattcacttaacctctcaattgctttatctgtaaaatgagaataggctgagcgtggtggctcatgcttgtaatcccagcattttgggaggccgaggtgggcagatcacttgaggtcaggagttcaagaccagcctgaccaacatggtgaaaacctgtctctactaaaaatagaaaaaattagccagctgtggtgttgggtgccagtaatcccagctactcaggaggctgaggcaggagaatcacttgaacccagaaggcggaggttgcagtgagccgagattatgctatcgtgctccagattgggcaacaagagcaaaactgcatgtcaaaaaaacaaacaaacaaaaaagagaataaactaattctcgtatcgattgtgataatacatgaaaagctcttagcacaaatgtaacataagtattcagtaaataggtgtccgtgtgtgtgtatcatccatcatctactatttatctttctgtcttcatctgtcatctgtctgtttctatatgaatatataaatgtatttatctatatttttctatatgtacatatataagggtatttatcatttatctgtatatcatctatctcgatataggtatctatatgtgtgtgtatatatatacatctctgtgtgtctgtgggtgtgtgtatatgtatatatacattcatctatccatttatcgtctatttctccatacaaacagacacacataacatacatttactttcttgaattgctaaattgactaatgcagatacatgttcatttttgtcccatagatactaggcccacccctttattctttaagactcctttaacacaacctgttggatttagaagactccactgacactggagggattgaaacaagagaaaaggaggaattatacttggtaatagctttcatttctcctagattccctcagtcctgtagactatattgagttataagtctttgataatttgtaatttgtatcattaatatctctcagtcagtgagatcttttgattaaccaaaacacagtgaaatttctgaaaagcctgttttattgtagccataaactatgtttacagagctgtttcttctaagagcttcaaaatggtttgtggtgtgtgtttactgtagatgtatttttcattaaaaagtaagataatgctatgactaaccgcccccccccagtggaaaataatgaagaaaacaaaagcattcatcacagtacaatcagcattaaatttgtggtgcctttcttccaccctcagatgtattttttaatttatgtgcctatgatcataatgaacatttaacttttttaaaataaacattgtcctatatgaaccaagtaatctagtctctataatcataacttaaccttaacttgtaatggctatcaaatacttcactctgtgtgtgtgtgtgtatgtgtgtgtgtgtgtgtagctatataacatttaattgtcattatattaggtgaaattaaattttactctttttattctaaataatgccccaacgggtaactttttccatatttaaaattatctctttaggccatatttccagaagtgtaatcataggattagggaaatggaaatatcttgcacagtactttacatgtatttccaacttacttttcaaaagggtcatagcaatgtatataactactagcaatgcatataaatgctagtttctctacatcctcaccagccttgggttttataattactttacattttcctaatagaaactgtatcactgctgtttaatttgaatttcattactagtgaggttgattgtttttatatgcttaatctctgggttcatcttcctaatagaggcctgccttgtgttttaacaattcagctgcccagataacacttagagagccatgagtaaaagcactctgttaagcaaaacaaaagccacatatttccaaagactgtattgtataatttcaatatgagtcagtattccaatgtgtcatccaaacatttcctatcatttgttaatatgatcttaagctaaattaatgtattagtccattcttatactgctaataaagacatacctgacaatgggtaatttatgaaggaaagaggtttcactgactcacagttccacgtggctgggacacctcacagtcatggcagaaggtgaaggaggagcaaagtcacgtcttatgtggtggctggcaaagaaagcttgtgcagaggaactcccatctataaaaaccatcagatcttgtgaaacttagtaactaccacaagaacagtatgggggaaactgcccccatgatccagttttctccattttgtaccatccttgacccaagggaattattcaagatgaaatttgggtggggacacagccaaaccgtatcaaccaatatatgagaattgatttatttactttagtccctatcataagggaagcagtggtccttcttcatgtttcctcatgtcactttttaatgagcaagtcatgcacaagacaccatatttaagaagtatggaagggcacacagtgaaagatgagtgactgaagacatgtttatttccagcatgatgtctttccaaacaactagccaaatatgtagtccaatggaaatgaatgttttagactagagagatatttcttttataaaatacaatgttatgaaataactctcgtgggtctttggtattcaggtgtggcaaatactgttaatttgtaaatcaaaattatttctgaccttcttctataccttgctgtcttccgctctagaggctgaaagactaatttaaaaaatttcatgcaagcttgaaactttctggagacaaaaacataacaaaaagggttagacaagagtgatgtacgttttcccttccctccttctgcttgcctggagcatagaagtgataactggagctgtgacaattgcatcatgaccatgaggagaatgtcaggaggattgcagatacatcagctctgacatagcaaccatcggcttctagatgaggacttccctaactttagtgcacataacaatcacctgaaggctttgttaagccctggattgctgggcccctgttccagagactgtgattcagtgattcagtaggtcttgggtagaatgtaagaattttcttttcttttattattattattattattattattattattatgctttaagttttagggtacatgtgcacaatgtgcaggttagtcacatatgtatacatgtgccatggtggtgtgctgcacccattaactcgtcatttagcgttaggtatatctcctaatgctatccttccgccctacccccaccccacaacagtccccagagtgtgatgttccccttctgtgtccatgtgttctcattgttcaattcccatctatgagtgagaacatgcggtgtttggtttgttgtccttgcgatagtttactgagaatgatgatttccaatttcatccatgtccctacaaaggacatgaactcatcattttttatggctgcatagtattccatggtgtatatgtgccacattttcttaatccagtctatcattgttgtacatttgggttggttccaagtctttgctattgtggatagtgccacaataaacatacgtgtgcatgtgtctttatagcagcatgatttatagtcctttgggtatatacccagtaatgggatggctgggtcaaatggtatttctggttctagatccctgaggaatcgccacactgacttccacaatggttgaactagtttacagtcccaacaacagtgtaaaagtgttcctatttctccacatcctctccagcacctgttgtttcccgactttttaatgattgccattctaactggtgtgagatggtatctcattgtggttttgatttgcatttctctgatggccagtgatgatgatcattttttcatgtgtcttttggctgcataaatgtcttcttttgagaagtgtctgttcatatcctttgcccagtttttgttggggttgtttgtttttttcttgaaaatttgtttgagttcattgtagattctggatatcagccctttgtcagatgagtaggttgcgaaaattttctcccattttgtaggtcgcctgttcactctgatggtagtttcctttgctatgcagaagctctttagtttaattagatcccatttgtcaattttggcttttgttgccattgcttttggtgttttagacatgaagtccttgcccatgtctatgtcttgaatggtaatgcctaggttttcttctagggtttttatggtcttaggtctaacatttaagtctttaatccatcttgaattaatttttgtatgaggtgtaaggaagggatccagtttcagctttctccatatggctagccagttttcccagcactgtttattaaatagggactcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggtgatgagggctcttttttggttccatatgaactttaaagtagttatttttttccaattctgtgaagaaagtcattggtagcttgatggggatggcattgaatctataaattaccttgggcagtatggccattttcacgatattgattctttctaaccatgagcatggaatgttcttctgtttgtatccttttttatttccttgagcagtggtttgtagttctccttgaagaggtccttcatgtcccttgtaagctggattcctaagtattttacaaattcttaggcagtgctgatgttgctggtctatggaccacacttggagtagtaagatgctcgattcattatgtgagaacaaaaaagccctatttttaaagtcactgcagttggtgttgcttgtaccctaaaaaaagtgaactgattcacctgctaggtctgcgtatttctgcttcatatgtaccacctactctagaaagagatgagattatcaatctaattgaatgtgtgtgaagatgacagaagcaacaatcagatggtcaaaagcagattaagaatcacttacttggccaggtgcggtggctcacgcccataatcccagcattttaggaagctgaggtgggtggatcacctgtggtcaggagtttgagaccagcctgaccaacatgggaaaccccatctctatttaatacaaaaaattagctgggtgtggtggtgggcacctgtaattctaccttcttgggaggctgaggcaagagaatcgcttgaacctgggaggtggaggttgtggtgagccaagattgtgccattacactccagcctgggcaacaagagcaaaactccatctcaaaaaaaaaaaaaaaaaaaaaaaaaatcactcactccaggaatttggggctgtccccagtcctgtgtaggctcctttccttctgggaagtgatggactacaagagaggtagagaacagtggaagagtttgaaggtgatctttaacaatggaaggaataacagctacaatcccaatacgtgctaactgaactgctaactgaagtaggagagttatatatatatatataaaatagtgcccctgttctgaaagcttggtatcaaaagctgcagggtttgatgtttagcaggaaagcattgctataacttgcgtatcttctaaaaaatgtgcccacatcctcccggtttgccttgggaacagagagaacttggttatgaagcccctttctccaaggattaattgaatcaagatcaaccctatctggaatgtacatttaatacccgggaatgatgtcagtaatatatgtaagagatttttatattagataactgctcattaaaagtcaatcctttcccccagggttttaaaatagaaagtattcaccttttgcaaatgaggatagtgaaatttactttaacttctgccacaatgaaaactggaagaaagggaattgctcacaatacaatataactccaccaaatttgcataatttaggcataaaatgtaataccctgctcacactcttttgtcttgaatgaaattggttttcaagtaatgtggggaatcataaccagctttaacaaaatggatcatgtcagaaagcaaaagttcctactagcctaggagacatgactgaagtgtgaatgcagtgtgcaacatctttacaaaagttgttcttgtgatttaatgcaaaagcctttgtagactttacagaaacactgaagccgtgctttttgatagttaatgggggaattaaccatttgaaaccttaagacaatctttttctaggattcttaaaatcatgggattgtaacaattctaaggatgttaaaagtgatatacattcctgcagttcctttccaaagatcacagagttctttgtgtaaattagtatttcccaggcctggtgcagtggctcatgcctgtaatcccagcactttgggaggccgaggtgggaggatcacctgaggtcaggaattcgagaccagcctgcaacatggtgaaacccagtctgtactaaaaatacaaaaaaaaaaaaaaaaaaaattagctgggcatggttgtgggtgcctgtaatcccaggtactcgggaggctgaggcaggagaatcacttgaacccgggaggtggaggttgcagtgagccaaaatcatgccattgcactccagcctcggcaacaagagtgaaactctgtctccaaaaaaaaaaaaaaaaacaaaaaaatatttccaataaattttcagcaatgtgaagtaagcctgtctatgtctttcctgtggcacaggtagtgaaactgaggtcaggaaaaggagtgcattgcccatgaccactcattgaagcggtgttcaagttttcaaggcacagactttctgaagcatattgtatgaattggtttttgatatattatggatagtgatatagtaaaggtatgaaagtcaaaagaattactcattgaaagcattggcctccaagagcattttctccccaaacctcttaaggggtttatatgaagtttaaatgttgatgttttccattatcttgctggctgtaggctttgaccctcactttctttcatctttaaaatgaagttgtaacagtatatgcctcatgtgtttcctgtgataattcaacagttaaaatgataatattgtggctggacatagtgccacacacctgtaatctcagcagtttgggcggtgaggcggctggattgcctgagctcaggagtttgagaccagcccggccaacatgatgaaaccccatctctactaaaaaaaaaaaaaaaaaaaatacaaaaattagctgggtgtggtagcaggcacctgtaatgccagctacttgggaggctgaggcaggataatcgcttgaatctgggaggcagaggttgcagtgagccgagattgtgccactgaactccagcgtaggtgacagggcgagactctgtctcaagaaaaaaaaaagtaatattattattactgcctcatatatctttttgttgcagacactattagctgtctaccctggccctcctcagaggtgagcatgaaccagaattccctggaggccctcttaaaacgcaccctcagagcgtttgattcagtgattctaaaacggagtctaagaatttgaattttttaaaagttctcatgtgttgccggtgctgcaggctttgggaccacattttcagaaagagtgttttctcttgtgaccattctccaatgttctgtgtttgttaggtgtgacaatgggtccatctagagcaaaaacaaacaacagtagcaaaccttgatttctcagggttttttttgcatttgggagtggccgtggagccagtgatacagaagtggaagtctgcagggtagggacagaagtgagcttgtacacaccttccagccacacgcccttctcctttcaggcttcctcttgcctggaagaagtatgctggtcagaaagtagggcagccatctatgaccatgagtccagaagccacactggacaatggaacaggaatattggagcataatgagttcctcaagaatagctgaagtagctctatagggccaacctccaaacttgtgttttgcgataaaaaatgaatatgtggttactaactatagaaatccttaactgaattatttctctcaggtacacacaaatcttttggacttcttattttaacaaaaggagaggtaaacagtagggaggttcctcaaaaaattaaaaatagaactaccatatgattcagcaacctcactgctggattatacatccaaagaaaatgaaatcaatatatcggagagatgtctgcactcctgtgtttattgcagcactattcaaactagccagggatatggccaggcacggtggctcacacctataatcccagccctttaggaagctgaggtgggtggatcacttgaggtcaggagttcgagaccagcctggccaacatggtgaaaccccatctctagtaaaaatacaaaaaatatctaggcttggtgacacgcgcctgtattcccagctactcggggccgggggagcagtgcttaggtgggagaatcgcttgaacctgggaggcagaggttgcggtgagctgagatcatgccactgccctccagcctgggtggcagaatgagactccttgtcaaaaataaaataaaataaaaactaaacaaaatagccaggatatggaaacaacctaagtgtccctgaacagatgaaaaggtaaagaaaatttttaacacacacacagacacacacacacacacacatacatatacatgccatgaaatacaattcagccttcaaaaaagaaggaaattctgccctttgcaacaatatggttgaacctggaggacattatgctaactgaactaagccagacatagaaagacaaatgctgcattatctaacttatatatggaatctaacagagtgagactcatagaaacagagtaaaatggtggttaccaagggctggtggctggcaggggagagttgttggtcgggtacaaaatttcaggtaggcgggaggagtaagttcaagagatctattgtacaatatggagaaatcatagttagtaccaatgtatggtgctcttgaaaatcaccgagtagattttaagtgttctcacacaaaacacaaggacgtgaaataatgtatatattagcctgatttagccattccacatgtatacatgtttgaaattttcatgttgtacctgataaacatatataattttatttgtcaattaaaaataattagaaacaaacaaaagtagaggtgaaggaaaaaagttcttggcgtttatattaaatgatgcacaaatcccctgctgtgccccacaattgttggaggacagtgggtggatgagacacacagaatagactcttccttggcccatcttattgagagaccatgttgtgcagcagtgtcatcctctgagacgtagttaagataaatgacatctccttaccttttaccccccgagactataatgtcattctgtagtctgaaaggtcatttgtaaagctcacaggattgctttagctgttaaaatagagagcaaaactcaaaagcaaacctctttctccaaggaaaatactatactttgaacagtctcatcgttctcctgtgattctaaaccagttcctctgcacgcagtgcagaaactagatctctcctgccactaggctcacaaggactcttgtggatctcgttttccccctatcttttgtcttacagtttccaccctcccttttgttctgtgtgtttgaatcaagaaccggcaaagcccacaatgatgtttgtgagcattaagtgacgcaaacacaataaaggattttgcttttttgagccgctcataaaaagagataaattgctttagctttttatgcatgtagaaaaatagagtatgagctaatagtactgactgaagaggaaccaggaagaaatttagtatgcatataaatttaatgcaaaataaaaagccaaatgtaaatattggtttccttccagattttcaaggcttaaaaaaaaaaaaaataagattttctttgcttgttatatttctgctgatggaaaacatcctttccactgttggaaaatgaatagttataaatatagaatacatatatcttagactcggtggtctttaaaattaagagtttggacttttcttttgatagaatgtggcatgtagcatatcgcatgtcttagaatattatttgtcctcgcgaaagtgatcctcatcccttattttaaaggaaaagaaaaggtatgattctccttttgtgcattcagtacacaaaaaattgcctgttatctagggtgtacttgactatggatctccttttaagtcaagactacacttacatgatggaaataataatggaaaattgtagataataataaatatatttttactccatcttcttcttaaaagactttatcgcagagagcaaatagcttttccctttgcaaaaacaagatgctagaagcatagaagagatgaagttaagcaattagtgattggaatgagttgatcttttaatttttttaaataacaataatcaccaatctcgattggacacttactatatgcttggtaattcatgtgtattaactcagttaataattataacaatgttgttataattataaggaaaaaatatttattatctccgtttcacacatgagagaattggggctttaactaatatgcctctgatcacgctattattctgtggagtgctcagaatggaaggtcagaccaccgcgttctaaaacttttgcttttaacctggtagtgtattagtcagtgtctgctgcatcaaaccgccccaaagcctagaggcttaaaaccaccatttattcaactcacaattccgtgggtcaacagtttggactaggatcagctgggtggaggagtgagcagaagtataaagaggtctgatgagggagtgagattagcagcttaatttcttcacgcataacaattcaaggggaccttcatttgcctgattgagcaaatatcttatgcggatagcttaaggaaagagctgcacacctgggctgtgaccttctgggagatgaagtccaaggacatttttagatatggatacgcatagtacaaagagatggaatagaaatgctaaagaaacatatacataaactccttggtgtggatgattcactcactgactgtatcgtgtgccatcctttatgcagacagtgtcaaatgttggtagaaaatgaagtagatgtagccctctgactttataggggcttgcagtctgggaggagaaatagtgaaccagtaaactgttacatcagtgaccacttgtggtacatgttaggtatgaaatagactatccagatagaaactaattaaagaagggtctatttgggtaagttggccaggaaaggttttttggacgaatgataattaagctgaaatctgaatgttgagaagggtacagtcaaggaaaaggaagtcggggctgttttagagatagaggggtgtgtgtgtgtatgtgtttgtgtgtgtgtgtgtgtgtgtaggtgtgtgtgtgtgtgtgtgttccttataagccaacaggtaccgaatttagtgtaggtctaagggatatgttgaaagatgaaggttataagtggaggtttccgtgtttaaattcagtgatgagactctctagctcttctcattttcttaaatgttgcccaaagaatcccataaacatggaaggaatcctacccaggtgctatataaagataaggatagggagcctcttggagatataattgaggagcaccagatggggagtaagatttggcttctcatgttggcattaacgctaatttaccatgtgtccttggcaagggcactctgcctgtccagaatttagttgcctaggctacagtgattgcctgttctgaatggttgatgagagctatgtggagaaaagagtctgaggccacttacaatcactgtgagccagaattctgtaattgattaggcatgtctgccctggacttggaaggagcaagtggtgttgtgtatgctgtatatgtgccattctctgatggccttttattttccagcacaatgttttctatggcttttatgactaattggaaaaattctgtagctttccagtttttttttttttttttttttgtcctggtattttaaaaatgcagcaataattgaaaacaatgagggaggaaaataaatacatcaaaacaatagtctgtacacttacttcaaagggatcaaataaagcaaattatgcacgggagggaggtggatttgtacttccctcgtttgcaatattattagtgtgattaatatacaaagaccaatatttcctgaaattcataatttgccctattcctccgtgagctttgtgtttcccagaataatcatgctgatccatttccttaaaaatgtattgaatgcctaagtgctcattttgcaagggcagcagcataattggacacagtggggaaacagcagagaagtggtttgcttcctgaggagaggagaatgtggtgtgagtaccggctggacggaatgtcacaccaggagggacctcatctctgcaccagtgtcactgagcagaatgcttaagggctatttatggaattagggctggaaaactgcagctaattctcaaagaagggagggcttccctggattataaaatatgtgttcttttgaataatgggaccgaatgagagtagaatgtttcagcatttttttcctaacatgacagccctttggggatcctggtgattttacaactggatttcatcttcatgaaattctgttatgtgtgatcgtttctgctccacccttccccttaaatagtcactttaaaagcatctctatcttgccttggagattgactttcttgttccagttgtctagaaaagtatttctatagtgtgagctttagaaactaggaacagaggaggaagatcggagtccttaggttcaaacctatttaaggtccgtgctctgccttgtgcctgcctgtctctgagtttctcttaatgcttttccaaaacagttcattaatgcagtgacctcgaggtcttgctcagatttgcttccacttggactggtgatgagaattgctggtgaagctgggtccctatgtgtttgcaggtctgtttagtagactcaacttctgcacatgtagcatccacatgtccagtctcttctgtgagatgtggacagcgtcagtgccagcataagggaatcagggtttgagaactctcaatatgggcagggtagccgtactgtgtaaacccatggagcgccattcccattgaattctacatcgtctgctcatcactatgtaggccccgatacagatctaacagggaaattcttgtagtttactgaggcagggccagctgctgggtgagatagagagagatgaggctggaaagtgggtatgagcccgatcacaaagcaggttatgtattgtgattgggtttggaatttattctgaattcacttgccgtcagtggcatttcagagaggcccctttagctgcacttgaaaggatgagttagagaagccccaaactggagggaagatacattaagacatgattgcagggtgaggtttctgttaattccttgcatctctatggctagcaccatcctgatccaaaccaccatctcccccgggtggttgcagtggggatctgacgaacccctgcaccccactcgtccccacctccacaccgcaacccaaacagcctgattatattaccccataggcagcctttcagggacagggagttcacattgctctcaggaaggagacaaaaatccttcgtgtgggtggaggcaaggtcttgcaagatttaaatgtcctcaccctctacattgttcactaagtctccacaccacaccagtcgccttgattttttatcaaagaaatggggtctcactgtgccacccagcctggagcacagtagagcaatcatagctcactgcagcctccacctcctggcctcaagtgatcctcctgcctcagcctcccaaagtgctgggattacagacatgagccaccatgcccatcccaactttattttttttccatccgtcctccatgttctctgtcactaaatgtggttcactctctctggaactttcctaaaccattttattacccctgtcttagtctattttgtgctcccataatagaatacctgagactgagtaactgataaagaacagaaatgtattttatcacagtttcagaagctgggaagtccaagatcgaggcaatagaaggttccatgtctggtgagagctgcatcctctggaggggaagaatgccgtgtcctcacatggcagatgggcaggctggccaaacactgtaaagcttcttttataagagcattcatcccactcatgaggggaggagcctgtatgaaccagtcacctcttaaagcccccacctcttttcaccatcacagtggcattaagtctcattgcccttcaccacgcacttgtttaacttgcttaatttttatttattctcaaaattcctgcccactgtcaattttttacagaagctaaatttcccctgtgttatctatcgaaaagcaagtatctctcctttttggcatttagttcagttgtaaatttacatttgtttatgtgattctttgattattatcttccttccaaaactgtaagtcccatgaggataggggctatttttattggatccttatcatttacccttcctgccacttagcatggtgatgtctcataaccagcagcattcagaaatagttttgaaagaatggataagagacagtagaagtctgaatgaaggcttcaggaataggagcagagaaatggggtggatgtgtggggttggtactttctgtgtcttaatgttctggagaataatgactctcaggtttttatctgggtgactcagtaatggtggcattgtaaacttaagtaggaatttttgaaggaaaacaaggttagaaatgaatacaacaaaggggccttttcatggtgaagaagttctgcatcttgattttggttgaggttacatggatctatacatacacatgaaccacacatacgcatgaactacacacagacacacacacacacacacaggcacacatgcagtgaaatgtgaacaaggtctgtagattgcactagtatcggtttccttgtttggatatttggttacaggtttggaaaatgtttccattgggggaaactgggtaaattgtgcataggaggactctgtaccacttttgcagattcctttgagcctgtaattatttcaaaataaaggtaaaaagagagggatctaaagattggcagggacattggtaaattcagtttgcaggatatggaatataatttgctccttacagactccactaagacctcacctctcctttttgactcaattattggcctgaaattcttgttggctcttcttgcattctaagagtgcagggctctgctgacctgtccacctggctttgttttcacccttcttccatgtggtcattcacatctcggaaggcctaactcccctcctccacacagaatgaatcacaaggtgcaatacttactttccacctattcagcagcataaaaagtccaagcaggtaggattccctccctttccaccagccccagctgtctgtctgtctgtgtgccatgccgcatatctacccagaggaaaagaggtcatcatatgaaaaagacacttgcacatgcctgtctatagcagcacaatttgcaattgcaaaaatatagaaccagcccaaatgcccatcagctgagtggataaagaaactgtggtgtgtgtgtgcgtgtatgtatgtgtgtgtgtgtgtgtgtgtgtgtgtgtgtgtgtgtatacatgatgggatatttatacatatatatatacttacatatatatatacacatatgtatatgataggatgctacttagccataaaaaggaatgaattaatggcattcacagtgatctgaatgagattggagactattactctaagtgaagtaactcaggaatggaaaaccaaacgtggtatgttctcacgcatagtgggagctaagctacgaggatgcaaaggcacaagaatgatacaatggactctggggactcaggaggaaagggtgagaaaggggtgagggataaaatactacaaattgggtgcagtgtatactgctcgggtgatgggtgccccaaaatctcacaaatcaccattaaagaatttactcatgtaaccaaccacctgttccccaataacctatggaaataaaaaaaattcaaaaaataaagtaggaaagaatgacactgacaaaatctataggaaatgggaggctatttgctggactagagtttctcataggcatgatttattccattgcttaaaagcaaaacatattccatactttatttttctaataaagaagagcaacatctgacttttactgagctcagtatgcctttgttgttgaaagagcaagctctggagtcagccctgattgaattcaaatcctggcaccaccaccttgaccttgggaaaactactgcatctcactttgtcctggtcccatttgtgaaacaggactaatagtacctaactcataatctgtggaaatcagctacaatgatgagctccaagagcttagcagagtacctgaaatacaggaaatacccagtaaatattagcctttattatgatgtttatttttttttttttgaggcagagtctcactctgtccctcaggctggagtgcagcagcgccatctcggctcactgcaacctctgtctcctgggttcaagtgactcccctgcctcagtcacccaagtagcagggattacaggcacgtgtcaccatgcctggctaatttgtttatttatttatttttgtatttttagtagaggtggggtttcaccatgttgtccaggctggtctcaaactcctgagctcggatgatccacccacctcagactcctaaagtgctgggattacaggtgtgagccaccacgtctggccttattatgatgtatttttgccagatgctttttgtgtgttatgtccacacgttttaaaaatgtatccgtaagagcaactttacccattggatattttattcctatagtgtaagtgaggaaatagaggctcagagtattcaagccatatgcccaaggtcacacagtggcacattgtaccatggagattacaactcaagtctatttggccccattgtaggtcacaatattctatttcatctctaaacaaactcaggggaccctagcattataaatgcaaaagaatgtttaatgcagataattcctcagcaaaatggagtgtctaaggaagtcttcgggtttgcttttgttctgcctgagccaaaatcatggtacttactaaaatcttactggaagtccctaaaatcttactggcaagggtacttttattacgaacacatcttcctataaatttcgttaggtatttcgtctttgttatcttgctaaagcagaaggctgttgttctggaatgtgaaatttatgaaattgcaatgttagaaggtggaagtaaatcctacttttccctgtggaagaagtttgagaggcagtgcttgggcaagtttcatccttatatggccaggtctgaccctataaaggtgaagggctattatagtggggttcagagaggtaagccaacgtgcctcaggttacctaactagtaactgagccccactttcatcagttctaaaaccagaaaaagaaatacctgccttattgggaggccaacacaggtggattacgaggtcaggagttcaagaccagccttgccaagatggtgaaacctcgtctttactaaaaatacaaaaattagtggggcgtggtggtgagagcctgtaatcccagctacttgggagggtggggaagagaattgtttgaaccagggagatggaggttacagtgagccacgatcacaccactacactccagcctgggcgacagagtgagactccatctcaaaaataaaacaaaataaaattaaaattaaattaaatgaaattaaattaaacaaagaaatacctgccttatggctggatgcgttggcacacacctgtaatcccagcactttgggaggccaaggtgggcgggtcaggagggcaagaaatggagatcatcctggtcaacatgtgaaaccctgcctctacaaaaagtacaaaaattagccgggcgtggtgatgcgtgcctgtagtcccagctactcgggaggctgaggcaggagaatgacttgaacctgggaggcagagattgcagtaagctgaaatcgcgccactgtactccagtctgggtgacagaatgagactctgtctcaaaaaaaaaaaaaaaaaaaaagaaagaaaagcctgccttatagggttgttgggaattagaaatgtctgtgaagtatctgccacttagatgacataaaaatattgctattacagtgatggcattaggtctgcattcacagtggaattacagtatggccaggcatattataatgaaggtttttaactttcttagaaacgaaatttgtccttttgaaactccctcttcaggtttgcccttaatccaggaacctctatcacattacaggcgcccagcagcacatcttaatatatgttaattccctttatttctgatactggagaatttaaatagtgactctcctcgtaggatgcctcctggcatggtggaaattgccagaagacaaaataacagattttatggtacttcgctgtggtttttccatatgtccaaaccctatccgtagctttcatgacccagataaagtgtcattaagtatgtattagtgattctcaaccctggcttcaaattcgaatcagttgggaatgcattaaaaactatcaaaatttggccgcactccacaccaaacaaatgagaatcccagcagctttatgctttttttattctctggtttttattgtttgcaatgtcttgctcttgttacatttttctgactgactatttttttaaaatgtttttaatgtttaatttttgtggttgtatatatttatggggtacatgagatgttttgatatagacgtgcaatgtgaaataattttatcacggagaatgtggtctccatcccctcaagcatttattctttgttttataaacatccaattatattattttagttatttaaaatgtaccgttaacttatttttgaccatagtcaccctgttgtgctgtaaggtagtaggtcttattcattctttcttactatttttttttgtacccattaacttattttttacaagctccttagttaagtgattttaacatgaaatcaaaggtaagaacctctaatataaagcttaccctaaagcccaccccattcccacagcatacactgtccaccatcatgtcgcttattcaatgattggaataaataacggtatgaatgaatgaatagccctctaggtcactaaatgatggtcatcttgtgctttgctttgatgttcgtcttatctttaatctcccctcgcagacttgagatacttcttacagtccttgttggggttatttctgggccccaccgtgtccgaagggaccacagtgtccaagggagagtatatggtcagtaaatgcttgtcatatgaatgaaaaatttatcatgaatacccgtcccatggcactcatggcagaattgttaatggagtcccacctgttaagaataacttattcttctccaactgactctttttttttttttttttttttttttttttctgagatagagtcttgctctttcacccaggctggagtgcagtggcacaacctcggcttactgcatcctccgccacctggttcaagcagttctcctgcctcagcctcctgagtagctgggactacaggcacccaccaccatgtccagctaatttttgtgtttttagtagagacgggggtttcaccatgttgaccaggctggtcttgaactcctgacctcatgatccgcctgccttggcctcccaaagtgctgggattacaggggtgagccaccatgcccagcctccacctgactgttaaaacattttctttttttgaattgatacgacagactttattgacatcataaaaataggtacgtgagtgtctgatatagtttgggtagttgtccccgcccatatctcatgttgaagtgtaatccccaatggtggggggtgtttcggttgtgggagtggatctctcaaggtgggaggtgtttcggtcatcggagtggatctctcaaggcttggtgctgtcttcatgacagtgagtgagttctcatgagatctggtcatttaaacgcatctcgctctactcctttttccatcattgccatgtaagatgccatgtcctgcttcaccttccgccatgagtgaaagttccttgaggccttcccagaagccaaacagatgagagtgccatgcttcctatacagcctgcagaaccttgagttaactaaacatcttttcttcataaattacccagtctcaggtatttctttatagcagtgcaagagtggcctaacacggtgtcctatatggggactaattgtctccaaggttattgaggtagttcttcagcttatcttaaagtaactgttggctttcatctctggatggtgtgtagtgtgggtgggaagaaccaactaagctccagattagttgatgcatggtgagggagtgaaccttcctcccctccttgcttgaaggtaccccaggccctcactcaggcatgaaggtgcaaactcactctttggcacaattttcaaactcttcatcatcttatactttgtctgcaagtacaaacccctactgaaacttcaccccaggccctttcccaatataaaccttgcttgaccacatgcagctgcccacaattatcactgacttcatttttatgattttctttttcctaaaaaaaaaatgccattgctgtagggaaggggttcacatttgcagaacactgacgtcttggctacttacaactcagccacatttggacttttctattccatttggtcagtctccaactctttcttgattcacctgatattttcagtcagaaatatgcacacgttatgcagttttccctttttcaatttactttctcaccatgaagttcccattgacctctccctgttcactgtactctgtgacatcacacattgtgtttctaccgactcaccctgatgtttttcccctttaccgtagatactccttctgaccacctcctctgatcaatacttcgcattcataataaggtgtattgatgtacatatgcacaaaacatctttcataactactcaacttatccctcctggaaataaaacccaatctcaacagtctttggatatcaataattaatgtagaggaaagcccagcaccccaacgcccctgccagagataaaaataagcgaaatatgcaaattcccgttcagacggggcactattgtaatgtgcaatgaagccatgcctatttaaaacaacaacaaaaaatgaatctggcctatggattgctggaatgttgctggcacaattcttgctgtcctcatgggtggcagacgtttaaaatgtggaagatgaaacatactgttgtgagcattgaacatcgcattacgaacgtgctcatggtacttaataaattgtcaaaaataataagactgctgccaagtctgaaagctataaatagctaaaaaaaaatcagacatgactgctgtggattcttttgaaagataattttcctcgtaagtaatttctatgagcaagagcaatacacagttagatggtaaagtctacattcctggctcctgaaatgaacagcctgtgaattagaatgctcccaaagacgtggtgttaaatagagttgcaactacagggtggccattacattaagtaatttaatgaacactgatactgaggaaataaatcaaatgcaaacaatcaacaccaatcaaggaagctgagcatttcaggcacttaaaatgtattaaatgagtgtttcaatcacagtgggtagtttttcacaaactctcttaatcagctagcatcattctcaacaaagtgcccatgcatgtaaacatggtgaactgcaaaagcccaacacattgacacatggacacttttaggaatggaaattctgcttagggttttcactgataggataaacaacagcagataaattgggaaaggtcagtggaagtcaatgttgtgaaacagaaaagaacattcatattttgcatgtagttaaaaaaataagaatttcaaacatagaataaaatttgaaattgaattccaggcagctaatgcacctcccaaaggtggtttttaatgtatctttgcgtaaaatttccattcatgtataagtcctgataggtgcatctttatttgtatatttattatgtgtacatgttatatgcatatatagttatcagtactataagactgataagtacattctctctatatataagtatatgttgtttattcaaacaggatcatatccaagctcactgcctttgctacttaatcaaatatctatcatgatctttccctatcagcctgtataggtctatggtctattgcattctgctcaaggttttcttttttttaaaaaaagtctttattttattttatttttttgtggagacaggatctcactatgttgcccaggctggtctcaaactcctggccataaataatcctcccacttaggcctcccaaattgctgggagtacaggtatgagctacagcgcctggcctggttggaataatattttactgtatgagtccatcatcacttatgcaactctctgcttgttaggcatttacgttcagtttgagagaggataatttattgcaaacacacacacacacacacacacacacacacacacattccttaaaatgtattattttatttcattctccttcaagtattagcattgcatctttttatagcctgtgaaactagggaagagagaggttaagtaatttgccagaaggcacccagataataaacacataacccttgttttaagcccagatgtccttttaattctgaccctatgcctttaatcactacactgaaggttgagtttttaaccaatgttaaaactttatcagagtcgtgatatatgtgtatacacttcaaaagatgtgtatgtttggaaatattgaagaaatatatgtccttgttttgttttctttctagagaaaaagccaggtacattactgtaatcaaaaggggtttctgaattgtaagagatactatcattgttaacagagagtgaaggtaaatattcccactcatgtaagagtcttatgatattcttattagtagctgcagttggataaattgatatttatacgtgtgtctgtgtgtgtgtgtgtgtgtgtgtttatgtacagtttcctctaggagaaagctttttcatttgaaaacattaggtgagttagaagtgctttgcttgttctttcatttccactctacatcttcacatctttgaagagattttgttctttgtactttcaaagaattttagttgaattgggagaaataaaagtattttgattctttaaactccaagtacttctggaggtttggaaagcatattccaatgttcttccaataatgcctgttataagtgcacttacagtcatggtgctgctgtttaagcttacggtttatgaggagacctgctttccagctgcagcctccctccctccacactcctgagggaggcatcttctgtgttatcctgcccaacagtcagtcctcgttcagcaagaagcagggtatcatgtcctctaatcatggtccgtatagactcgggtcaggtggacccacctcagattcccctgtggcccgtaacccgggcctgtctcatcagagcatcccaacccctgacctcagtgcatggcttggggatgagaacctggttcagccaggctggtgccactccattcagaaattgctgggggccctagcaccttggtttggttggtaggagttgtgatggtgggaacttagagtcgtcatggctccagtgatgggagatcctgcctgagatgaaagaccatccagaggggagtatatctgagatgaagagaggacgtgtccagaggccattgtatcaacactcatgttggatctgtaagacacccttcaatgtttagttgtataagccagtaaactccttctcattacactcctttaatgaagttttagttggattttcttgcacattatctcttagagccgtgagtgatgcagtcttctctcatttagggagttgtatttccatatatcttgccatctttactaaattccttggagaaactttgactttttaatataaaataaatacagtctatcactccattatcccttctagtctaccttctcagtcactgtcaacatttttttttttttaactaaaatggagatttggttatatccctccttccagcaaaaatgttagtggcatgccatttcctgcagaatgaaatccacgtgtttttgtttggcggtcaaggcctttggacatctgctcaacccagccttcaaatctcagtgtctcactcacctgcagtctttgttccagggagatcagagagtccaccctagctcaagatagcatgccctctgcctctagggataacatggtctgcagtgcaacatctagcaggttttacagttgggtatccaagtttggcgtgtgtctctgtaacttcatacttttttgtttttttgagatggagtctccctctgtagcccaggctggagtgcagtggtgcgatctcagctcactgcaatgttcgcctcttgggtcccagttcaagcaattctcctgcctcagcctcccgagtagctgggattacaggcatgtgccaccactcctagctaattattgtatttttagtagagacgggatttcaccatgttggctaggctggtcttgaactcctgacctcgtgatccaccttccttgacctcccaaagtgctgggattacaggcgtgagccaacacacccggcaaacttcatacttttgttcatgcttttggtgtgctgttttctccttcacggatttgtctctcctgctggtctgttttgccacattctggtgtcctttggcaaactgaatacccagttttgttttgttttgttttgttttgttttgttttgtttttcgttctggagtccttagtacctctgacagtatgatatttattatatttgatcagagtaccaattaatattaatattcttcctcgtcctcttgtttgatggtttcttggcagaagctatatcttccctgggatgcagaacattgctgaatcatagtagaaactgataggtgtatgtgaatgaactcacaaataaatgcgtgattgaatgaataatgcactttttaacctctatttctttgtaagcaagtcatgtgggttcatgaatataagcagaaatgatggctttaaattttttttcttatttgcgctttcttgtaggctttcattgctttaatgaaatctggccctgaataccttgccaaatacgttttccttgaggatattgataatggctttttatggttatttaagactccctctaaggccatgtatctgcaccaataattccagttttcatttatctattcattcacttttattaagcactttgtagagtgcagaccctggaccagaccacagcagaccaatgacaagatagcatgccctttgcctctagggataccacggtctgcagtgcaacatctagcaggttttacggttggacctgtttctttattgccctctacacactaataataatacaaataaccttctgtgtgctagagtagtggtaggtgctttgtatgcactcttgatgattctcttaacaactcttagtggtgttagaattctttcttcatgaagcagggcacaaaagctctgagaactaaagacacctgagaataacatctgcagctactcagcagtgaaacaagaatttaaaccaagttgtatttgaagccaaagccactacactgtaattccattccttggtcattccctgccttcatcaggatctccgcttggttttgttgagacacagagtatcttattctcatgtccttattcatagctttaagctctcttaagcctactcaaactatttcagtcaaaatatgcagtttacttttccctctcttttttctaaatgctctttaacttcaatgtcccagctttcttagaggtcctgtatatctgaataatcagaattattgtggttttaagtaacagaaacccagtttacagtagttttaacaaaacaacaaaacccaaatgactgtaggatgtattgaatcatggagctgagatcctcatcatggtggctcacagaatcaaatgcatgactcgtgaagtaagggtgtctaaggctgtacctcaagctttgtgactggaactgatggcttggagtttctgggacattctctcttgccaatatctacttgtttccagctcttagtgggctatagttactcttgctgtagacagacatcctccaagtagccaaggaagagtgagcaggcaattccaacattttatcttttaagcatcatgatctcccctttccccaaaagcaagggattgcaagtaacagaaccccatgccagctccagcataaaaattcctgggaaggactccagttggcttggctttgagctcacccatcacccaaactttgaggctaggaagaagagtgttactatgattggcagctctgtggtaacaccatgggttggaaaagtaattggccaaaaggaaaaggggtgattccaccagaagagagaaaatgagaaaatatgccaggatgcaaaatgttagatgtcacagtcatctatggaggcaagtgtcagactttgtgttagtataactgcggactggatagggagcgtttgtccaggctggtgctgccgcggtctctatcttgtttcctaaactccagtccattgtaggctgggcattgtggctcacgcctataatcccagcactttagatggctgaggcgggcggatcacctgaggtcaggagtttgagaccagcctggccaacatggtgaaaccctgtctctactaaaaatgcctaaaactagccaggtgtggtggcagatgcctataatcccagccgcttgggaggctgagacaggagaatcgcttgaacccaggaagtagaggttgtggtgagtcgagattgcaccattttactccagcctgggcaacaagagtggaactccatctcaaactaacaaactaaaaaaaattctgaccactgtagcattggtcactttcaatcatatcaaggtttagatcagaaatgatatagctactataacaattaaattcagtatgtgaaattgcaactgtcttggaaacgtcagagactcactttcttccccttgtctcccaggatcttgctggacgtgtaatagttacccagccttcaatggattgaggagcaacccaggacagtggacaaagccttggtcttgaatcacgtggtctcttctcttgttcagactttggcagctggtcacatgtgtgatttggaccctattacatcaaccataaaatgattgaagaaccagacatgctgtctttttcacagaagattagggagaggcagttagctcatgaatgagaaaatataatataatttgaacagttctgcagtcattaagatagtggtagtaacagccaatatgcatgttgaatgcttagtctgtatagcctgttgtgccaagctttgtgcaagaattactttattttatctgcaaaacaaccctacaggagtcatagttattatctctgtatcagagatacaaacactagagcatagagaagcaaagatacttgccaaagtcatgtagcaaaaacttgtcaaagctaggattcaaactcagatcctagtccttccccaccaggcaaggctgaattactctacagagagagagtgagtgcgtgcgagagacagagagggagagagaaaattctttcctagctctgccttatttctctggctctgatgataggaaagcagtggccacattgtcataagctccagtcactctccaagatggcagaacattccaacactggttaatggctctgggatcatcccatattgagggacatccatccctttgtgttctgacattgatgttactgtcagttgacagtgagctttatcatcaatcccttcaagtacaaaaggccactgttcagaaactgttattaaaagcagcctctctttttaaaagccgtctctcttttattccttccataataggagccagtgtaccagaagaggctgaccttaagttgcgcctgtttagttaaacaaacaacaaaaaaaaggaaatagaataggttatgtttttaatgtatttaagattggaggcctagaattagaatggaactgggggtgggaggagaggtggaaggcaggataggaaaaaagagaggtggccttggattttctttgcttttggataatgggcatttctagttaaatcaacacagtctatttcacagcctgtctcccggtgatgtatatactctttggacagtgttgtgggctgcctaaagatctcttttagccatgggacatgggtataaataagctttatgtagtcacagctactaagagcaatgtgcgtagagtatattctgaaaggagagggcaggatgctcattgtcatggcggatgaggtcaagagagaagggggaagatccccgagggatgcaaattggggagggttttaccaaacaaacttcctccagggtttttattcacattttaatacactttggggggaggtattttaattttaaaaagatgcatgtgatggaggggtgatttgatatagaggttaagtatgggttttataattgggcttccgagattcaaattcagctctgccatgtatgagtcaaagaagtcacatgcatattatttaacctctttgtgtctgtcttcgcatccatagccacatgcattagctgtgaatattaaatacgtcaacacatgaaaagagcttacaagagcacctggcacacggggagtgctcagagagcatttgctgttattacttgcattgtctgggtgctttctatgtacgaggtactgaaggaacagtggtggatgagacagccacagtctgcctccatgagccgtatgttcatagattaaaataaggcaacaaacataaattgatcattatacattttgagaatgctgtgaagggccctcagttgggattagtccagcccccactcccctccccaccaacctactcaagatcgttaagaaagacttccatgagaaggtagcatatgggcaaagatcaaatgcatgaccagctatgggaccaacacaccaatggaaggaaacagaagatgcataggttttgagagcaggaaaaaaagagacttgtgaccataatcccagcactttgggaggccgaggcagatggatcacgaggtcaggagttcaagaccaggctggccaagatggtgaaaccccgtgtctattaataatacaaaaattagccagacatggttttgggtgcctgtaatcccagctactcgggagactgaggcagagaatagcttgaacccgggaggcagagattgtagtgagccaagatcgtgccactgcactccagcttgggcgacagagggagactccatctcaaaaaaacaaacaaacaaaaaaacaaaaaccagaggagagactggtattttagaggacctgaaagcagccagcataggtagagagtagtgatcaggcagggagtggcccctgtggaggtaaggcatgcaggcaaaggtgagatctagccagggcatccatgccaagtgatgacatgattttaatcttagaatgatgggaaaacactgggaaggttgaagagtgtcctgatcagcttcacattttttttctttttttttttttttattatactttaagttttagggtacgtgtgcacaatgtgcaggttagttacatatgtatacatgtgccatgttggtgtgctgcacccagtaactcgtcgtttaacattaggtatatctccaactgctgtccctccccactccccctaccccacaataggcccacattttaaggttactctggcagtggagcaggaaatggcttgtaggtgcggtagaaaggccaaaaggaggttcttgcagctgactaagcaggaggtgatgttaagttagcccaggcacgtggcagggtgagaacagccccttgcagataaggcatgctggttcagctctgtgttctcttcaccctgcttacctaaccaccttcatctgctgttgcttagttgcttgctttcaccaggctataagagcagggactatctttttttcccttcttctttatacattctgtttctagtcctgtgtcaaactcaggctaggtgctcagtatgtgtttaatggatgaaatatgcagtccactgctcattagaatgtttaattttgcaagcccatattattagaatattaagcgaactacctcatgactaggaaagtcactcctcttgacattgcaatgtttgtgatgcggaggtgggattctagattatctttatgtcaaagaaaatgagcaatgctatggaccttgggcagagcacaggcagtacatggcttggcaatgtattttctgtaggaagatgtccccttagctccttatctgtggtatttcaaccaggagccctagttaattttcatgcaggagaagcctttgaaacccaggcctcttttatgctctgggaagatttgagaggggtcatccctgtttagattggttctctgcaccagtcggggaagcctgccggctgttctcagcatggagtatgttgcagagaggaaacagaccagagaaccagggcacttcccagcttgaatcaggcctgtcttgtgtgggttcattattttgttggaaattaatcccccaaatggcagacatagtatatttgaatgtgaactgaccgtgcattgcttggccaagtgagagtggtttttggattatccaacctggttgattgtccctgtctctgaacccttccattagtgtagataattgaaagatacctgattttgttttttcacacccaatttgatgtccttatggcgtttgagatggggtggggagtgtgagatggtcagaatcagcttgctgtcatttgcaatggaagcggtgaagtttgcaaacagcagtaccacttaatgagagcttgtcatgatatagccattgtgttcagctcttaatcttaatgaccacattcactcctcacaacaaccctacagtaataataacactagcacttatttggcatttactatgtgtcaggtgctgttctaaacactgacaagtattaactaacttaactcacaaaacaaaccccagagagtgagagtcacatggactaggatctgcacagcacccttgatattaaactggggggaagccctgcttgtgacatgggtaccattattattctcctgttacaggaagttcagaggggttaagtcacctgcccaaagtcacacagtcagtgtgtggagggggcaggaactgaactaaggtccttaggtctccaaagtccccttgctttcttttcattgcagcagcctaagaaccaaaagttagatatttattatacatgggtttggggctctttacagtatgatagaaaaatatactgctttgctaaagcctccccctaccccttggaggtagggggagagagagagaaaaagagagagaaaaaaatgagaatagcaatgccagctaaaactctgctcgaagcacagagtttggtgcatcagtacatgtgagttaagggaacaaccaaattacaaattaaatgaatgaaaaaactggacccaaactgatgcttcctcttcatgctgcccctaatgacgtagctggagtcacttcacttcgggacttctcaaagccctgcctctccttgccagagatttacgtccagtctgaggatcgtttaaacttcctcctctgtccaggattctgtgaccttacttacaaggcggctgtctgctttctcctaaattctgtctcctggttccgaactcattatttctgatccaaccaattctgtaatgtcagcctgtgtaacataatggaaaaacaaacttagggtaaaggaactccagcgagaattttaggtctccttgcttgatggaggttcgtggccctgagcatttctaagcatcctcatgttcttctccaacttcccctatgacagtccagtcctccacatggggaagagaatgttttatctgtacctgtctttggttttgcgtccctgcacccatcccgcaacttgatagaaaaggcagagagcccttctgccatttcttctctcaatacgcccccaccctaaacctgaaaagaagaaaggtaaaatgggctattcaatgaggagtctaggtgttgggaagaagaatctatttcgaggatctgaaattggaacctgcatcagaccttaggataaagataattatcatgtgcagaaaattcaattaaaaacaaaacaaaaaagaagaaaaagcatcttccaagttgttcttaaagtgtagttttgcaatgactatcactgaaaagtaagtgtggagatctgttcagttctgtaattgagttgggaagtcgacccgaaggaattccaaaagccccagttggccagaagaacaggatatgataggatgctgttgatctgctttcgtttccatgccaaggtgttttgttttgttttgttttgttttgtttttggtaaacttccattcatgactgtgtacagccagaagccagtaggacaacagtggctttgtaaatttgcaacagatattcaaacaagataagtacataattagcatggagcagcagatgaggtagtgtggaagatttaaattctgcgtagggaattagcaaacagttcctgataaccacattctgaacatgttgctgttcgatgggtgtgaatggatcgtgtaggcacagcccatctagatggctaataatagaagggattgttcaagaacaacaatgtattgtgtgcttaccatgtgacaggtaatatgctagactacttagtgatataatgctttcttcgtaatatctctgtgaggtaggaactattataatccacttttacagataagggtgctgaatctctgattgttgaagggacataaccctgccatctctccttcttgatctatatatgtatctctatctatctctatcatacacacacttacatctctaatgaatggcaaagcttggatttgaatacaggtctcatctaactccaaattctatttctcctagaggaagttcaacatgagggatttcgacaaaaaggttgttaaaagcagtctgattgactttcacctaacagatctttccttcatcatcgccatcattttagctctctgcaaagtcatcacatctgtcactgacgttgcacctactttgacacaagctgtgggctacgcaacttgcatgcatgaactcctggggaactcacagcaaaccttcataggtaggcaccattatcctgatgtctgactcaggtgagaagccagaggctcgttttccaaagtcacatacgtagaggtcctgccaggacccaaatttggtgactctgagtcctacattttgcacttttataaccacacactcttttgttttccaatcaaagcttgatcaatggttgatgatagatagatagatggatagatggatggatggatggatggatagatagataatagttaaaagaaatagatgtgtgtgtgtgtgcatgtgtgtgtgtgtgtgtgtgtgtgtatatatatatatatgtacctatacagaatatatacctgtatccatatctatataaatttggaattcaaaattgtgctgtctttctctttcttctgagtcgtctgaccagcttgctgcatttgcagccgccacagtgcatttaactccttgcttgcattggtattcctctttggagcagccccgtcacaacagcaattggaataaaaccccaaagagtagtgcagagaatataaatgggttatttttcacctcaactcaagtaggacagaactcttataaagaaccagggaacaaaggttccatgacaaacatacaccaggggactttagctctctctgatacagcctgtgtgacataatggaaagacaaacttacgatcaaggaattccagtgagaattttaggttgccttccttgatggaggttcgtgggcctgtgtgtttgtaagcaccctcgtcaatagcatttatcgaatatctactctgtaagtgaggctactggatattgcctgtctgtataggttatcatgcagtgagcctggatccatgtgaactaaacagatgtattcagggagaacgtttatctctctaaataagcaattgtttatcaacaatataaatatctatctacataagtgattgtttttatcaaaatcatgagaatcattaaagagaatttacggcaatgagattggaaataagagctttctggataattaaaagctgatgtgaaattaaatcttttattttcaaaggcagagtagcagagtgcttaaggatatgggattggtaataacccttgctgagtttgaagcttgatcccaaggtcataccatcttgggcaaggtgactatgtattcttaaacttggtttattttctgtggtaggaagacattttaacatctgtgcaaccttcataaacctttgactgatgcaatctagtctctgcgtgaaattccattcaatgggggaaagcaatacaaaatgttaaaactgaacattttttaaattttaaagcattttgaaaaacctcttttaaaattaacataaattaaaacaatatatttctgtcttctgaaaaatatacatgtgaaaggaaattcaattcattatttttagtaacacttctcatgtcctctttcctgccctgttctctgggatttacatggtgcaacaactttttcttggctttccccccatgcccacccccactgtctaccgttgacccattcagattctctccctttatttcccagattattaaaatatatatggttttggccttttttcagtcagtgcttttattccttctcttcttccttccatctctcccaccccttccttttatgtcattcttaaagttcagcatcacatatgtccgcggacctgtttttcagctcagcaggctggggagagagataaacaagaaagaaagtctgtggattagaagggtggtgagaacctggaaacatttccatatcaatactttttggtttaatcaccccatttgctttgacttctacctgtcaacagcacacaatgaagaccaagccacagagcctccattcccaggcatgggaaaactctgtgggtagttgagatgcagcagtacccaggttcacttggggcccttttctccatggtcctgataggacagatgagatgcgaaaggatggctggtattttgctcggccaagaggtgaaagggcacaggacaggaggagagtggaggaaatgcaagttggtgtgaagctgtagctctggtgagaataatgtatgagatgagtgcatgcatggtgattttgactataagacccaagaggacccctcctcatacaaatggatacaggtgggtgccaacaggaggaatgcgctgttcagtgtcctataaggttagcaatcatgtcagttttcaaagtccacagagaagtggtgcctgtggtcaacctggaagtatgacggattggataaagaaaatatgacatatatacatcatggaatactatgcagccgtaaaaaaagaatgagttcatgtcctttgcagggacatggatgaagctggaaaccgtcgttctcaccaactaacacaggaacaaaaaacgaaacaccgcatgttctcactgataagagggagttgaacaatgagaatacatggatacagggaggagaacgtcacacaccggggcctgtacttggtggggtgcaaagggagggagagcgttaggacaaatacctaatgcatgcggggcttaaaacctagatgacacgttgatgggtgcagcaaaccaccatggcacatgtatatctatgtaacctgcacattctgcatgtgtatcccagaacgtaaagttaaataaataagtaaataaataaatggaaaaaatgaaagtaggatcatttccacatagcagtctcttatctgtaacaaatatatatatatgtgtgtatatatatatatatgtatatatatatgtatatatatatatacgtatatatatgtatatgtatatgtgtatatatatgtatatatatatgtgtatatatatatgtatatatatgtgtatatatatatgtatatatatatgtgtgtatatatatatgtatatatatatatgtatatatataaggcagtcagaaagaaaggatggtccaagaaggggaagaggttgggtaagaggactgaggcagaaggaggcaggcatgcccaaggtcacctggaacccctgacccttcgagagcagagttcatccttggagccctgggacagagatgtgaatcagagaagttgatgagaccagattgtatggatttggaaagttagtctaagtctttgaacttgacattggttgcagttgtgaattttgaaaagcgattaaaccgatataatcaatatgtcaacatgtgcttaggacaggtgctggcagtctcagcaccactgacactttagccagaacacttttgctgtgggatgctgccctgtgcattttaggacacttcgtagcatccccggctgccactcatgacatgccagcagtgtcttcctctcccgttttgacaaccaaaaatgtccccagacattgactaatgttccctgggaagaaaatcacctttggttgagaaactctcatttaggaagatactgctaagagcagtatgtgggatggatagaaggcatatgaaaccagaagcaagaggaccccttagaaggctgtagtaaaacttaggtggagaagtcctaataatgtgtgcaccccaaagcgtaaaccttacacctgcattccatgagtagatgtgagatttgtaggaactttgagaaagaagaatgactggttggagtatttagcaggaagcacaggggtcattttttgatgtattttatttattgaatgatttggttacttatttttctttttttaatttcattttaagttccaggatacatgtgcaggacatgcaggtttgttccacaggtaaacatgtgccacagtggtttgctgcacctatgaacccctcacctaggtattaagccctgcatgtgctagctatttatcccgatgctctccctccccatgatgtattttatttttctgaatctattaaaaatggcccctcagccaaaggagcaataaattcactcccagcagggatgttagccaaatctcttttccccattcaaattaaaagacagcatcaacaatatttgatgttgaatttcttcttcttctttttttttaaacttttaagttcaggggcacacgtgcaggtttgttacataggtacacttttgtcctgggggtttgtcgtacagttgattttgttgcccaggtttaaacttactacccattagttatttttcctgatcctctcccacttcccatcctccaccctgaagtagacaccactgtctgttgttcccttctatgtgtccatgtgttctcataattcagttcccatttataagtgagaccatgcggtatttggttttctattcctgcattagttggttaaggacaatggcctccagctccttccatgttcctgaaaaggacatgatcatgttcttttttatggctgcatagtattccataatggatatgcgctacattttcttaatccactctatcattaatgggcatttaggttgtttccatgtcttttctactgtgaatagtgctgcagtgaacatacacatggatgtgtctttatactagaatgatttatattcctttcggtatatccccagtaatgggattgctgagtcagatggtagttctcttttttggtctttgaggaatcgccacactgccttctacaaaggttgaactaatttacactcccaccaacagtgtgtaagcattccctttgtgtccgcatgatgttgagtttcttaataaaattcccatgcccttatcccatcatcttttgtaacgttttatttatttttaaaactccttacaattgtccatttttgtctagggtttactcagttcttcactgccagctggccattaaagacatttggaaagaaaaatgctgatgcaactgtgctcttgtacatattgcataatcaaccaaaatagccccagaagtgattatgcttgaagctacaatgacagcaaagatacactgtcattcaccttgaccccatttgagatcatatcatttactcaagttcattgtgtttctaaaacaacaatttctcttagaatgagtgtgtttttgattgtgtgcccgtgtgtgcacatgagcatgagtgcatgtaccgatgaattttacactctgtttccaaataatcttccatcacaattctgtttatctcactcctctgctcaaaaaccttcagtggctccctattgcttatcagatcaactccagggcagtgtcatactgaataccttccatggcccaaactctgttttcctaatttcatcttgtcctgcaatattttctgcatttcactttttaactaagcaggataattgtttaaatgtttatagtatcaacagggggactatagttaataatcattccattgtagatttaaaaataactaagagagtttagttggattgtttgcaacacaagggatgcatgcttgaagagatggagaccccattttacatgacgtgattattattcatttcatgcctgtatcaaaacatctcatgtaccccataaagatatacagctatctatccacaaaaatgaaaatttaaaaacatttaaatgtttataaaaatgaagaaatgaatcaatgcaattccgagttcatttacaacattagatgactgatacagaataacaagatatagactttcttatgctcactttctaaatcaaaattgttatttgcttctgacagggtattcggtatttaattttactatgtcagacaggaaatctagagctgaacatttcaagtgtgcgtgtttatgaatttttcattaattactctgactgaaattggatacaagcctagcttagaagatcacccattgcttatttactcagattgttatccaggtcacctactatccagtgaaatctatcattattcctttacttttgcttgtttcatttgccacatgctttgctggaggtcttttcagtctccctcctctcctctctagccgttaggcagagttcaataactgatgtcttgaaaaacttcatcaggactcacagcctaagcaagtgaaataagctgccttcttggtcagtggagacagatattttcatgtgtctctgtgtccactttcttcttttaaataaacttgtgcaagaactaggtaaaatatctttcttctttctctctcctcaaactcactttgccttcctgattcacctccatgagttcccttttatagtttctgggacttggggagggtggcccagtagcgacgaaagtgcaagtggattggtgactgaaaaatatctgcgatcatgtacgtagaacaaataaagataaaaacactggggccgggtgcagtggcttatgcctgtaatagcagcactttgggaagccaaggcggatggatcacctgaggtcaggagttcgagaccagcctggcaaacatgctgagacgccatttgtactaaaaatacaaaaaaaagtagccaggcctggtggtgcacacctgtagtcccagctactcaggaggctgaggcaggagaattgcttgaacccgagagatggagggtgctgtgagctgagatcgtgccactgaactctagtcttggtgacagagtgagactgtctcaaaaaaaaaaaaaaaaagctgatgaaaataagtccattcccactttcaaatctctgcacatggcccttttaaaacaattcctttatcttcgtgagaaatggcatttgagttttcgaattctagtaaatagccaccactgtaaatctgcaggctcttgatcctagatagccattgcctctacagaaatctgttgagctgagggaaagttctcccattgaaaataattctgtactttacatgcagcctgtggtccctgacaattgatatattgccgcagaattaaacacgcttttctttgtcattgctgggcagagatgactttggtttatgaatgttccagattactttctacctgcctgtctctgctgagtacagagaagtttcatgacccagtgcctccatctgattccagatgacacatggatgaccccaaaatgttgcagccaggttggaatgaagtgggccagattgggaaggacttgactggattgaaatggagtgggctagactgggatggagtggaacagaatggtagagagaaatcagcccataggttttaattaaaagccattgagaaatggcttttaattaaatatctgtattaagatatatataaagaaggcatggcatgcatccaggccaggcatggtggctcatgcctgtaatcccagcactttgggaggccgaggcaggtggatcacttgaggtcacgagtttgaggccagcctggccaacatggtgaaaccccatctgtactactgataatacaaaaatgagccaggcgtggttgtgcacacctgtaatctcagctactccaggggctgaggcaagagaatcgcttgaacctgggaggcagaggttgcagttaggtgagattgtatgacttccttccagcctgggcaacagtgcaagaccctgtctcaaaaaaaaggaaagaaaaaaagaaaagaaagcatgcactctttgagaaaatgagataatgttgctgagaaggagagtaatgttgattttccctctggacatggacaaaatatatctgtgcatatatattaaaattatgaagactatcttttgcttagagtgctatcatcaacttgtataacttgcaatgtgttaaacctctgcacaagagggagaaattacctggaatatacaattttttaaaaccccacaaattacagtcactttctgcctagggttgtgaacagatgactgcaaggagtttggctttcacattcccagtggatgagagaaaaattggcaattgtttcttcccttccaaaaagcagaaaagtcctggcatatcctcattgtgtgtgtttcaccaaaatcagtgtctttgagtcctggtgttagcctcatctttcagtttttccatcttgaggaaggttgtttttttctctacctagtaccaaaatagtacgtcaaagcaaaagcaacttccaaacaactggctgttccagcctctcccagatgtcagatgatgagtgtgattgttttagtggctcagacatgccctgtgagagttattatgactgtacagcagacaaacagaaacaggctgctgagccatttgctgggtcatccttgtcctgggaatcgagccttctcagccagtccatcaagcttcaccagtttcatctctgtaaatgtccacattatggtgttttctttgcccattggatcagcgaggctgtgagtgacagaaaactcaggaaaacagtggcttttaaaagttaaaagtaggctttcttcagtccaggcatggtggcttagcttctaatcccagcactttgggaggctgaggcaggtggatcacttgagatcaggagttcgagaccagcctggccaacatgatgaaaccccgtctttactaaaaataccaaaaaacaaaacaaaacaaaaacaaaaacaaaaaaaacctagctgggcatggtggcacacatcgataatcccagatacttgggaggctgaggcatgagagttgcttgaacccagagacaaaggatgcagtgagccaagctcacaccatcgtactccagcctgggcaacagagtgaggctctgtctcagaaaaacaaaaaaaaaagaaagaaagatggatattttctttttaaataaggtgaaacgtagagatgacaaagacagaggtgcagagactccttgacttcccttctattgcggtattccaccatccagaactcttggtttctgccttcccatccaagacagtggcttgatttcggccatcataccctcattcagatgggcaggaaagagaatcgggaaagttaagtcacatttcctctctttaagggtacttcctggaagctgcatgtaccaatttcacttacatttcattatcccgaaattagtcacatgggtacctctacctgcaaaggaggcttggaaaaaagtagtagatattatggcggtggggggtggtgagtgtgccctgctgaagaattgagtctcttcttaagaaaaaaaggagagatggggaggaatatgacactgtttgcctcatccatattgagggaggcagtgttcactgcagcagcatctcataaacattggttaaaactatgcgtttgtagttattttgctgtcaactggattgcaacatctttcccaacaattgattgctcacttttattttcccactttcattcggcctggattatgttatgttctgggaagaatcggaacaaagggttgagggctgtgatttattatttaaagtttaggtgggaagaataggaacagagaaagatgtctctgccagctgggattgtgtcttgctcatctttgattttccttgcaacctcagtgctcctttatccaaggaagcgcccattctaagtaccagggtcacagtgggcaacaaggcaggccatctcacaaccctcatggaaataacagatcaaggtaagtaccatcaaggagattaatgggatgaagttgcaaagaggcactgaggccgggagagggcccgctttagatgtggagtagacagggaaggccactttgagatgacatctgatttgtagcctgaaggatgagattaaagtcacccactcaaagaaccagggagagagctgtaatgtgcccaagactgaaatggggaaaagtttggtgtgtttaggagaacacagagtgcgcctgtgggttgaaatgggttgaaatgagaaagagatgccttatatagagaagatgtcttatggttctgctcaatattggagggtcatactttctgcttccccaggaattttgtttgaaatccatttgtgtagaagttcttagtcaccccagtcttagctggaatcattctagcatagaattgaatttgagcattgagaattcatgctcaaactgtggggccggtgtgggatggcaaggagaatgatatctatgttttcacgggagggtataaagagagaggctctgataaacacattcaattggttgggggaaaaaagtaaacttatttggaggtacatttctggaatcgcctgatttgaactgagcagtgcagcctccatttatgaaaccatttctctgaatgtttcttttttccaatctgtcttccattctgacagatgtggcatatcttgtgcccaattcaacaagaactagtctccctcccttcctgtctctctctctccttccttggagcttagagcttctgctagtgtctgctcctttcctagttggcatggtagttgctccatttgtttttgtaaattgaggaattttctttttgtttgtaaatttgtcattatctcctacaaagcaccctgccatggttttttaaatatcttgatgtcttcacattggaagcaccactccatctgtgaactagatgcttccatcccaaaatgccattccaaaggagaaagttggaaccaaaagtgttggtagcagtggccaccaccagcaacatccactattacaggattaataggaattaaatctgcttcagctgtgaagtgagccaaagctttacttgcaagtggggctaaaacatttttttttaaggatttaccttaggtaaattgttctagactattttgactttaatttgctgagggtgaatttgcaatggggattcgataaccttactttcatagagtctcaaaacttatagttacacaacttcttctactgcctgcccattgctttgggttccttttcttgcaagttgcaatttgtttggtttttcagtgttctcttggataatccatctggatcactttgactaccaattttgcagcttcctgtcatgaaaggagaaaaactgaggtccaaggaagtatgcaaccgtttccataaccatgccatatccctgcatgaacttggcttgactttctcccagtgaagttgcactgggtatgcagtgggctccagagtcatcaaagtggctgttgcccttaaatagtcattgcattatactgttctcttgttggaaacccgtcaaatagtcttaaactgaagttcaaatgctcccactggctggtaggacagtgagtgatcagattgcatcaggcccatcggttctcattgcttaccattcacctcctcgctcacatcactacagccacagggcccttctctgcagacctcagacccaccacattctcttcctcttcaggaccttttgctcatactctccccaccgctaatgtgctcttccccttccttgtcttcagtaatccggatcactggatagaagccacaccccttggaaagcagtccctgaggcctaagtgccaggcaggtgctcagctcttttttgcagcctatgttgtcttttcttagcatgccactgaaacttctaactatctgattagtttttttgttttatttctgtcttgctcaggaaatttcttttccttgattacctctgagtccatggcatatgacctaacatgtagtaaatgtgcagtgagcattggttgaataattgagcgaaggaactccgagttctgtgtgtgggaaccgactctgataagagcaaacgcttgacacccaacctcgtcctgcctcccatgccgcatcaccctatttccaatattgtgggtggggctgatggttcaaagatgtacttcattccatttcctttttccctacaagccattcaacaaccataacggagacagttatctggggctattttctagatgttagacacgaggaaacctgaaaggaacattatgctcttcgcacactcacgtgtttgtctggttaccctcgggcctctccaagtggccctattttttttttgacattttgtttttttgtttgtttgtttggggtttttgtgagacagaatcttgctttgtcacctaggctggagtgcagtggtgcagtctcggctcactacaacctctgcctcccaagttcaagtgattctcctgcctcagcctcccgagtagctgggattacaggtgagcaccaccgtgcccagctaatttttgtatttgtagtagagacggggtttcaccatgttggccaggctggtctcaaactcctgacctcaagtgatccacccacctcggcctcccagagtgctgggattacaggtatgagccactgtgcccggccagtttgacattttgcatagcttacaacatttattaaacatttaaagacctgaagccttcttaaattagtgtttctcaagcccttcttgtgcaggatatgtgcgtcaaccaccaaattagctttggtgcacccagcgtgggaaaaggagcttttctttaccatgttagctctctcaactgccttccttgtacttttagcttcagcctttttgaaccaactactctgaattcttcagaatccctctgtctctcttccttctgccccctcttctgcccagattcttcttgctccctctcctcctcacttcttgtacatttgaaaaccctgtcttcctagaagagtcataccactttctcttcacatgcagcatccttcctggtattgtgggtccatggtaggtttattattccttactaaacattctggcttctctttttgtggtatttcttactgcaggaggatttttacatccccatcaggaatggccatacatcttacttcagctaatgaaacgtgggggaagtgagatgtgtcacttctgggcggaagctttaagagcctctatctgactcaacttattctcttctcccactgtggagagatcagtgagtcacttctctatcagcctggacccttgagagaagatgacatgtagcaaagccatagctaaaagacagccaacacatagcctagtgagaaataaatcttcactgctgcaagctaccaaaagtctgaggtcagttgttactgcagcgtctagcccatcctgaatgatattccgttgtgtctcagaagccatttctttgtaaaaccttccaagtctctagcagaatctcagaatctaagagtcttagaatctatttactaacaggccagacacaattgctcacgcctgtaatcccagccttttgggtggcctaggcaggcagatcacttgaggtcaggagttcgagaccagcctggccaacatggtgaaaccccatctctactaaagatacaaaaatcagtcagtcatggtggcacgcgcctgtaatcccagctactcagggggctgaggcaggagagtcccttgaacccaggaggcgaaggttgcagtgagctgagatcgcgccattgcactccagcctgggtgacagtgcaagactctgtctaaaaaaaaaaaaaagaagaagaagaagaagaatctatttaataacagaatcctagaagaaccttagaatgttagaatccttaaagtctgttgcttttatcatgtgttcccatggcattccctcataattagtttttttgtctgtcttctgtatgacattcagttctgtgcaggcaggaagcttgattgattcgcttctgaattccatactcttagcagagtgccttatgattggcattcagtaaatcactgtgactgaaagcaaatggagcagtgcaaagagatttctggctccaccaccatcatgaatatttttgatgggataggttctagtgaaaagcggtatccacctctatggaaacatggtggtgtttgaagagttccccacagccacacaaaatggaggcacccacttggaactgaattgattatttatggcaaactctggatcccagtcaggaatctgaaaaagggggaaaaaaatctggggcagtgatcaaaggaaaagtatttggagtatatgggcagaaaaaaaactgtcagagatattaatttaaattcacaattcatacactaacaccgtaggatcatgtttcttaggtcaatgaactctactcatattatttggtgatttgtttgacctctcctgataaaccccgatttcactatctcctatgtgtccctcctcttctgttccttataggacttgaggggtgtccccttggcttcttatctctttctctgtagcctaagagaaatagaccatggatatatccagttgcaatggaatccagttgattcctttgtgaaaacgagcaacagtcctttctttagcagagaagctagagtcttatctgacagatttctttttttaccataagtttttctgaaggtatgggtggaagactgcaaaaccctgaacatcaacaagcttcagtgttgcagatactaggagagatctactcctaaaaccaacaatcaaaacttctgtttttttccctttttcccatgaaagagtcaactgaattcgggtacaagtcgcttagatttaccaagtatgataaccaggtgtgtggctattctgagcatccatagctgaaacccacaggttggacatcctgtgacagtttcttagcctgcaaagaacagtgagcatgaaagctttaaatgggctattacctttttatatttatcccaaactgctaaggtcagcattaaaatttgaccttttccctgccaacccgtttgaagtaattaacccctgtgtcttgaaacacaaggaagctatgactttgttattaaattctcataaagagcctattaatattaaaattgcttcactcttgggctgaatgtattaatggccttgcactgggtaaacacaaaccctcagctcagtgttttaaaatgcatgagttgagggcagagcatgttcttccagctaccttttctgtagcagaacgttatgccttttgtgacagtttcctctccaatttgttcaaatgcttttgttttgaatctgtgtccctagatttacatctctttatggggaaactcatttccctgctagcaggtatggagcaggtcgaatggaggagaactcccgtgatgacctctgctcccatcaccctaatcatcgccttccaggacagtgctcagaccctaactgtcttggtatgaagcacagcttgtgattattcttttagtgggtccaagatagctgtgttcaagcacctgtgaaatgtgcttaaaaatgcagaggtacgcaatccagcatagacctcctgaatcagaattgacagagatgagaccttcctgaatctgcagtataaattaaattctcaagggtttactctagtaaaccctactgtgaacctgactatagttcagtttgttaattcaatcattcaaaatatgcatcgaacagttattatatgccagggtttatggccttgggaatacagtggaaaattgaaagagtcaggtgtttgttcttagggatcttacagttcatcgaagaaacacacaacacacaaacatgcaagtaaataattaaaaatagttataagtggacttctggaaagatgaagtaaacattttttccctgttcctccaacagagaacaaacaaaatgcctaaacagaagtgcagtcttcccgcagtatcagtgggggactggttccaggacagtccaaaatccatggatgttcaagttcctgatataaaatggcatagtgtttgcatataacctaaaaacatcctcctgtatgctttgtggggacatatctctcacttcaagcatttatcattttatttgtgtcatctgatatactttaaaacatctttacattacttataatacctaacataatataaatgctacgtaagctatgtcagcaagagggacaacaacaataagcattagtatgacagatttctcttctctgctgttttcaaaattatgctgtatgcttaagcaaaaattatactgtctgatgtgattggtgaatatgtaagtagtaaatagttgttatactgtcatttaatttgtattatttttattgtattgttatttatttttaaatttttggaatatttttgatgtgtggttggtagcatctgtggatatagaacccatggatatagagggctgactggatatagtttcaaatcactgagtaaatcccaagtcagattaactgaaggaaatccacaccaagtcacatgatagtcaaacttctgaaaagtcaaggcaacgaaaacatcttggaagtaacgagagtaaaatgcacgccatccttataggaggaaacccatttgaaagagaacagatttctcatcagaagccacagagtcaaataagaaatggtgttttccaagtgctgaaagaaaatacttgtcaactcagaattctgtattgagtgaaaatctccttcggagatgaaggagaaatcaagacattttcagatgaagaaaaactaaaagaattggttggcagctggtctaccttaaaagaatggctgaaagaaattttctaaacagaaaggaaaggataaaagcaggaattttagaacatcagcaaggaggaaaacaaaaatagccattaatatgataaattttccttctctggtgttttcaaaattatgctttatctttaagcaaaaattataataccatctgatgtgattcaaaatacaagtagtaggaagatttaagacaattatattttaaatggggagaggaagggaacataaagggagttaagatttccacacttcattcaaactggtgaaaacatagcaccaggctgtgacaagttatgtatgtatattgcactacctagataactgctaaaaaaatctgtaaaaggagattcactcaaacagactataggcaaattaaaatttaattatgaaaatatttcagcaacctagagaaaggcagaaaaggcaaactgaaaaacacaacagaaagaacaaataaaaaaaaaagaataaagtggcaaaattaagcactaacataccaataattacattaaatggcaatggcctatatacaccctttgtaagagattgttagagtggattaaagtatacaacctaactatatgctgttgacaagaaactcctttcaaatttaatagtataggtagactgaaagtaaaaggatggaaaaaagatagagtatggaaacatcaatcaaaagaaagtaggagtagctatattatcagataaagtagatttaagagcaaaaaaaaaaaaaaacaactagaaatagagacgatatgtaatgatacagtgatacagtgtcagtccaacaagaatagcattcctaaatgtgcactcattaaacacagagctacacaatatatgaagaaagaaatatataactcaaaggagaaatggaagaatatcacaattatagtcagaggctaaacactattaggaattaataggaaaactagactgaaaatcagaaggataaagaacaatgcaaccattatccatcaacgaggactaatcaacattatagaacactcccaatgacagcagaaggcgtttctttttcatgtccatgggagatatcctgggccataaaacaaagtttaacaaatttaaaataattgaaatgatacagtgaccacaatggaattgagttataaattaataccagaaagataacaggagaatctgcaaacatttggccactagacagcacattgccgaataaattccatggattaaagaaggagtctccaggaaaataaataagtgtattgggcagaatgaatgtggaaatacatcacaatttgtgggacacagctaaagtaatactgagaggaaatttatagcaataaatgaatacattagagaagaggaaaagcttcaaatcactaatctaaactcccaccttaagaacatagaaaaagaggccgggtgtggtggctcacacttgcaatcccagcactttgggaggccgaggtgggcagatcactagaggtcaggagtttgagaccagtctggccaacatggtgaaaccccatacctactaaaaatacaaaaattagccgagcatagtggcacatgtgtgtagtcccagctactggggaggttgagacaggagaatcatttgaatccaggaggtggaggttgcagtgagtcgagagtgaccactgcacttcagctggagcgacagagcaagaccctgtctaaaaaacaaacaaaacaaacagggaaggaagttataaagatgagagcagaaatcgatgaaattcaaaacagtaaaacaatagaggaaaatcagtacaaagaagaagctggctttttgaacagatgagtaagacaaacctcctgacaaatctgagcaaaactgatagagagatgacacaaattatcaaacagggaatatcactacagactttgcagatgtcaaaaaggtagtaagggaataccgtaaataactccacaaacttatctttgacaacttagatgaaatggaccacttccttgtaaaatacaaaccatcatattttactcactgtgaaatggataatttgaatgtcctataactgttaaagaaattgggtttttaagtttaaacctcctaaaaaataaatctccagatcaggaggtttttgttagagaattctaccagatttagaatgaagcattaacaccaagtccatatatcctcttccagaaaacaggagagaaataagaacttctcaattcattttataaagctagaattaccctgacagtgaaacaggacaaagccaggagaaaaaagaaaagaaaactgtagactaatattcttgatcaccattgactgtaacaaaatattaacaaatagaattcaacaatatataataataattttataccttgatcacatagggtttatttcggggatgttaacactggttcaatatttacaattaaatcaatgtaatctaccctaccaataggctgaagagaaaaatcattcaccgaatcttatcaatctatgtagaaacatacttgataaaattcaacacccattcatggcaaaaactgtcagaaaaacaggaataaagagaattgaatttgttaaagaacacctaccaaacacctacagctgacatgctgataccacaattaaaaatgcaatgtcatgtacaatgactcaaaaaatatacttaggtgaaattttaaccaaatacaacttatatgtgaaaaactgcaaaactttttaaaaatttaaggggagacatcattttcatggattggaaggctcatcatagtaaagacattgattctccccaaatggataaacagatttaatagaatttctgtaaaaatcccggtaagcttttttgtggatagagacaacactattctaaaatataaatgaaagtgccatgaaatttaaaaagcttaacaattttgtaaatgaagtataaagtgggagaaatgagtctgttcaaaaacaaaacttcttatatagctacagtaatccggtgtggcaatggcagatggatagacacatagatccattttaaaaagtgtatagaacccagaaatagacctacataagtatgtccaactgatttttgacaaaggtgaaaaggcaattcaatagaggaaagataacctttcaacatatggtactagagaaactgggaattcttgaccaaaattttacattttatacaaaaaaggctcaaaatggatcattaactttgatataaaacataaaactataaaacatttagtaaagaaaaaagaggcccgttacattggctcatgcctgtaatcccagcactttgggaggctgaggcaggtgagtcacccgaggtcaggagttcaagaccagcctggccaacatggtgaaaccccttctctactaaaaatacaaaaattagccaggcatggtggcttcagcctgtaatcctagttactcgggaggctgaggcaggagaatggcttgaacctggaggcagaggttgcagtgagccatgatcatgccactgtactccagcctgggcagcagagtgagactctgttttaaaaaaaaacaaaacaaaccaaagcaaagaaaacagaaaatctttgagatttaaagctaggcaaagagtttgttgttgttggtttttttttttttttttttttttggcaaagtttcactgttgttgcccaggctggagtgcaatgacaaaatctagactcactgcaacctctgcctcctagcttccagcgattctcctgcctcagcctcctgagtagctgggattacaggtacatgtcaccatgtccagctaatttttttgtatttttagtagagatgggcttctccatgttggtcaggctggtctggaacttctgacctcaggtgatccgcccgcctcggccccccaaagtgctgggcttataggcgtgagccaccatgcttggcctagagttcttagaattagcaccaaaagcacagttcataaagaaaagaaaatgataaattggacttcatcaaaaaaattttttaaatcttgctcggcaaaacaccctgctaagtggatgtaaagggaagcttcagacttagaggaaacttttgcaagccatgtatctgacaaaggaccaaaatctagaatatatgaggaactctcaaaactgaaccaaaaaaatcaagcagtgagcaaaggacatgaagagacattttactgaagaggatacacagatggcaagtaagcacatgaaaagatggtctacatcattaaccattaaggaaatgaaaattaaaactgcagtgtggtatcagtgcacacctatcagaagggctaaaactaaaacagtggcaaccccagtacttgcaaggttgttgagcattcggattacatacacatcgctggagaggatgtcaaatgatacattcccatagccactttgagatatagtggagcagtttctttaaatgtaaacacgcagttatcagataacctagtaattgccttcctgggcatttattccagagacatggaaacatgttcacacaaaacctgttcaccaatgtttgtagcagctttattcataatagatagaaactgggaacagcctacatatatttcactgggcgaatggctacagaaattgtggtatatccataccacaaaatacaacccagtaacaaaaaggagtggactgttgataaatgcatgcaacagcccaacagcctgaatgaatctccagaaaattatgccgcatgaaaaattccaatttatgtaaaattcttgagatgacaaaataatggaaatggagaacagattagtcattgccaggggttgagaggagacagggaggaggaaggaaatgggtgtggttatgaaagggcaacatgaaggatctttgtgcaaatggaaaagttctgtatcttgactgtattagcgctatcatcacgcaatcccctgatatcatactatggttttgaaatcacccttgtgggaggaactaggtaactacacaggatctctgtaacattattgcctacaaattcatatgaatctagaattatctcagaatgaaatatctaatttaaaagggacatttatgatgttaataaaactaagtgctattcagagaatgagcagaaggaggacagttgaactttcctacataggctgttctttttaagaagaagagttggtcattgatccattaatgatgagaaggaaccagttctgtctagtggaaaagcattctggacaacagagtgagacactgataccgtgtgctgtgaaaacttttagctgagatatgtcgctcttgtccggagagtgacatggaaatatccagtcttgcttctacagagagtcacattgtctggtcacacctatcccactgcaagacaatgtaagtgtgtgtacatacctacatctctgagattattttatctgcaagcttcagggcttgcaaagttagtatatagctgagcatggtggcgggcgcctgtagtcccagctactcgggaggctgaggcaggagaagggtgtgaacccaggaggtggagcttgcagtgagccgagatcatgccattgcacttcagcctgggcgacagagtgagactccatctcaaaaaaaaaaagaaaaagaaagaaaagaaaagttagcatctttcaatcagcaaacatttattgaacactcactgtaataacaactggtggtatttctgcagtgcttgactgctttcagaatgttttcacacacctgatctcattcgcatctcataactaccccgtggaatagtaattattaacacctttattttcatttcacatctgagggcactgagactgaaaaaatggtatgttgttgtgtttgaatgtgcttgatatggtagacatgggggagtcacatctgtacatatagtcctaaagtctatatttatttccattgtgtactgatgatagtactacattatttgatataataatggaagggacatacctatttttaaaaaacactactttggaggaattaacagtttactaaggatacataaatgccatagaaaatattagcaagaaatagaagaaagtgattattttgtctgccaattagtatgataaaggtaactgaccttgtgaaataaagaaggaacaatataataatatttaccaaatattttaaacaattttgtcatcaccatttaccaaataaccctaatacttccctccccagttgatacgtgatggcaagccagggtgagtttttgtatattgcattgccttaattcattgattgatgctggtactgcaggtgttggattattataagtttaagctattctttaattgtacagatagtaagtcttctctcattggaggggatggatatgaagggatttaacatttttttaaaatttaaaacatcatttctcattaaataaatacctttttcttttttcctgcagtgaagaaaaacatagataaacggatgactcaaagtggaagggaacaagtgattttgttacagtcgtcagaactgtggccagaatcattttagataaatatgtcaaatgtgtggaatgtcacggaagtggtcgttttttgtcctcccagcttggggcacatgctcatagaaatatgtgttagttattgagagtctttttttttgttaagacagtcccattctgttgcccaagctggagtgcagtggcacgatcttggctcactaccacctctgcctcctgggttcattcaagtggttctggtgccacagcctcccaagtagctgggattacaggagtgtgccaccatgcccagcgaatattttttgtattttttagtagaaatggggttttaccgtgttggccaggttggtctggaactgctgacttcaagtgatccttccaccttggcctccaaaagtgctgggattacaggcatgagcctccgcgcccggctgagagtcgttttttaatgttggattcatatttatcccacacattgactggttatgcagatactggtcgcattaagttcccaagaagttctcctctctgctgctattctttatcacagcatcctgtttatctgtttccccacgtgtattacagtctgtaattatttcttttctttgcttttttttttttattaactatgctccttccaggaatgaaatctccatgaagacaaggaccatgctcattttattttgtgctttatattcggtacttagatcagcgcttgccacaggacaagtggtcagtaaccatttgtgaaatgaatttgatttaaataaatgtacatttccagaagaaatgggaaatagacctacctggttaaatgagtgtttttatcttaaccggacatgggttatcactttgtaaactaaaaacaatcccatctcagtactgtaccagacacaattgccggaggttcagaaaataattaaagttttgtaatgacttataaattgcattattaaaaagtcaattttcagctgggcacagtggctcacacctgtaatcccagcactttgagtggccaaggcaggcagataacttcaccctaggagtttgagaccagcctgggcaacatggtgaaaccccatctctaccaaaaatacgaaacttagccaggtgtgatggtgtggttctgtagtcccacctactcaggaggctaaggtgggaggattgaatatgggaggctgaggcagcattgaaccgtgatcgcagcgctgcaccccagagagagtgacagaacaagagtctgtctcccaaaaaaaaaaaaaaaaaaaacctcaatttttatcaggacacagaggctcacaccttttatctcagcactttgagaggctaaggcagaaggatcgcttgagcccaggagttggagatcagcctgggcaatagagtgaggtcgaggctgcagtgagccgtgattgcaccacggcaacccagcctgggctacagagaaagaccttgtctcaaaaaaaaaaaaaaaaaaaaatgtccattttccaaatccgtgctgactccttggatcccgaccgctgtatataactgctggtttcccctacatttaatgtgcggtacagagaagaggggtggcaatgaagacgtgtgctagagacatacaagattctgattgcgattaggattactttagaaacttttgatctgctgggattgagtcatgattctgtaaagcccttgaagaaatacggttaccctcgtgtaagctgtctttcacagctcacttttacttggcccggagtttaattccaagtaatcattgggtaggtgatgaggttccgcttctccttgagctgaacgaattaaaatgtgaagttcccttactttgtaagtgggtaggagttcattggacataggccattagtcacttaatttttatgccatataaatggggcatctctttgccattttgcatgaagggactttgtggaaagccataaagaggggcagtaaatgtgcaggcaggtactttgtgaccacgttgcccctttcggctcagtccccttttgagggatgattcgttgcaggcaatttcctgccctagtggcagggagcaggcatgtgctttaaaatccttccttttaagaatgattccttgccctgcaaggttccttcaagttatttttttttttcgtctccaactgggggaaattgtaggactcaccaaaaaaaaaaaaaaaaaaaaaaaaaaaaaaaaaaatagaggcacaacacaagaagagtattacctaatcgcatgaagcataaatctgtgcgtcacctcctactttaataaattgctctttagtttcagaattggtgaatctaagtgggcacccaaagaagaaaaaaataacaattttccccttatctctgaatttctcttttgagctttttcgtagattatcgtgggtctctacaaagatttccttttccttctatttttaggttgttaaaaaaaagtcatactgtgtacttttttctcataatcctttatttgttatttaaagtataaataaatcatagatatttgcatacagcttagagcagagtaggtggggggttattttggtttatatcagagaaaatggaaataaaatagaaactcgatattgtttaaagacagcttaacagcattgtaaggttcataaaagcccaataagctattcttgatcttaaatcttaaatcgttggtgattttcatttagattttttttaatcaccaagaaggttgagatatgtctaacccgttatgtgagtttgaaacaaggtttgtgttctattttccattcctttggtctaaaattttattagacatttttcttagtgcaaaattaattgatcctggtggtgaggtggtgataaatcattgcaggtggggggaaattgatttttataccacctctcacttatttcaatcttagtggaattaactctgttaggttctgggggtgtttatgggtattataaaacatttacatcttgatgtattaaggtacttgagtggtttttagacattattaagggaattatgttaggattagtctggttatcaatttctgtatctggcacctagctaaggaaatggctgttttatcctcattagagccataaatagaattttattaactagcacgtaccaagtgccaaggctggtggtgaaaaccctttctgccttgaaggggagactgtagattcctgagcatgagacgttaaatgagtaagtctttgacaatctgtaaacagcttcctctgcagaagagtgccctgttgccttggagtttgaaaatactgcaggggataaagattccatggaaactttaaacaattgggactgatggatttaatccctctgatacgcttgtgtaagtctcactgaatacagatctgattatctattggccttggagaaggaacactgagactgtccatatggaagattattagggagaagagaaacataaacacactattaactattaaccatgctgtatatttgatctttactgaggctgttgatgtcagggcttggttttatttatctgaattttcttttgccatcaagattagttttaataggcttagacaaaacctggctgaaagattataaacaaaagataatgataaatggtaatgttcccacttggctgggatctggggagagaggaagggagattcataatagcttggtctaggtgaggattttttttttaatgatctggaagggaaagtaaattgcatgctaatgaaatttgcagacgatattaaattggaaggtgttgcaaataggagcgtggactggggacattacagaagcctatcctaagcaggttagaaatatgagcagaaaagattaaaacacgattcatcctagaaaagacagactaatacattttgggggtcgggaaagggggataccctgaatcttgcaatggaactgatgggaaaactcagaaggaaaaatagggaccagaggtagaggaagctacaggcagtctgcagggtggcattgtccaaagactctctgttggtccgtggcctgagtgggataagctgcatcgtcccagaatccaaggacagccgcctccctccgtcctcgcttctcacaacttctggggctgcctttctgctgtctctgtctttgttttcctctctcttcctttttttgttctttcatatctatcagctcacccacccctagtctgtagcatttatttctggtacctttagtaggagaaagatggagacagattggagacaagttggcaatgaagagtgaaaaagattaagggaaggggaggattgatacatgaggagggattaaaagcattgcatttgcatcatgcgtccacacagcatccagaggaggacataagcacacaggcacttagacaatgtaatgtcgcagtactcaggaaggtggccgtggcattatttagccccacgagccagaatatagccagaagtaattaagatagggaaattatataaccaaaattcattgcgggagagaatgagggttggaaacatcacggtttatgtgtttataccggtcattacataaaccagtcacatctgaagggctcacagctacactgaacaggggcttgcttaccaacagaaaatcccgaggacacatactacagagagtatgtggctatttccttttcctttgagattttttgttaatatatatgtctaggagcgtgctcagtctaacatctccaaagcagatctgcatgctagcaatgctagcaacatatgtgtgtgtgtgtgtatgtgtgtgtatatatatgtgtgtgtgtatatatgtatatatatatgtattacatatgtatgtatatgctatcaacatgcaggtctgctttggagatgttagactgagcaccctcctagacatctatgtccagtggaaagagcagtggagagcattgggctaacatgtattgagcagatggtgggggatgttagtaatgagatataaattgatactgtgcagccaactttcagaggtgcttactccatgcccggtgctaggacaagcaccttgcagatgtgatcccacggaattgtcaccataaccttcagagatgggcactgttattgatcccatttttcagaggaggaagatgcatctcagagagattatgcacaccgggaagtgttactctgcatagaagtaggggacagccaggattttccacaccaactccggagcccacgccttgtaataccacgttttgctggtgaatccctaattcagaaaattaccatgaatgtgtcatgggagaaaacagcttccaccgagggtgtgggccccaaagtgctttgttctggaattcattgcaggggagaggaagagacttcagggtaaaagaaacaggtgaggtgtggggacctttgcattattttgtgggagaacaccgagtaaaaaatagtggcggtggtgttggtagtaacggcaaaaacctcagttacttttgtgccgacgtaataacaacactattcataacattaacagttgaattttcagagcatttgctgagtgctgtggataatgttggtgctttctaagcatttttcacagactcctcttagaaagcctccaaggaaagtgaagattaggaggatgaagtaacttgcccaaaatcccgctgccactctgacttgatccaggttggaacccaggcaatttgacaaggctaccccactgcccgcctgagttgaatagagagaaaagtggaagaaaattaggccgtactgcacaccagagagacagaaacgggtgagcgtttgttattgggcaaaataaaaatgtaccactctatagagtggtatcatattaactgttcctgagtagagaaagaatattatctctgtaccatgagaagtaagagttctgaattaaaggtatcacctctaagttttaatttttgcagaagctctcttcatctgaattcacaagtattgactgtttcttgggaaaaatcccagattgcgcatagaccagcatgcttgatctctgagacagatggacatgctgtaatcttaaagtgaaaaatctaaggaaaattttacaaggtaatttttgtctccttttctgaacagcaagtttgacacctagctatggcttcagggccttctcattccttgtaccttgtctgttttttttttttttttttttttaattttactttaagttctgggatacgtgttcagagagagtgtgcaagtttgttacacagataaacatgtgccatggtggtttgctgcacctgtcaacctgtcatctaggtgttaagccctgcatgcattaggtatttgtcctaatgctctcccgcccattgcccaccacccccgacaggccccagtgtgtgatattcccctccctgtgtccgtgtgttcttattgttcaattcccacttatgagtgagaacatgtggtgtttcgttttctgttcctgtgttagtttgctgagaatgatggtttccagcttcatccatgtccctccaaaggacaggaactcattcctttttatactttgccccttcttttaagaggtctttaaacaatctcttagcttcctatcagcctgtaagtcttcagaaccaaggagagcaagctctgcacatcaacaaggtctaataatttcttgagcatttgttatttgccaactacttcattaagtactttgcatctattgtctcatttcattgatccttacaacctactcagttcatagttaagagaaccctcacttgaagagatgaagaactctgtgtaccattgtcaccctgttgcaaagtgactgagtctagatgtgctcctacatctgactctaaaacccttacgcaaccaaacatggtggcccctgcctgtaatcccagcccttggggaggccaaggcaggaggatcacttgagctcaggagtgggagactagtctgggtaacatagtgagactctgtctctacaaaaaagtgaaaaattagttgggcttggtgactgaggcctgtattcccagctacttgggaggctgaggtgggaggatcgcttgaaccccggaggttgagcctacagtgagctgtgatggcactctgtacccaacctggattacagagcaagacctcatctcaaaaaacaaaaacaaacaaataaaaattaaataatatccttaagcctagccattctttcctactacagtgaatgggctaaatttttatttattctgtttttatcccagtccttctcaagcagattctgccattgaagtggaaacattaacaatcagaggcctgttttcttggtgttatggcactggttgaacttcacgtagtatacataggtattacccagcctcaaaaacaagcaaaaattaaaaattctctccagaactcaggtgagtgaaaaatgggaaaggatgcctaactttatagatattgcaccagttcatccctttgtccctacgtgccgttagtatagtgacggagtttcacgttggcacccagagatccttccagaaggaatatgcacatacccgcagctacttttgtttttctttctttctttgcagtactctaattagaaattgtatatctgggaagtcctctgtggtttgacagtgagtggcagagatatggccaaattacctgcaatggcacttttaatttattttctactcctggcttgcctcacgctaaaccgactttgtttctgaagctgttcttatttggagggaacaagaaaaggaaggttttccaagtacaggagtgcaatgcagaaagttcctttttcgtgttgatcttagtgagctgtggatggtgctggaatggatggagagaaagggctttgcctgtgtagcttgtttttaacattattccataaagagcactgacaattaattagactcacacaacatctaggccattggtactgaagtggtagatggtaatcactttgccccatttttcctattatctacttagcagctacaaaatataattctgcttgcaatttatattctttttcatgctttggctttgctattggtactgaaattaaccagtttgctcgatctcttttcctatgccgtcaggacagctctggggtagttcagaaatcaattttcaatcagttcacacctgtacctaaaccaaatcccaatgatgcttgctggtaagctgccgatatttgaaagagtcactgtgctaatgaggccctcacatataatatctgcataaatggaagatgtcattcacaaccagtgttgaggacagcagcctgcagaactgcaggtgggtgggctgcgaagttgggataaatgtttcattcatttaatgccatttttatcacctgtttgcctgaggaagacgccatagcaacaatattttatagctttaaatacggtgttgatgttttctggagtcaggaaaagttgggtatacttacagaaagtggagaggtccttggtttctttcatgccactttgtaaagatgaacaactattcaatcacggtgcagaatacccctgaccttgtgaaatcaggggagaatggaaattattttcccttctcagtcattggtattcagctaggtggtttatgctaggttgtcttagaggtattgtgactccgttcacattatatacgagtgcatggagaacacattgttcttctcattaaaggcttattaactgcagtttgtgaaatggagtgaaaacaaatacgcttccaaatggctggcatgtttcttatcctcttgcctgacacagaaaaccccagggtatcggggaaattcacaggaacaagggcttcaaagaaacattcacagttagccagtcttaaaccgagagaggcaaggaaatcgcaggaatgttgatttcttcgttgttgtttcttttcagatacttactgtaggagtcaagaaaaatgaaaattaaaaataatggctaaaagtatggaagaatctgctcagtggccctggataggggagaaaagggggtcccgttaatttgcaaatttggaattccagatactaaatatgttaagcttagtaggaagtagattctgcataagcctccatgacaaaggcatttgattagaaatatgaaaagaacctcagaaaggaaagtttaagactatatctggaagtatgaattctgagggcgtgtgaactgaataaaaggagccatatacattgtggtagcaatgagtgcagtcttcatgctgacaggagtatttctaagtttatgggagccaaacaccctgaaatcccacatctctacatatggcaaaaggttttcatccctaaaacacctcttgggtgttgccgagtgctgattccatgcacaaggagagacgtggctgtttctttgcctcacagattctgagatgcataatagcttctgctttttgttctggtgagaggtttgctttttaggatgtaaatgaccatcacgttggcttgaatctgttccctgcttttcctgcctatccatccttgtatatcctgcaacctccatggctaaggacaatagggtctgttggtaacctcagaggagattggattgtaggtagactctgtttctctcctgtcctctttgtgactgctctagttgcagtggagacatcggatcccatccagaagcatcttatttacattgatggcccattaacacaacatgtaacccaagaaggaacgcaacaataaatcatcagtcacataattaaataaattgaggcttcttgtgtaaaagtgggataacacacagtcggcggagcgttatttagttcaagccaagctaatattgttagagcaaacattaaggcaggtgacgaggctgcatcaaaatattaattatacaccattttggcactgataataaatgttcacgtatggccctctttccaggagaaatgctgaaatatgtttcaaagcaacgctttgaataattcaataaattattggagtctcagtgggagagctcgactgacatgaaagtcatggcgtccatttttaaccccccatccctggtttcttctcttctccaaagggctctgaatgccaagtctccatgtgtcttaaatgtatcattaaagacacattcccagacagtgagaaatgcagtgtcgataacttgggaagagttcagaaatcttgactcagatgtgtgagaacttttaaaatcacagatcttggcatgaggccaagtctgtgtcctacagcctggctaccttggctgagttgctcaaagtctctgagcatccctctcctccttcatacattggaagtactagtacctaccttgcaagattgttgcaaggaatggaaatgagatatgtgctacccttagaatattaagtttggggagttctggaagatagcagtcgtctccttaataagtgtggttgttactaactatttttacagatctgacttctccatagccttgcctggactccgagcagaaggttactgtgtgttcttttgtttacccactggactggagaatgatccaacattgctctaaaacaggatactgcacaggctcacctgggtagcagattcattcagcctagccagtaggtctttatacaaggaagactagacttggaagaacttgataatcctaaataatattatttatttctattccttctctatctccctgcactagaatgcaacatctgtaagaacaaggattacatttttcccatacatggcaatatttgctcagcaactatatagtggtagagttgacttgaaggatatatttaaaggaatcaatcaagagtgaattagttggggttttaggtgagtctgaaactcaaatgcctacagagatctacagattttgagttgggctgggtataaaatgataagggaacagcatagttcatggcaaaccaaagaaggcacacctcacccaagggtattcagagtcatttgatcattaccaacgacaggcacaaaaaactccatttgaatgcaaattcagcctccaagaatgaactttgtgaacttactgttttcaagttgaagtgggttaggggaacacagtgactaatgactatttaaaatggccaacgagtgccaccaaaaatagtcatggtgttgccagctctatcttgtctatttgttcggacttgaagtgatcttcgttgttttcccagtaggaaacaaacttgctaagaatcctgtattatcattggtgtttgccaatatgatatttattaaattagccaatggatgtgttttgaggacatgtcatgtgtcaaagatgatgctaggtgttagggctgcaataccaaatactagattattcacaggttcatgaggctcatctagcatcattctcacaactgctaacacagggcagtgcctgattcatagttagactttagtaaacatttgatgaatgactaaatgtgtaatcagaacaggaaagtgaaaatcttgcagatcgccagctcagagtatgtatgcatatatacataaaagcacacacacatataagcatacatatatgtgatacatatgaaatggcatattaagaccattctccatttatcgtcatctgattgtctagaattaagaacatttacctatatgtggaggaactccaaaattattatgctattgtttctaatctagaaagatctttaggaaatactggtagaacttcacatcttcagataagcttttcagtctagcttacccatgctttcctgtcctaaaattttctaagttttgatatcttgctaaagaaaaaatgaacagtgttaagcgttggtgcattttgcgtacttcaaccttttctgtctataaacaagcatctgtaaggcacctggaactctgctaacatggctcacatgttccactttgtgacttgatgtaactcttagctgcgtgcagcatccaggtgagatgtgaagctctcattcagtttacaaacagtaaaattactgtgtcttaataatgtatctctatgttgttgaaatttatggagaaaatgtttgtggtcaacaatgcttatcagaatggtgtgaacggtttttttatagcgatgtttatcaagttatgttgtgcatatgagtcatgtagagttgatgcttgggaaatcttgttaaaagaattgcttaggagatcttgttcaaatatagattcagatttggaagttctgggttagagcctgagattctgcttttctgctgaactgcaagtgatgggatgctaccaagtcatggaccacactttgggtagcaaggattttaaacaaataaggtccatgcatcatacatactattgtacatacatgattttgtgacaaaccacatacatgtcctatgctagatactgcgtcatttttgttatctccagtttacaggctgaaaacctgaaactcagtcaggtgagagctgttgtctgagttgcacttctgggaaactgcaaaattgagatttaaacccaagaactctgacttcgagcacatgttgttaatgtccctgtatgttgcttactgtctctgctggtacagctgaagcaaggtcttaggtctctaagcagatagcacctgaatacgcctgtatgcctctgtgcttggctgcattgtagagtgtgtttttagtaatacctgcttggggtactactgaattgaatagggttggaattctggatctaaggtctagtggaaccaacagcgaattctggacattagttctcaaggcaatgcttctcattgagatgctgtcacccccaggagggtatagaccaacttctttagctccagtggtgtgagaagagtaagcagggattgagtgtgtctccagaatctgaacagaatgagcttttatcatttttaccaactatgcccttgatttgtgttcaagatagagaataacttttggagggggttatttctggaataaaaagggaatttacttatctgtttagtgatggggatgatctttcctccaaatcacaccgtggaacagtctttgatcagtagaatttttctttgcagatgtcacagaggtattcgttccttgacatttttggaagtgtggatataggatggaaaggtttggaagggtggaggtaggatggaagggtggatataggtgttattctttgcaccatcaatctacctgtgactggtgatgcaaagtataatgcccttccctcccaaaagtgtaccctttgcagaatcagtaggaagtgaggaagtaactccttttaacttggatgttagcagtcatcatcctaatcattccctattttaatcacagaaataaaaggaagaaaatcattcttgagtcggctaatgctatgttacagaaccatagctattcattggtaatagctggaagactgttctcttatgcccttttaattgagtgtctttccgtcctctagctgtccaatatctgtttaatccacaaacaagactaattttgactcaaaacatagctggccctagtacaagaagatgcattgagcaataggaattataaaatgaaaaggtaaggatggttgcatcctggggggaaaatgccttcccaggcaatttgagcaaacaaaataatgcaaatgtcttctgaatgtagtaaggagttaaggccatcagtaaaagagagcaaattgaatgaataatacaaagaatcatccctcagtaagagaataatgatttcatgaagcagtgtagaaagaggagggagagtagagaaatctgaatgcctttgatagttgagaatgaaatggaaatgtaacagcttcacaaggtgaatatggagaaggggtaggagaagaggaaacaagatcattagagataacccgtggttttaagcaaaatgaggggaagacatttagaaatttgtaaaattgtgaccacagcattttttgacagtggaggaggaggggtatgtagcttggatcgttgtatttagaaactaccttttttatgaattttgctgcattacctgaaagtgagcattagttacttgtataataagcaccaaaatagattgttgtgagcatagcagtgatgtccgtgtgaataacatgtgcactaagaacgaaggtgaatatggagaaggggtaagaaaagaggaaacaagatcattagaggtaacctgtggttttaaggaaaatgaggggaagacatttagaaatttgtaaaattgtgaccatagcatttttggacagtggaggaggaggggtatgtagcttggatcgttgtatttagaaactaccttttttatgaattttgctgcattacctgaaagtgagcatcagtcacttgtataataagcagcaacgtagattgtcatgaggcatagcagtgatgtccgtgtgaataacatgtggagggttagataattgtatgtggaaaagaaagggacatggacaacatagcggtcatcctattgtgtctaaagtgaatttagcacacatgggcgaaaaaggaaattttacgtatcaggtgttcagtgaatattggaggtgtttgttgtggtggtggtagtttttactattctgtaaaatgcacagtttcaaataaaggatattgttatttccactttaaaatacataagaaactaagtaagttcttcttgataccagaaaggggtccaaatccagacccctagagagtgttcttggatctcaggcaagaaagaattcagggtgagtctataaagtgaaagcaagtttattaagagagtagaggaataaaagaatggctactccatagagagagcatccccaagggctgctggttgcctatttttgtggttatttcttgatgatatgccaaacaaggggtgtattattcaggcctcccctttttagaccatatagggtaacttgctgatgttgccatggcatctgtaaactgtcatggcactgctgggagtacagcagtggtcactctgattgccatcttggttttggtgggttttggccaccttctccactgcaacctgttttatcagcaaggtcttcttgacctgtattttgtgccaacctcttatctcagcctgtgaattagaattccttaaccatctgggaatgcagcccagtaggtctcagcctcattttactccgctgctattcaagatggagttgctctgattcaaacacctctgacattcttgctgagagccgtgagttctcttgctggggttagatgatatgagatggtggaggccgcagggacggaattgtttcttttctagatctcttccttagtttactttctttcttccctttgtaaaaggaaaataaatcttgggacctcaaactcactaagccaaagggaaaagtcaagctgggaactggttcatgcaaacctgcctcctgtttttcttcctcggtgtaatggctacaaagatggaaagctacatacctccctcacctcttgcccgcctgaggcaaatgcatatccaatggcatcctttgccgtattgtctacattatcttatgtaaacatgcagattagctgagacagacaaaggcataaataattattttctcttatcctccaacatgaaaattgtatacttctcttgatcttgccctttcccctttaaatattgaaaccttgaaaatcatcttcttagaaaggtattagacctgtctcccaggcacatgttcttaactttggcaagtaaatctaagatgattgagacttgccttggtcattttccttgattaacatgtctttataatctttcaaaagttatagactctgtgttggaatgaatgtgtgtgtgtgtgtgtgtgtgtacatacttgtgtgtgtgtagtttgggtctgtgttgtacaggagtaaaaaaaatggctttatgtccactgtcagtgaatactgctgtgcctttgcactttgactttaaacaagagaaggtgtaattgataaagaaactagaagccaggcatggtggcatgcagctgaagtcctagctacttgggaggatgagttgggaggaccacttgagcccaagaggtcaaggctgcagtaagccatgatcacaccactgcactctagcctgggtaagaaagtgagatgccatctctaaaaataaaatagaaaaagaagctgaatttttccaataaagtcccacatccaactgtctggtggaactaccaccaatggcttctcattggtggaaacagttccacagattttttttttttttttaagaaaaacctaattgcatgtgaatttttctcagacaaaagtagttctaagagtttaccaagaaattaaagttcttcaataattcagtgtcaaatacatacgtttgaatactgaaagcagcctcttaatatccatcttcttattggctttttgtcttgctttgccttgtagatttttagataacgtctaaaggaaaacaacaaaatggttgagggggaacctcatggagtcaatttgtttttcactgtggaaaatttctgtagtcagactgatttttgctccttctaggcgaattgttatatttgcacacattgtcaaaaagtcattgaactatctattgctggtgactgcacacatccctgttaccagctctgtagtcctctgggtttgggtgtaaaaagagttgcctgaaataaatagttaactgaaactcagcctgggagctacatttctgagcacttccgttttctacttcttacaaaatacagttcaaaaaattctagactgacattcaaagtactttttcatctggctccagcctgtttcaaccttaagtacacacagtgatataccgtaggctaggacattgttgtccccagggtacttacaatttccttcctgtcttcatatctttcccccacctggaggaatgtctaccccctttagctccaagtcttatctactcctcatagccacactcagatagtagtgattaatattcatatatattcactatgtgctttacatatgcagaatctttcattttcatagtaccctattaagtgggtaatattgtcattttatagatgggggaaatgagaaccagagaggttaagtaatgtgtaccaaatcacagagctaagaaatattggatcaggggtataaacctagacactctggcttcaaagtctgcctccttaagtattataccagacagcctctcaatacttacatctgccatgcaactgttcttcatcttctccagcaaaatttaagctcgctttttccctcaaatattcctatcgctctgcccgggctcatcattttctgttttgaatatttgttattcattatgatgagatgaatgcatagcctgtctgccaggtccttggataagctcttgggatgcaaagtcaaaccattttctcccttcagggaactgataatctaggtttggagaggggcaagcaataaacatctgtgaggtagatgattatgtgataccttatgccgtatcttagtgtcttttaatagaggtgtgaatacaagatcatagaaacatagggaagaggggctagttcagccctcgtcgcctggtatgggcaggaagactctactgagaaaaggtacttgatctgaactttgaagcatgaatgtaattttcctaaccagagggtccaggaataggattccagtccaaggaagtgggatgaataaaacctcaaatacactctcttcatatgccaatgttcctggatgggtttacaccatctcagaattccagggtgagcgggggggtggtggaaatagacgaattgcaggaatttttactgtaagagtaaaggaaaaacatttcagtgaataaaataaagatgtaatgtttgccttatcctctaaatatttaaaccagagatcaaaaagtcaaatttcaactaggtgtggtggtatgaacctggagtcccagctactcaggaggctgagacaggaggattgcttgagcctaggagttccaggctgcagtgagctatgctggtgccactgcactccagcctgagcgacagagtgagaccctgtctctaaagaaaacaaaaatagattttctgcatggggccaaacaggaaaagggaaatgtctaaaggcaatagagatgggtggggcctggggagagcacagactcttcctgaaggaagcatcagcttgtaagcttattagacttggagacacaaaaatatggtcccagtatggttagatgagttggatttgtagatatttaatgttgattgttaagccctggtaactttgcgtaaattgttttaagcagtgagtggttcacatattttatatagatgggccacttagataatctcacttgcagtttgtggtctgtgatttagaccaaacaggcttagctcagagtttctgtgaaacaggtaacactaagtatgaaggtgcctgcttgtagaccaagtctaatccgtcagcaattcctgagtgcctacttgatgctgagccctctgtgagatcctatagagtctactaaagtaactggatgatgaagagggctcttaggttaatgcaagtttagaaaattgtgttttggcaattggcacataaataccaggttgtccttttgatatcactctgttaaaatgtataattctggaaatgttcctcttgttttgagtctctgatggagaaaataatgagtagcaacagaatgcatgtaaataggaggaatgtgctgtggtgctgcacatttacaccgttccctatcatttaaggagaccagctgataaaaaaagatacatgtttatttcgtttgttccttccctaaccccaatttgctgtgttattcttccggattttcaggaggaatcggcataggatagtaatcagcattgttttcaccgtgaccatgctttttccactatactctctttctcccactctctctcctccaagtccatttctggcaaagagctcttaagcagtgagtttttttttttttttttttttttttttgagacggggtatctctctgtcggagtctctctccatcgccaggctggagtgcagtggtgcgatctcagcttactgcaaactctgcctcctaggttcaagtgattgtcgtgcctcagcctcccaagtagctgggattacaggcatgcaccaccacacccagcaaattgttttgtatttttagtagaggcgaggtttcatcatgttggccaggatggtctcgatcccttgaccttgtgatctgtccaccttggcctcccaaagtgctgggattacaggcataagccaccgtgcctggccccttaagtgtgtctttatagtagaggtttgtatgctcagccttccagcctgtggagctgtgtgctattaccaagttttactctctgagtacatagcctgtagttgggtttgaatattaagtgtcaaattccaatacaccaatgagagatttgaagcaaccagcaggtagcttctacatccctaaaagctgcagagcgctgtctgtgtttatgagcggtctcatttcacacatgtccaatgactggaatgaagctggtgatccagtgtgtgatgctgaaggtaccattacctgcagctgtcctctttcctgaaatgaggaggggacaggggcaatggctcaggaggaaaacgtgcagagcccgctgttcacaaatgtgaaggttactccagagagcgccgggagcgatttgtcagctttgtttgcaaagagatagggagtgaaggattgtgatccttggcaccgataatgtcccctgggccacaaactaatccagcaggacacctgatgtaacacagctattttattcacatatgtctgtatggttatcatagagggcaggaatggaataacaaggcttaggagataatcatcaaacaacgtctccctcttctgtaaaggaagctgagcccaggatcttcatcctttcagccgtacaagcagttgttcttctcacagacatttatcgagcattttgctacatgccttgggcacggttggaaggtccctcacttcgcagagagacctcatccatggatttagtcactcacacgctcatccattccccagacactgcttatgaccttggtgccaagttcagtgctagattttcaaagaagaaaggggataaacatttggctccggaagcagaatcctggctttattactaaaaagctgggtgatcttttctctagcagcctcactatacttatctggaaaatgggtataaaggcagtttcacctcataggtggctgttacgattaagcggggaggggatgtacttttttttttttttcgaggtggagtctcgctctgtcgcccaggccggagtgcaatggcgggatctcggctcactgcaagctccgcctcccgggttcaggccattctcctgcctcagcctcccgtgtagctgggactacaggcgtccaccaccacacctggctaatcttttatatttttagtagagacgcggtttcaccgtgttagctgggatggtctcgatctcctgaccttgtgatccacctgcctcggcctcccaaagtgctgggattacagacgtgagccaccgtacccagcctgtgtattttaagaatacttagcatatggcatggcactgttagtgatcagatccacatgagtttacttgccagaggaagtccatgcatgtgttaccacaccgaggtaccggtacagaccccaagagagggttcttggatcttgtgcaagaaagaattcaggatgagtctgcagagtaaagtgaaagcctgtttattaggaaattaaaggaataaagaatggttactcgatggagaaagtagccccaagggctactggttgcccatttttatggttacttcttgatgatatgttaaacaaggggtgggttattcatgcctcccctttttagaccacagagggtaacttcctaatgttgccatggcatttataaactgtcatggtgctggtgggagtgtagcggtgaggaccaccagaagtcagtgttgtcgccatcttcgttttggtaggttttggccggctttcttactacaacctattttatcagcaagatctttatgacctgtatcttgtgccaacctcctatctcatcctctgacttagaatgccttaactgtctgggaatgcagcccagtaggtctcagcctcattttacccagcccatattcaagatggagttgctctggttcacacgcctctgacacatggatcacaatttggagagcacggataggctctcatggatctgctgtttcactgtggcttaaatcccagcctctacttactggtggccttagcattactgtgaccttgggcattttataaaatgcctgtgaatgcctctgaaccgagtttcctgatctgtaaaatgagaatagtggtgatttgtacagtagtcagggaaatactgggtagaagagggcagttccttggcaaaggcttcaccctcaagcctggatacttgtggccttaaatagcaacagacattcctgttgctttttggcccaccacacccccctatcctatacccatataaaccccaaacacccagttccagaaggagatgaagagacaaacagaagggcagaagaatggcagaatggcatggcagaaagaagagagggagcatctgaacgctgagaggagttcagctggggacagtcagagaggagattggccactgggtggcgaaacgccagaggaagatcatcttcccactccatcccctttccagctccccatctatccagatgagagccacctccaccgctcaataaaacacctgcattcactatccttcaattctgtgtgtgacccagttctttcggggtgctggagaagagctcaggatgcagaaagctgttgcactggtcctctgcatttgcaaataggcagagggtctgctgtgcttgttaacacttaagccatccgtggatggcaaggctaaaagagcacactgtaacacacgcccagttgggctcctgcagctgtctgtcatcatgctccacctcctgtaaggggtttgagcagtggcagcaattgaagagatgagccacacccctgtctcatgtcctgcgagggggtcagggaactctcttgtttcaatggtagtgtctgtgaatgcagttctactgcacagggtgctccatagacaccctggcttgtttttgctttccatcacactgatgtgttagtcatacctcacacagtcactcacagctccccaagtatatcccattgttatgcacttcatgtacacaatgcatccctaagacataaaaaacaatcatcaatttatttgacaaagtgtgctttgtttataagttttcacaataatcagagagtgactgctggtaagccttgatttcttttcaaattcagttgaacgcagctgtaaagtgcctgaactttgcctttagctaagcagatcctaatgggttcagttagcattgtatatgcatgtgattgaccaaaaccttccttctgggttggcaacagcgctcattaaaaagtgaaaatacccttagtgttaatttaccaagcagtgttcgagaatgacaagccatctcaagagactgttttccaaaggttagcttttgaaattaaacaaattatggtgagtttacatatttgttggatgcaagtgcaatctgatatttaaatggatcatgccaccctttggatgttcatggaaaatttggaattatagcctattttggttttttgatgatctgacattcctcatgtggtgcttgagaggttaagaacccagaggggagccttggtaggcactggtattcattggtgacagtggatggaaaagaatatcaggatcttgacccctttcctcgtgctatttctgcccttgtctctgatacttcatctctgttcccaggtaaaaggcatctgccaattgcaacccacagtcttgtttgcaaggaaagtaaccccaagcaatgcagcagctggtggtaacattagaatgaaaggggcaggctgaatactagcaccatgggaaagaaaatgcaagtgtccgatgcaggggccttagccccacaaactcatctgaaacagtggacccttttcctatttttgctcttccgtctcttcctcagaggatgataaataatgtgataaccatgttatttactgacatcattgttaaatggctaaagttgagcaggcagatctaattcttttaaattcatcaattcatgtaattctaaaaatagcgttttgagatgagtggcagtatcatgacttccatattacgggtgtaaagattgaagctcagagaggtcgagtaacttgcccaaggtcacagcgccagcacatggtgaagcgcacgtaagccaccagccagagtgatttcagagacctcattttactctaccttcccaagaccccagcgtcatcgtcactctcacatccaggtcactctctaccatttggccagtttttctcctaaaatatggtcagaacaagtcattccccttctcagagatccctaatggatccttaatgactacctgccaaagcctaaactcagttatttgcagtggccaaaagcgtggactctggcgtctgctgggtctcagttaaaggcgtggctgtccttatcactaagggatctttgggaaacaagtctgtcggggttcagtttcctcaatggtaaaaaaatggcattaaaaacaccaacctcagatggcttcactagaagcccacaccctcgttttaacacaatatacctctgtaacaaacctgcttgtgtgcccccagaacctacagttaaaataaatctaacaaaagcacctacctaactcacatgtacaatgggataccattcagcttcaaaagacaaggacattctgtcatttgtgacaacatggttgaacctggaggtcattatgttaagtaaaataagccaggcacaggggaacaaatactgcattatctcacttatatgaggaatctaaaaaagtcaaactcatagaaacagagagtagaatggtgtttaccagaggctggtgagaggggaggaaatggggagatgatcaaaggatacaacatttcaattagacagaagaaataaattcaagagacctatggtacaactatagttagtaacaatgtatatacttgaatatcactaaaagagtacgttttaagtgttctcaccacaaaaaagataagtatacacatgttaattagcttgatttagccattccacagtgtatacatatttcaaaacatcatgttgtacaccataaatatacacaatttttgtcaacttaaagaataaaaagaaatccctccgccaacccaactacctacctcacaaagttattagcgagacttgcacctgtggtacatataaagtatttagcggagtactcattaaattcgtactgttgttaggttggactcatgaagcctccttcatctagtttcatctttccaatttccctcaatatctttcccacattctggctccggaaaactattcctgattccctcatatggcatggggcttcgtgcatctagcttgtagccctactctttcattaagtgacagtgttttcaatccatgcattatcacagttgccacttttaccaagtccatttactccaccaccacctcccaagtcaggatacattgctcttcagtttttctgctgggaatcttgttttgctgtgccttctattagctattattaatgtgagcttgtttagaaaatggaatgccccatttatctctgaatccctaactgtacctggcatcatgctttgatggttttcacaaagtgggaactcagaaagtgccaaatggattaatgagtggatgtgcacattaaaatgaacacaagtaacttacattatgttcctttgaaaaacatttatttcctatgagttgtcattgaaaaaaaaatccttgaggatcagaaacagaacctggaaactttggaatgtagatttttttctttgcttctttaaattgtagacttatttaaatctctacatatttcaaatctaaaagaaattatgcacaaccagactctaaatccatgtggaataattcagtatttcatatacatgagttctgtatttttgatgggtgtcacatgccaaagaatgtagactatggctagaaattaagtgggcttttgtttgtttgtttgtttgtttttccaattgcctagataggattttgccttattaggattaaagactgctttcttattaagcgatgcaggtctcattgaaataagtacctttatgaaaatgatgcttttctgatttttgtgaaagattgaagcattttagggtaacttggaacattatgagatctagtttccggagatgtgagtaaaattaactccatgttgtgaagattttcaaatgaaaaaaatattacagaaaacgtttagggaaggctacccgtgtctgaggaggtgtgtgggaaatctctataattttctctttattttgctgtgaacccaaaactactcttaaaaaaaggaaaattttataaaaacagtttaggggagtgcctagaacttagcaaatgctctgtaacttaatgctcaataaatgctagaatatgcttctactagatctggacccaaaacatgaggctttacctattaaaagttaagaatatttatcagaattatatgcaagcatttcgtgaagcatcagatatgcagtatttcatttaatccttacggggatccggtagcacaggtagtccagccacttggcagaagaacatcctgaggttccaaggggtctgtaaatgccccaatatcaaactcagggaaaaatcagaaaccgagctttgtttactgcaggttttcagttcttaccactatatgttactgtccgtcatgacaagaccggagatgcaaatatttttatctcaaaacttcctacatgtcctgtggcttcatccacaatgtttatttcttacctgaaatcatgctatgaagaaagtattgcccaaaacacatttggatgaggtggcatattagatacataacttttgatggttacctgaggtggcccctgaacatttcgcaaacctttcatgatctcactccagttttatgactttcctttctcccacacggagatgctgagtgctgtattcatctttctgcctcgctatttttccttcatttccttcattgtctgcttttctggagcattgtaccaaatggcttggttgttctttgctgaacatgaaggactgactatcaggaattttcttttgtcttctggaattcactggctttttaaaaagtcagatatccccttcgactagatggattttatgttttgtttaatttttttcttcttgtgggtaggaatgtgtcatactgagaggcacgtagtatatctatcttggtattgacagcgttgaaccatatgtacacttttgaggtatctttgctcttaagcttgttgattttcctcttctgaggatgcatacgaaccaggtcatctgttgcaattaaaaagaaagaacatttttaaaacaagaaggtctaatctctttcttgtgcaaacaggagactgaggcccagagagagttaaataacctaatcaagaccaaatggctggtaattagcagacatgagactaaacttatgccccttttagtgattcatttagaaaaatatatttttaagacatttttcagaatactaagggagggtttttaggtataaagaatgtagtgaatgcatctttgaaaagtagcataaatgacttgaaaaaatgatattatcagtgaaggcacttcacatattttatgtgggggtgtctctcatacttggggcagaccccactgccattgattctgttgggatatgatgcttgaggttcttattcttaaagataactgcaccaagtttgccttgatcgttttactatttccttgagattactttcttgagatgatgagaccagcttgaattttcattgtagttgtgagacctttctcaggttgaaatgaattctgataagctgattatctctctgaagaaaatatgatgtccacatttcatagcttagttccgatcacttcagtgccattttcgttctgagacatcttcccgggtctgaattaaataagataataaggtgctctggagtccagtacgtattaaatagatttttttttttttaaaaaatcgaggcctacagagtggaggatggctttctttatggtgtattttctttctccatgttgaagtaggtagcagctagctagtttctttttctttatagagcaatgagttatgaagctcaaaaataaagtgttctcagtggtgtaaataaagcagtagtctgagtaaatatatcacactatgtactgagggtttgctttttgcgttattttgtctctttcttttccttctccgctctggtccagtttatgccattgtgtattgttgacacattaatcttggtaatagaaatggaaagctacttttcattgagaaatagattcaaaggaaaagatgattaatgggctgggcacagtggctcatgcctgtaatcccagcactttgggaggccgaggagggtggatcatgaggtcacgagtttgagaccggtctggctaacatggtgaaaccctgtcttttttttttttttttttttttttgagatggagtctcactgtgtcaccaatgctggagtgcaatggcgctatctcagctcactgcaacctccccctcctgggttcaagtgattctcttgcctcagcctcctgagtggctgggattacaggcacgcactaccatgcctggctaatttttgtatttttagtagaatcggggtttcaccatgttgatcaggctcgtcttgaactcctgacctcatgatctgcctgcctgggcctcccaaagtgctgggattacaggtgtgagccactgcgcccagcccaaaccccatcttcactaaaatacaaaaattacccaggcgtggtggcaggtgcctgtagtcccggctattcaggaggctgaggaaggaggatcacttgaacccaagaggcggagattgcagtgagccgagatcatgccattgcacttcagcctgggaaatacagtgagagtccatctcaaaaaaaagaaagataattaatgaacagaagttccatgcattcccaatgatgtgtttttttatcctggctctataaatctgtctgcattgcagcctcttgtgagctcccagattactgtatccctcctccgtctcacctccatggaactggtggatttagctccaaagctacctggtattgctaacggaggaggaggacacttagaatcttgaggactatcttccctacagagccgtatgcctgaggaggggagacgaatggctgggaatgatctactcagaggggagacgttacttagaattgctgtgttggtgaccagcatggtggtgcttgcctgtaatcccagcactttgggaggtggcagcaagcggatcacttgatgccaggagttcaagaccagcctggccaacatggtgaaaccctgtctctctaccaaaaatacaaaaactagccaggtgcggtggtgcacgcctgtggtgccagctactcaggaggctgaggccggagaagggaggtggaaattgcagtgagcccacatcatgccactgactatactccagactgggtgacacagtgagaccctgtctcaaaaaaaaaaaaaaaaaaaaggaattcctatatctgagagacgttgctttgtaaacctgttgcacaatttctctctccaatgacaacaatcaacagaactagtgagatgatggataataaccaaagtgaatctgttgggaaggggtgatgcatggtagaggagcttcctgtgtgtgtgtgagagctaatcacagccccatggcacgtctgagctcctttcttgtaaaagcacatcaatcagtgtctttctcgggttatcccaaatccttccacgggtagtcataagcatgtgatgtctacttgggatggaagcattctcattgagagcaaatatagcacaactgccattcagaccacagttcaagttgtggcttctcagtgagaacacgtaccaatactaaccctctctgaacatcatgcttaatctgtgaattggagataatgatgcccagggcatagggatgtcagtgcaatgctgcatgcaaattgtttatcagagtgcatgacacagagttaacatgagatgctcctcctcctccttctttttcctgttaatttttattattttcttgctattggcattgtctttatttacacatactcacatgcatatgtctttatcagtcccagatagatatttactgagttcatttaaatcgcaataatttccatcacttttacctgtgtctcaaggccctcttcagcttgggaggacttcaatatgactcaagtaggtacagctttttaaacacatactgtagtcatactcttagctttttttttttcctgtattacctcatttgatcatggggagaatactgtaaaagagtactttttatttccacctcgtgcattggataattgtggccagagatggacagtaactcacccaaggtcaagcaactagcaaatgctggagctgccagttgcaccaagtgggtatgacttccaagttcaaagctctttcttcacgtatgcacttgcctctgaatatcatggtctgtcctctaactgaccccttaggagctggacatgaggtaggtaggaagttgagcttcaagaaggagctgtcagtgcagggtggtccatgaaagcccctgggtctcagatggcagagaaacatgtggtttctttctagaattattcactccttcactgagcccatatttaaagcgcgttggttttgctctaggcactctgttgagtgcagagtatttggtggggtgcaaaaccctccatgtctgagtcctcaggcagcattcagcctggtgggagagacaggtactaatcaaatgcttatgttttcctgtatagttatagctgagataaatgcaatgacaagggaacctgtcctagatttgctgcagaaaccaatcaaaggaggctttgctagggaggcagtatttgagctgagagttgaatcatggatggaaaccacacaggggatctcctttcccttcaagccctgctgctggagccgggcaagttgcaggggaccctgagggctctcagttatcgctcatgcatcgaaaggaatggaactttctgcattagatttctgcagagattagcacttcttttacgtcagaggcatttttatgtaagaagtctactgatttcttcatggatgaaatcctttggccttcttaatagcacgtgtgtgccaggccagctccagaagctgatagattcaggtgaactcagttcatgtgaactcaggagcatttgctgagaagcctgattcctcttggtcagaagaactcactggccgtttctacttagatgggaaggagcattttcatctcccaaacaattttgtgcaatgcctgtaatcagccagcagttgccgtccatttctgcctgtcttttatcattgaacctaaaagaatctgtctgcaggaattaaaagttgtcgttttctctgatatactatgccttgcactcagtacctctaaggaaatgtcacagaccccccaaaactcccccatttaagtggtggaaacatggaattctctagtttcatgatgggattggtaaaggaagatatagctactttgtgaacttggtgcttataccttctctccttttgctagacatgaacctgaaggcaccacccaaaaagtcaaactagacaacatctctatttttaaaaaaggagaggcagactaaacattacatcagcgtaaggacttcagagtcacacagaactggatttgcattctggctttgctgttgactagtggtaaaacctgcagcaagttctttcagattcgtaaacgcccccctaggtcatcctcaaaagagaaataatggtggttgtgcttagagagacttctgcaagtaaagtgcctagtacatggtaaatacttggtgttggatagtaatcattattgccgggcaggaggctgaggcaggagaatggtgtgaacccgggaggcggagcttgcagtgagccaagatcgcgcactgcactctagcctgggtgacagagagagactcatcttaaaaataaaaaaaacatcatcattatagctattaatattgtccaatactaaatggataagaaataaattatttcttatttatactaaattatttctttctaagtctaattgatctaaatacatatgtaaataatagtcattatataatatcatttaatatattaagtcattatataatatcatttaataatatataatagagaaaatgatataacaatctgatacataatgagttttaattatatatttttataaatgatatttatgatttatatctttagattattaatatttatgtatttttataaatgataatcatttatgttatttatatatttctctattttgataattatttccatattttatacatgatgattgtttatattatttatatgtttatttagattgttatttacatatttgtatcagtgataattatgttatttatatgtttatttggattattacttttatatttctataaatgataatttatattatttatatatttatttggattatttacatatttttataaattataatcatatattcatttaggttgttatttacatattataaactgtaatcatttatatattcgcttaggttgttatttacatatttttataaatgatatttatgttatttatataagtttctttggattgttatttacatattttataatcatttattcatttatttatttaggttattatttacatacttttataaatgataatttctattatttactgagttatttggaatgtcatttacatacttttataaattataataatttacattgtgtatttatctatttggatggttattatttgcacatcctataaatgatcatcatctgttatttccatatttatttatttggattgtgattattatttgcttattccttatgtagatccttgtggccctgtgtgtgaatccatgttcttgagcttgcaagccatgtgttggatcatctgttttgcttcgcctttgtggcatgaaagcaatcttagataacacttacataaatgaatgcacatgactgcatctgagagaaacttttttacataaaaatactggctgtgtgttgacttgactggtggaccctagtttgctgagtgacagggttgcctgcacttgaacatcctgctcgtgtggctctgagtagttcttacctggatgacttagtcaccaaaatgtatgttgtaagtaaaagaagccccttggagctaggctgagccagagaggcagttttttggggaaatgcattggtgtcacgtttggtatgcattggatgcagaaattgcatccctgatttatgcgaaaagcaggctattcgaccaggtatcaggagttgtggaataagagatgcaaatgctgtctggaacagcaggtgccattcttagaaaaatagatatgggggatgtagaggaacaccaaaagtatttcccaactatcactcctaaaacaactttgctcagtagctgtctccccctgccactttttaaactctacagcacattttaagtgccttgtccgagcctggccagagggacgtctctctgcttctacaagaataccttgatgatatttcccagctgaaaagacttacctctctcctctcaccctatacccaggaagttttaattttatggagattgaaataatcaggtctcatgtgtatatttcctttcaaaccactgcgttcgcctgttttgaattcaatggcctgtcttatgtactcggtggagaaataatataaacaaaccttgaaatttccctggagttcagcttcccttttcatactgggtctagctaaagtttggagccaactaaaaagagcctcattgccttacacacaccctgttatctctggcgggttcaaatgcaatttctctgagaaggctgtggtacctctgctctctctggccttgaatctgagcgtctaaggatttctttggagtacacacagttgcatccttctgacagacagtgcaaattaaaagatccggcgcggcccaggaaccagggacccaaacttgccccttgggttttcatttacagttaggcactgcagacacaattattgctgacagggaagcggagctggtggcagagtgcgcctgacaggaggctcatgccagcccataattgggaggattatttttaatcagaacataccctacagcccaaacattagaaatctcctgtaaggccaagacaggaaattaaacacaccaacaataaggctcaaagggaggcggtgtgtggggtgtaatattgttagtctctcggaggtccctagagcttcggggagaagtttgcttccctacagagggaggctgggaggaacagaagcagacacagagactatacctgagcccttgttgaatgggcaaatgcagccaaattaaatgcagcagaaacactaattgcatttaagtgcaatgtgtaatgcgtttgtttcttgcaaatgcaatgacgcttattgactttagtagtagtagtagcattttgagacagagtctcgctgtgtcgcccaggctggagtgcagtggcacgatctcagctcactgcaacctctgttcaagtgattctcctgcctcagcctcccgaggagctgggaatataggtgcctgccaccacgcccagctaatttttgtatttttagtagggatggggtttcaccatattggtcaggctggtctcgaacttctgacctcgtgatccgcccacctcggcctacgaaagtgctgggattacaggcgtgagccaccacacccagccgcttattgcctttaagcagcataagccacatgtaaaccttggaatagcggatacaattgtatttcatcagtaagagaagagcctcactggttccttatttttaggaatcttcagtgagcacttactacgtggcaggtgctgtgatggcttatgatactaggctatgctgaaagtcatctggatgatcttattgccttggcaaaattttgcacagcacagtaaaactttgtttattaaaaggattgttgttgaagaagtaggcgtagcgcttggctgtttggctccagtaatatttatttagtagtagtgccaggtaatttagctgtagtgtcctcacatcaaccctctgaggtgggcattattatacccattctatggacaaaaaaactgaagctccaagcggtcaagcagcttgcccagaactaataagataactgactttgaaaccaaatctgtgtccaaaacctgtaggatgtcaaactatttgtcaaactgtactgtcactcatgaatatgactgggcacagcctggtgcttcgaggtgctgccactccaatagaaaagacagatgtagagacagatgtctacaaatgaagagtctatagagatgctaactggattctaagagtggggaacatggcatgattcactgtgcttggggagtcagccaggactccctgaagctatgaagaacaggtgcaaatttaccagtggtttaaaaaaaaaaaaaaaaaaagaacagaatcccagacataggaaacaagtagtgcacaggcacagtgttatcagagatgctaggacatttcaatttagtttagaactattggcttgcctggatgtggtggctcacacttttaatcccagcactttgggaggccaaggcgggcaaatcacaaggtcaggagttcaagaccagcctggccgacatggtgaaaccctgtctctactaaaaatacaaaaaattagctggacgttgtggtgggcacctgtaatcccagctactcaggtggctgaggcagaagaatctcttgaacacaggaggcagaggttgcagtgagctgagatcgtgccaccgtactccagcctgggtgacagtacgagactctgtctcaaaaaaaaaaaaaaaaaaaaagaataaaagaactattggcttttgggttttgttcttgttaggctcactcaacaaatataaagggagaaaatgaatctctctttggggaacgctcatcacagagaccaagcatctgatgtggggatgggatgggaagcaaaaggagatgatgttggagaatccgctcctgaagtcaaaggatattccatgctgtcctcactgtgtgaaatgcctacgcctgatggcagggaaaggtggtgctttaacccatgactgtccttagaaaagcaaccacaggtttacagtaacattacgtattgcttctgaggctggagttcagggtgcagagatcttcagtgagtccaggaaggcatgaatctttcgcatggcagactgaggcccatcagatactctgactgcagtagtggttactgctaagcagcttcctgttatgtggctgggagtcactggattcccatggggagggcttctatctccaatctaaggtggcttcagtgcacttcctgtctagttcacttctcccatcccaggtgtgatgggcactaacctctctaccaccaggaatcgcacatcataatccctgagtggtatcaagcaaccctgggcagcttgctgatttggcttcagggtcctttcaaggacagttaaacgccagacacctgaatgaggtcaggggctgctgtgaggcttggagagcatgtatgcaatcataatccctgatgtgatcaagatacagtttgcttccctgcctgcagggtgggtacaaaatcccaacttaggtgaggcaccaccctctgagatggtcttatacataattgcattgtttgctagcaacagaaatccattcaaactcactcaataaatgggcatgtttcttacacagcacaggagcacagaagtgagtttcagcactaaaagtcaggaggtgttctaggtcccaggaagaaccagcatttctgaaccgctgtgtaatcaggaaacaaggcagcccttaccctcccgccccaaaaccctcctccatggctcttccactctcttcttcttctctctctcattgctacttctgctgttttctgcacacgtggcagagaagagtgaccccacagttactgacgacacttaagtgtgccttgcaaattcctaggagaaaattgaacctagatagggtgaggtttcgtctgttctgaacatagcacttactaatggagccaggatcaggcgctgcagacccaatttctggcactatgctagacagagatggggaagggaaatgacttttggggaggctgagtgtgtctaaaattagccataggatgactaagccgatagttccttctttccttccttccttccttccttccttccttccttccttccttccttccttccttccttcctccattccttccttccttccttacttctttccttccccctccctccgtccctccctgtttccctaccttccatcttttcttccttgggtaaatatttactgaatgtctgccatatccatagcattgtgatcagagttaaaatagtgagcaaaacccacacagctcctgccctcatggagctaactaacatgctggtgagacaggcaaactttcatcaaataatttttctaataatttttaattggatgcaaaatgcaaactgggatatgggctatgaagaaagggtgatgggctcttaaagccatgtggtcagggggttccaacaggaagcagcaatgcactggagttaattaggtgctaaaagcatccccagtcaaagccatagcatgccaggcatccctgtggcaggtgaggagtaaagtgtggtccagaatgggaaagtccatggtgctggtacccgggactggggggaagtgtgatctccttactaacaaataaataaggctggagctgtgtctaggagcaaatcattagggatgtcaggagtaaggtaggtttggaatgaaatgggaagccagcaatgtaggatttaaacaatcaagtaacacagtcacatttacattttgtaagggtcacactccttgacctgcatgggggcaaggggtgcaagcctggaggcaggaggagatggcattgcattcattgcctggggaagtctatgaagcagttcatggcagaatctatggaaacagaaacgttgcagtagccagccctgtttagagagtcagagttagaaaaaaactacattctggctgtccaagggtcatcaacaccagtgttttggaagtaatcggtttgctattttgtgcatccatttggatggagtgcataggtgaaggtagctaatgcatgaactgagcattcaccttcattctgcctgactttgttccaatgtcctccgagtttccttcacttgcagctctttagcttctgtgtaatcttggtacaatgaaaattgtgcccaattccactgggacctgagattctccctggtcacaaattgctcttcacgtagtttgcaagagtaattgcaaactcagaacattttagttaaaaaaaaaataacactaaatcactcttctggaactctagagagcatattagggttttcttgctgtctggtaccattgttaatgatcatttctgttctcgctttataacaatggttctcagcctctgtttttataaaataatccccctaaatgactttacaggttcttattagtggaaaggaggggctataaaattcatttcaactgtaggttggattaagaccagatgtaaaggtgtgggtttggactcagatggacatgaaattcaatgttattacctgggtaccaagtacggtagcaccaaagaaggcccagttgctcagagaaacctctttctggaatgaaggtcaatgtcctttcttggtgctgtaaccctctggggcaaggaagaatcacttgttaggctacccaatgtagtgagcagtacataaggggccgtttcccagactacatagttacagtgttgaattaaacattgcccttgccttccagaaattcacagcctgggtaggccaagtccacaaaaagttagaaaggatgtatattctgcttctgatagaagaatatgccaatggccatagggacctcccctaaaattcaggcccactggaagggtcaatgaaagttacagagagcacgcttgggtagatgttcaagtctcaagactccagaccttccatgagttcaaatggggccaggtgaagggcagtttaggatgagagaaggttgtaatcgaagggctaaaggaatactagtgcactgtgtcttaagtatttgatttagctggatcttagaatgtaaggatatgttcggagatggaggaagtgacaggaaagagggggtaggagctgaaaaggttgaacctgaccatggtagctattatttttaataaatgagaggatgcatgcaaattttgatatgaagtttgggctgtactagggattcagtgaaactacaactactataattattaggactcagataatcctgcattggaggcatactgtgaatctctagaagagaaccatgtattttgactatttctattctaattattctaactattcttcccaaatcatgttcttccacttctcacctttacgatgtcagctccgttgccacttccttgatggagccttccccactgtccccggtgaagatctgtctatcttccccactggactgtaggcaccaaggggacagttcctgacatttagaaggcttaataaacaataaacttttaaaaagcaccgactttgtgctaagcacaatgctacttgttttacaaatattaacttttaatattcacctgaattccttgaggcaggtactgtttattcccattttaatgatgaagaaactcagacaaagaaaggttgagtgacttggccatggtcacaaagttagaaggtagtgaagccaaggatgactggaaagatggatggatgggtaggtgggtggatggatgggtagttaaatgggggacagatggatagatagatgggtggatgggtggacggatggatgaatgggtgggtggatggatggatggatggatgggtggatggatcgatgggtctatgggtggataggtgagggatgggtgggtagatggatggatgggtgaatcggtggatgggtggatgggtgggtggatgggtaggtagataggtggatggatggatgggtggatgggtgggtgagtacatggatggatggatggatggatggatggatggatggatggatggatagatggatggatggatagatggatggatgaatgagtgcatcattgctgtttgttgacactagcccatgagattggtcatttttattagttgaaagaaattgaaaacatcaaaatgcaaagcaaaaggctattgaagggtgaatactatcaccaccatttcaaccactgaatagctctatctattcttgggtctctctgcaggtcacccctctttccaatattttgaagtcacttgatgtttttaggtgttgtaatttatcaacaagaggggactcaccagatgtgaagactacacacacatatatatatccacatacatacacatatgtcatcttcatttatatgtatatctgtatatctatatatctagatatacctatcacattaggaaagggggtatattgtctaaacatatctgcaaataatgtttaaaatttacctctaaatcttgtgaactttgttgagtcttggcgtaaattgtactgctgctttataagagtaattcaattatcgatggatcaggattccagaaccctgcaaagtagtcccgtctctgctacttaagtttctccccagagaggaaacaagtcagtatcccaacccccttgggtataggatgccgtaaacatctttcagatctaccagaactcttgatttttctggtaggagatgacctctctttcaactcactgaactataggagattataatagccatttgcagtttaggtgatatttggtttatttaaatatcaatgaacatgaatctcactccctgtgattgggtgatgatagccatatttatgaaatttattactgctaggataccttgtatcataattctactcattgcaaaattaaatcatttccatatttgaactttaagtaagtatcacctgaatgcacattgtagaatcctgcagttctagcgttgaaaggaaatttagaatttatttcatccaagctaattcctagggggaaaatccataatgatatatctgaaatgtcaacctccagtcttaccttgaacacctcctgtgacaagaactcatggtgtaagagaagaatacagaagagtacttccaagcttggtgttgacttgcccgagttcaaattcaggcttcacgatgtacatgcatgtcttgtcaactgtgggagctgtctgggcctcagtttcctcttctgaaatagagaagataataacaccttctttgccaggatctgagaggatgtaataaaaatacatcgaagaactgaatcattttcatcatcatcatcaccatcattgctgttaaattcacaatatagtcagaacctattttgaaggttggtccatattactatgacaaaaaaagtgcggacaaaattcaagaatacatttcttgatactaaagtcattcccctttttcttctttaggaaactggtcaaagaactcatgcaagtggaacttacagcttccttgatcggactcagcattcagtaagtgcaacccattttgaacattcattccataaatacatccatgtctttgatcctgttctctctgaaaagctcttttctgcaggtttgaagttgttacaaaaactttgctgcctgcctatgtctttctcttctgccctattgtatcagagatgagaagagggcctgcaaggtagaaccaccctcctttagccctccctccccaatgaacctgggaaatttgtgaggttatcaatgagttaactgcgcctttattagctggggattaaaataaaatgtgtttttggtttctttttttctccccctaaggttttcttatcaggagacattctgtcccccttctgagtcacatgaccctgcaaagtagaaagaaatgccagcaaacacagatcagttaccgagagcatgtatttcttgaggcatttaagaacagttcatttgctctttttgagctggaatacatgactatgatctgaaaattactgcaaaaaaaaaagaaattttttactttaagatgctggggtacattatagaaatttcatttgttttcagcaagtaagcatttttccactttctgcctttctcattgcatgcaaggactttatttttggtgaaggtagcagtattttgtccaattttctcagctctctttttttatatgcagatatactctagcatttggggtagcaccttcacaaagtctctgatgtcagccctcctctgcaatagttttatgggtgaacagcttgttttaagaagaaatctgtaataatttaattataaatatcaaaattttaaaaggctagctgaaagaaatatttatttttcaagatgtagcttccttcataggaatgcagaatttcttagcaggttctacttctgaaagtgctggagtataatttgatacatcaaatatcagcccatgtcataaaggagcaggtagaattggaggacatgggactccaggcctgcaagaggctgatcaaagggaattcttttgccctcagtgggattgcaggactctttctattgtcttggaatttgcatattcaaatgcagaggggaaggaggcagagatagaaagaactaaaaagatggtgtattagctgttagctacatcagaatgacttagcgtaaccctgatcagctaacgcttgtatctcacaggagattagactggcagcttttgttcctaataataaaggaaattccatgtctaattccctacgtgccacatctatcttttcatgcctttgaagttcaggcttcggcatttcttgaaaactgggaggttttgtaagtaaaaaggtgggggctgtttggcatgaagtctgttcaaatctatttagtgtaaagttaaatttgcttgttacttgatctttttctgtttaaagcagcatctttctcatagatgcctttgttggtgcttgggcagggaggggagggatggaggacataaggtttcaaggatgggttttcagatcatacatgaccttctcattcctctgtcttctgaatatgattgaaattgctgcttctctgaaagaaattcctgttccaaccctgcactgggattgaaacttttaacctaagggaggctgtggtccctaagataattagtacatggatgtaagggagctcatgttaatttgtctatggatatggtatttctgtatctacaactgccatctaaagagagacattaaaaaaagtattaatttactgctctaaaccagtgagcagatataattttttttaaagaaatcattttagaaaggaagcaatggcaagatgccttattggggatgtttatgggtattgatccctcttagtgtatctagtaggtttccatcctgtccttgggattgcagcttctctgatacagcaaacctcaatccccttcagagaccaagcagtcacttcctctggaacaaacattgaattctgggacgtcgcctggttatcaggaaggcagatgatttgacatctaagctggccacatgcctgggttttgtgtgttcttcacccataacatgttggatgcatgctggttgagaaattgctccagtctcttacaggattttagcaggagcgatgacctagtagttggaatttgtacatggctgacactgggcctgggctgatgttgtgaagaatgccatattttagtctgaatccaggttttgatatgtccattggcttcagaaaattaattttcatttcctgcttccaaaatttggttattcttgtttaattttttccagaatgtttcctttgcatcggtaccctttggattgctgtttgttcaatagtatattacccctcatgatatccacagcatttactgtcgtgttggtagaccatgagtacttgttggatataatgatggtcgaacaggtacaacaatggaaagctgaataggtagatgaatgcttcttaactcctgatggagtattgtgtaaattggagaaagatggcattgacattagacaagagaccagtatgggtgtttctgatggttggtttctattccccaatactcttcttcaaagctttcacttctactttgacaggtctagagtaacagattggccaatgcacatggtgtaagagaatgagctcccaggaaccagcatctgttttctagctctccacatccctttgttgttatctgtgtgctaagaggaaagccacagaaagctcacagtagcagggtcggtgttggaacttaagcctcagcatgattttctacaacttgaaaatttaacttccaagaggtttccttgatctctattttcctatcaggctaaaaatcccatggcatgctgcatcatgtttataattaattaattgtgcaaactttatttttatgtttgtctttttctttggtctagtgctatccaatacaccatgtctgtgattataggaatatttttttttcaccaagtcttaatgaggtattattgaccaataagaattgcgtcaatttcaaaagcatactcttaatataattggctttggtgactgagagggggaaggttgggaggaggttgagggtacagataagaagaaggtggagacagaaagaactaaaaagatggtgtattagctgttagttatatcggaatgacttagcgtaaccctaatcagctgatgcttgtatcacacaggagattagactcgcagcttttgtccctaataataaaggaaattccatctctaattccctacatgccacatctatcttttcctgtccttgaagctcaggcttcagcatttcctgaaaagtgggaggttttgtaagtattgggtagagagggcactgcttgggtgatgggttgtttgggtgatgagtgtgccaaaacctcaaaaatcgccactaaagaactcatccatgtaaccaaaaaccacctgtacccctaaaagtattgaaataaaaataaaatttaatttttttttaaattgcgaagatttaaggtatatatgagacatgttaatgtacatataccttgtgaaatgattaccacaatcaagctacttaacatacttatcaccttacatagttaaccctgctaagagaatagataaggaatattctttatctgtgctgttcaatatggttaccagcagccagacggagcaagtgaacgcttgaaatgtgactattacacctgaaaactaactgaaaactaagtgttctttcaaaaactgttattaaaaaaaaatttgttactttattattattattatttatgagacagaatctcactctgttgcccaggctggagtgcagtggcacgatctcagctcactacagccttcacctcctgggttcaagcgattatcctgcctcagcctcccaagtagctgagattacaggcacccaccaccatgcccagctaatttttgtatttttagtagaaatggggttttgccatgttggccaggctagtctcgaactcctgacctcaggtgatcctcctacgtcggcctcccaaagcgttgggattacaggcatgagccatcacgttaaagtaacataaatgtgttactttagttttaattgacaaacaataattgcacatattcatggggtacatagtgatgtttctatacatatactgtatagtaatcaggtcagggtagttaacatatctatcatctcatttctttgtgtccggagagttcattaatttaaatttaagaacatgtggcttgtaacctgatactgtattgttgtatgggatggctttagactagcagccttataaatacaggggctaggtcagaagtgtccgtccttgtacctaggctgatacttagctgttatagatcaattaggactctgactgataaattgctactgtctcaagccccaaagtgtcctctattccctgctgttccatatgttctgcttccttgaatttacccttgatccagaactaaaggtttaatggtcccctgggactctgcacaatgccacagcattcatctattctaactggttggtgcctaatgcatgctgattattcaaatagtatatcacctctgattatttccatggcatctactgtagtgctggcccatagttcaccatcagtacttgttggatataataatggtcgggcagatagagggatggaagaatgaagagatagataaatgcatccaccttttgatggggtattgtgtaagtgagagaaatataacatcaacattagatgaaatactggtatgggtctttctgatggctggtttttatttcctcagtattcgtcttcaaagctttcacttctacgttggtaggtttagaataatagactccagatctatcactgaattctaatgccatatgcagcacagattgctatacatcttcactcatttctttctgtcacttaaggctcccaatgcataacacttgaaatcagtccacgtctcactcattgacccatgggcaccactctcttctcaggaacctcagtcccaagccttagttactaacattgtctttgtttttcatccgccaccaaatgataagtgagtgttttatctgtatcttctaagagacttcttttcattccctctgttggcatattgctccagggacttcttacttacgtatctgggaattctttctaggtagtcttcatacctaaagccaccttcccttggatcccagccaacagattgcaggactaatattcttgaaacaagaatatcgtctagttggttgttgaataagctcatccttacctaacattttatcttttctccatgaatccctcaatacatttcattccaactgggcaagttcatctcttgatatctaaacatgtttatttcccagctccaagcacttgctacacttggtctcaccagttgggatagcctttcctattcttttagtctacacttctatgtagatctctgttaagccctcctgataatgaatttttctctgtttatttcagctacttgattgccccttgtaggataaagaaaatcctaagccaattttcaacgtaggaagttgaccctatgattatattttagaacctgggtttcagtggaacaggcaggagtggaacagagtaaggaggtattgaaagagaaacaacaataattgccttccagggagacacagttctctcacatgcaaaattcagcagatgggttggaagtggaagaggttaaaaggcgccagttggaatacaagagggagagagaatgagaacaggcatggcctagggcattaccttaattcaaggccaggcacagggtgggtttcatgccagctgcatttagagtctgtggtctggaaggacaaactcatctagataatgctcattgaccatcccatttgctttgacacttccctggccaccaaccacccccacacactgttgtttacatttcccctatgaatatctcttacctctcctaagctgctgcatagcagagctcttttcccagcttccctctgcatataaggggcaggaactctgcagacctttttcgatcgaatgagtacatgagcatgggaggaaagagagagagaaagagaaggcagagagagaaaagacagagagctaaaagaagaaataacaattccttctgcttctttattgttaggacagagcaggataataaagaatggaagttacaaggaaggtgtgtaaagtagtagcatgggtaaggaagagggaagcccaggcagcaccccactgtcagcctcgttcttcttcatcatcttacccagttaaaatctgccatggtgcttatgatgctccctgatgaccagttttactgggtgtgcacaatctgtcttccccactggactggaggagttctgagggcatggggtgtgtcagtcttgcttgcttctgtatccttagcacctgtaaaagtgacaagcaggtacatattttgaatgagttgttcattgagttgaatgaatttgtgctgtgaatgttgatcacactctttgtactttcaaattattcttctgtcatccatgactgccggtggcaacccccatacccccaatctagatcagtctttgaaagattaagggagcaatgcttgtgaattgaccacacagctgtcttttgaaaacattatttatatgtttattaatttttcaatttgcataaatttagaggttgcaagtacagtttccatacatcatgggtatgttgcatagtagtgaagtctgtgcttttttttttttgagatagagtctcactctttcacccaggtgggagtacagtggtgtgatatctgctcactgcaacctacatctccaagattcaagctattcttgtgcctcagcctctcaagtagctggtattataggtgtgtgccatcatgctcagctagtgtttgtatttttagtagagaaagggttttgccatgttggccagcctggtctcaaactcctgacctcaagtggtctgcccgcctcagcctcccaaagtgctgagattatagggatgagccaccatactcagccaactctgagcttttagcgtaaccatcaccttaatagtattcattaagtaatttctcatccctcaccttcctcccgccctcccacccttctgagtctccatagttcatgctctgtgttcacaggtacacttcatttagctcccatttacaagaactacataactcttaacaacacatttgaccaatctggcttcagtttcctgattacaatactgataatgaggaattgaactagaatggagtgtcaatttgttctcacattgctataaagagatacctgagactaggtaatttataaagaaaagatatttaattggctcacagagccacaggctgtacaggaagtatgatgctggcatctgctcagtttttggggaggcctcaggaaacttacagttatggcagaaggcagaaggcaaagggggagcaggcacatcttacatggccagagcaggaacaagagagggagaggaggcaccatgcactttaaacaaccagatgttgttacaactcattcattgctgcaaggacagtgccaatgggatgttactaaactgttcatgagaaactgcccccatgatttaatcacctaccacctggctcacttctgacgttgaggattaccgttcaacatgagatttgggtgaggacacatgctctatatcaaatggtctttaactagggccccatctaacttcgaatttagaaagcaaatgagatatagaaactaggccacagaagagaaggttgaagggaagtatcattatctcagcaagacagagatggataagttacgaccagaagcagtcagtccctccctggcccacctgtgtacagaaattagcccattttctcttgacaggagagtgtactatgtagctaaattaggtttgcaactaaatcagtacagacattttgctttctctttgctataatgagaaactaatattaatataatttgatctacattcatgggttgtagtaacgaattacaggaaaggtacccaggcatggtggctcatgcttataagcccagaactttgggaggctgaggtgggaggatcacttgagactaggagtttaagaccagcctgggcaacatagtgataacccatctctacataaaatgtttaaaaaattatccaggcatggtggtgtgcacctatggtcctagctacttcagaagctgaggcaggaggatcacatgagcccaggaatccaaggctgcagtgagttgattgtggcactgcacaccaacctggaggcagcaaagccctgtctgaaaaaggaaaaataaactaagaattatggataatgaaagcaaatttcacctgcattcaccttctattagctttaacacctatgaggtgaaatctttgtatttatcattatcgttcaccggttaccaactgaagaaaaacagtaatgatatttctgctgaatcccttcatttaaactaaagagtagctctgcttgctgtctcagctcaacctgaggatgtagtgttgttttctgaagacattagtgaatctggaatcacctgattcctactggtggttcctgtagaagactatggaagtcacaaaggatgaaccaaaattttggtaaaataggctggttaatacgatatggaaacaggaatttggtttttccaaattcaggaggctagaatttcttcctacttttgagaagctccaaagcaaaaaaacacaaactttgtccatgtatagatggccagaatggttttattttcctaaaatatatgcctagtttcttttgaattcaggtggttatttgcagatccttgcttcagaaaataccagcccaactccatgcctggcttacagttggtacacagtaaacagtaacaatgattgctgttattgctatttaaaataattatgtgctgagaagggatgtcctctcccactgactgacttgtgtgcgtgagtgtgtgtgtgtgtacatgcatatgcattggcagaaaatcggttaactcttattgaacctcagtccctctgtttaaggagaataaattgtcttgcaaaactgcatggtggtacattctagctcaagttgctatgacattgatatggaagtcaacatgcttatcttggtaatgccatcattccttccttccttcattcattgattcattcataaatagctatggaaaaattttgattttggattctcgctaggtactgaggatatcatagtaaacaaacagatatggtgctgtacactcatgataacattggaagataaaactttaaagtaaataaaataatccatgtgagattaactatcacagactagccaataccagggagggctcaggaatgtaaggatgtgattagtttgaccagatgtgagagaggaccaaggagtatcctagatacaagtactttcttctctttctttgtcccagcccaggttttctcctttctaatctagctggctttcttcatccttctcagagggcattctcctctcagggttgtttcgtctcccagcaatgaccatttacgcttcacagggacagactctcccaccaagtccataaacctgcactctgtgcagaatcattgcccatttacagctgctaatgcattaataacagaaacgtccgtggccatgacctacctgagtcattacacactaatcataggaggcaatttcaagcagattgactagtgatcggtgtcctccctgacgtccaggcaggaggacacacgactgccttcacaaccccagagcagatggcccgagagcataatcacacactacagccggtgcaggtgtggctccaggaagggaaatctccatgtcttgcatgcaaagctgggctctctcacctggaggctgtgctccaaatgctcgtctttcattttggagcagaatccacatctcagggaccttctttgtgctcgttttaaacttatcacacagacagctctctgaagacatggaggaaatgagattcacctgcacctgaatggctctaacatgcaccactgtccacaagccactgtcgttccttctccactttcctctgcaatcccagtccagatgtatggtccaaagctgtggtcatcatgggcttgtgatttgtgttattatttcttccctgaagctgcttaagcattgttttttattcatgttgctctctcattccctgcgatcatcattataatggccacacaatataacatcaggatgatgtttttccgctttatcttagaatatctagtaggtttctgcttttctcactaataccagaatcactagagttaattacttagcacctatagagttttcatctttgggataagtgcctgagaagtataagtcaaaggatagaagcatctttatgactttggatatatttttctaacccattttttaatggatttgctcatttacagtcagttcgttgtattttgggctttctgctcttagctgcctattgtttatttgcccataatgaggactcagattatatttaagaggaactaggcaatgactttgcaattaggagtcaaatagaatctataccttcaagaaacagaatagagagggaatcttggttagaaaataactcattgctctatgacatgataatgtccaagaaaagaaaaaggagtttcagaatacatagattctggtgcaagacatgatttctatacagattcaagccaggagcctctcttcttgaccgatctgagatgaatgccatgttatttcttgacaaaggttaggaaatgaggggtctaatggctcttcaatcccgtgggttactgttctatccataaattcatgtataagaactttgttgcatgcaccgtggtcccagtctgcttttatggggcgtacactcagaagacagcttctgaaaatgatctgggtggaaacgtataaaggttgtgcattgccaatttgcagttgcaaaaatctggaaccagccctaatgcccatcaatcaatgagtggacaaacaaactgtgacacaaacacacataatggaatactactcagccataaaaagaaatgaattagtggctttttcagcaacctggacgggattggagactattatcctaaggaagggaaaacaaaatatcgtatgttctgactcataagtgggagctaagctatgagaatgcaaaggcataagaatgatgcaaggaactttgggcactggaggggaaagggtgggagggggatgaaggataaaagactacaaactgggttcagtgtatactcctcgggtgatgggtgcaccaaaatctcacagatcgccactaaagaacttattcatataacaaaatgccacctgttccccccaaaaaccgatggtaataattttttttaatgttgtgcattgtgaggccaaataagctaggattatttttgggtgtatatgctcaatagaccctatgggtcacatctagcagttcattaagattcaaataaacaaagcagcagtcccagtagaaaatgcacagccttggagacaaccaaatgaggattcaaatcttggccctctattcactatgtatgcaaagtaggaaagttacttaatccttctcagctccagtttcatcttctctcatgaggatggcaataggaaaccataggtctcttgtgaagattaaataaaaattcctttttgggaggaggggatgcctgttagggataaaccttttactatagagaatgggacccaaggagtatagcttgggcagtgatcatttcagcaaaagggagtcgtgattactgctctgctgagttaaagaaaaccttgtgctctgataaggaagaagagagaagagagaaaatgaaagacaaggatccaaccaacaagtgggtgggaatcagatgtctatgtgaaagaaagagtccctaggaaatcagcagctggttctgaagttcaatttgaagtggtttgctgtgtggtaaaccaatccccccgactctgtgtgcccttttctacccttccccctgaagttaatctttcctttcaaaactcatactcataatggtttgagagtgatcatggatggaagttatttcaagtgctgaattcctacctgactccatgaagtggaaagcagttgttgttcctagtcattcttaagataacagctaacatggtggaagttttgcttatgggccaggctgtgtactaagaagtttacaagcatcacctcatttcatccttataatgactgagtgagataggttctgctaattattactcttctacagatgagaaaactggaactggaagaggatacatagatttcttaaagttagacagcatgcaaaagctggagctgagtttgaattccacccatctcaactgtggagtctacgctcttgaccactatactaaactctttctatatgcagaactctgagacaaaagttccagtgggactgtaagtctcatcaaagaaatagtgacaaaggcgattgtcttcatcaggaggtggccttgaggattctggtgcctggagacctcagctaatgtctgggttatatttacaactccacttcttcaaaagatggatgaaggccaggcatggtggcccatgcctgtaatcccagcactttgggaggccaaaacgggtggatcatttgaggtcaggagttcaaaaccagccaagccaacatggtcaaaccatgtcgcttctaaaaatacaaaaagaaaaattaagtgggaatagtgtcacacacctgtaattccagctacttgggaggctgaggtaggagaatcacttgaacccaggagacagaggttgcagtgagcccagatcacatgactgcactccagcctgggtgacagaagtgagactctgtctcaaacaaataacaacaacaaaaacaaaatcaaaaaccacaaggtggatgaagttgatgactggtatgattttaaaaatattgacttctactgtgtagctttccttcatctttcccttcttccccatgcaaagaaagatgaagaacatgagcacactgtacaataatgtatgtctgtagtttaatactacatatctgtagtttaatacttagtatgcaaatattctaataaaaaagtcataaggatagggaagtaaaggaaggagaactattctaaagttcaaaaataccttattattcaaagcacatggtcttactcctgcgtagtggtggctgaaacagattgcaagctcctttcctaaggctgactctgcaaacatgaggttttgaagaacttgaaggtttcacacctgcacaaaggctcccaagaagccttgcacagcagctctcgtagtactgagctcaaagtcactgatgattctgttcaaaccctctagtccccactatgaaggctttgaaaagggatatggtgaaaggtgaggaatcagaatagggcccctaacattcctgtgatgctcttcctcatctcttccttactggaattgctgtctcactatatcaagcagggaactacagcaattcattcattcaacaagtacatagtgagtgctcttctatgctaggcatgtgctagccgcgagagacacagtgggaaaaccagacacccatgctgcctagactcaggggtcttactttctctagaggaaacaaatattagataagtaactgtacaataaaatagtataattacaaatcacagtgagtgctgcaatgtaaacacaccagcgtgtgataagaatgtatgcagtgtgtggccatttaatgtaggtgatcaaggaagtgatatttaagtggagacattctagggcaaattctctgggagaggagcaagacttcggtggttttggggaattaaaggatggtatggttagaacagaatcctagaaggggacataggatggaattgaaagagcagatatgagagagattaccatcaaggtacagacttcagattttatcctaagtgccttgggcagctcttaagggatctgaaaaagtaaggaagttagtaatacttgtgtttttaagaaagtattgatctggctactgtgttgaagaaggcttgaagaggaggcaaaaagaacagttaagtgggttattgaaatagtctggggccgggcccagtggttcacacgtgtaatcccagcacttcgggaggccaaggcaggtggacgtggtcaggagtttgagaccagcctgatcaacatggtgaaatcctatctctaataaaagtacaaaaaattagctaggcatgctggtgcatgcctgtagtcccagctactggggaggctgaggcaggagaatcatttgagcccgggaggtggaggttgcagtgagccaagttcgcaccactgcacttcatcctgggtgacagaatgaagaaaaaaagtctgggagggaaggatgacattggcttagaataggggtgagttgtgggaatggatataaatggaaggatcctccattttctgtttctctctctctctctctatatatatatatgtatataatatgtgtgtgtgtatatatatatgtgtgtgtatatatatgtgtatatatatatatataatctatctgttaatctatcttctgttttctattcagtgttgcataaatctcaaccatttgctcaattctctggtgcatcagagagtgccaccagtatgtcctaagtcctgcagaaatcatgcaattttttttgtttcacctttttttaaaaaaaaaaattgtatttatttgtgtattgccctggaaatgtacaaatagtttcttcttcccctattaaagtttgcttggtggggtcttgctggttcctgagtttgccttggctgccatcttccatcctacctaggatgacaccatttgtttcacataagtttctcatgcatgagaggctgacattcttaatagttctgtcactcctgttacaacaggctgctgaaaagaaacaagcgatgcctgcaggagatagggctgtctcagcggtttgtgtaacaccaatggggtgtgaggtagcaggaaaataattagtttagttagatgtaaatggaagacgaatgaagaaagtgctaatatgtggatgcctgggagaaggggtggcctgcctcatttaaggtttgaggaagaataattgaatgaatagctatgaaaatgaaagcaatattaagagacttgtatggcaacgtagaaggcgggaagagctaaattcgatcaaccagcatttactgagtgtttattatgtacctgtcactgtgtgaggcattttagctacactggtgggaaaaaataatggtaagacataaataagactttagaatctccgtggaagtcaaaatttcagaacatatgaatgcacaaacagatattagaaaggttggatagcaattgtaagctacattaataggcaaaactattagggatggcaggaataatgttgaatataggagacatgactgactgtgacgatagctagttgatttaaattctcagcacattacttctttccttcataaaatgttcatgtcacagcatagcgtgctgttatatcttcatacacacacatgcacacacatacacatacacatctggtcaaggcttgtgaggccacattaggggttctgggaacaggaaggtagtggagaaaaattccctctcctaaccatttagtgtataggagtctactgttttagtgaatagttcagagaacttaaaggtgttcagagaagagaaagtcagcataaaccatgccgtggactagaagggtagatgaaaggtgttggaaaaatgtagagatgaatccttcattgatgatgcccatctcttatgaaagttatagaacatagatgatcaatatattagctacaccttacagaacatgggccattctaacagatcataatcattatttaatatcttactgagagttttgattgtattttattattgatccaatgtcatgttttgatgtccttgacatgtgacattctttttttttcttttttgagacagcatcttgctctgccacctaggctggagtgcggtggcatgatgtcccctcaatgcagcctctgtctcccgggctcaagcaattctcctgactcagcctcccgagtagctgggactacagtcatgtgccaccatgtccagctgatttttgttttgtatttttcatagtgacagggttttgccatgttggccaggctggtcttgaattcctgagctcaggtgatccacatgcctcagcaccccaaagcgctgggatgacaggtgtgagccactgcgcccagccagacattctttcctttgctatactctttcatattgtttaaagctgttttgttctttggatctgatagttctgttgttttagtcctgagatttctccatttcttttctgctttttattcagtgttttttcaaatctccctttgtcatcatagcttctctttgcctcacattcttttctatcacttgtcaaatttctcatcagcttttcatccttgatttttcagagtttggtttacgaaatggtccagtcatttctacacctctgaaaaactcttaaaattaaaaaatatatatatcagaaatggatacaggcttattttcgtggatggacttaagtttagaataggtggcatatgtttaagtttttagatcacagacattaggaattggcttttaaaagatgttacatcaacgaatggttagaaagcagtaacatcttttctacaaagatacttgtcatctgtcagatttatttatcagttaataataaagtgatttttcatatcactagatgattttctactgtctcattagttgaagaaatcaaaagaaagccaccctatgctaactcatagaagggcataactatttagtaccccgagggccaaagaacaattaaagtgaattaaaattatttcttttttggtgggggtaggggggagcaggaaacagaatgactagactccgaaggatttttctagagaaatattttaaccattgagtaaattttccttgattaaagaaggaaataacaacttggagaggaaatctaagtattactttagggttattgagagatgccggctagtggtacttggaaagataaggacaacttgtcagccactccacagagaagtagttttattaaaagtcaacgaaagtggccaggtgtggtggctcacgcctgtaatcctagcgctttgggaggccaaggtgggcagatttcctgagctccggagtttgagactagcctgggcaacatggtgaaaccccatctctactaaaatacaaagaattagccaggcatgttggtgtgcgcctgtagtcccagctactcaggaagctgaagcaggagaattgcttgaacccaggaggtctaggttgcagtgagccgagatcatgccactgcactccagcctggacaacagagcaagatagcatctcaaaaaaaaaaaaaaaaatcaaagaaatatgctagaatcgtcattatatattgagaaataagattcaatatcccatagatttaggcactcttcacatctgtgtatctggattgggtcatagggagttttattccaggctgagtgaaataagacagaggacaggcaagtagatttcttcttgcttgccagttctcattcgcagaggatccctgtagttctgttgagaattcattggaactcagccggaaagtgctgagattgattagcaatgtcttccatgggtacaggaaggggaggtggcaggtaacatatataccagcttttgccattctgctctagacagaagaaacttttcccctgtggtcaaagagggagagatatttgcttctggagactggatctacttgggttggtgaatgcattttaagatgacctggtttcatattactgtcaagcaagagagaacagtgtcatcctataatgtcaggagtaatgttacagttcagttgggaatacctattatgcctgttagtatttctaactaaatcccctttcgatgtgatagtttaattgtaggaacatttttctgcagttttgtttagggaatactgcttgcttagcgcttaatccatttatactattggattctgttgcaaatgacactcacactggaatgtgtgttagacacgtaaggcagacgggaagatggttccattcatttcagagaaatgggaggcaaaagtgagtaggatggctttgaaggtggtggtcttatgtttgaatgcgcgtcaggccccaggtggtaggtcttggtactgcatgctgctttattcatgcatctctctaaacaaatacgtcctcagagaagagagccaggagagggaggaagttctagaaatgtgctattggtaaatatacctaaagacagtggcatttctttaaccatgttcatcataatgagaaatgcagtaaatatgaaaataaaaaatcaggccgggcgcggtggttcacgcctgtaatcccagcactttgggaggccgaggctggtggatcacgaggtcaagagattgagaccctcctggccaacatggtgaaacctcgtctctactaaaaatacaaaaattagctgggtgtgttgacgcgcgcctgtaaccccagctacttgggaggctgaagcaggagaatcggttgaacccgggagccggagattgcagtaagctgagatcgcaccactacagtccagcctgggggatacagcaagactgtctccaaaaaaaaaaaaaagaaaaaaaaaagaaaagaaaagaaaagaaaaaataaaacaaaaaaatggaaaatctgtagtaaagtcagagaacctgcattgtgatatttcctatgtccatatgtccatcattgttctccaggtattgcctggttttccagcctcacagtaggcagtgggtgagagacgcagcatgatgggagaatgaagcccattcatagtggaatcaagcctccatctttgacctcagtctgtgaccttggcagcttcttgactctgtgagccttggtttcctcttttggtaaatggaacaacaaatggatacttgcaaataagaaggcttaaataactgtgatatatatatattcatatatatacatatacatatatatatatatatatatatatatatttttttttttttttttttttttttttttttttttgagatggagtctcgctctgtcgcccaggctggagtgcagtggcgagatctcggctcactgcaagctccgcctcccaggttcacgccattctgcctcagcctcccgtgtagctgggactataggcgcccgccaccacgcctggctaattttttgtatttttagtagagacggggaactgtgatttatttttagtctcagttgaaatggggaccctatggctctgagaagtcaagacccactggtaagtaaatgtcagagctagctttgaacttcagcattcttcctacagagctgatatctcatgatgtgctgtagagagggctggatttataatctagagagggctggatgttgattctaaaactagtgcttcagttccagcctcatcacacaccacccgggagaactttgccagttgtcaacttccttggcctctgtctcctcatctctgaaagccataagattctgtaaagaggtgggggggaaattggatgagatgatagatgtggagacagtttgcacagcaggacaggctatgcagtgggaaagtaccactgtaaggaagactggatgtatagctgcagaaggtcagagaagacatagaaaatcctttaacacctgagtgaaaacgatccatgacaaatgaagttacttcatttaaaaagagcctagtcagagttttatcatattcaagaaatatcatttattggcaatctactatctgcaaaatcactgttcgagtttttctttgtgatccagagcagtttacattgcaacccttattctaaaggaactcaaaatggcattgaggaaagcatttttcaatctgacccattttttggaacccaagagttcagagcactttatattactcgacagtttatttccatggagggagtctataaatgctttatatttatccatgttatgaattaatgcatttctgaagaaatccacccaccatgtggcatgttgattccccttttctctcatttcccccaaaacaccaaagaaggagggccctatgaggttcaatggtctcctttaatggtgcatttaaagtcgacatgctgatgccaagtctttctgtattgtgccgtcccaacagggatggcttcttagcagcgaatatggggtgagtaatttgaatcaccgccatcaacctgaaaagccaaagttgttccaggataacccaaaccagaacaaacctcagatatttgcaggtgaaagaacgagaatacgaatatatgttgtgggctgggagagccaaaatggcaaaggagtggaaataaattaatggggggaaatgattgatgtggaagtaagtctctcaattgtacacctggatgccacattcttacaagcagcccagtagaggcagatatataggctacaaagacacgtgctgtcaagcagcaagcactacttattgtctctgttttctctctaattgatacgtgtcttaggaaagcttaggtaatcacttggcaaaacacatctttataagaccatctctgtaaaaaaaataaaagtattaaagtgacagtggcacagaaaatcataagaaaatttttccacgttgagacgaatcctcctgcctcttcttgagaatccctccaaagatatcctgtatgtctgccttgtgagaaaacacccccttgggtacaaactggtcaatatcaggaaggcagcatgctcatatctcagtcccaatgcatgccaaatcactaagtggatggcattttcacaaagtcagaaaagcgacagttttattctcaaggttttgttactatgtttcatgatgtgcaagcaatactttggacaattttatccagatggttttgtccaggtaatttttgtctgcaatatgtgaaatacgtgatattctactatcagatactttggattactgttttttagtggtgagaataaaaagataccttcattttccattaagtattacattttatgaatattttccccacctcttcacttgaataccttcccactgcaacacacacacctacacctgtattccttttgatccataattataagcttttgaagggattatatcaagattacctatttttaataccatgttaataattagacaacttgccaatgttgaagtttgttaaggtcctctccatcacaattcctgagctaattactagaatatcagtcagtaggttctaaatcaaaaactctgggcgtgtgcctagatggaaatctgaatttttaataggcagatgagttgatctttattaatagtagtttgaaaactaacacagttcaagcaaaaacaaattctcatacagttgagcactgggactaaaatatttttttaaaaacttggtcactggatgaaatctaagttcttggctttctcttaaagagtactttaaaggttagaaatccacaacagtggctacctggttatgtaattccaaattcattcctcttctaagacatacaatggcactcaagagacctgaaaaagttagttcttcttcaaagagtgcatgtttaaccaacttctcaaaccaggtgaccattattatgttcactttcaaaagtacggaacaatttgaacctgtagaaatgtatccaaaggaacttaatcttttattttgtggtaggtacacaataaaagttttcttcattgaatgaattagtcaagaactcattctcataatgcaggagaatgaaatgggaaggggtgaggggtggcatagctctaggagactggcatgattacagatttgggtaattcccaggatccagtagcctggggcagacttagacaattagatagaaggatcaggagtggaatggaatatggcaagaaatgtatgtgcatgcagtgaaagcgggcagaaaacaaaactcattgattcattaaatgaatattttatggaatacttactgtatgccaggcactgtgctgctgaggaaggccaagttgacagagtaactggccatcccaggatttccacaattgaggagtgtccttagaggtgggactttcatactaaagccagggaaatgccaagcaacccaacctgagtcaatcatcttgaacttgaagaagtgctgtgattttaataggtttgttgcctgatgtgtgcagcaagtcaataggagacactgggttacagcagagaaagtggtttaattatggggctgctgaacgaggagcagcaaacatcaaatccatctcccggaggagctgagggctagggttcttggagagggctaaaatgtggagatcattcattgatcaaagaggtcatcgtaaagtcatggacagggaggtaaacagtattctcatactgattctgttcctctctgggaggtctttaaactggttggcatcagctgtttcactggaatgttggatttgataaacatcttaagcgattcctttattttttattttattttattttattttattttattttattttttgagagagtctcgctctgtcacccaggctggagtgcagtggtgtgatcttgactcactgaatcctctgcctcccaggttcaagcgattctcctgcctcagcctcctgagtagctgggattacaggtgcctgccaccatgcccagctgatttttttttatttctatttttagtagagagagggttttaccatcttggccaggctggtcttgaactccagacctcatgatccacccacctcgtcctcctaaagtgctgggattacaggcatgagccaccgtgcccagcccatcttaagcaattcttaaacaaaagctttatgattctagtatcagaaatcctatgtacaggaacaatggggatgcaaaaggttggtatctagtgactttcagttagaaggaagtggaacaaagtgcagcctgattaatacttaattatgaccatatttctgcccaaaattcttgttaaccatgtgaggatggcttcagtgctaacaagagtgatgaatagtatgggtgctaaggggtcacgaaacaggccgtccgactatctgcagcaaggggacaggaagtataggggttgggggagagttaggcctagctcactcatgacctaaattagttactggtgttaccgaaaatgggtttggatccagactctaagacagggttcttggatctcaagcaagaagtaatttagggcaaatccacagagtaaagtgaaagaaagtttcttaggaaagtgaaggaataaaggaatggctacctcataggcagagcagcaacaagggctgctggttgcctgtttttatgattatttcttgatgatatgctaaacaaggggaggattatttatgccttccctttttagaccatgtagggtaacttcctgacgttgccttgtatttgtaaactgtcatggcactggtgggagtgtagcagtgaggacaaccagaggtcattcccattgccatcttggtattggtggatcttggcttctttactgcaacctgttttatgagcaaggtctttatgacctgtatcttgtgctgacctcctgtctcatcctgtggcttagaattccttactatctgggaatgcagcccagtaggtcttagcctccttttacgcagcccctattcaatatggagttgcccttgttcacatgcctttgacacaagagtgagccagggaaagagagacattcaaaggagaggtaacagcacttctggggacctgggggatcacaagcattaggaaaaccagaagaaaaaaggggaaggggtggacagagagtggcacagaatgaagccacagagatgggcagtgtccactgtctctagggtcttgtagggcatgtgtaagctttccactgatgctgcatcaaatgatcacaaatcattgatttaaaaccatgcaaattttctgtcttacagttctggaagttaaaagtctaacatgggtcttactgagctaaaatcaaggtgtcaatggggcagcattccttctgaactctctatgggaaagaacctgtttccttgcttttttttggccactagaggctgcctacattccttggcttgtggcgtccttccattttcaaagccgacaatggcaggttgagtctctttcacatcaaatccctctgatactgactcttcttttacctcgttcttctccatcttgtataggagatgagtaaaaggaggttgagacttcctgggcggcattcataggaagttagggattcctagcctctagatatttacagttaagggaacagattaataatgtttactaaacagacccaggctcagaatgtcctgatatccccatatcttgaaaacaaaaggattcctaattttgctttaaagataataatgctgattcttgcaaaatatagtaattaagaaaattaatcctttatcacaaaccctgatagtaaagcacatcttcccattttttttttgttatgctgtatataaacaagcattgtacatagggtggctggtttcctcctcttacattatgaatgtcctactctgtctatggagtagctgttatttcaccactttactttctaaataaacttgcttttggtttgcattgtgggctctccctgaattctttcttacacaaaatccaagaaccgtttattggagtccaaatcaggactgctttctggtgacacttttaacgattctcgtgattccactgaacccacctggatcattcagaataatttcttgcgtaaggtcaactgattagcaaccttaattccatctacaaccttaattctcctttgcaataaaacataaaatacttacaggttccaggaagtagcatgtggacactgttggggggcctattattctgcctagcacagggcacagtaaggattttgtgcaaattcaaacaggaattggcaaactatcaaagccctgctttgaaggggagtgatggtggtcaatttgcatttcaaaggatcactctgctgcaatgtgggaatggaggcaagcttgtgtaagggattatcagttgggaagctgttgcagagctcctggggagagatggcggtggtctggactaggatggcaccacgaagatggacatgtggaaatgcattctggctatattaaacagggagaattgacatgaattagagatagattaaaaacaagtagaaacgaaggatcccatgttttgccatggcaatcttttcacattgaatgaatacaaaacgtcaaggtgcttagcatagactagcccatgaatggcacataacagaaacaaccttgataaggttcctgtctctaaatttaaagatgtgcacagcaacctcacgagattcaaggttgaggcattgagggtagaagaagtaatgaagttaggtaggttttgctgagtggcatccacgtggatgtctattagagagttaggtatacatatctgaggttcagaatgcacattcctgtccatttcttccaaatataacctttattcctctaaatgctttttgtgaaatgtgtttggtatttgataaatctcttcggtgcgtatctccaaatttggagataggaaccttatcaaggttatttctgttatatgccactcacaagctcgtctatgctaatcaccttgacattttgtattcatttggtgtgagaggaatgctttatcctacattgatggggacacttgtttctaatgagaaatctgatgaaatcaggtgctttgaatacagatcatctccaaacttctgtcgctttatattttttctgaagtttgtctcctccctttaggagaccatggtttttgatacgaaactccatctgatagtcatttctgataaggattttacttttaaatccatcaaaagggaggagaagtgacaatttaaagtgggcagatggaaaaatgagtctcttggtctttctttatttcttatacccctcttcctctctgttcttttcacaaaagatagtctcatcagaaattcggggaaaaatggcttttcattcttattctcattttctgacattcttactctacagtcattattaatgtagaaaactctgtctattaggtaatctgtgtcttcccctaccctggtggtatttcattatcatttaaatatgccacccactgctccttctcaaaccttttgaatagagggtcattagtagatttttccccctaaattatgctcagcagttgttaaaggaagatagtcttcagggaagttctttctacattgaagaactgaagtgaggatttgcgataattatctggataactcagcctcttcttatccctcctgaggtggaacatatttcctgttctctttcattccttccttctttcatttcttatggattatctttgccacaaacaacaacaataataaccaaaacaaaaccaaataaggtattcatgtttccatgcttcctatagatgtagaaagtttttaaaaagtgttttttgaattgctagctactgtttaaaaattaatacaaatgcatgtcaaacttcctatgagacattttaaagcaggactcgtcttgagatttgaatcagtcgtctttctcagtcattttgggggattaattctgtgttttccatgcataatattccctttggattaaggattactatgaacctgggctttgtcttcatccttaagaatcaccatcccctgagaattaaagatgatgcttctcatgtaaattgcttgaggttttcacgagtctctggctgttacaaatgtcagctgagcacagtctaattctaatcttagcagagtaacctctcctgggcatcggagactgtgatgaaaggaggtaatcagtccttcttcatctctatttctcgtacccagtgccacctgatatgcatcatggaaactgttgttggaggatcaatgtctaggagaggcactgcttgatcttatgcaacctccacctcccgggttcaaatgattctcatgcctcagtagctaggattacaggtgcctgctgccacacccggctaatttttatatttttagtagacacggggtttcaccatgttggccaggatggtctctaactctgagcctcaagtgatccacccaccttggcctcccaaaatgctgcaattacaagcatgagccaccatgcccggcctggtattatacaattacacaatctttccttctctcttcttcttttttcttttttttcttttttttttttgagacagagtctctatcgcccaggctggagtgcagtggcacaatctcagcgcactgcatgctctgcctcccgggttcacgccattctcctgcctcagcctcctgagtagctgggactataggtacccaccactgcgcccggctaattttttgtatttttagtagagacggcgtttcagcgtgttagccaggatggtttccatctcctgacctcgtgatttgcctgcctcggcctcccaaagtgctgggattacaggcgtgagccaccgagcccggtttttttttttttttttttttgagactgctctgtcgccaaggctggagtgcagtgatatgatctcggcttactgcaacctccaccacctgggttcaagcgattctcctgcctcagcctcccgagtggctaggattataggcatgtgccaccatgctccactaatttttctatttttagtagacacgaggtttcaccaggttggccaggctggtcttgaatttctggcctcccaaagggaggattacaggtgtgagccaccgagcccggcctggtcttacagaatctttgtgagcatcaagtctgtcatttgtaaaacaagaacaatatatggcggcttttagggtgttatgatgatacagtaggatgagatgtttggaagagcaagacactagattcttgtgaagcaaagcattctcctgtttgccacttccttgttctctcctaggtagacttaaacagctcctgctgcagagtagatgaatccccacattggcgctgcgtccaggagggttcttggctttacccagaagagaattcaagggtgagccaggtgtgttaaacagtaacttttattgaagcaactgcgtactgctccttacagagcagggctccccctataggcagtgtgcccagaggcagttctgcagcaatatttatgcccacttttaattacatggaaattaaggggcagatgatacagacatttctaggaaatgggtggtcatttccaggtgttgccatggcagtggtaaaccgacatggcaggctggtgtgcatgtctaatggaaagctgcttctcccccagccctgttttagcgagtcctctatccgacctggtatgggaatccccacatccagagtcagttgccacctcctacctcacttccatcatcctttatacttactcggtcccagctacatggcagacataatcctaggtgtgaggatgtgttgggagcaaactcgagtttctcccttcatggagcttacattctaaaagagggatcagatgttgacacatgtgaacccatacaatctaagactggtctcagttaatttagaaagtttattttgccaaggttgaggatgtgtgcctgtgacacggcctcaggaggtcctgacgacatgtgcgcaaggtggttggggcacagcttggttttctacattttagggaaacataagacatcaatcaatacatgtaagaaatacgttggtttggtctggaaaggcaggacaactcgaaacaaaggcaggaagactcaaagcggggagggggattccaggtcacagataggtgggatacaaagtggttgtgttgttgagtttctgattagcctttccaaaggaggcaatcaggtatgcatttatctcagtgagcagagggatgactttgaatagaatgggaggcaggttggccctaagcatttcccagcttgacttttccctttagcttagtaatttggggggcccaaggtattttcctttccaacacatatgcaagtgaatacttattatatatagtgccaataatgagcccaaaacaagcaatccatctgagagaatagaagcggccagaaggtactgctgtagatagtgttgttaaatttaactatatttggcctgaggatgcctctgtgactgagtccttagttaacaaactacagcctaatttagtatgtgaactaagtgaaagcctaacttgggaatgtgagtctgtaacaggttgctgagtctcagccaatcacggcagctcagcttcagataatcccaggcggccaagggatcaggtactgttccaacgaggcaaggctgatctgtaactaatcaaggtgcttccctacctcacttctgttttctgtccataaaggctgactgcctgtgttgaggagtggagctctctgaaactcttctggttccgatggcagcctgattctcgaattgttccttgctcaattaaactctgttagatttaatttgtctatagtttttttattttaacagtgtcttgataatgcctcaagaaatgcctttttgaggttatgatgttggagcagagagttgaaataacttcgtaattgaggcttgtcttgggatggttgatgttagtcatgtcaaacgctggatctctcatatattaccagaataacctcttgacaagacagagttttctgtttaactgaattatgggagagcactacctcaacagagtcttggtggtgttccaggaggatgggcaaattcaggatatttattgagatttcaatgtgtgttgtaaggtgggtctttccatgtacagccttgtttacattgaataaagatcatgatattatagtttagaatagatggacagagcaaggcaaggatattgggctgaggagttcaaagaatcttagggtgaaagtggccatttgatgctttctcttcaagagtaagtgggtctctgaagaagttcctggaatgggcaataaagccatttggacttttaactttctggccaagagtttcctggaatagtaaagtgatgtgaagaagagagtcaactagggaagtcatggtaatgtagacagtgaacgggagatggttctcatcctcaaccaccatcatcatcattgtctctcctctttactgggggcttcatgtgtgctgcatactatgcttggttctaaagatacagctgtgaacaaacaggcatgttcctttcttctcatttggcttataatctacccgtgaaggtagatgctaaacaaatggttgcatgagttaattacaaatgcaatagttgctgtgaaaagaatgttcttcactatgacagtgtagtgtcaatcatggggcgctgtggaggcctgggagtaactgagagaggctttgcatcttgcatatgcatagatgctagctgggtgaaggacgcaagagacggttgggtgaaggagactgaagtttatcttagagcaaggagaaacaaaatgtccctgtatatcaacaattattatatcctatgttcacagagaacttgacacaaataatatcataagacacattcacagtacacagtgacagtgcttggaaacatcaaaattgacagtctacctgcgactgcctggcccattcctctaactaaacagcagttgtttgttgaaagaatgagtgaatgttgaattaatcaacaccatttagttcctcagtgacctccaacagctcatttgctcatgcagatcatacagaaactggtgagaagacatgtttgcatctcagcctagcttactcctgaatacaagaaagcaggaaaacaggccttcaggcgtgaaagtgggtggtggaaacccagcccgttcatacctcttggtcaagtttagctatcctaagtgtgggaggcagagaaggggaaagaggcaggagtgctctgagggaggttatagctttatgggtttgtgtggtttgaggtctttgctcttggttttgagcactgtaggagaggagataggcttgtgataaaatgtggggcacatgtggggtcaggccatccaggttcacactccagctccactgtttaggagctgtgtaaactcaggcaaatcatttagttccttcttgtctatttgtctcctctgtaaaagagagatggtatagatgacaccatatgcttcttggagaattgaatgagatacttcagtagaaagcacttatacagagacttatatggcatttctatggcaaatgctgcccttacgtcaggggaaatctctttgccctgttgtagtcctactcatgcttggtgagatggtatatcagcctgttcttgcactgctataaggaaatacctgagacggggtaatttataaagaaatgagcattaattggatcatggttctgcacgctgtacaggaaagatggcagaatctgcatctggggaggcctcagggagcttttactcatgacggaaggcaaagcaggaggaggcatctcagagcaggagcaggactgagggtggggagcgtgccacgttcttttaaacaaccggatgtcccgagaactctctcaggagacagcaccaaggggatggtgctaaccattcatgaaggatccacacccttgatcccatcacctcccatcaggccccacctccaacactggggattacaactgaacgtgagatttggacggagacacagatccaaaccatatcagatggcaacccaggaaaagcagatttcaggtgtactatgcttttctggggatagagatggacagaggcagatttgctcatttttggaagtcaagcgcttcaaaagaaattcttatcttgagatttgattcctgattttatcaggatcttacagcagacttcttcatggaaaagaataactgttggctaggcgagctgatgctgtgccgtgggttgctatctctttcaaattcctatctgcagtaacctctgtctctctgaggttgaaccaaacacatacttattttgagctgaattttagacaggtttagagcagccagaaaaaaagcagaaaagtgcccttcagaactcaaagcagataaaactttctgttatcccttacctagccgacgacttgagtgtagaattcactcagctgataaggaggctgacattttacctcttagaagttttgtcagataaaagatgtgcaagccatgtttaccatccactctgtgtttcaaacttttgataatagatttaaagaaaaaatcatcgagatacgaatattgtggtaaaataaagctaccccatagaattaaaataatgaggatcaaagaaaggctcaaattgttcaacatcctttaaaaggatccctttgagaaaagctgacttcttgacctatgtcattagtggttggtaaacaatttgcatggcttactaggattacactaatgttcctgactccagctccagcttgcagagagtgcaggtacagtcctattgagaacacatcttcatctctagagagcaaacctggcattaacaatgggagctaaatagaaaatcatggcatttcccatgaaaaaaagagtaacattaagtgctgggctaattgtcaagtggagggttggatatcttctccatttttccccatggttttccaatactttataggaaaaatgattaataagatatccaactccaagaattcagaggtccaaggagataagaaaggaaggcaagttggtttagaactcgtgtcttctacaggggatgccatggggggcagtggtgagcttaactgctggagatttccatggtgaatgtgcgtgtctctccttggcaaaacatgtagaaaagagacttttactattaattactttggtacgctcaagtatccttctcaaagcccttaaaatttcaaaaagtcctaggtttgtgaaaaatcatgcaattgatattggattcaatttatttgtggcgtatagacaaaaattcagatgaagaaatcgtaaaaaatacatggtgtttcacgcctgtaatcccagctctttaggaggctaaggcgggcagattgcctgaggtcgggagttcgagaccagcctgaccagcatggagaaaccctgtctctactaaaaatacaaaattagccgggtgtggttgcgttgcgcatgcctgtaatactatctactcgggaggctgaggcaggagaagcacttgaacccaggaggcagaggttgctgtgagccgagatcgcaccattgcgctccagcctgggcaacaagagtgaaactctgtctcaagaaaaaaaaaaaaaaaaaaaaaaaaaaaaaaaaaaaaaaaaaaaaaaaaaaaaaaacagtgttctctagaatatacttcccaacttctaagtacttcatttaactagttttagggaatgtttatttaactaaggtgatgcctgaatgccaacaatggcatccatacatctatgaaagaccttttactagtaaccttttaaatcacttctctgttgataatcaccaccctcttgtgagtaattactaggtcctaaagcattgtccatggattttcatatttaagcctcattaacaacactaggaggtaggtggcattaattctgttttattaataagttcaacaaaaacttaaagagtgcaagtcatactcatcagcaaggatgcctagctcacaagtggatgcatggggatttgaaccagggtctgaaaacttggaggcctaggtttctatgagggcactcttctgcctcccttagtggtggatggcctggcacctggtcctcaccacgaaatgcctgaaatgaagaccacaggcagtgggcacttggctgacaagtagcaacttgtgcaaagttgtgatatgtcatcttatcctttcagttttctcctgttgcctttcaaccacagcaatgtggccaaaacttacgaagcaggagttttatgacataaaagacataatggagtccctgtcttgacctggggaggcaggttagcttacagggaaagatacataatctttataagagaatattttcatgtgtgcggatagtaaatatacaactgtgtaattatatatatgcatatgcgtttgaattgtattctaatatatacaagaatatatataaaataatattgtatacataaaatatatatatataacgtgtgtgtgtgtgtgtgtgtgtgtgtgtgtatatatatatatatatatatttttttttttttttcttgaggcagagttttgctcttgttgcccaggctggagtgcagtggcatgatgtcggctcactgcaacctctatctcccaggttcaagcgattctcttgcctcagcctcccaagcagctgggactacaggcacctgccaccctgcccagctaacttttgtgattttggtagagacagggtttcactattttggccagggtggtctcgaactcctgacctcaggtgatccgcccgtcttggcctcccaaaatgttgggattacaggcataagccaccgctcccggcctaagggaatgttttcatgtgtgtgtatactaaatatacaagtgtgtaattatatgtatgcatacatatatgtttgaattgtattctcatatattaaatacatgttatttcagaaatggaaggcaaaataaggatattagcatttcctgaggtacgtaaaatgttgggtgctttgcacgtctgacctcatttattttacaacctacctacaagatatgcattattttcatcattccaccaatggggagtatacgggagatgctgtaactggtataaatgcacagaatttatacactgcagaaccagcatttgagttcatggctgtatttacccaaacctaccctttttcagtgcttttttctgtctgttgggcagggagagacattagaatgagctggaggtatcacagatggataaggtacaattgagagtttgtagaggtttctccagtcactttatataataaaaagcaaccagctatctcaagtcccagacctcccagccctatattctctgctttattttcctccttagctcttatccttatctggaatgttgtgtattaacttgtttcctccatctagtttataaatgctatttaggcaggggggttgtttcttttgttgctaggaccattgtacctaaagtagtacttgacccatcatagataaactatccgtatttgttgaaataatgatgccacctataatcaaacaaattcaggacaaatgaccaaaatttagtgtttatgttgaacaattatgaccatcaatgatcaatcatgaatgtggattacaatggaattttactttgaaaattttctaaacactagtttttgttttgtttttgtagcccagggaacaaaggagggcactgagagctgtgagtggagatagcaaaacaaaaaaacaaacaaacaaaatcgtctatttatcctgtccttgctttgggttaccatgcgaagtcattcattacttttagaaataattcatacattgctcaaaaaggatatcctgcgtgtttgatacaaagggcatttatcatattgaagcagctaaaacttttcaatcccatccattaactcacgaagctgcaagttactgcgacgctgccttgcccatctatttagtatttccaggcaatcatggtacagtacaaagcaatttgtttttatataatttccttcatgctcgcaaacacaacatgcatcacagggaaagccaatcatgaactaaagagaaaaagggatgatttaaagcgggagagtggttcatttgctttggggcatgagaaacaattatttcaagaggccagggtttctgtgggaagtcaggtgaataagaatgctagtgctggccggctgctttctcggagaaactgctttgcctaagtaacttcttcttttgagaggatttcttactgagccataaatgcttctaatgtgaggaaggctaaatccgcctcctataaacctgggagccatagttccatttctccccatctttcccaaagatcatctcctctaccattgaaggacaatgggaaatgctgccgcttttatcatacgtcctccatctgaaatgcacttggatttcagccacgtttgagaacctaatcttccaataaactcctttagctctatgagagatttccattaatttatttatttctgtgcttgtttgttttttgggatgggtattagctcatttgccatcctagatacctattttttaacttccttggtgttttactgacaaatataacttgtcatttatttgatttctgtaataagctgcaaagtacttatggtcccttttaagtgtagggcatggtgctgggtttaggcatggggatggtctcaggagactttgctggacctagagagccaggtaggatgggtccttaagcccaaatgcattgcttgtgggggattcaaagacttatctaagattcctttgaattcaaagggggcttgtatctaaggaccctcgatgtccctagccctttgttccctgtagtgtcacttggttatttcggccacaaagtctttgctacactggtttccataaaattcatgcaagcgaacggtgagtttaatccacgttgaggaagatctgaaggacattggagtgcccctgtctcttaaggcacagtccacatgacacgttcctgggctctggtgttcttcctgcttttcctgccttcagtgaagaacttgttcatgtcttcttttcttcccacctttagtctccttttctagaagcataaacacataaacagttcacgcctgtagtcccagtactttgggacgccaaggccggtggatcacctgaggtcaggagttgaagaccagcctcaccaatatggtgagaccccgtctctaccaaaaatacaaaaattagccaggcctggtggcatgcgtctgtagtcccagctactggggaggctgaggtgggaggatcgcttgaactcaggaggtggatgttggagtgagccgagatcatgctagtgcaccccagcctgggtgacagagcgagacactgggtcaacacacagacacacacacacacacacatagatatatataaaaaaaatagcaacagttttccgaaacatgtttcagagagcttttggcttctgttgctctctgtccatcaccagtctccagcaggacccgcctgctctccaccctatcttcgtttctttgtctgaccactcatcacctctccgcttccactctgagtctgcaccagtctcttctccacacagcagcgaaaccagtgttccaaaacgctgtcttgatcaggttgatgtccctgactgatagcttcagaggctcaaggtcaaacatctttcccaagatcaggaccaaactccttcctatgatctcgcaggcccctgccctcttcctctggctcattccccttctgtttcctcttcctgactgtatactagctgcaagagtctttcattcccttgaaagtattttgcttccttccatcacagagtttttgcacaggccgttcctgtacctggaacatttctcctccctcggtctcactaatctctgaaaccacttgtgtctgtagtctggtgatgcatcttcagtgtttaacaaaaattcatggcacttactaatagaagatgctcattaactactgaaggaatcagtgaatgaatgatcaataaatgaataaataaactgggagtcctgaggttaccgtcatcttgatataccagtgttcacataaggagacccaagtgctctgcagatatttgtcctaaaaagccataggtagttgcaggttattacaggttttcttcctctgacagcccagaggacataggagcctgacttcccagtagcaaagaacacacttagcatcctcatcttggtttctaagaccattctccaataaccccttcaaggtattgctgattacagatatatattctgtattctttttttattattagtatactttaagttctggggtacatgtgcagaacgtgcagtcttgttacataggtatacgtgtgccatggtggtttgctgcactcatcaacccatcacctacattagatatttctcctaatgttatcactcccccagccccccagcccctaacaggccccaatgtgtgatgttcccctccctatatccatgtgttctcgttgttcaactcccacttatgagtgagaacatgcggtgtttggctttctgttgttgtgatagtttgctgagaatggtggtttccagcttcacgcatgtccctgcaaaggacatgaactcatccttttttatggctgcatagtattccatggtgtatgtgtgccacattttcttcatccagtctattattgagggacatttgggttggttccaagtctttgctattgtgaatagtgacacaataaacatacatgtgcatatgcctttatagtagaatgatttataatcctttgagtatatacccaataatgggattgctgggtcaaatggtatttctagttctagatacttgaggaatcaccacactgtcttccacaatggctgaactaatttacactcccaccaacagtgtaaaagagttcctatttctccacatcctctccagcttcttttgtttcctgactttttaatgttcgcccttcgtattctatattctttcaactagaagttggtatatacaaaatgatcaggagcaacttctatttccaaaaactaatggagttttcacaaaacaaaatgggtgtaggtcaagaaaacacatgggccaaacttaaagaactcctaatgggcaaagctgaagcaatttaaacagcagaagaaagtagcattagattatgacccaaagtattaaaataaatattcatgagtcaatagtgatagaaataaatgcatggataaattaatacatggaagtagagaaacaaatctcctgtgcagaaaaatcccagataatgtatgcacagccttcatccttgaagaggtagagcatgattctccatctttaagcactgcttttacatggtggctttcttccagagagtacagcatggagaagggaaggaaagggagcaatgttgcaggggcaaaaacctgccaaaaacatcctcagccaacagatcagggtcacgtcagccagcatgtcacattaattgttggtacccttgatcacttaaccccaggagattgaggctgccgtgagctatgattgtaccacagccctccagcctgggcaacagagcgagaacttgtcttaaaaaactattaatatattgggagaaaaatgctattttccctctgtggttttcctccccatacctataattccagtctgattatgaggaaataaacatcagatcaattcaaaattgggggacattctgtaaagtacctgagcagtacatcttacaaccgtcaaggtcttcaaaaataaagaaaaactgtgaaatagctgcagccaagagaagcgtagggagacatagcaagtaaagataccattaccgtggtatcctggatggaatcctggaacaggaaaaggacattaggcgaaaaacaagggaatcattccaagtgcagactttagttaataataaggtgtcaatatcggtttattaatctgacaaatgtccccttccaatcaaagatgttaatactagggaaagtgagtgtggatatgtgggaactctctgtactctctctgcaattttttctgtaaatccaaaagcgttctaaaaatgaaataagtctatgaaaggaaactaaaagccacaggcaatcactcctccagcagcccggtaatggattcccccttccccgtgccctgggccaagactgaactgtgattctgctgtcctgcacccggggacctctatttggagcagtatttggccaagggaagcagcgctcactctccccagtccctcccctcctgccctgcttgcggattttattttagtttgcttccaatggcactcagctgctgctacaggcaaatatctggctgctttgcacgctattgtacaacacactgggggaaaatgagccttcgtgctagagtctgggtccctgagcaaataaacagagaagaaaaatggtgcatgtgggggtggtgaggttgagggagagactggggagccaggtgattgagaagttagtggctaattcagctcagagtttgggcagaaatcctatgcttctccccattcaattttccttattccccggactcctcagaaacacccagcttattggtgggggtaaagagggtattgttttcctgggggtttctgttccaaggataagggagttggaaagagctgttgagggtgtctagccttttttactaggtggaggtcgtctgcacaagcgctctctctcttgcttgctctctctctctctcgctgtctcgctccctcttgctcccgcttgtgctctctctctctctgtcttgcttcctgctttctgagttctctactgagagctggacacagatgcagtggctcatgcctgtaatcccagcactttgggagtcctaggcgggtggatcacttgaggtcaggagttcaagaccagcctggcgaacatcgtgaaacaccctgtctctactaaaattacaaaaattagccgggcgtggtggtgggtgcctgcagtcccaactacttgggaggctgaggtaggagaattgcttgaaccctggaggtggaggtttcagtgagcttgagctgagatcgtgccacttcactccagcctgggcaacagagcaagactccatctcaaaaaagaaaaaaaaaaaaaaagaaattaatggggccagagacctttggaaatttcaatggttgtgtcaaagcaacctgaagtttcggcttcatcaacttccagaaccctttgagagtgtaaaggtgaagaggaggctctgaggctgcctggatgtaccctccaactgtgtggctttgtggaagtcgtttaacctccatgaacctcagcttcctaatgtgcagatccatgaaacactgacacctccttcatgagactgtgtaaaaattaaatgtatcaacccatacaagggacttttaacagtttctggcatcatgtaattttccagtacatgttacccctcctccaaaatcaattatgtatactttaatatgttaagtggtaacatttcacattttaccttctcttcatgtaaggaggtggagagccattgtcaggccttgtctcatcttagaaaaagattagaagttgccagcttcaacataattgtcattgagagggcttaaattttgtttggattaataattcactaattaatcccatagataaagatccagctgaagagtctcattttttcattattaacaatttgaatagatttcatttattgagcaattactatgagccagattctttacagagtgcttaaggtgattatgtctaatcctcccaacagcaggaggtagatactattattcatttcacttaccctaatgtcagagaggttaagtgactttccaagcttgcaaggctagtaagaggtgaagctggagtttggaacagggtttacagagtccagagcttgtctcctgatggatatgctacattgcttctgtttgtgaatttagagaagagtggtttaaaatatcttttatctctctgtttttatggagagaggggagaaagtgctgtttgacgaagatttattgccggagggacatattgagttcgaaacatgaagggtagcaaagctgagattctggcatctgttttcttgcttgtttatcccattgctctgtcggcgcctatagaaggtagctggtttggtttgagttccttccaaaacctggctctaaggaattaatccctaataacaaatgctcagcttgttgttgaaagggtttttgtttgtttgtttgtttgtttgtttgttttgagacggagtctagctctgtcacccaggctggagtgcagtggcacgatctcagctcactgcaacctctgccttccaggctcaagtgattctcctgcctctgcctcctgagtagctgggatgacgggtgtgtaccaccaggcctggctaattgtttgtatttttagtagagacggggtttcaccatattggccaggctggtcttgaactcctgacctcaagtgatcctcctgcctcagcccccaaagtgctgagattacagatgtgagccactgcacctggcctaaaaagggtctttttgactgttggtgatcttcattactcggtgaaggtggagactttcagccacctgataggaggatttgcagtgacttgtcttaggatgggagcacattctcataatgaaagacactcttcccaaaatgttaattcttttggtagccacatgcttgtgttaactattgctttgccactggtgtatggatacaggaaaaagcacttgaaccagaaaacatcagaccaacatgtcctgcaatgctttattcctattgctggatgtttctgcaagtaagtcactctaccaacctttcgagcatctactgtcttccacgaagggatcaggcgtgtatataagccagccttatacttatacttatacacagccgacttactgtgtttgcgacctggcatcatctaagtcaaaaaaactttggtgatattaaaaaaaatgccctcaaaacaacttaatagtatttatagaaattataaagcttcatccagtgcctaaaatgaacattgggatgttagatcattaaattaatgggatgtgatctatgtcctccgtgatttcaaaaacaccattcttttaattgttaattagagaatgtagtgattacagaacgtgaggaacaattttgcttattttcaatatgctggttgtgattatgtgaattattaactctgagcagcattcaatttcgttcatttccatggctttatgaactatttccagtatgcatctgttcttgttttcaattaaaaaaaatatagatttcagcctgtaccttgtaatgaaaataggaagaagcaggaaatgaatttcttatacatcattgtgtaatatttctttatagatttttttttttccaatgtggacctgcctggagacctgtccatgaaagatcatgaggtgccaaaattctcgcaagaaaaacttggactgttattggctatatatttaatactattatacttgcactgcagggaccaaaagtttcttatcaaatttattgagatgattttaacattctgaaacagattgtccacactatatttggaaaaaaaaatgtccaagtgatagatggatttacagcttacacctcaggtttttattatagttgacatttacacagtcttgaaagtctctactcctctgttttatagaaatggcaatgccactcagtctcatccaatattattatggagctgtaacactctggtgaaggatggaccatctattacttgacaaaccctttgtcaagtatatcatgccgtttcagaattatctgaaataatcatcacagaaattcattgacccatcttatgttttgcgaatgtatgctcgaatgttaagaagctattcatttgtttttctcagatgactaaggatggggccatgtgccacagagctccatgtctgcttttacatagttatcattgtgaatggcgccccctacagttgttcagtgtgtagtctgaaattttggagaccctgagtttcttgacattgtttgagccgaagaccgttatctttacttcaggggtggtcctttcacatcttttttattttattttattttattttatttatttttaggcaggtaatttttgcatttgaagagactctgaaatgaccaagctgagccgttgccattaatcctgtttgtctaaaagtttaatcttgagccacccctctcagcaatgcattgccactttctcatacattacaaatatgtaatatgggcaaagtaacgaatgtcatgttatcaggttatgtgtctcaatcactgaaacaggctcaaaaggaatgggacccagtgtcgaggagaagaaaggcacagaggaaagattctgacacttgaagcactgctcagcagggcaaatttggggaaaagatgtagacaagaactttagacaccaggaacaagattgagaaggtgctgagaaaagatcatggctgggccaggcgcggtggctcacacctgtaatcctagcagtttgggaggccgaggcgggtggatcacaaggtcaggagttcgagaccagcctggccaatatggtgacaccccgtgtctactaaaactacaaaaattagcctggtgtggtggctaatgcctgtagttgcagcttctcgggaggctgaggcagaagaatcgcttgaacccaggaggcggaggttgcagtgagccaagatcgcgccactgcattccagcctgggtgacacattgagactctgtctctaaaaaaaaaaaaaaaaatcatggtcaatcattcttaaagctggctaattagtgttacctggagagctttacaaaccccctaccttatctttataccaattgaatcagaatgtctggaatgagggcacaggcgtcagtgtattttaaagatttccccagatatttcttatccacagccaaaattgagaaccactgggctggaggagtgctagggaaggaaaaggaatacaggatcaaaagaacctttcatttgtttattgatccagccgtttttgttttttttcactcattcattcaacaaacacttctcatgaagtccctgtgtgatatacactgttctatgatttgaagatacagctgagaagaaaacaagcaaagccttcatgctcaaggagcttatgttctagtgtcctgaagcaaatcctttctgactcaatagaaatcaggttcacgtggcaattataacacatgacctttcattaaaagcatgacagaatcattttcatgagattgttaatttggaccacaaaacaagtcctgcccaccccacgcccccccaaaaaacaaaattaaattactaaaatttgatgtaatcgatgcatatcacatctatttgtgaaacactgctgtttctaatgcccgtccttcctctaagtactcttcaccttcatttgcctaattcttcaggagtaaacttgtaaccaaaggcaaacatcttacaaatttgatgatacttagacctgcttcccaaatgcttgggaagttttcataaaattgaatgtacataaataatacatggtcaggggttcggagacttaggcaaggtgctaaatttgtccaatatgaggccacctgctcgtatgtcatctgttggcactggctcacgcatttgtgtgccaggacatatgaaattaagtttacctgatgctctctgacagcagctttctgttacaacgtgcaaattagattaggttaaggtagagggcagagtaaatggatggcttcatagactgatactagaatcctgacggctttaaccagaaggtgactggttctggtctagcttgggtcattggtaatcacaagttcctgttattgatgcctgtgcagtggcctgtggggagatggatggcttattttttattgaattttgccgttatagccaaacatcacactggcagtgcaacttcattgaccttcaccctcgaattcgaggaaggaaggtcgaggtgtaaacagaggatggagactaaataaggtagttgtctcttgaatgttgcttggtcccccttctaagtgtgtgatacatgagcaaggctaaaaggttgtacagcctgccacctgggaaccacctcccttgggctgaagctggcatgattacttgggtcttcaaagcaggcgtgcacagtttttctctcaatatgaaatgatctaatgcaaacttgaaattctaccagaagaatcattttttaactttaaaggaatctagagttgtctctgcctcattaagtaactcaattggcttcaaaagcattttttatttatattgaaaatatagaaactgtcaacttcatcctaattttgaagactttttttctataatgtggccttccgttgtgtagtaaacttagtaaagcacctgttgtacaactcaatggcattccatcccaagggatggtttaatggcataaacgaagggccgagggaaaaataaattcagatatttaaacagactaggcaccataccctaaatctttgcttgcaaagttgaccagtgatgcacagaatgaggcagaaatactgtcaaagggactggagactgatctcgagatgttctagcgtggaatggatgggtttacttatttgtttaaataattgcgttctttggaattgcctaaattttgcacttctgccggtttaaatagagtcgaattgaggttgtttctggcaagaatgagtgtcacatttttgaagggaacagcagtgacagcacaacaacagacagttcggagactaaataccattttttaaagtttccgaagattaaatagaaaaacactccggggcttagctaaaaggctaacaggagaaacgaatttcacgtagaaatcaatcgctctgttcactgacacccagtgacagaactaataattgtgtccatgtaaaatcagaccctcttgttactttttaatgaagtctgtctgattctgtgatatttttggcctaggaaatgaaagagatgttttattaaatgaaactaggtctacataggtgaagtatctgaatataactatgtaatcatatcgtacaataaaaagaaaatataaaaaaattggaaagacatgaatgtagttcaaataagcttatccctccaagaaggcttctccgtgttttcaatggaatagtggcctgtattttgcatttgaacaatggcacaaagccattggaaggggaagaaaggtttagcctacccctcttggatccttatgccacaacgtctgttccctgctgtactgagaagtccaactctcctttgcaagccaggaaaaataggacctttttcaaattgcatgcttcgaagatgctggcagaattcaaaagtgctttctccacacagtataaagccctttacctgattaaagctggttatttggcttgccaaggtgaaaagttttcttatgttttatcttgcattttccctctcttcttccctcatttcctctcctcttcctctttctttctttctcatcttccctccaacattaaagacatttggtgcaacctcagcattattatttttaacacccaccttgccaagaagagtataactccaaggaagcttcttttttaagcagacctcatctgttctctgttggtccctgagtggtacctttcagctggccatttttccccagcggtgcatgtgaacacatgtgcgtgtgtgcaggcatgtgtgtacacacactttcatgttgatggagacatatggtcatatagaggatctttgtggtccatctagttctttagtttcaaatgtgatgtgttttatctaatatctgaaagggaaacatctttctgtgtaatttctcaccctgaattacacatttaaaccccacaaatatcagaggacattctaagaaataccttgtgggtggaaaagttgaccttttgtttccctctgcctggttggctgacttgggagagagtaactgaaggcaaagggaatgtcagagtggaggaaattcccatcctagactgggcgaggggcagggggtgtggtccttttacgatattcacccaattcagagcgccctacttctgttcaaaactgtgataagaaatatcaatatgggcatatgacagtatgtgtgggagggtacctccttcacttgtagcatctcacagggagaggtcttggcaaaggcacagtcatcaaaactgatgagcccaaaatgggattcacccttaaaaaaaaggttttgataaaattagctttcctcttaacaatctgggagtgctatcagaatagcagctataaatctgtctggtagggccctctcttcttaaaatagatggatgggtagatgaatggatagatgggtagatggatggatagagggacagatggatggggggataggtggatggatgagtaggtggatgaatggatgggtggatggatgtttggatgggtggatgggtgggtggatggatggatggatggatggatagacggatgagtggatgggtggataggtggatggatgagtagatggatggatggatgggtaggtggatgggtagatgagtgaatggatgggtggatgggtgaatggatgggtgggtggatgggtaggtgtatggataccttggatacatacatgtaatacatttaaattcttaataggtacatcttatgctcttcatgtctctttctctggggaggggcactggggtgctgacatatgctatctttttttgtggttaagaccataaggatgagaccacttcaccaattcttctaggcatgttttgaagcaatgtggtatagtggaaagaacacaggatttgaatcactggaagccagatttaggtctgagcaccatgtgctttttagcttgagtacctttgctcaagatggttaacctcagtatccatgtctgtaaaatggaaaaatgttttctaacttgctggattgttgagagaattaaaagatatctagatctaggcagatagtgtttaactcaatacctagaatagagagagcattttgattaatgggagctacagctactacttcaactgctgctaaggatctttcttgtttttactttcccctccttctctgggtgttttttttttccacgatacattttagaaatagaagccacattctaacttctttggctccttgcctgactttcatatggtctctggtcgagaatggtggccattctatgtgtgtgtgtgtgtgtgtgtgtgtgtgtgtgtgtgtgtctgcctgcctgtatctatgtctgtatctagaaaatatatatttatacctggaacatatgtacgtataaataaaattctggaagatgcatcttgctggaagatatatgtcttgatatgtatatctggaaggtatatatcttgtttttcccttgcttttgacagatgttctaaactcaccataccttttggatattgaactataaagacttctacattcctattttatacatttagaattgtgaatattgtaataaaaattcctctgacatttctcacatactacagacatcatgtcccctactttttcttcatggagagatatgagacaatgttgaacaacccagaataagccaaaatataaggaggtaagaatggattcgttgtctgaggctcaatatgacaccacctgaattttctctatatcacccttcaagggggtgaggatggctaagaccactgatacttatgtcatagcatgaacaaataataactacttaccatgtgccaggttcttctgcaggcactttacatagataattttatttaatcttcatagcaaacttagggagtagatgctagtattatcccaagtttacagaggaggcaactgagtcacagtaagctgaaatgacatgctccaggttgcagaatgatcataaagcagagccaaaattaggcaccagtgtcttttggtgtcaggaatctctgcttttgtgcttttctgtctcatgaaaatatcagagtggctctctctattgggtctcattattgcatgccattgtgggttcttctgactgtgtgtcacctttcacaaggagcatttcctacactgtgaaagtgcacatgacaattttatgtacttcttgttgaaatccttgtcttccttatgctgcccattggtgcttcacactattttcttcctcatcccacttccgcagcttgtagctcctgcctgagctttggaagtgaaagccaaagttccacctcgatgcaggtgataaaactagggcaaaatgaataaagtgagagctttgacgtcagcacgtggaacacatacacaggttatgctgaattgtaagctggacattatgtcactgtaggtttagcccttcttggattttctttgtttgtttgttttgttttgttttgttttgttttgtttttaaggtgtagtctcacaccgttgcctgggctggagtgcaatggtgtgatcttggctcactgcaacctctgcctcccgggttcaggtgattcccctgcctcagcctcctgagtagctgggattacaggcatgcaccaccatgcccggctaattttttgcatttttactagagacagggtttcactatattggtcaggctggccccgaactcctgacctcatgatccacccatctcggcctcccaaagtgctgggattacaggcgtgagccaatgcgcctggccccttcttggattttcttatgcatttgaaatcaggtaaagctaaaattgtgaatatgtaaataaaaataccatgagaacatgggagagggagctggggtgttttgctttcataggatgggagccaatgcctacatgttttctattgtatcttttggacaggtagaatgattgcaattgttaaaaaaaaaaaaaaatagggaaaatgatgccaggagcagaaagcaaagatgttttcaaagagtcagaaagactctgttccaaccacaaaccatcctatcttcccccagttaatggggttgcctaaatcgtcaactcctactgtgaaactcaaacccttgttgttccaacttaactttttgcccacagagtagtttaggacaatccaatgtcagtatggcaggtagaagtagcacaaagtaagatccatttgtgtcttgatttgagggacataaatgtcctattttctttacgtgtcttggtcaccccctcacacaggctctctgaagttgtttccgtcattttgtacccttcctcttcttctctttgtaagcttaagtttcacattcattggctgtttttctctctgaggtttcagcttcaagggattatgcatatgagacttgtattatataccctgaatgaaaaatattgaaaatatctcacagctagctggatctctcttaatccaggctttccagaaaaatggtgctgggaccacccctggaagctcagcctgccccaaaccccaggaatcttcagtctgcaagggcagaaccagataatgaaatggcatgctagcaggtagtagttctctgatctaaccactgccacacataaaaaatgctgcagctttgatttgggttttatgtcctgtgattacacggatcgtgctggttcctaatgtagacctttccagttctctgggtgtgcacctctgcatccacatctccttccaattcatggaacctcctttatttcttccctgcctgtaattcttctgctctatgatctgagcttccactcatgcccttattatttagctcttacattcctagaagagtatatgtttatctattttaccactttgggcattgtcatatgtcataggttcattcaccattcattgaacaaatggttatcaattagtcatatgtaccagtccatgtttacacatgacaggcacatcaataggtaagagaggaagagcccatgccctctgtttcaatgttggtagtaacatggcttgtgaaggttaaaagaaaaacccagaagcaacctagtcttgtcatcaaaatgagaaagtaaagatggattgtggtaaagtaacgcagtggaatactacagagcagtgaaaaataaaccaggacgaatctcacaattttagtgttggaaaaaaggaacaataggatgtgttatcctcacttgtgtaaaattgaaaacatgcttgtgtaaaattgaaactatggaaaataatgtgaaacaaattagtatatttcttagggatatatgtatatatacatgtatgtatgtgtgtatatgtatatatgtttgtcagggataactaagggattcctaatctattggtagtatttactaacttgggcataggaagcagatacatcttgtattaagtaatatactgcttatgtgccttaaatatctcattttaattttttataaacaaaattgatatgctcacttcaaattcacctaattttaagggattgaattattccttagatgtattctgctgaacttgctgggtcggatagtgtaaagattgaaaggattgatttaaaaaatggaaaaacattgtgaaggaaaaagaaaggaggcattgtttgagaacgtttgtcttagacatagcatctctacccaacagtgcaaccactcattattcctagcattgagggaagaatggttaattttggtgaaagttctagttcatatgaattcctctctttagtcctaaagttgttgggagtgaagagatctttccatgtcctcgagggctggtaggaaaaatctgtgtcttgttactaccatgttcccccaccatctttcctttataagttttaattaccctccaacctatacctcatgtaaagtttttcactatcacgcattttctacaccttctatgtacgtaaatacacatatatttttaatactcttacctatcttagtgtcagttccagacatgttgcctggttaactttgaatacttcagtgtgttcctaaaaacaaggacctaaccacaatacaattccaaaattaagaaatttaacacactggtatagtcctctggtctcatccacagtttgttttccaatttcatcaattgtcccaataatgaccttgatggcagttttgttcatggtccagaatctaatccatcatgcatttcatttagttgtcaagtctctttagtgtcttttaatccacaacagtgacagtcttgcttggtcttttatgatcttgacatttttttaagaacacatacgctgggccgggtgcggtggcttatgcctgtaatcccagcactttgggaggccgaggcaggcggatcatgagatcaggagatcgagaccgtcctggctaatgcggtgaaaacctgtctctactaaaaatacaaaaaattagctgggcggggtggcgggcggctgtagtcccagctactggggaggctgaggcaggagaatagtgtgaactcaggaggcggagcttgcagtgagccgagatcatgccactgcactctagcctgggcgacagatagagactccgtctcaaaagaaaaaaaaaaaaaaaaaaaaaaaaaaaaagaacacaccctggactgcccattgccgaatcacctgaagagagcccttcaattttaactaatcatttttgcaagcttagttgtttcagctgctacaaaaaagcacgagtcttttaaaaaggagtaaaattctgacacgtgctacaacatggacaaaccttgaaacattacgctaagtgaaagaaaccagtcgcaaaaggacaaatattgtatgattctacttatttcaggtacctaggatagtcaaattcatagagacaaagtaatatagtggttcctagggaccagggggaggatagaatggggagttgatgtttaacgggtatagaatttcagttttggaagttgagaaggttttagaatactgataatagttgcacaagaatgcaaatgttcttaatgccacttaattgaatactttaaaataattaaattggtaagttttatgtaatgtatattttgctacaattttttacaagagagtgggtcctcaatatgtaaatataatgtcaattaaaataacaagaaaacacaaggcagttatttactttgtggatgaccctcaatttgggtctttcagctgtttctttatgatcccagttggggtgtgcatttttgccagggatacccccaagtaataatgtcctgtttttcccagggtgccatattaagagacacatgatattagtttgtctattattggtgatattaacatcagtcctttggatcatatgatgtctctcagatatctccagtaaaaactttctcactgtaattaatacatagtttgggggtgggaggaatggttttagacttttaaaataccgatttgtcatcaatccttcattcactagttttaccattcattgatgattcttgtctgagtcaattatgattattacggctatcaaatgatggttttctaaccccattgcacttatatgtgtgggttggcattctatttcctttcctatatatatacatttaattacttatttcagtataaagtcatggattcgtgtttttattctatgaactacaatcggttactttcgttatttgttttgatgctcaagttgtatcatatgtattcactgggagccccttcaagctggctcctgtatcattttgacataaacccgtaagttttttttaataacatccttattccttggcaccagaagatattccaggtatatcttgacttttcttgccccagtcctagagccaggaggccatttttccacagagtaatccttcctttgattggagagtggtgtttagaaacaaagttctgggcgattatggcttctggaccctctaaatagacaatatagatagaactaggaaaaaatacacacatgcacatacacatgtatatataattatcttttcaaagccaagaatttgttaatccttcctaaggattatgttcttcccaacaggatacattatctaggttaaaatttccctgcctatctgatatcacttgttattacgagttatcttttatctgtctgttaggctgtgagacccttcagaagagagacttcatattttttgtcatctttgtatccccattgcctaggaagatgtctggtacagattaggtactaatattaattcataggattgttgggtgaaacgatggttgaatgaaaggatggttggttaggatcattgggtaggagggtggatgggtggagtggagattcgatggaaaagtatagttgggtgggaggatagttctttgggatcctgggtaggagggttgttgggtagaatggagattgggtggaagtatactcggatgagagggtggttggtaaggatctttgggtaggagtattgttgggtggaatagagattgggtggaagtatactcggatggaaggatagttggttaggatctttgggtaggaggatggttgggtggagtggagacttggtggaagtatagtcggatggaaggatggttggttaggatctttgggtaggaggatggttgggtggaatggagaattggtggaagagtatagttggatggaaggatagttggttaggatctttgggtaggagtattgttggatggaatggagattgggtggaagtatagttggatggaaggatagctggttaggatctttgggtaggaggatggttgggtggaatggagattgggtggaagagtagagttggatggaaggatagttcattgggatcactgggcaggagttttgttgggtggaaaggagaatgggtggaagtatagttggatggaaggatagttggtgaggatctttggataggaggatagttgggtggaatggagattgggtggaagtatagttggatggaaggacagttggttaggattgttgggtaggagtattgttgggtggaatggagattgggtggaagtataactggatgggaggatggttggttaggatctttgggtaggagtacggtcgggtggaatggagatttgatggaagagtatagttggatggaagcgtagttggttaggattgttgggtaggaggattgttgtgtagaatggagattgggtggaagtatagtcggatgggagggtggttggtaaggatctttgggtaggaggatggttgggtggaatggagattcagtggcagagtatagttggatggaaggatagttcattgtgatcactgggtaggagtattgttgggtggaatggagattgggtggaagtataactgtatgggaggattgttgtttaggatctttgggtaggaggatgtttgggtggagtggagattcagcggaagtgtatagttggatagaaggatagttcgttgggatcactgggtaggaggatagtgtagaatgaagattgggtggaagtattgtcggatgggaggatggttggtaaggatctttgtgtaggaggatggttgggtggaatggagattcggcggaagagtatagttggatggaaggatagttttttaggatcactgggtaggagcattgttgggtgcaatggagattgggtggaagtataactggatgggaggatggttggttaggatctttgggtaggaggatggttggtggaatggagattcagtggaaatgtatagttggatacaaggatagttcattgggatcacagggtacgaggattgttgtgtagaatggagattgggtggaagtatagtcggatgagaggatggttggcaaaatctttgagtaggaggatgattgggtggaatggagattgggtagatatacagttggatggaagaatggttttcatgcaagagcatttgggttaggggatggttggatgagaggagttgttaagtggaagaattgtgacgataaaggatcattatgtgggaagacggttgtgtgggatgtggtctgcatgtcttatttagcaatgtatgtcttttttgttatacttctgtactcattgcattcaggtgctgtttaagaagttattttggttcctttttgtctttcagatagtaggtgttcattcagtatctattgactgtgtgactatgactttcaggaacaggaatggatgatttatctttcgattctttgcattctccatagtgctcagcttggcgtaaatacagatttaatattcagtttgacagtaagtcagttagaaaaccacagcaacataatatctgccctatttaccttttaaagaaaactaaggatgctgtattagtttcttcaacactgagtgtggacttgattcattgtctctggatattcagttgccccaaaattattcaagtagtctacttggcaagtatttcaagaatggagggcattgtttagccttgtaattattcattggctcatgtaattaggagacaaacttttgctttggaataagggttacaccacacaatttgggatcattttgtgatcaggcaattgaataggctagaaagaattcctttactgatggatagacattctgaatacctgttttatccttttctattttctcatactaagaaagtaagtagcaaattcttctcacactgatattgtgaacagaaaggaactctactatttttggccatatatatgtttttttaattttggatctattatgtgttctagtgtctttagagaaaattttcgtaattgaaccttagaagagaagacaaatgctgtgtaatgtacataagaacaagaagacgttactctagctgaaaatgtcttttttccacagtactttatatcctggccaactgctcttgtgcaaggcgaccaagtaacattttcccattcagctataagaacgaagagactgttattgccactggctggtattgagtaatcgtacataggtggggtgagttgaaggcaatctgaattataaaacaccttcctttgaagtcaaatcaatttttattcttaatctgtgaacatgagatgggaacaaataacttctgagtgaaataaagatttcttagcctgtcaagatttatcttatcaggctgaagaggtgggattcctgttagcaactggcagttttaaaaatccattcgcctgaggaagtgtgaaaacagtctgcagaacaaagacactgagctattgctgcattgagtgcttatttgctccttttttacatttcctgcttgagacctcgccaggtccaactttaaaacgtttgcaggctaatgggagtgtgtgcacagggagtatcagaaatcatttccttaggggaggaggtgttttgtggtgcaaaatgttgaggttctgttgccaaaacaccaactgcaagagggtattttctgtgaacttcatgggtggctttcatagggaattctccatgtcattctctgatgtcttttattggcccttgttttgccagagtggggaaaaaaaacaaaaacaaaaacaaaaaccaccttccctgtgtcatttctcttttaacaaagaaagccaaaataattctataaatgaaagtcatgcacatgtagaactttgggtgcagctctagagtattttttttttttaaccctcctaggatgaagccaaaagaagaaaactggttgtatttctctaacatttttaggcagatgatcgtttctgggcagggggaaaatgccaaagcctgtgcagtttctctttcggctcatttgaaaatactctaggaaaagacccctgtggattctctgccccttctgtaatgtgtggaatcatgtgattgctggacagcccccttggaagcctgccagcccagcctcttcagcatccagatgggaacccggaggcgcatctcacagcggaccgttgattaacccaaggtcacctggctctggtttctgacggagcgagaatgagtacccagaggtttccagaacctcagcacaaagggtatccatgatgaacaggcatttccctatcccttctctctcctgtcccctgcataaacaatgcaaaaaacacactcccttcttggccaggacccaaagacctattatcctacacatgtctttctgtgctttgagggatcagcaggggtgccagtgaacttggattactctttggatcaccctgctgcctccagctccccctctgttttgtttcatgactcagtcatcctgtttgagctcatttaccacttgtataggggtacattccttgacttctcagagcaaaccaagcccccatccatgatttcttcttcttttacaatgagctctcatatcacatttatcccagtggaaatttcatatcaatatctgtgattctttgactgttctctctttcccctagactccaggatccttgggatcactggccttgtcatttatgttcctgcttatgtcctatagcctggcacttagtgaggcggtgtgttgtgttgggttttgtttgtttgttggttggttgttgttgttgttgtttgcaagggcccctgcaaagtatcacaaactaggtggcttaaaaaagcagacatccattctcttgctgttctggagcccaggaggctgaaatcaaggtgttagcagggacatgatccctctgaaggcattaagggtgaatccttcgttgccttttccagtttctggtagttgctggcattccctggcattctgcggcttgcagctgcgtttttgaaagctgcctcactcctaacctctgtttacattggtgtctgttcacgtcacctgtcctctatgtgtgtatctctgtgtccagattttcttccgtttgtgaaaccagcagtccttggtttagggcccaactaatggtttcatgactcctgtgttagcttcctagattgcagtaagaagtatcagaagctcagtggcctaaaactacagaaatgtgttttcttacagtgctggaggctggaaatctgaaatcggggtattagcagcgccatgcattcttcaaaggacccagggaagaattcttgctttcctctttcagcttctagtagtcgttagggatctggcggccctcagcttcgagatgtgtcactccaatctctggcttgggtatcacatagccttccctgtgtttttctctgtctccaaacttccttcttcttataaaggtattggtccccagactgggctcggtggctcatgcatataatcccagtactttgggaggctgaggcaggtggatcactttgaactcaggagttcgataccagcctgggcaacatggaaaaattccatccctacaaaaaaaaattaaaaattagctgagcacggtggcctgtgcctgtaggcccagctacttggaggctgaggttagaggatcacttaagcccaggaagtggaggttgcagtgagccaaggtcatgcaactgcactccatcctgagtgacagagtgagaccctgtctcaaaaaaaaaaaaaaaaagaaaaagaaaaaaaaaggtatcagtccctgtatttaggcctcatcttaattccatatgaactcatcttaattacatctataaagaccctatttccaaataagcccacgttctgacattctggggggccatggatttctgggggttgttatccaacccagtgtacaaggcagtacacatttattgaatgcatgaatgaatgataatgctctgggccctggcaagtctcagcctggagaactgagtctgcctgcctgcgtagaatcaagaacaacatgcacttcagtggaatttgggaagggtcagggtctgtgccgacagaaatggaaaaatcctccaagcgcctcaccctctcttaaaagactcctcaagattgctttgctgttctaccctctacagtgtttttaatatgtctatttaaatgcaaattttgactttctgtctgtaatcatataaaatgtttggcactaaaattttaatcaggaatgtaattttagatagaggcggtaatggagtggtaggccacacataacagaatgaagcttccccaacgtggattcccagactatggaagtgctggcctccctgctcccagctgagccgggaaaactctgccccactccaagaggtgcttctcaaagatgattcctgatcccaggcatgtcctgtgtcctgtcaccaatcctggtgcttcatcgtcctttaaaatccaaacgaggtgatctagtgttcttcctctgcgtcctctggtcttctagcatcctggataggccgtgtatgtttagaaagaggggctccaccctgtgcccgcctaagatgatggctcatttatcaagaccaggctggaggctcagctaccagagcttctgttgtttgggaggaaggctgccagcagcagatgtttgtcctcgcctcagctccctgcagcctttgagctccatctgccgcacactcgggcacagctgccagtgcttcccctccgtgctcacctttcacctctcacggaggctggggtttcatgcatctgggcccaacagagagatggtgacccagaccctgcgatcctggtgccacaatccttcccaacagctcgctgggcatctttctgcactagcctgtcagcatgctggaagcagcaccgatggaggttgttgagcagggttgcaattgtagcccgtcactttggtcttggtgttccatcttgttagggcaagagagtcagagcacacacagccatctcctggctggatcatctggtggagtgggagtgtgcacatgcccacccccatttctaaataagatatgcattgtctcagggcctttgcaatgtccactccctagtcctcaatgctcttccccattggtcatcccagagctcatctcaaatgtcaccctttagaggggcagctgtcagtcttcccagttaaagcatatgccaaccccctcatcactcctggtctcaacaacctctttatttccctcattgctattatcttcatctgtaattctcatctttataatatctcttgaatgaatctttaggaggattactcttcctagagtgtgcaaaacggattgcagggatggtgagaggtgggcggaaatgttggaaaggggacaagggtggaattggtagcactgatcttgttgagagaggattggccctggaaaaagaaagtagcaatggagcaggaagtaattagacatagaagagagctcttcacgtgggaggtgaggagaatcggtgttgggattgtgtgttaggactgaggaaggaggaggaggaggatgcccagctttctaaactgggtatttgagtggatgggggtgacttgccgaaaataaagaatggtttgagaagaaagatgctgtgctcatcttggaaatgttgagttttgggcccctgtagaagacccagctgagatttgcaggtctgcatcaaatggagaattcatcagagaggcaatggtactcaaaaccatgacagtgaaaggtgcttccctaggagagaggcaggataaaaaaataaggtggcccaaaattaggatggccacacatcccagttagccaggatattcctgccttatacctgttgttccaccataatttctaatggcccccgcccccctactttcactttcacttgtctcagtgaactatatcgtcaccctacccgcatgagaaggttggggaaattcagagttcataggagggcataagaacccactgaaaaaaactgagtatgagcagaagggtagaaagaaaaaccggggtagtgttgggtaatgtatgccaagggtagaaaattgacaagagaagaatcattcatgtcaaatgggtcacagaggtgaagtcatgcaagtgtcaagagctgtgcattggatttagctaccaaaaaaaaaaaaaaaaagtcttgatgaccctgtaatcatgatggtgggaatatgccagagacaggtggctttgaggagaaaatcattgatgagaaactagagacagtcagttccactaagttttgttgtgcaagaagggggatatgttagaggagtttgcagacgggcatgagagaacaagagaaggttcatgggatgggaggcatttgagcatgcgtcagtcctggaaaggggcctgatggagaaagcttcaggagagggggtgtccacatgatacagcagtgttcccaagggagagagagcagatgcaggaagggacaccttccctgttaacaggcaagaaagagcaagttggggtgtaaggaagtccgtaggctttatggcggggatttgaagagagtagcatttattttctcctctgaggtaggaggcatctgagaggtgggggaggttgaagatgggaggaaagtagacagttgctttaaatagccacatggaaaatgggagaaggaattggctcattcagatgacttttattgggtgccttctgtgctccaagccctgggaatcaactagtgaagaaaacaatccaatgggactgatgttctccttggaaagagaacagtgacggtggtggaggcagcaaagggaacactggaggctgaagacccctccccaacttataatgatgcgtctgtgagtggtgaatggtggggattttttttttttttttttttttttttttttttttttttttttttttttagtagaactcagcagcttgggtctagacacagagaaaatggacaacttatggtctagagatggcagcacagaaaggaaggtgagttgaagttctggggggaaaataaatggcaggtaaagttatggaccatttgatcaaatcctggtgtgaaataaagagcatacttaggatatgtcttttgttttttcttcttttcctctgacatgcattgctatcatgagtgtccttgaacaaatctctttgggggcatacaaaaccatttctgtaaaacaggtgttaagtataggaactctgggtccaaaggagaacacataatcaatttggataaatattgccaaattgtctgttgcacattcctcaccagtttgtgctgccttcagcagtgcccaaagcgcctccttcccttcacataccgttgccaacataggccattatctttctgagttttaccaagtggaggaacaaaccaaaggtcctcatatttttctgtgcattctggtgattgcttgtcttggcgagcatcttctttttaaaataatcttgctgggggacttgtggtatgcaatgatgactgtggaagtattttagggggcaggtcagagaggagatgcctgtcagtttggggcaaggggatttgggaagtttttggaggaaatcaaatgggagacaaaagaatttgtctgagagctggagaagaaggaatagatcctagagacattttcatttttgttgcattttatttttatagatttaagatgtgtaagtacaaatttctcatgtgcatatattgcgtagtgatgaggtctaagcatttagtgtacccatcactggaatagtaaacattgtacccaaaaggtaatttttcaaccctcacctccctcccacccttccatcttttgcgatctccagtgtctattattccaccctgtatgtcatgtgtacccattgtttagctcccagttataactagagatatgttggaagtaaaatgcaacgggcttgatgaccttgcaggaagtcagcgaggagtgatcagcgctgatagaggcttatatctttggagtttgtgtgaccatgctaacttttaaacaggaggaatgatacaaaataagatgcaggtttggggttcttttccaaggtcttgcctttacctattggatgtcaactatcttcttgggtcattgaacaggagctcttcctcttggcttgtggcacagatgagtttgcttctgtcatgacgctggggacatggggtcctgtgtgctaggccaggcattgggccgatgtatgcctggggctaccgcatctgctgctgctggaactgggtctgccctgtgtccctcgggattccagcaagtggacttcatcgcattatcatgcattcacctggtcagtttctgcacgggctgtttatagggcacgggtttaatagctgtctcccctgctgcactgcagattccacgagggcagagaccatgtccggctggtcgatcatcctctcctaggaaaaggctctgcaaagttttcctgtaaagggccacacaggaaatatttcaggccttttgggctgtgccatctctgttgctattcaactgcctttgtagcgtgaaagctgccttgatgatatgtaaacagatgggtgtggctgtgttccaataatactttatttatggatgcagaaatttgaatttcccatcattttcatgtgttgaagaatagtattcttgtgatcctttttccccaaccatttaaaattgcaagagccattttagcctgtgagccatacaaagacaggcagtgggcctgcggtctgaaagcatagtttgttggtcccgtcctaaagtttagcacagggcctgtaatggcagtaaacactcatttcatattgtggaagaaaagaaagaaggtgtgtaagttgtgtttttgtgcttgctttctcctgcagagtgggtaaaggaatggtactgaggactagtaaaatgcaaagatttggtatcggtaggtcttcatcctgctcctaatgcatagtgtgacctggagccagtttgtgcagctctttgggcctcagctgtcctatctgtgtgatgaggagaagcctagcttcattaagggatgtgaaaatgcttttaagactgggtgcagtggctcatgcctgtaatcccagaactttgggaggctgaggcgggcagatcatctgaggttaggagttctagagcagcctggtcaacctggtgaaaccccatctttactaaaaatacaaaaatcagccagatgtggtggcaggtgcctgtaatcccagctacttgggaggctgaggcaggagaattccttgaactcaggaggtggaggttgcagtgagccgagatcatgtcgctgcactccagcctgggcaacagagtgagactctgtctcaaaaaagaaaatgcttttactctcaagcccactgaaaagtgttaagttattacccaaagcaggagaagcagcacaatagaccaggaagctctaaatcctgacaagccagtatttacgctgcagccagcccagggctcagctgcagaggcagcgaaatcctaacagtgagcaggaggatttgacatctggtgcccaagaagtttgttaaggttgcccagtcacttgctgacatgtgctagcaaattctcatgctttctccaaaaaaagggtatactatgggcttcgctcccacaacattttggtaaatcttccaagaagatctggctttcttcttgttaaaggaagcatttgatggcagcctggatgaaatagatatcaaatctgagtgacattattgctgttgttaaactaaagctgaacctcttaaacttggcatcagttgactctcctctttgtcagaaaacctatgcaggatgccatgtgatctggaggacacaaaagcatgattgtgtcatttctttctgtatggagtctgtgcagtcagacagttcttttctatcttgctttcttccttgggtcaggacaagtccaattcactgaatgcaccaagccccttctagaaaaacagcacagggctggacacagtggctcatgcctgtaatgccagtattttgggaggctgaggtgggcggatcacaaggtcaggagttcgagactggcctggccaacatggtgaaaccccgtgtctactgaaaatacaaaaattagccgcgtatggtgtgtgcctataatcctacctactcgggaggctgaggcaggagaattgcatgaacccgggagacagaggttgcagtgagccaacatcgcaccactgcactccagcctgggcgacagtgcgagaatttatcttggaaaaaaaaaaagaaaagaaaaacagcacaacaaacaagaagagttcagtggttacaatcaaattttaaaccaattgtcaaagtacaagccaccactaagcagatggtgggatctggtttttgttttgttttttgaagcataatggatcctctgtggtatgggaattttaaggggaaaaaaaagagaacaatttctccttctctgcagtacatttactgctgctatcactctctttctaccctgaaatgtttctgtttcaccaccattcatctctcttgattggttttgcttttttttttttttttttcttctaagatgttgctaaatttgcttgtaaagttttgtttattcattggcgcttggttgaaaggtgctggatcattaatctaagtattcaaggttaaccatgctttatgctgaaattgcctttttatggaacagatttcaaggttttgcaagagttgagtgctacctcatttttgacatttcagcaatgaatcctgtttgaaatgtgatttgaatccaatcatcatcttatttgtggaggaagataaaaataatatacaaatattgcagtaaaattgcatttttccctgccccctgttttgcatttcaattcagctagattctgctagggtggcacccagcaatggcatccctgctttaattctatctttcattttttttccctcccagaaggcttaaacatatttcctttctatctaacataagttgtacagggcttctgaagagtgtgcattgaagaaatggagcttacacaattacttctataccttattatggaatctgagggtaaacagggctttggaggtcatctaattcgtctccttttgcaattacagaattatttctttgaaggaacaaatgaagaatctcttcttccaggcctctttgtaaatgtgtgaacaagtttataagtgcctccatctcagagtgtgtgtggatgtggctttttaattaaagaccaaggcttcaagctttgctgttttctccgatctgatatagccactgttcctagtcacatcatggagctcttggtcagcctgtgatctgggaggtttcttttctaactaacgtgtatccttcccttagaactagtctgcaggggctggtaccaggcagcctctcttaagaaacttacacccagaaactgctccatttctgtgtaaatggtagccatgtccgagtgggtgtcactcaccctatttcagcagcaccccctccctgtttgctatctacaaattatctctcccctcattaaagtttggtcttccaaagcttttcaaactctcagactctcattcactctaaaatatttacagattaaccatgttcagcctcagcatggtgtcatcatgggaagatgctctcagtgtggacaagataaagctgttaaagctggttgagccaagctttttcgtatttaaataatggaaacaggaacaggcagtatgcatagttaaggacgtaggtctgggttcgaactctgcctttgctacgtcccagctgtgcccatgacattatttaacctctcttgcctcagttttccccatctttatttttgttttattttattttattttttgagacagagtctccctcttttgcccaggctggagtgcagtgccgccatcttggctcactgcaatctcctcctcccaggatcaagtgattctcctgcctctgcctccccagtagctgggattacaggcatgcaccaccacacccggataatttttgtatttttagcagagacagggttttaccatgttggccaggctggtctcaaactcctgaccttaagtgatccacctgcctcggcctcccgatgtgctgggattacagcaagtttttcccatctttaaaatggacacaataacaaacctactttctaacactattgggagaacagaacaaggtaatgaacagaaagtgataagcacagtgactcatgcgtcacgtctacacatcgtatttagcaaaaagctaagcaagttattcccttgctgtgaattatcagattctagtaccagggagctgaaatactagtctgggggaagagtgtgccaatgagatctttgtatgggacagcttccccaacattagtgtgggaattccattaagaactcatttcttttttttctttcttttttttttttttgagatggagtcttgctctgtcgcccaggctggagtgcagtggcgcgatctcggctcactgcaagctccgcctcccgggttcacaccattctcctgcctcagcctccccagtaggtgggactacaggcgcccgccaccgcgcccggctaactttttgtatttttagtagagacggggtttcaccgtgtcactcaggatggtctcgatgtcctggcctcgtgatccgcccgtctcggcctcccaaagtgctcggattacaggcgtaagaacacatttctaagcttcacactgctgtcctgttgtcatgatgataggtcaaacttactgcagcttagtttgggcgggacattttggctgggaacaccaatacccgtaaaggtcatgtttacattcttgtgtgagcctttctttaaccactgagtgtattttctatcatgattatcatccacttcttgctgtgtattggcatgagggagtctttgtcctcctccatttgttcatccaaaaattactgaatagctaattaaccccgatgctggggatacaccaaacatgattcctgcaccttttcgagcttatatttggtggaaaggatagaaaaagcagcaacaaccaataaatggaaaaataaataaagccatcacaggtggtaagatgtctgtaaaagaaaccattgcgtcccaaagagagaaaagaagttcttttagtatctccagttgttaaaatagtgtctgacacatagtaggaactcaagtgattattcactgagtaaatgtttacggtaaatggaatagtttaggtaggggaatccacaaagattctctggggatctactatttcagcagaaatataaagaattattcatgagatgatcaaggggccagatagggctgggaggaagggaagtatgggtggtgagaaaggcggagagctggaaagatattggattgtttgaggaattgtggaataaagaatctctatggttgaaaaataaagagagaggtgttggggtagttattgattccgcaaagatgaagctcagagagtacccaggaacatgactggggtcataggttctggagaggaacttggactttaattgaaatgcaaggggaaatgactaaagtcttggtaaagtcaaagtccattggcaaccattcaatgaacttcaaatccatgccttttagggttggtgaccctgaaggatgaagcgttggccttgagaataaggcagttcttgtaagttcaaccactggctttcacttacagccttcatcacatcactcacctcctgtaagcatccgtagccttcattttcaatggagaaaaaagaagttgagatgcatttctccccattgctattttggaatccactcagagcactcagcgcctgctgttgttctcattggaatcttgctgtcccatgcaacttgacttctatttacactcctcggattcgtatgtgcaagtcttgcttgtgagggaagagccaccctagatatgaaaggacttgattaggaaaaaaaaaaaaaaaccttttgaagagagaggtgtaaaaaaaatgaagccattagcgtcaacttaaattcaagatatttgggatgatacatctgcttataggctcataaaacaggcaccagctcaaggttatgtgaaacaaagaaaatgtctagcattgctcagctgttttaggctacctaattatatttttagctttatgcacttgggattctcttttcttttttatttgttttgagggtgtatagtgggcacctgtcaattctgcagcccagaatccatgcccctacttctctaagagtgtccatttttccctctggtgatcattcctccccattctcagaccttttgacttccaggagagcttcgtctgtctcagtctacagggaacaagtgtgtggcttccacctggctctgagaagcactgtgtaccccagtcactatgactgttgaaaggtgagcatgcgcacctatcagaaccagtgacatgaagtttgtggaacattttttttttttttttttttttttggagacagagtcttgcttttggccaggctggagtgcactggaacgatttgagctcactgcaacctctgcctctcgggttcaagcgattcttctgcctcagcctcccgagtagctgggactacaggtgcatgctaattttttgtatttttagtagagatggagtttcaccttgttaaccaggatggtcttgaactcctgaccttgtgatccaccaacctcggcctcccaaagttctgggattacaggtgtgagccaccgtgcttggtcctgtctgtggaatttttaaaatgtgtttgaacttgggggacgtaggtctgaagctgtttgcagccattttggcaccatgtggagcgtaggaatgaaactcacactcacagaaagtgtgaagaagagcagaaagaaagaaatgaagaccaaggttcaatggcaccatttaatggtgatttaaaacatgtgtttgtttttatttttacttattatttattatttttaattaatttgtcttttagttgacaaataaaaattgtgtatatttgtcgtgtgatatatatatatataatggaatactactcagccttaaaaagaaggaaacctggctgggcacagtggttcccaccagtaacctcagcactttggtaggctgaggtgggagaattgcttgaacctaggagtttgaggctgcagggagctatgattgtgtcactgccttctagcttggatgacagagcgagatgctgtttcaaaaacaaaaacaaacaaaaaggaaattccatcacttgtggcaatatggaagaacctggaggacattcggctaaataaactaagccaggcacaaacatacaaatacaccatctcagtaatatgtggaatctaaaaaaagttgaactcacagaagcagagagtagaatggcggtttccaggggctgacaggtggagatggagagttcaggagatgttggacaatgacatcacttgaaaggtccctggatccagctaagccttaacccttttatccctctaactactgagttacctaaactagtaaattccctttttttagtcttttcacccagcttggctttgcacttttgccagctgcaaccagcaaagttcacactgtggcaggggtgctcatcagtacgttcagttcatgaggaggactcagatgatgcatgctgcagggattcagagggagaatttcttttctccttcatagagcccatttttctgtgtctgtgggcacaagttgggaaaggagagaataatgaaacgacatgcacagatgcatacaggactctgcagagatggtgcaggcattgtcaagatgacctgcccaccactagcttacatatccttcatttttttgtgtgtgtttctttcaacactcttcgatcatgaaactacatcttttattttccttgacagtgctcaagaaaatgtggtcattaagtttatcatcatgaaagcaggcacctggtttctgaaatactagacttcttcatgtgtatcatctctgtggtttttcagaactctaaaatgaaggtccacttagtccaattgctgttctaggaacctgtgatcttttaatcttggatgtctctacctaaactatggtgtgagggtggtgtactaacaagcaactgaagttgaatgacaagagtaaacatgaggtaggtttttctcagtgctaatcaatgacgaacctcgtgctcaaaaattcagctcaggctgtagccaccaaataaatcatgggccagagaggttcagggactcaaagacatgaggctgtacccaggagaaatcaagctatggactggtaaggctcagaataaaaattgatgctgtcttcccagtatttgggataataggattgtacctctttgagctacttatgtgtactgccatctgagtcgctgtctcagcatttccagcagaaatgcaacagggctggtgaagtgtccaggagtgaatgacttgtaagccattaggaaggccggggaaactgtgtttgggctaaattgcttttggtcaggagctccatcttctcatggctgtgaaatgacggatacctgagagaagtcccagctgaaagccgtgtctgcactgttgttttctaagtggatgctaatccgttaattagaaggtttgcagttatccttggcactgtatgcgtgcatacattagtatttctatttatgcacatgcaatggatgtatttacatatccgtaaacctgagtctttttacctacctcttagaggtgccattctgattattttctggtttagagatggaaagacaaaatctgcccctccccacccccaaatcctgaacttgagtggagctgtggtgataatactgaactgaagggctgtgcaggtacctagtgttttactttgtgccaattatttgttaatgcaggtatcaattttttaaaaaatgttttggatgacttcagtgtgccgggcactgtgtttgtttctgggaataaaatagagaacaaaaaacagagaaggtgtcagcccttttgcaacttataatttagggagggagtgagaaaaaaaaaagcatggaagaaacatatcagatagttatgatttaaattaaataaaataaactatgaattaaaattagttgatgcgacagtatatggctaggtgagtctctaagcttaggttataaatgatgacttttacaaagagactacccttaagttgaaatctgtattataagtagggagcacctataaatatcggggcagggggttagttttgagcaggtggatcaattagtgcaaaggtcctggggcaggaaggaggctggagtggtttgggaaccaagaaagagccgggccagggttgcattttagtggatgatagggaaggcagcatggaatgaagtggagacgggcttgtggggccgggtttctcaacctcagcactactgacattcgaagctggagaatgctctttggtgagggctgtcctgtgtatagtaagatgttcagcagcctctctggcctctacccactagacgatagtacctcgcactcctccagttgtgacaataaaaatgtctccagacatttgccaaatgtcccctccaaatgtgacaaaatctcccttggttgaaaaaccactgaaattggccttgcctgcaagaagtttgagtttattctaggatccatggaaagccactgaaagtttgaaccaattaagtatcacgatttgggccaggcacggtggctcacgcctgtaatcccagcactttgggaggcccaggcgggccgatcacgaggtcaggagatccagaccatcctggctaacacggtgaaaccccgtctctactaaaaatacaaaaaaattagccaggcatggcggcgggcacctgtagtcccagctactggggaggctgaggcaggagaatgacgtgaacccgggaggtggagcttgcagtgagccgagatcgcaccactgcactccagcctgggcaacagaacaagactccgtctcaaaaaaaaaaaaaaagaaaaaaaagtatcatgatttgattcacatttttaaagatcattctatttgctgtaagcaaatgggttgcaggaaggcaatgtggaaaggaaaaaagttcatggtcccagagagaggttataattgccttgatggaaggtgatagtcatgggaagaaagttctgtaggcagatatgatttggataaagttgacagaatttatttgtggaccagatggatgggcagggagagaaggagaagattaagtacaattcttagatttttaaataacaaataggatacccctcccatcctcgaagagctcacactgaagtaagggaaaacaaacatatatattgcactcattacagtgtgctctaataaatgcatgaacaaaatgtttcggcagcgctgaggagagagtgaataagtctttcagagaaagtcagggaagattgctcagaggctgtaaaagcttttgaagaataagtaggatttttctaagtggagaaggagctcaggttcctggtctatactaagaggaaaccgtaggagataatccctcttcaataattcaaactgctgtcaaggaaaattatgcccagagtgactctgttctatggcctgggagggaaactggggtgaatgtcctaaattgttgtctttgaaaagaccgtttctaaaattcgtggcccaacgtagccttttactggttaactctaagtatttaagatgttctccaagcgttttaactgaagacactgcgtcttattttgtcttcattgaatttcgaagaagcatctgtagtaagaatatttacacggtttttctaggtaattgtttgtctcctggaccatagagtaccttaaatacgttacattatataatttactaatagtaatacaattttatgaagatatctagaggtaacaaattcaagattatgtatttctatctctggaataataattactgttttcatttgtaaaagagattgtaagggaaataaaatgtaaagttaaagctaaatgtcattgtattctatgcttgctgtaaggtcaaaatatgtgatcctgatggaatatggtaatatccctttgctctcctccgcacactgaggaaccttttcctgggactaatagacccccctaatgggatgcagacagtgcctcagagtagatgttgttccataaatatctgggggcactccagattgggaccttgagaactagatggtatgctaaattccctccttcctttgcaggaattaaaaagcatccctcaaattgacaagaaaattggataataaattaaccatttacagtttggtaaatatatgcacaactgaagttccacgtcatgggccatatttttatcagacgcaacaccagatgaaggataaaccatatgacccaccctcttctgccatgaatgaacaatggactgaagtctttcataattgcttgtttcaagatgctcactaaatcagacaaggaactcctgtcttgtgtctttaagggaggttgaacaataggctgggacactggagtaaatggggcactctgccatacttacactttcctttgaaatttgtgtttgggaggctttaactatgagtatattttgcagccaaatgcagttagctttttgactaatggagctggtgtgaattttacccctccatctgtagatgctgaaatgtcacattatttcatttttctaaaacaaattaaatgactctgagcatccagtcattagggttttaagaaactcaatcacaactatgagtatagggaatggggatgaacagtatccctttcccatatgctagatagacagtcacctgtggagcttagcagtgcttcggatacagggaaggacagctggtctttgagatattgtgggcatttgggtgttaggattcttattacttaaacctgcccagtccctataaaaagggaccgctttgcaaattctgatccatgcatggaacaggaaatctttcttaatatttagctgcttcatgcattcaaatccttgaagaccccccacatgccctgcacccttctcagttccctttcaatcttggggtatctcccctttctgagaattcactgctgttgctgacctcctcccactcatttccttccatcttctcttactttcttaataccccacattatctctgctgactgtgtctttagacacacaacacttttctttaaggaaaggcaaggctgtgtgttccttacctcatcatgttatgttagaggtccaaatgttttatgggtgaccaattaattcatcatgtcatctggatgactgttgaaagcaaaagcgggatcattgtaagaactgtgtcaggaaaccagcaaaaccagccctgtcccaggcaaactgggaattatgatctctctctggaaggaaagaagaagaaaagtgggagaggtaggctgttctttttccaacaagaatcttggaaggcgttttcattttggaaactgtttagaagactatactaaattgttactccttattaccaacatgcatagcatcctgcaatgcagacatccatgactgtgcatctccactgcttcaaacagggcactagtgttccaagctttgtgtttctattgccagccctgaatgcaaaaatatgggatcctgagttcaaatcgggctcagaagttgacatattgtttgaccttgagcaatctgcttaatttcatagtgtttgtttgctcatctgaaaacaaaagggataatgctgatcgaggcatattgtggagattaattagtttctgaagtgctgagatccacagatgaaaggctttaagtggaaattattttgtttttaaaggaataatcgatgcatgtgaataaaagagaactaactgaactgaattacaggcacttggctgctggtgggagtgggggaagaaagaatattgcttcttgcaaagaaccttaaatttaccccccagaatagcagtgggaaaattgctttttttttgtgattctgaaaggatgagaaattatgcaaaagaaacgagctagaataagaggagaatatatgcagttaagacatatttcaaagtaactttcctggataaacaactaggtatctaatatatatattatgtgtattagatatatatatgatatatatgatatattaatgtattagataatgtgtgtgtgtgtaagtatgtatatactccaccagtcctctgtgattaggttcttagccaaatgcttgtctaccaaaacagctcagccacgatccccaaggagccttaatgacccctaagtccttggtgaaaagatcagtttgggaaggagaaactaactgtttaaaaatctcacagctgtgtatcgtggtgagaaaactagcactattaagcgtgttactgtttaaaaccacttttgctcttgttacatttggtcttctctccaataaatattattattgcccttgatgtacagataggaaaatgataatcagggaaattaaatggctggccaatggccatttgtttggttaggtggtataggcaatattctgacctcaacattatgactcacaagactctgaccatgtcactgtcaccgaagggtttgctaaagatatggtgacattcagctggcatgtggaaatgaattattgtctaaggactacagaagaattggaatgaagacaggattttttttgtcaaagaaaataaaaagttctgaccattaaacgaatgcgtttttgtcatagacgtggtggaaaatgccaacaaagtcagatttcaaaattggctcaaagtctcctgagtcaaatgaaaactctgtcaaagccatgttatacttcttcttagtcttttatccatgcattttaataatatagttatggtcatgttatcccaaattcttttcaaatgttgttttaatggctctgtaactttctaccttgtgactattgcatggttgttttgacctttttctcattttttgtagatatttaagttcttactttttttttacttttataattagctctgtaatgagctttttgtgtgaaaaaacatataattatatacagagttattaccttactacagattcataacatttggattattgcatcttgggaaataaatattgtagtgttccttgtgtatatatcaagtttatatcaataccatctatatacttatatatcagattttataaattaaatgtgcaatttattgtgtaccaaatatatttcaataaagctgttttttaacatgagggccttgcacagtagctcacgcttgtaatcccagcagttttgggaggctgaggcaggtggattgcctgagctcaggagttcatgagcagcctgggcaacacagtgaaaccccgtctctgctaaaatacaaaaaattagctggtcatggtggcgtgcacctgtagtcccagctacttgggaggctgaggcagtagaattacttgaatccgggaggtggaagttgcagtgagctgagatcgcaccaatgcactgcagcctgggtgacagagcaagactccttctcaaaaaaaaaaaaaaaaaaaaaaggacaactaacacctttactcttatggcagtaacagagtagcttgttttggagtaatcctatcatagatagcaattataaattctagataggatagtaaaaatcaccttctgtttgatggtactccccaacaaccataagtaggcagaaattgaaggggctttgaccctggaaagagaggtactgtaacttgataaaatgagatgcatttgatattcacccccaaagtacacaccaatccatgtggtgcaaggaagacgagactcaggaaggctacagtcttactgagtttgagaaataaaagacagatgtccagaatagttagaaagtatcaatgaaagacacatagatagactaggaaggaagatgcagatttacctataaaatctacacacattctggtggatctctgaagcatatttatataaaagaggctctaggggagcccgtgggaagccatagctggacgactgaaagaaccgagtggatactcgagttgctaaacaggtagaggatgcagaatgggagtgtgaatccagcaagttaactgcctgctataacaaaaatcagcactcttctgagtaagttaacaaaattcagcctcattaatatattatccatgatgtccttttaaataaaacttactagatgtgtgaagaaacagagaaacattactcatagtcatgagaagaagcagttaaccctgacataaaaaaaatgttggaattaacagataaggactttgaaacagctggtataaatgtgaatagtaattaaagaaataactagttatataaaaatgaaaattttagaattacaaataaaatatttgaaatgacagttttactatatgggctaaacaggagaatggggacagcacaacagatcagtgaatttaatatagattaatgtatatcattcaatttgaaaaaaagcaaatgatttgattattaacagaagactagtgatttatgggataatatcaaatgtatacagctataggtacttggagtcccagaaagaggaaggagaagataatgcataagtaatagttgaaatttcttcaaatttggtgaaatactttcaagaagctcaagaaacttcaagcaagcaaaatataaagacaagcacacctagtatgattttaatttccacgtcatagtcacagtgatgaaaataaaagataaaaacatcttgaaaacaatcagagtgaaaaagaggcatttcctacatggggcatagtgatatccgtgatggtcagcttctcatcagaaacagtggaagcaagaagacaatataatgacgtcttttaatggttgacaaagaaatctgcccacccagaattctgttttcataaaaaaaaaatccttcacagaaattaataggaagatgcattcagacaaatgaaaatagatgttttattaccattagtcctgtactataagaactgtagctttaaagggtatcttcagagtgaaaggaaatgatgctaggtgagacttaaagagatgaatgaagagcagggaacatggtaaatatgtggataatataaaaggttataatgcttctttgaaaatatatgtaactgtgtaaagaaagatgacatcactgttttttggagtttgtaacatatgcagacacaaatgatgagaatgtgaagcaaaactatactgttgaaaattttttacacttgccatgaagtagcactgtattaatgctgagtagactgtgctgtgttaagattacatagttaattctgagagcaactactaaaaatattacaaaagtgtatagtgagaaagatacggaaggaactaaaatgaaataatagatatatcacttaacccaaaatgagactgaaaaaggggaatagagaaacaacggcataacaaaaacaatagtaacaaaaagcaaacagaaattaaagagcaaaccataaacataagtccaactatgtcaggaaacttacaattatggcagaagggtaagcaaacacgtccttcttcacgtggtagcaggaaagagaagtgctgaagaaaggagcaaagccccttagaaaaccatcagatctcatgagaactcaccatcatgagaacagcatcagggtcaccgcccccatggttcaattacttcccaccgggtttctcccataacatatgcggattatgggaactacaactcgagatttcggtatagccaaagcatatcattctgctcctggtcctttccaaatctcatgtcctcacatttaaaaacacaattattccttttcaacagtcccccaaagtcttaacttcttccaccattaacccaaaagtccaagtcaaaagtctcatctgagacaaagtaactctgttctgcctatgagcctgtaaaatcaaaagcaagttaggtacctactagatacaatggggtacaggcatcggataaatacactcattccaaatgagggaaatttgccaaaacaaagggactacaggtcccatgtgagtccaaaatccattagggcagtctttaaacattaaagttcccaaatgagctcctttgactccatgtctcacttcctggtcatggtgatgcaagaagtgggcccccatggccttgggcagctctgcccctatgcctttgtggggcacagccacctttccacctgctttcatgggctggcattgagtgtctgcagcttttccaggtgcacagtccaggctgtcgctagatctaccatgctaccattctgggatctggaggatagtggtcctcttctcatagcttcactaggcggtgctccagtgggactctgtctgggggctccagccccacatttcccttctgcactgtcctagcagaggttctccatgaggattctgccccagtagcagacttttgcccggatatctgggcatttccacacatcctctgaaatctaggcgaaggttcccaaacctcaatgcttgtcttctgtgcacccacaggagcaataccacgtgaaagctgccaaggcttggggcttgcaccctctgaagcaatggcctgagctgtaccttggcctcttttaaccatggctggagctgaagcagctgggatgcaggggaccatgtcccgaggcagcacagagcagggtggccctgggcctggcccatgaaaccacttttccctcctaggcctctggtcctgtgatgggaggggctgccatgaaggtgtctaacatgccctggaaacattttccccattgtcttggtaattgacattcagctccttgttacttatgcggatttcttccaccagatatgcgaaatcatgtctctcaaggtcaaagttccactgatctctagggcaggagcaaaatgccaccagactctctgctaaaacacagcaagagtgagctttgctccagttcccaagaagttcctcatctccatctgagaccacctcagccaggacttcattgtccatttcaccatcagcattcaacaagtctctaggaagttccaaactttgccacatctttctgtcttcttgtgagccctccaaactgttccaacctctgcctgttacccagttccaaagtcacttccacatttttgggtatctttacagcagtgcactccactacctcaataacagcttatgtattagttcattctcaagctgctatgaagaaatacctgagactcggtgatttataaagaaaagaggtttaattgaatcacagttccacatggctaaggaggcctcaggaaagttacagtcatcatggaagacacctcttcacagggcagcaggagagagaatgagtgcccaatgaagggagaagccctttgtaaaacccccagatctcgtgagaactcacccactatcacgagtacagcatgagggtagccagccccacaattcaatgacctcctgtcaggtccctcccacaacatgtgaggattatgagaactgcaattcaagatgaaatttgggtggggacacagccaaatcatatcaggtgatttgaacaacactatctaccaacttgacctatgacatttatagaataatgtatccaacaactacagcatgcacatgttttcaagtgctcatgaaatatcccctcaaagtagactacatgttgggtatgaaatcttaatgcatttaaatttttgaaatattgttaactatgttttctggcaacaatggaataaaattaggagtcagtaattataacgtacctataaaagtaccaaaattttggaaattaaatagaatacttctaaatgactctcacattaatgcagatatcacaagagaaattagaaagtattttggactgaatgatgatatctcaaggcttatgggatccggctaaaaaacagagtgaatgtatagctatagatgctgtaaatttactggttgaaatgttagagagatttaaagtgaataatccaagtttctcctttaaaactagaaaaaaagaaaattatacccaatatagtaaaaggatgggaatagtaaatataaaaacagaaatcaggctgggccttgtagctcatgcctgtaatcccagcactgtgggaggctgaggcgggcaagttacttgaaatcaagagtgatttcaagtgaaatcacttcaaatctggccaacacggtgaaaccctgtctctacaaaaaattcagaagttaaccaggcttggtgggcgcttgtagtcccagctactcaggaggctgaggtgggagaatcacgtgaacccaggaggcagaggttgcagtgagctgagattgtgccactgcattccagtgaaagagcaagactctgtctcaaacatacacacaaaatcagcattgatagtacctgatggtgttggattgaaattggagctatcagtatcaatttagtttttttaaagtatatacataattatagaaatacacaaaacttggaaactccaggagtaatcagcacaactagctcccagatcttggtttctaaatatcattaatcattaaaaggaaccaaaacttattggagaaagggtgattccagaactggggcaaggaaagaacaatatgaacctggaacaactctttctttttgccagaaagtcaggaatatcaaagaatgatgggagcatgtccaaaggacacaggcctcagcttcaagtaccatccactggccagatctgggataatctgagtatcaaaatgtaaataatagcaagagattggagctcactgaatgaaaggcaaatgcataagtgtacactgatataaataaattagaaaatgaaaaattcttcctcacaatataaacactactactaacttataagcataactcacacctgtgaaaatgagttagggtaacttcacttatgataacctcaccaacattggactgtgatcattttaaaacctacgctaatttgaagggcatgaaatgatcttttatttggatttataggactttggatcattaggggacagcagtgtttagccgtatgcttataatgtgtctttaactaaaatatgatcatttttcagtcattttgtagctttcatttacccataccccatttcaaatcccttgtataatggaagccactattgctgttcccagagtgactccattgttcttagacgcagagaacgaaggaagaaatcaaagtttaaagataagtttactgttcatggaaaacattaaatgataaactatagtttatttaaaatagaaaatgattatttcttgggcagctattgcatttatgggatccattttatatgtatctagtaaatccatcaataaccctgtgatggagtaattagagaagagaaattgctattgtttccactttaatgatgagagaagaaaatacccagggagattaagatcgtaactgatcatcatggctgagccagaccagctaactgtcgaaacgttcctctggccccaaccgtgatacctttgtctaatggtggggccagggagaagggtcagaaggatgagatgactggggagaagaaaacagaaaaaaaaaaaaaagcattttcttgtgagtcctgtcccaaaaaaatgctaagcatgcatgcagacacccattcattttatacattttgcttgagtccctgcagtgtaccaagagctaaactaggcatataggaatgaccctgacattcatccccacccactggtctctggggtagaataaacttcggaagcttcctatgtagaggcgaccatagtagagaactgaaatctcaccctttgttataggaggataagagaaaataaacgtggatatttaggtgtgttcttttccaaacaaaataaaaatgaacaaacacatttgcttgcttttttttcctttggatcttttatcttttaatgcactttcattggaattcaatccatacatactgaagggtggttgaagtaataaatacagtctttttctccaaatggtacccaaatgaaagcaaagtactgctttctgcttaagagtgttcagtttgtccttgacctatacatttacactgggttgctgtcctctgcctccttccactactgtccacacaatacctatgtaaacacatacacacacacaggccttaatgatgagtaaggcccatttatttagaaaacatggtttgaaggatatgttaaaatcatttgtagataaattgatatttttatattattacttctttcttgggtttctgcctttgatttagactgtagccagttgtgcctgctatcagttctggaacctaaaattcatgtgggaagaatttaagtgtaaccgagatgtaattgtgattgaagcagggaatgaaatataaacactaatcaaagcttcagtagacatgttttttttgtggattaatacatcacattttaaaaccttcaacccttggcttctcagttttttctgtttattgttttgtttgttgatgtatttgtttaattcatgggttagaggcttgggtgctgagagagtcgattgtgttaaaacctttagtgtggaggtcatgaagaggactgagaatgtttgatctttcactgtgggtgctgaaccagcagcatgagtatcacctgggagattgttagaactacagacttgcaggcctgtattcaaaatctgcattttaaaccaagatactcaggtaatttgtaaacaaaagtttgagaagcactaggtcagtttactccagctgtctaaaccagacctgccactcaggtgttaagaacccaagcaataaggggtggcttgcttttgataatctccctctaatcttatcagagactttttttttaaatagaggattctactcccatcatccaggcaggagtgcagtggtgtgaccaccactcattgcagcctggaccaccggagctcaggtgggcctccctcctgaacctccccagtagctgggactacaggcgagtgccactacagttgcctaattttttaattatctgtagagatgtggtctcactatgctgatctcaaactcctgggctcatgggatcctcctgtcttgacctcccaaaatgctggggttgtagccatgagccaccgtgcctgacatcagagacacttctgatgagcccaatatatttctaattattggaccctcaagtgcatctggagaggacaccgaaggactgtggaggcatcgagccctatgttcatgcattgactcaagtgtgtccctccaaaatccatgtatggaaaccctacccctgagaattactatatttgaagattgggcttttagaagataattaaggtccaatgagattataagggtggggtcctgattcaataggactggtggcattataagaagaggaagagacacagtaggaaggtggctgtctgtaagccaggaaaagagctctcaccagaatccaaccatgctggcactccaatatcaaacttccagcctccagaaatctgagagtgtaaatttatgttgtttaactcacctagcctatacagctggctctccatgtccatggactcggcatccatggagtcaaccaaccacagatcgaaaaaatatatattttaaattgcatctatactgaacatgagcagattttttcttgtctttattcactaaacaatacagtataaaaatttatttgcatagcatttgcatttgtattaagttttacaagtaatgtagagatgatttaaagtatatgggaggatgtctgaaagttgtatgcaaattccatgccatttgctgtcagggacttgagcatctgtggattttggtatctgtggagggtcttagaaccaatttctgtggctactgagggaccactgtagtatttgtgatggtagtccaggtactcaaggagagttcagttacaaatgcaattttcccctaaagtaacttggttccaaaagagtacgcatttgtagttgtatactacaaatggagtgcgtgtgtgttctctactctaatatttcatgccagagtgagttattagtttttgatcctttttcttctttttccttcatgagcagcagtcctagtttgcttgggacggggaggttttcatggacgcatcatcccttcagtgctagaacagggagagtaccaggcaaacttgggtggttggtcaccttttgctgttcccagattctttcctgagctgaagatctcagctcccttatgagaacttcacattgcttcaaagaagagcagatctcatcagaatccagcaatgacatgaagcattttggtgcagagtaactaccagattagagctcctggaatacttaaaccttcgtggatccccgatatggaaggaagaagcctggctatcctagcttgaatggaattcagcattggtagacggaaccacaaatgccttctatttcttcccaaatatccttttagaacttcgaactaattctagatagagtcttaaggtcaggtataaatgaactgctaagtatttatgcctgcataacacaatgatcaagaggcttcctgtgagcccaacattctcatgctttaatagaaaacttattgtaaaatttgcactctactctataacatagaaatgtctatcatttctataaatactatgcagtctcttctgatatatctgttatcctatcatacaagagcagatggctgggattttatcacagttagagggtgttttgagatgggctgcaaatcctctggagaatttgatttggagactcaattagtcatgacaagttaggttatgctgcagtaacaagttggctcctgaatctcaatagcttcataaaacaaagctttcatatgtccagtgttgggcattgggaagtgcaccaaatagtgcctcagggactcaggctatggaggcttcaccatcccaccaccgtatcatctggacacacaacttcctttgtcagcatgatgggaaagaaaacatggagaattgtacaccagctgatccatgcttaggcctgcaagtgaaactccttggtcagaactagtgaaatggccccacctaacaaggtggaatgagaatgctgctcttctgtagccataaagggaaggaatagcaaaaatgaaagtgaataggcataatatctaacacaagggtccaagaggtagaccctatacatgacaaactgtaattccacagaacagctggagtcattgatttgggaactagccactttacacatgggctatttttacatttgtttcaaggagtagtggcagggatgtattatttaataatgatcaataaaactcataaaatattgagggagaaaacaacttctattacaaaatgcaatggtttaacctcctttccacagaataaaattgcaagtgcatgagaattatcacatatgtccaaggatacacatattcctaccttggatgctcacatactgtgtgcaggaaggtgagaacgcagaggaattaaggactcagaacttgtctcctctcattaacagccaatgtctcacatatgtcctggtggatcttacagggctcagcctgaatgcttctctaaacttttccacatgtagtaaggctaaagaccatgtgttttacaagatggcaacactcaatcctatgcttttcactgaaacagaatgctctgtcattgaagcatttctctggggacctcagattctctttacagaggcaatacccattaattctaatgcagcctcctgtcatctgggactcatgaacttccaccgcagtggtcccttcctataatcaaactgtagtagcttctgtctccatagaagatgttagacatgcccagaaacctggtatgcaatgtcacactctgccaaaagaacataaaacttagacaaatatggaagtcattaacactgaagagttctttgctattaaaaataggaaaattttattactttcctacatgagaagaatatataatacctttagggttatttggtcatttggaggctagcttcttttctctgtttgtagacctatttttggaagtcgaacattttttttttttttcattttaagcaccctattgatacttggcatctctgcagtaatagaattttgaagagttcatcctgttcctatgctcggtcaatttttggataagtctgaaaatgatgctgtggatagaggatgctgggacccccatcatggcaagcatgcatcattgcaaagggtcttcataaggttatgtggaggctacctggggtcaggatccattcagagctggaaaacttaaatagaccaactgatgttagaaatagaatagatccatggcttgaaatgaacagttgtgtgtttatatgctggctgacccccctactgactgtgtgactacggaaaaaacaaaactctgctgcccatcggtaaaatgggattatgatccttgcctaacttcctgtttatagggttctggaggtcccaatgagataaactcttttgaaagaggtttggaaaatgatgcattatttcacaacaacatggtgttacggttgaatatcaatgatagagagtaattgagatggctatgtaacatagtggccagtcatccatttgcctagcaaccatctatattatttgtatctgtatctatctatatgtctatatgtctatacatctataactatatttatatacctacatccttatctgtatctgtacctttatctatatatatgctatggatttgcctatgtccaagtctatatccatatcaaatatgtacatatacattttctatatatgtaatccatttctatctctatatgtctatgtatatatctatatctatatctttacctatacctatatgtatatatttgtctttgtgtgtatctatgcttatatactatctctatatttatttttatgtatatctatgtctgtatttatacacacacacatatatatagagagaggcagagacagagagaaagagaggagaaagagggaaggagaggggtgtgtgtgtgtgtgtgtgtgtgtgtgacagagagagagagagagagagagagaagtacattctatcctaggaaatgggaacagagccataatcaaggcagcatggttttgacttatagttcccaggagagactttcattaaacaaaaatatcttgaatgaattgcaattgtggtaagtgctatgaaggaaaagtacccaatcacagtataaatcttatcccagcagggaccatcagggaacacaaaagaaataaaacactaaatcaccaatcctcacgcagcatacatggaccgtaggtgtggaccccagcctttgtgagtagatccccactatgttctgaatgttcgcttttccccagaattcatatgttgaagcctgattctcagcacaatagtattaagagctggaggctttaggaggtgattaggccatgagggtagacctctcagtaatggggtttgtgcttttatcaaagaggccagaggaagcttgtttacccctcccatcatttgaggacacacagaaggcaccatctataagaaatgggccttcactggacgtcaaatctgtcgacaccttgatcttggacttccctgcctccagaactgtgagacatgcatttctgttgttaataagccactgtgtctaaggtattttgttatcacagctcaggcagacaaagacattccctaaaagaaaagcactttattctataaagtgctgttgtttgagcttaataaaaagttaaaaaggccctttacagaggtctgtcttaaggaataaggtgtgtgtgcaggggggactttaattaccagtgggatgtatttaatgtatgatttcatttagaatccgggagccaatggttagtgttttttaatagactgaaattttcatcagggcgagttctggatctttatgcagctggtgctcagctcatctttgacctgcctgggtccttttctcacccattccatggtgggaagcagacactttgacttttcagagcgttattgatggaacaaatgtagtttgaatgagcttattagagtgtctatgaagtgtcctctgttcttaggcaacaaggccagtttctctcctcttccctccctctctgacaccgtagtgttatgttgtctgtaacatgttttgttacggttttagcaagttttcaaggcaaagggcatggcattaggaaaattgaattcacaggtcaaacaacaagtcaggtgacctcaggaaaatgacagtgatttgtgtttgcattttaatttaattcagtcctaaaaatgacccatcttgctgctattttctgtgatcacaacttttatgttttcttgtagctagctcttcatgtaattaatcattgcatgaatttctattttatcattttcttttggtgtcgttttaccaccccttctgtgatctccctgaaggtagaaaacttttctgttttgttcatcaatgcatacttaaagcctaacacatatttgacattttataaatatctgtgacttgaataaatgaataaattcacagtctctccctacatactacttcaaatactaatgttttataacaaataaaagtttactgtctggacgtggtggctcactgtaatcccagcattgtgggaggccaaggcaggtggatcacctgaggtcaggagtttgagaccagtctggccaatatagtgaaaccccatctctactaaaaatacaaaaattagctgggcatggtggtgcgcaccggtaatcccagttactcagggggctgaggcaggagaatcgcttgaacctgggaggcggatgttgcagtgagccgagatcatgccattgccctccagccagggcaacgggagcgaaacccggtctcaaaacaaaacaaaacaaataaaactttaccaaacactttgaaactggaaaaccttaaagttgttttccatttgaaagttaagatgcctttgagtgttaattacatgagtctgttcaattgtatgttttttgataatatacctccatgaaaagttgtgggatttttttaagctaagacacatgatttaaaataccctgtgaaacttttaaaaaggaaagaacctgaatgaacaaaataatatggtccccaaatggctgttgtagtggaggggaaaaaggtttcggctaaaatttatccagctgcaaaccactgtcttaagccagcaagaaatttatattcttccgaagctgagggaaaatcaaaatccacaagtgactcttctcttcccctagctgcttcatacactgctcagtttccggagatctgagataatcattttgtccttgagagtctcgtggctgtgctcttggagggtttgggtttaaaatcttaggatttgatcctgttcagaaaaacaaggcaggagcacccgagaagcatctaaaatcagccactgccagaggctgcttgctttacctgtcttgcctgttcaatttgtcctctacgaggcaaaggtgagactaggagccctgcttctgggaaaatgcctctgttaaagaaccatctcacattcctggagtttgttttgggatcacaaaattggcaactttcttttcttcttcattgcagtttagagttttaagcatcataaggctgtgtgtgtgtgtgtgtgtgtgtgtgtgtgtgtgtgctggtgcatatgaatgtgcttttacaggtacaagaaaataaataatccaaaggtagccttctccttggggtgtcctgctgaaacgatgacctagggttcttttttttttttttttttttttgagacagagtcttgctctgttgcccaggctggagggagggcagtggcgcgaacttgactcactgcaagctccaccttctgggttcaggccattctcctgcctcagcctcccgagtagctgggactacaggcgcctgccacaatgcacggctaattttttgtatttttagtagagacggggtttcaccgtgttagccaggatggtctggatctcctgacctcatgatccacccgcctctgcctcccaaagtgctgggattacaggtgtgagccaccgcgcaccttctatttgaggccctgcgctaggaggactgcattaagaccaaggcgtgcggaagcacactgatgttgctgcctctggtgggtgcacgttgaatcacgtgtgtctatccaagaggaatttgtattaacttctagtgcatttggccagaaaatgccatgagaatcagtggaacatgctgtgtaggctgttggagtggaaacaaacctacctggaagtaggcactgtggtctgcaccattcggcataagtcacttagcccctctgagcttcaggtttctcagcgcacagttggggataaaaaggaacatattactcagcatttgtgggctggctaaggacacagcaggcattacctgaacatccccacaataaccccgggatgtagttatcacttcccttatcgttctcatttagacagaagaggaaaccatggctcccgctgctcacaggagaagctagtattattcccctactctgaaaaccaactggatgtcccgcaatcatgggaatacaggtgcaacccatcacatatggccaattgtttttaaattttttttgtagaggtggagtcttgcaaagtggtccaagttggtcttgaacccctggggcaagcagttctcctgctgggacctcccaaagcattggcattactggtgcaagccaccacacttggaccctttttatctagataaccataggtccggagatgactgtgacaaaagagccatgtgctgtacatagcttgatcaaaatggcaaaaatgtatatgtttatgactgctgttttgtgtattcccgatgaacacatgcctttgttgttgattcttcatctatcttccaatacaattttaggtctggtgataatttctggatttctctatttatagaaaactttgaacttcataaatattaaaatgtcctattagctacatgcagactgctttttctatggccatggacattatgcaattattacccgagctattaattaaatttgaaaatagataaataatggatagggatgctatttatgagttaaaagtgagaaaatgaaaattattctccattctgttaccttggatgagtctaacctactgcatgctctcagcttttattattgaaagtcattatgttactttgcataaaatgaacaattggttgtaacaagtcagccctgtacagtgaccagttttcagatgaagtgattaaaatattttctcaataaaacaatcaaaacatggcccttggccaggtgtggtggctcacgcctgtaatcccagcactttgggcggctgaggtggtcggcttacgaggtcaggagtttgagacaagcctggccaacacagtgaaaccctgtctctactaaaaatacaaaaattagctgggtgtagtggcaggcgcctgtaatcccagccactcaggaggctgaggcaggaaaattgcttgaaacccgggaggcagaggttgcagtgagccaagatcgtgccattgcactccagtacaggcaatagtgcaagactccatgtaaaaaaaaaaaaacaaaaaaacaaaaaaacaaaaaaaaacatggccctttcacagtagtcaaatactgggtaatttccatattatacgagttagaaacatgaatctcaccagagaaaaggtatgtccccaagaacagagtgaacatgtattttgggagttactgcagaaagctttcatgaactctttctgataatataatgcgctggtagatttcctctggtcaacttggatttcagtcttccgtttctaccttttaaaggaggccttattagtctctctggttgatagaggatgcctgtttgttcaattcacactattcatggacccctatatgcctttcaatgatcatcctataaaagttatctttccactgcgtttactagatttgagttatcaaatggaaactctcaccaatgtctttgaaacctttttgttttcaccatgcctcataataagaaatacattttacattgaggcagcatgcacctgcaataataagcaagcgcttcacatgcactttgatgtgctccattttatttctttttagaagaaaatgttggtcacaaatgacactcccagttttgtggctgctaatggacatgtgaagcacttacttagttgtctcggaaccatctaatgatctgattcagtgagcaagagtgtggaattgtgagcccgacatgcttacacatcagtctttctgctgttccagagttactggagcgtgcacctggcatttgttgagtctctctttggatggtttgtgtggcactatcagaaacggaactttcaaaaactgataattttggaagataaataattatggaatactcttgcctcagatactttaatattattgagaaaaattacaacaccaggctcagctatttttaaaaaaaatttttggccaggtacagtgcctcatgcctataatcccagcactttgggaggccaaggcgggtggatcacctgaggtcgggagtttgagaccagcctaaccaacatggagaaaccctgtctctactaaaaatacaaaattagctgggtgtggtggcacatgcctgtaatcccagagacttgggcggctgaggcatgaagatcacttgaacccggaaggcagaggttgtggtgagctgagatggtgccattgcactccagcctgcgcaacaagagagaaactacatctcaaaaaaaaaaaaaaaaaaaaattgtagagatagggggtcttgctctgttgccttagctggtcttgaacccctgggctcaagcagtcctctcatcttggcttcccaaagtgctggggttacaggtgtgagccactgtgtccagccaaaatttatttttaatagataatggttaggacagtgaaatttttagtcggctatcattgcaaatgactgtttgccatatgaaacctgtgcttttgaaatgagggtttttattctcataatcggtcaaaacaattgacagagaaagaaagaaagaaaaaagtgtttgtgaaaagattctaaataaagagtgcattgaatgagagccattttgttggaagaaatccaggatcttttgatgtgactactggaagaacaagaccacatgaaggtttatcttttgatacttaattaactaagaatcaggtatttctcagtctctcatctacagctctcctctacacactcacactagcccctgcatgttcttttttgttggggggaactatggcgacaactaaaggctgaaagagttcaggagacaaagaggaactcttagcgaggttgatggggacctgcattttaaagggtgaatgcatgttctccagctggccatatcttaaaggctgagcacatattctataggtgcacatagacgagaaggaaattccaaccatagggatcgttccgcgcaaacacagcaagtgcaagacctcagagagtgccaagaacacccaagtactgtggaaaggggctggaggaagatgcctcccaagagagccagcacaggcccttggacaatgaaaaactcttggaggctttttaagcaggggaagatgatctgatttccattttgtgaagaaccttggaaaggtggatgaaagcagtgtttctaatatctgcctgaattgataagtcaagtcacctaatgtacttgtgtatgtagacatatgtacttatatatgtatatgcaatttcccagtcctcttctctgggattatgtgtatggaatttgtcacatccatttgcgcatgtatttcccgggcacctactgtgttgtctactctgccccaggtgtgggaattaggcagtggccatggccagtaattctgatcctcatccatcttatgtgctgttgggagagaggcagatattaataagcaaacatctaaataaacaagatagtttccggcagtgacaagtgcaaagaagaaaataaagtactgtgtaagttcgttaagcaaaggggtctcattcgattcaagcttatatcccacccaaatatctagcaccatgtctggaaaataatgatagctgtgcccatggattgtagactgtgtgccagtcattgtcaccggccctgtacatataatacagtctctcttcaaaaccactctacaaagcagggattcttacccagggtcaattttacttttagtggacatttggcaatgtctgtcttgagacaattttcattggcacaactggaagaggttagggagtgctgctgacatctagtggatataggtcaaggatatagtcagacatcctgcaaggcatggggtaggatgcagagcaaagaatgaaccggtcccaatatcaatactgttgagtcttactggccaggcacggtggctcacacttgtaatcccagcactttggaaggccaagacaggcggatcacctgaggtcaggagttcgagaccagcctggccaacatgatgaaaccccgtctctactaaaaatacaaaaattagctgggcgtggtggcatgtgtctgtaatcccagctactagggaggctgaggcaggagaatcgcttgaaccagggagtcggaggttgcagtgagccaagaccatgctattcactctagcctgggtgacaagaaagaaactctgtcacaaaaaaaaaaaaaaaaaaaaaaaatagcgttcaggttgagaaatcctacagtgtaacagggtactagtgttaccccattttcaaaagcacaaaagatgcaggtgacttaagtgataagcccaagctcatacagctaggaagaagatgatgcgtttaaaactggagagtctgggccgggcgtggtggctcacacctgtaatcacagcagggagagatttgggaggtcgaggagggcggatcacgaggttaggagtatgagaccagcctggccaatatgatgaaatgccatctctactaaaaatacaaaaattagctgggcgtggtggcaggcacctgcagtcccagctactgtggaggctgagacagaagaatcgcttgaatccgggagatggaggttgcagtgagctgagataacaccactgcactctagcctgggcaacaaagcaatactgtgcctcaaacaaaaaacaaaacaaacagaacaaaacaggagagtctgtgtgcagagctccaatatgtaacccccacaacctcaggatatctgtgagatacacaaatgcagacgcaaatgactgttctgacagctaacgtagggacttcgaagtctctatcggtgtgaaaaataagaaacattttctgcagatgggtgccaggtaagatgggttcactttgaggaccttggtttaatcaggatatcaaaatttgttgtttccttgtgcttgtcacaatatcccattgttaacacctgccagcgttgtcatcctaaactgttgctgctgtttctgagatgagctacaacaggtgtgccaaatattgggccattagcaagcggtaattcacctgcatgaatatttatcgtcttgtaaggaggaaacaaaagccgtgtctactttttggaacatggtgcagcagtgtcctcgaaaccaaattgtttgagtctctcgcttatgcggaaggagaagggctcctctgtaattttccatcgggtggatttattttctcagccatctccacatcaaaacacaacactgacaggcgcttgattttattaagccggtaaaatcacccgacagtttagatagctcaagcctctgattatcaaaatatctattcttaaactggttttgaagccagtcgcttctccatggggaaatggccacaatgatgagcaggacaaatttttgcttttctcccctctaattccttccctccctgcctcctccttctccttgtcttgttctttttttcgttccatttttctttttttactgaaagagattgtattaatgaggaaagaggagaaaactcagaaacagataagaaagagtggcaccgaggcttcttgtacaagggtgattgtaaattttatgtcctcagtaagaaccccaaggcgtgtgtgcttttaaacaaaaagaaagtctaagggagaatatgccatttccacgcccatgttactgctgcattcgcacctgtcagcactgcggcctgtacctccttgtccagcaataccatactaataacataccttacaggatacacggatacatcaaacaggttgcagtgctggtaatcactgacttagaaaccaaatgtgctgtcctgaatttttaagtattgccatgactaaggaagtaatgatggattcccaataagtgtgtttgccatttgtgtttggatatcatcactaacagtaactttctgtgcatattttatggtgatcacttatgggatcattccttaccttaaatttgtgcagatcattcctctttctttctttttatttttttgagacagagtctctctctgtcacccaggctaaagtacaatggtgcagtcttggctcactgcatcctctgcctcccgggttcaagcgattctcctgcctcagcctcccaagtagctgagattacaggtgtgcgccaccatgcccagtaaacttttgtatttttagtagagatggggtttcaccatgttggccaggctggtctcgaactcctaacctcatgatccacccaccttggctgtggaaagtgctgggattacaggcgtgagccaccatgcccggctgaattttcacctttctttccctttccatcggccctctctactgattctatgtttatacttgatcaaataagagtttcagttagtcaaatataaatgtgtttactttttttttttttttttttgagactggagtgcagtggcactgtgttggctcactgcaatctctgtctcctgagttcaagcaattctcctgcctcagcctcccgaatagctgggattacaggcgcccaccaccatgcctggctagtttttatatatgtagtagagacggggtttcaccatgttgtccaggctggtcttgaactcctgacctcaggtgatccacctacctcagcctctcaaagtgctgggattacaggtgtgagccaccatgtctggccttaaactcctttctttttaaaaaaaaaaaaaattaagttcaagggtataagtgcaggtttgttgcataagtaagcttgtgtcataggtttttttttttttacagattatttcatcacccagatattaatcctagtatccgttagttatttttcctgatttacacatgtaaatcattaacctaaagaaagcaaaagacagaactttcttctgagaaaggatgtatgttttcccttttggaaagttgtattaataacatctaatccttggggagtgctcagaaattattttctgaaagaatgaatgaatgaatgatcaagatcaaataagagacacaggccaagccttcaaacaagttatactgaacccagagggttccctcaggctccttactgccatgactaagtacgaatggtaagtaacatttgctaaggacttactggggagtgtcatggtttatgccatttaacctcatgagggaggcacttatatttcccctattttaccgaagggtagctgaggcttggagagaccatatggcatgcccattttagccagtgagtggccgggtctggaaataaatctaggaggtgtgtcctttaaccactttgtagaaccattctcattatagtaatggagaaagaacagaatctcttatggtgacttctaggactaagggcacataataagagctgctatttggggaatatgtctataaacctgggagttataaagtagggtgagaaatgggggtgcattatgatgttatctgagagggacttggaattcacatcatctacaattttggacagatgtctttctgcaagccttattttttttttttttttttttttttgacagagtctggctcagtcacccaggctggagtgcagtggtgcaattataggtcattgcagcctctaactcctgggttcaagtgatcctcctacatcagccttctaagtagctgggctacaggtgcatgccaccacacctggctaatttaagaagtaaaatttttatagagatgggatcacactatattgcccaggctggtcttgaactcctggtccttaatcagtccccctgccttggcctcccaatatgctgggattacaggcatgagccaccacgtctggcccttcatgcaagtttgatatgcttttccttcactggggctttctccctgagtattacctgaaagtcagaaaggtcctatgtggaagaaccgttgtattgcaattactggggagcagaaggaaagtgattttggaaaaagcgtatgtatgggcttggaaacttttccccagaacagagaccatttgcagacttttcactgtggccgtttctcccagtcttgatagcctttcacacatctccagggttatctttgcagtgactcagtcattattctacaggccagcatgatttttcttaaattttctaaacctttttccaaaccttcaattttataaaatgtgacacacattttgacttcttttataagacctaattcgaatgccccctcctttttgaagcactccatgatttttttctactgtccaggtatatgctgtggtatcgtattgcagagtcattactctttgcctgactggcctggaattgcctgttgacatacagtttccctgctggaatgtgtgagctctctaaaaagtgtggagtgtatggcttggtttgttcattcttgattcatcactcacgtgtgtctctaagtagcagctgctcaataaacattgaagggaggcagagacaagacagtgctaagaaaggaatgaagacaataagcaaaagttaattcaagtacatttctaccaaatttccggaaccagattcctaagcagtggaggcagaggagaatgaaaaggtagagtgggccccgtgccaatttcatttcagaaaacattcagagagatgcttccctgcgtggtgtggttgcagagggcccacctgtacatctgggatacctacaggcatcccaccattcccgttcttcatagactatatgacacatcccagtcgtgttctatcttttacacgcagcacacacaccgcaatttttgccttgctgagcttttaaaactcttattatctcagattatgaagacaagctgtgcggggtataggcatgatctcaaactgagttaattgaaggtggaggtcagttcagctttcctggaccatcaatcagtaaaaagtttacttgtttaatgcacggagagtcaaagacatgctgcaggcccccccatcccttcccttctggcctgtcaggtagatgttagatttcactgagctgttaaaaatcttaatggatcccactgagctgtttcaggttgtttgtgacaatcacttaatttccttgttttgcagctaacaatgattttaatcttcatttcagattaaccacataaagcctcagtgtccttttctcccgttgtcttgcctgcttcaactctgcagtcgatgaaagggagaactctttccctttctcttcagcagagcctgaaaaaaatgtaccttcagcaaaattatagatgcagtaatttctcatatatgttaaaaatgcacagtagcaaagactggaaatccagcaaagtagtagtagcaattgcctccaggtggttagagtgtggggagattttttttccctacctctttcattttttatttttttacactttcaacattttctgtgatgcactttataatttttacaataagaaaatgtaaattaaagaattggtgtttctgaatcaaggatgaacaaagaaaatgtagtcttttgaagagatgttaagccagatatttttctactttaaagggtggagaaaaaccacatcgggataaaagagtgaggctgcagaattagcttgcaacttgaaggatgggccctattacagataatgctgctgacagcctcagttcatcacgtttctcatttttagtgtattggtgtttgctcatatgaaagttcccagcttgtgctactaattatttcatcaccattcacttgtacaattgacagcctttgaaccaatatcagtgcagagaccagagaaacgattctgagagagatgattcaagaggcaaagattggggaaatgaagaagacttatttggcactctctgagtgctttatgtgtgggatgagggtgacatagtgcaaggagtaaatagtgttgtcattttaaaaggctagacctgcatcaaagggcacttactgtaagcctgaaagtgggtggactgaagggctctttcttccaatggccccttgttgcagcgtgaacatctcccatctttatattgtgatggcactattcctcaatggctaattgctaggcaatagaagacataatttagactccaatttgtaagtcaatcacatgaaggctggatgtgagcaagcttggagataaatgaaccgtggtgtaaacaagagaggcccagaggcttcttgatccaatttcaggaatcccaggctaccctgatgcgttggttgagattacatcctctccttcgggaggggacagagggcagcccgcatctctgctcttccatctggagccgctctctatgggagaaggagtcttgagccctttgttggctgttgatttgatttttaaaaggaaaatctgacaaatcatgttgaatgagaaaagcgtattatgtgaacgtaaaaacgtttgcacatctgaggaccacgcgattttattcaaggaagttctacctttaaggaggttatgaattctgaatcagaattttgtcgtcaggggaatgcttcttagaaggaaggaaatgtactttttaacaagattttcagcaaacgttgacacattcattatggccatgagcatggaggtggctcaaatatattttgcataatgtggaaataatattgcattctatttgttcctgcctcctagcgtcaccacgaatgacactggcacagaagaaaacatgggtgctttagatcacacacacaaaaaatgatcgggataaatttaacacactaatcatcgtgaaggggcttctccatgtatcttttcaatacgcaggtttatctcaaccttggcccagctctgtgcagttttataccataaacccagtcagactccgtcttatgctaaaagacctcccccctcctcagtcacaaatcccatcaaatagactgtggtcccatttcctggtcctgttcctcctgtttagggaccagaccttttttttttttttttttttgtggagtctcactccgttgcccaccctggagtgcagtggtgctatctcggctcactgcaacctctgcctccaggattcaggcaattctcctgcctcagcctcccgagtaggtgggattacaggtaagtaccaccacgcctggctaatttttgtattttgttagtagagatggagttttcccattttggcctggctggtctcaaactcctgaccttacgtaatctgccaccttggcctcccaaaatgttgacattacaagtgtgagccaccacgcccgaccacctctccttttttttttttttaactcaactttctttagattcaggggtacatgtaggtgcaggtttgttacatgggtgtactgtgtgatactgaggttcggggtgtggatgatcccatcacccaggtagtgagtgtagtacccaataggtagttcttcagcccatgccctcctccctgtctttcccctccagtggcccccttgtctattgttcccatcttatgcccatgtattagttcacttgtattagtccattctcacactgctataaagaaatgcctgagactgggtaatttttaaagaagagaggtccatggttctgcaggctgtacaggaagcataatggattctgctcctggggatgcctcaggaagcttccaatcatggcagaagacaaaggcggagtaaggtgactcacatggcaggagcaggagcaaaagagaacaagaggggcggcgctgaacgcttttaaacaaccggatctcaggggaactctttcactagcacaaaaatagcaccaaggggatggtgccaaatcattcctgataaatccaccgctgtgagccaaccacctcccaccaggccccacctccaacattggagaccacaatttgacatgagatttggcaaggacagagatccaaaccatgtcaaatgcttagctcctacttacaggtgagaatatgcagtattcagttttctgttcctaggttaattcacttagattaatggcctccagctgcatccacattgctgcaaaggaaatgattttcttttttatggctgcatagtattccatgctgtatatgtactacattttctttatccaggccaccgctgatgggcagctaggttgattccatgtattcacaattgtgaacagtgcagaactctcctttcatcattgtttttcctcccaggttgctgctgttcacttctctgtccagtctgtcaacacccaactttctctgataacaatacagtgtttgttgtatctgaccaacattttgttcggccttccgcaagctgcagagaaactttttgagagtttgataataaatcttgccatgatccctgtaggaggcacgtcttcctgaccaggcgtggtggctcaggcctgtaatcccagcgctttgggaggccgaggcaggcagatcacctgaggtcaggagtttgggaccagcctgggcaacatggtgagaccccgtctctactaaaaatacaaaaattaaccaggtttgatggtgcatgtctgtaatcccagctagttggaaggctgaggtgagagaattgctcgaacctgggaggtgaaaattgcagtgagccaagattgtgccagtgcactccagcctggctgggtgacagactgagactctgtctcaaaataaaaaataaaaaaaaggaagtatgtcaagtatgtcttcctacacaggggagcagagaaagaccaagagcaagacacagtggaggagcagcactgatggagagacatgccccagaggacgtggggaggtgtaggaatcccagccgccagatgagagttcagctacgacgcagcactgcaggcccaggaaggccatggtccagagggaatcagaacagaagagaaatgaggagcccagataagagatccaccctgaatcctagtaacacacagagggcggggagctccggtcttgaggctaggaaacagtcttgcatttgggcaagttgtccttgtatgaagtgccagttgtgtccaggcgtggtggctcacgcctgtaatctcagcgctttgggaggccgaggcaggtggatcactaggtcaggagttcgagaccagcctggccaacatggtgaaaacccatctctactaaaaataacaaaaatcagccagatatgttggcatgtgcctataatcccagctactcgggaggctgaggcaggagaatcacttgaacccaggaggcagaggttgcagtgagctaagattgcaccactgcactgcagcctgggtgacagagcgagacttgtttcaaaacgaaacaaaacaaatgaacaaacaaacaacaacaacaacagaagtgttgcctgcattaaggaggcagtctaagctgtctggcaacttggaggacaagtatcaaagataaattgagattatgtctcattccactgggtgcttccattataatattgcagtggttatcaataggcagtaatcccgtgtcccctggaggacatctaaccatgtatggaaacatttctaaacattaaaagtgaaggaaaggggctccaggaatgctactgctcagcatctttcaggacagccctcactttaaagaattatccaacttcacttgttaatagtgctgaggttgagaaaccctagtacatcttaagagcactgtgtgtgtgtgtgcgtgtgtgtgaacgtggggagataattataactttgtaaagatggatctacaaggatgttcactgcagcattgtttacagggctaaaagcataagcaacctcaatgttcaactatagggatgtggaaagacatgtaataattcctcttctaagatgaaatgacgttgcaaccatggtaaataatgccttaggttaaggttcaatgggatggaagagtgttcctgagatgctattaaatggaaacaaacaagttatacaacactatttgcactatgttttactttcgttttgaaaaggctatctatagatatttgtatttattgcatctaagtcgacataccaaacagaatacaggaaaaaatactctacaatattattattacttggatattgaagatgtggatgaactaaatattttcactatgtgttgtttaatatctttgcagatttccacaaataatttatttgactttaataataaggatgaaacaactttataccttttagtaatattatttttcaaagcatggagctgaaatctgagtagatagaggaaccaggattttctgtcctgggttgattttttagccagaatctacttccatatgcagacaggaaggagagtatggtcaacaggtatgaagtttggggagggtaacattgggctctcactttaagcattgatagctaagctgaaggaggaatactctaaaatcattgtcttctcatttaaatgctcttgatcaaattaacagcctctcctgaatattccaattatattaaaaatggcagtagtgttcaatttgccttctgcacaccccctacccaacctctcaccatttctgtgggcttgggattaggcggtgctgtgttgtgtataagggtcagtcttatagggcaggagcctgggctaatagaaagactgtgacttcatgttcctaccaaagaaaaacaagtttatctactgtatgtggtttatcactattttttttttgtgaagaaaattgtttgttttgaaaacagtttgatggactttgtaggcatttctgtggggaagatttgtattgcctggtttattctgtggatctaattcatacacacacacacacgaacgttttgatagagtttgcagagtttgcttctgtttcagaaggtttaaaatttcttttattcagggagaaagagtttaatcaccattactctttttacctttttatggagggaaaatttacatagcataatgtcaatcattgtcaagtgtacaattccgtggtatttagtacattagcttcccaaaaagaatcccatgcctattaagcaacccctccccatttacccctcccccagcccctggctaccactaggtacacctcatctatttaatgttactgaattgtagaatcttgttggcattttactttctattgtagctagctgtttctctgtctctctgtctcattttctccctctctctctctctctctctccctctcattgtctctctcttattctctctctctctgtctctctttctgtctttccctccctccatccctcctcccttccttccttcgttctgtccctctttccctctccctgtctatgcaatagacaaacatagaaaggcaggttcaaaaacagatggggagatgaagagaaagagagaagggtgaagaagggagagagagaagggagaagggagagacagaagagagagaaaatgaaagtaagagaaaaagagggagggagaaggaaagtgtccaggaaagagagagaaaagaatgcagaggacaagaggaggggaaagagataatctaggagtcggagaaaggcagggtaggttttgaaagaaaggactaaaataggcctggtgtggtgatgcacacctgtcgtcccagctacctgggaggccgaggtgggaggatctcttgagcccaggaggccgaggctgcagtgagccatgattgtcccagtgcactccagcctgggcaacagaacgacaccttgtctcaaaaatcaaaacaaacctactccttctcacaggcacacctcagaaagaccggcagagaggcccctatacccccattgagacagaagcaatttgaaagaactgttctgaaatttcaaaagtgtctcatcatccagagaatgaaaaaaggaaagtaggttagacctgtcttgacctctgcaaattcctgccacatgtctcctgggttctgcccatagcaggctctagctctcagtggtgtaaacttcttgagcatttgggggtcacgctgtcatccctggagtcctttcgttaatgtcctgaaaccaactctccatcagtgttttgccttttcagtattctatctcgctgtataattgagtttctgtgattccaatgcagactatggcatgaactcctgtgtgtctagttattatagattagccctgctgatattatgaggtagggaagggttgatatgctgtagagtgacacagaaacccgataacaatgggaaaagagagtttcatataaatcttcttaagtatagtatttccatattaaatgttataaagtgaaggtctggctgcattgataatgtgccctctgctgatggaatgtgcttctgccctcttggcaggcttcctgtggatcctaggtgataaaagccgtccagagtatttcttcattatcatcgtcatcttatgtttacattattctccttgtcactgagaactccagaccccagtctataggaaacggttcccacattgttgaaatatggctggtggtacagggagtagttctgaacgctgagcatggcctcatttggaatattttatgcaatgaaagtgccggtgagaatttagacagcaaagcttaccagtatgaagcagaaaaaggcaaaataaagaggcgtatgtatggacattgcattcatgcatttgtgcccaatggtgttgaattctccttacaccttaatgaaagagtaaaaatgttgaggaggacgtggagctgccaagtaaggtggattattttttgcaaacaattgtattaccattatgatataatgtattactagtatgatataattctatctgccatgatgtgatatgatttataatgatttaaacagttgtattatcagtgtgatacaatggtaggatgatactataaagagatagtgatttcagagtattgcacaacctctgaagccatttggcctgagttcatgctcttggttcacccgttaccaggtgtgtgactgggagcaaatcacaccctggtcctcagttttctcatctgtaaaatggaataataaggataatttatagtattgctgtgagggctcaggagttaatgcatgaaagcacttagaaatgtgtttgatgagaggccgggcacggtggctcatgcctgtaatcccagcactttgggaggccgaggcaggcaaatcacttgagcctgggagttcaagatcaacctgggcaacatagtgagaccccatccctacaacaaatacaaaaacacttagccaagtgtgctggtgtatgcctgtagttccagctacttggaaggctgaggtgggaggatcacttgagcctgggaggcagaggttgcagtgagctgagattataccactgcactccagcctggacaacagagggagaccttgtctcaaaaaaaaaaaaaaaaaaaaaaaagtgctcgatgcctagttagcattccatacattgactattaccattttcattattattaagttcatgtactgaaaccttcaataaaagcagtatttactgggtggaatacaaaactaatgtatgtgtatgtagtttatttatattgtaattttttattctgtataatagaggcatattctgttattaaggaagtaacttgtgctttctgtgccttgattttctcatctgtaaaatggaagtaattctgttactttatagggttgttatggtgattctaggaattaatgtatgtaaagtacttaacacacactggataataagcttgctgtcatcatcaccatcattgctgttactattatctaaaagcagctcacgtcctgaaatctacagtgagaagaatattcactgggctacgtaaacaaaatatacatgctcatctatatagttctttgatataatcatttttattctatataatacaagaagttcaatttttgagtcaaaatggcaatgggaagtctaaattaattcaacacacaaacgaggctgtgattgtttgttttactagagatttattagctttatcaaagtatcgtgtaggaagtagtaaagcgtattcttagatcacagcgcatttgagatgtggttgggtttatggacctgcggcgtgcacagacttgtctgggaggtgcacattcggtgacatgcacctgctctgtgctgtttcctggaagaggagaaggtgcgcccctcccactgattaggcaggcatccttgtgtgggggattaaggagcatattcagttattagctgtgaaatgtcgtggctgcctctgcattgccagctgtgattggtgctggattttaattatcatcaagcaagttccaaatgtttgaaatgtgtctgtggagagagctttggtggagagtgggagaaaaggtcttgatgaaggagcaaaaccttggcatcagccgtgcacacggccctgggatctttgccagctccccaccactgctgctgcagggtttcttgttgaccctaggggctagccccttccattatagaataacaacagttgtcagaaagccatttctcatatttacccaacattcacttttctatagatcctaaaggccctggtattttctcaggtgcaatgcagatgattcttcattcattcatccatgtgcacctctttgtctgtttgttccttgttcaataaatattatgtcaatgcctgctgatatggtttggctgtgtccccacccaaatctcattttgaaatgtaataatccccatgtgtcaagggtggggccaggtggagataattgaatcatgggggcagtttccgccctactcttctcatgggagtgaataagtctcatgagatctgatggttttataaatgggaattctcctgcacaagctctcttgcctgctgccatgtaagatgtgtcttgctttcccctttgtctttcgtcatgaatgtgaactgtgagccaattgcacctctttcctgcccagcgtggtggctcatacctgtaatcccagcactttgggaggccgaggtgggtgaatcacctgaggtcaggagttcaagtccagtctgaccaacatagtgaaaccccctctctactaaaaatacaaaattagccaggtatggtgacacatgcctgtaatcccagctacttgggaggctggggcaggagaattacttgaacccaggtggtggaggttgtagtgagcctagatcacgtcactgcattccagcctgggcaacaagagcgaaactccatctcaagaagaaaaaaaaaaaacagaaaaacaaacagaaaaagtctttcctttataataattacccagtcccaggtatgtctttattagcggcatgagaacagactaatacacctactgtgtgctggctgaggttctcaacgttgtgctgggcaccagggaatataaaacagtaagactcagtctctcctcttgaggagctcagaatggatgtggccggggaatgacaaaatgctatgatgtacaaatgtgaacaattagaatttgtacaaagaaaggaagtttggattaatgctgtcagagtgcaagagcttggggattcttcatggaaaagatgatgccagagaagagctttgaagaaggaaaagggtgttttctaggcaaactcaagtggagttgaattaggagagaagtgcgaagacatgacggatggatggaatgacacaggccaaagaatggagttaggaacgatgtgctgtgcttgggagctgcaagttctgctgacgggtggagagtaaggccaggtgtgagaggaaacaagccagatgggggagcgggatggtcacataggctttgaatgctgtgatgggaagtttagactttacctggcaagaggtagacaaccaccaaatgcttggcaacaaggttctatttgcattttagaaaggccactctggctgcagtgtggatgataagtcagtggatacaagattaaaggcagggagactagtcaagaagttactgtggtcaggaacagtagctcatgcctgtcaccccagcactttgggaggctgagataggagggtttattgaggccaggagttcgagaccggcatgggcaacatagtgagtcctcatctccagaaaaaaaaaaaaaaaaaaaaattagccaggtgtgttgctgtgcacctgtagtcccagctacttgggaggctgaggagggaggattgcctgagcccaggagtttgaggatgcagtgagccaggattgtgccattgcactgcagtctgggtgacagagcaagatcctatctcaaaaaataaaattaaaaagatgctactgcaatggtctaggtggggaaaggcaggtgattgcactaagttaggggtaatgggtttaggagaagcaggtggtttgaataaagttaggagggagaatagaggatcctatggctgtggatgtggtgcaaagagtcaagaaggatacctgcttctagcataggtgaggcaggtggatggcaacagaggaaatatggaaagaaaagtctttccacaagccctggaagagggagggaaaaggagcgttttggtggcatgcagtgacggtccagcccactacctaagcccaggaagcgtcacgtggtacttctcaacaggcagaccaggtatctgagtaaatgtctgctcagttggcaggtgtcagagaaatctacaagcagataaaacaggggctccgagggtgtaaatggtgggatttgaaggaaggtgagtacaaagatgatgctgggggtaagtgtgagatgtgaatggcatgaggtcttggcaggtattacaaggacttgggcacttagtctgaatatgatgggaagccagccatcacaggattttgaacttccaatggggtgctcctgtagtcctggctactttaccagctttgtgacttggagcaaatcattcttggtgactcagttttctcatctgtaaaatggggctaacactggtcatttacagagttattgtgatgatttaaggagtttatttatgaacatgtccagaaatatgcttgcttgcttgctttctttctttctttctttctttctttctttctttctttctttctttctttctttctttctttctttttcttttttgaaatagagacagggtcatattctatcaccaaggctgtagtgccactgcacgactatagcttattgtagcctctaactcctgagttcaacggaacctcctgccacagcctcccaagaagatgagactataggtgcataccatcaggccttacctatttttgctttttaaattttttgtaaagatgggggtctgactagttttctaggctggtcttgaattcctgactttaagcagtcctcccacctgggcttcccaaagtgctaggattatacgtatgagccacgttgctcaccctgaaagtgctcagaaacatgcttcaggcataggtagtatttaacaaatttgctattatcgtttacattattttacctgaagcttgtatctcaaaatcttcaataagaataatatttaatgaggccgggcacagtggctcatgcctgtaataccagcactttgggagggcaaggcgggcggatcacctgaggtcaggagttcaagaccagcctggccaacagggtgtaacctcatctttactaaaaatacaaaaaaaaaaaaaaatgagcggggtgtggtggcggatacctgtaatcccagcttctggggaggctgaggcacaagaattgcctgaacccaggaggcggaggttgcagtgagccgagatcgcagcactgcattccaggctgagtaacagattgagaccctgtctcaagaaaaataataataggctgggtgcaatggcttatgtctgtaatcccagcactttagaaggcaaaggtgggcaggtcacgaggtcgggagttcgagaccagtctgactgatgtggtgaaaccccatctctaataaaaatacaaaacttagctgggcgtggtggtgcatgcctgtaatcccagctactgaggaggctgaggcaggagaattgcttgaatctgggaggtggatgttgcactgagccgagattgcaccactgcactccagcctgggctacagagtgagactccatctcaataataaaaataatgataacaataacaatatttaatgaaataatcatgctgtcttacttgtgagatgccatccttcgggctgttgatttgggaacagagagaaagtcaggggagaaagtcaggagctcagatggaagccattgcagcagttcaggtgggagttgatgctgccttggccccacatggggctatggatacagtgaaaagcagtcaggtgttgtgtaggtatagctgatgggagtttttggcatagcaaatgagaagtcatagagaaagacaagagtcagaaatgagaagcagagaaggtttgcttcatttcagcattatgttctgttggatgagcaacttttaaaaatggagccactatttcagttatcacttccaccagacactgtagagcctctgtcttgaagcccctgacctgcccctgggtgtagcccatcacctttctcatgggactcagacatgaatgcaagtgtggggccagaggccagcctaggagtgagatagactcgctattctcagaatttcccattcctctgtatttcatagtttctcattggtgctgtaacaaattaccacaaattcagtggcttaaagcaagaaccttatgaacgtattatcctcgggttctagagatcagatgtctggaaagagttttagggggataaaatccaggtgttagcagggctcagtttcttccggaggctccagggaagaatctgttttcttgctttttcctgtttctggggactgccactttccttggctcatggtcccttcctccacccttcaaagcacatcactccaacctctgctccatcatcacacctccttttcctctagctccaacctcttttcatttttcttttttttttttttttttgagatgggggtctcactctgtttcccatactggaatatagtggcaccatctctgctcaccgtaacctccacctcccgggttcaagcaatttccatgcctcatcctcccaagtagctgggattacaggcatgcaccaccaaacctggctaatttatgtatttttcatagagatggggcttcaccatgttggtcaggctggtcttgaactcctgacctcaggttatccacccactttggcctccgaaaatcttgaggttacgggtgtgagccaccgtgcctggtcacttctaagggcacttgtgataacataagacacacctgggttatccggaataatctccccagctcaatatccctaattacataacatctgcaaagtccatttggctatgtaaggtaacacattcagaggttctggagatgaggacatggacgtctttgagaaaggccttattcctcctacatctccaatggccaaggcttccttactggcatgggttccttccccagcttcctcttctcgatggccatgaaggctcctcagccttcctgcaaataggcccatcccacagtttttcccccgtgcctgactctcccttagtcttgagctgaaagccctcatttgtgaactgtgtattcatttaactcgattagctcatgtatgtaatgcacgtcgcatagtgcctggcacataggaagcaacttctaaaatagaattcagtctataaatataattttgaatcatggttctgtcactctgcttccaagctgactatgggtctgcaccatctgtaaatatgataaacacatcttctcaggtcatcctttccatcattgataaaaatgtccaactagacagagaactctgacattgctaacagcctataatctgtttataagtattttatatattttttagagaatgaccacctgcatttccaatgtattcttctcttccaatgatttgtacctcatgatccttcatttggcatttactgagttattactatgtgctaggcaccccaggaggttaaatgataaatgacaaacatgaggccagcttccaaggagcttgtgaatcatgctggaagatatgtacatatacgtgcacagctgttccatttattaacattctttggataaattgatggatcagccctgagtctaagctccagcccacattcctcattaattccattaatactgcaatacactcaatctatagcattagtcagtcgaagtgtctaggacctcaaaggaatggaagaggatttgcttgccatcactttttcgtagtgaacgcatgttaccactgaaggatcacctttactcattcagagtggtttcaaggcaccaattagcaaactgttgtgtaacagatgttttgtgtcattgctagcactcattttgttattgttgttattgttgttgttttttgttttgtttttgtttttgagacagtgtctcattctgtcgcccaggctggagggcagtagtgtgatctcggctcactgcagcctctgcctcccgcattaaagtgattctcctgcctcagcctcccgagtagctgggactataggcatgccatcacacccagctaatttttgtatttctttttcattagaggtggggtttccccatgttggccaggctcgccttgaactccttaccttcggtgatccacttgccttgtcctctgaaagttctgggattacaggtgtgagccaccatgcctggccagtattcgttttatatagcatctacccccagcaagatttatagacactggggcatttacccatttccaagtggtttgccttctcttcagttacctataatcactgcatctaattctgaaatcataatgtttgcaagattttatggcacctgggacacaattgattggggtctagattgttcattttaatcaaagtaggagctggtgcctatgtggtagtcaaacagtagatggacttatctcacatgtgccattcatcaaattccaatgttccatacatttatgaatgatctgtgacacacaccatgacttctgttgcatcgttttcccaccacgaacttcacttagcatgtgatggtttttcattcttctctttgttgtttggaggtcattctcttggggcaaaagttaaaagtcaagttagaaatggttaaaatctgcattttcaacacattggagaaaaactctggctcctggaaacagaatgaggaaagcatgaaaatgtggtgaatactttaaaaaagaaatatgcattttctcttctggttaaaaagataaatgcagctcaatacagttaagtaaatgttatacctgctttaagggtgatattgaccatgggaatgcaagagctacccgaattaaaaatggctgttggaatggtaatgcagtatcttgaattaccagtgaaattacttttcctcctcttaatgccttttctctgttagtatattttataccaccaatagccataagcacataaatacctggaagattcagtcctgtcctgtgctaggctcttgctcagaaaacaggtatttaattcccttatacatgatacagaccaaattgcagttgttgtaaaacatgctgtgaacaattttgacagtatcctgcctggtttttcttcacttttttttttttttttttttgccttaaaaagttttatttcacatataggtccaagttgaaatattattttttctggggggaaaaattaccaccccaagcccagtttcttctcaacacttactgtctttataattaattaatttgttgatgatttttctgtcaataccccaatggactgtaagttacataaggaaagccatgataatttgtatccccaaaccaaacacagtttccgagatgtagtagtaactcagtgattatttgttggatgaatgaaaatagacacaaaatggtacacgtatattgaataaattagggttatggaaaaggtcacatttctttaggaagtttgtagaggtggtgacatttaagcaaactgataacatagggggatttattataaattttctctccagtcgatgggcatagacatacttcatcccttgcaggcccagaatccgagatgtctatttttgacttgctatatatagagagaagaaacagtccctctgaatgtgaagttactcagtatttttggctctttggctattttcaaggttcttcatctggacttaaaaaccaaattaataggcgatcgtttcctcccatcttttgcacagacactattttaggagaagaagatctatcacccacagcatgtcagtgaacgaaggggctgtttttactgttcaatcaggaatgagcgtccacagcatcgttgctcacatactccagtaattccctactgacctgcatttactttatttaattccattaatttaagctaaatgaattttatttttaaaatgtgtctgtgcagaactaagcacagagagcatatttctgtttaactccttttgtttgcagcttgaaaaccaatttggatcttttattttcttttcccttggttctaagctttgcttggtcagtgtcttcagcacctaatttgacaattaaatgtatttcacaacccactgacactgcttcattaggttctccaggagtcatcatttccctgcagcctcattccagtcatttctaatagatggtgtgtgtattagtccattgctacactgctatgaagaactacctgagactgtgtaatttataaagaaaagaggtttaattgactcagagtttcacaggctgtataggaggcatggctgggaggcctcaggaaacttacaatcatggtggaatggcgaaggggaagcaagcacatcttcacatggtggcaggagagagagtgaagagggaagttttacagacttttaaataaccagacctcgtgagaactcattcattatcaggagaacagcatgggggaaatctgcacccatcattcagtcacgtcccaccagctccctcctccaacattaagagttataattcaacatgtgatttgggtggggacacagagccaaaccatatcagcatgccaatgaggctcttctgatgggacaaggaaactgccaggctcctcttggtcttgactcttgtgccaggaaagagtagctggatttcatcccaatgccgttcaccctggggaatacctgggttaagagagtttgtatttctactgatgtctcatcaaagaccttgctatttatgctgtccatatcggtgtcttttgtaaaccgaagttggaaagaaatgtttaaaaagaccgtacaatgtaataattactaattacttgatagccagcacttaataaatgcctgacgctgtgctctgtgcctcacaggtattaactaaattgtatcctgagagaaacctgtgaaaggtgtactgttgtttctatgttaaagatgaggagagtgaggcttaaggagagtaagtaatctggccaggccacttacctaagaagtggtggagttggactcacacccaaatagtctgatctccaaactttgcttgaccacatcctgtagcctcttggtttcatggcatagggctggatgctgtgtgctttgctagtcaattttagtaaagactttagacattgtttggtagtggactgggatcctcaggagttaatcacttttactgtttttaagttaccccgggatttatcaaataaatcgaattacttacagttcttcctctagctataacttatttgaaccctctgagttggggttggcgttgtttggtcacagatgaggagggcaaagtcaagaggcagatgttcgggctttccatagacatttcctgagcctgtataagagcctcaccatgcatataagcaatgcagtggttactgagacatgcataatgctactaggacattatgcatgataagtgttttttctgtgtgtgctcaccactgtacctgagtattcttaacattgtgcatggtactttgttagttatctgcaatatcatatgtgctgaattttgcaactcataatatggacagttgatgatttagtgtatgacatcttccttttgcattgtcactgctagtggcttgaagttctgcacccttagaatagcctggttttctgtgggtgtgagagatgtcctggaaactgaccccagttgaaaatcaatctagcctgtttttgtaggacaactctgttgtgaaaacctatgcactcaagggcagctggatcccacttgagcatgccgatggccccttgcagtttgaagtttgtgttgtcatgaggtcagttgcatacaggcagtgatgatgagactacaggacaggcagggcagatagcacatccttcggcctctgatgaaagatgcaaatggaaactgcagtcaggaaggtataatcaaacaccatccacccatgttaatgcagattgtcaggacggccaacctctcctttccccaggagtgtcacaggcatgattaacgtgctctgagttcagcagaaaccactgtggctcttaccccgggctgtgccttagctcaggcctaggtgaaatgcctgggcaagtgatgggattgtcgaggaatgtggaacatcccctgcttcccttctgcccctttcctcatgcctcctgagctgccccagtcatccaacctgcagtttgggtacagggaagtgttgactggagttcagtgcaatatacccttcctgatttcttgacaaattgtttccccgaaccactattctctcctgtgtggctcagaactacttctagttgctaagcaacccacaagcagctgtagcccacaatatcttctagaggggtagacatattatttgggatacttctccagtctcatctttccctgggagatgtcccttcccaagctctggccttccacattacaaacacacctgaatgaaccaaggtgagcatccgacccagggatgcagctcagatgggatgcagaaagctgggccaatttgatatcctctttaaaatttcaatgaaaatgcaaaaacaatactcagaaggtcttaaactgaaatactgtgtagacttgggacttaggtggccattagtcttactctgtcacccaggctggagtgcctcagctcactgcaacttccttctcctgggttcaagcaatcctcctgcctcagcctcctgagtagctgggactacaggcatgcaccaccatgcctggctaatttttgtatttttagtagagacggggcttcaccatgttggccaggctggtcttgaactcttgacctcgtgattcgtccgcctcagcctcccaaagtgctgggattacaggcgtgagccttaggtggccatttctaaatatacatgtattgatgagtaagcagagaaaggtgtggtacatggcatgaaataggatattgaagagaaaataaagaagatggggcctgtgggatgggagaagatggagagagtagtactcatctatgtctgcaaggtagctgggcttaaccaagcttataatttgtccaggggaatctgggtacctgccaggaggtggtttctgttctggcctatggtatttaggctgagaaattaggaaagagactatatgacaagggtagtaaagactaaaaggattggccgggtgcagtggcacatgcctgtaatcccagcaatctgggaggctgaggcaggcggatcacgaggtcaaagagatcaagatcatcctggccaatacggtgaaaacctgtctttactaaaagtacaaaaattagctgggtgtggtactgggcatctgtagtcccaactacttgggaggctgaggcaggagaatcgcttgaacttgggaggcagaggtttcaatgagccgagatcgtgccagtgtgcctcagcctgggtgacagagcgagacaccatctggaaaaaaaaaaaaaaaaaaatcagtaataggatcaagagggtggtgatatcgaatgagtccagtcaagtgcaacagtgaacagtatggatgagctgggagaatagaaggcaatgctctaagaatggatgcttgatattcagagctggagagagggtctaggctgcgtctgtggagtgtatggctgaggtggagttggaagcaaacatgattggagtcagtgatgagaaagacaagggagaccaggatgttgagtgcaccgtccaagagtgatgaccagagtcatggcggacggagaggcagtgagcccagtgccgttgctctcattgaggaggatgagggaacatgccctggggggtggtgagtggatggcagctgtatgagggatggggctaataatgtctaatgccgctgatctcaagtgagccagggttctaagggaggcaggtgaagagagagttgtaagtatctctggggaacaaataggacccagacatcctaagggaacgagctctctcctgtgtacatagcttcccctaaagtcctctgctagattctttctctctgactgcttgtcagcttcgttttattttcttgtttttttgttttgttttgttttgttttttcttttttttgagacggagttttgctcttgttgcccaggctggagtgcagtggggcaatctcggcccactgcaacctctgcctccaggattcaagcaattctcctgcctcagcctcccaagtagttgggattacaggcgtgtgccaccgtgcccagctaatcttttgtaattttagtacagacggggtttcgccatgtcatctaggctgatcttgaactcctcacctcaggtgatccacccactttggcctctcaaagtgctcggattacaggtgtgagccacctcgtgcagtcagcttcattttctcttatttctgactgtctgtcttcacgtagccaggatatagcccatgttttacgtctcacagctttagcccttgaagagagatggactaaacactctctgtctcatcccaagtctggggaagacagtccttctctattgaattggatgcttatctctgactcaggcagcagtggtcagcgtggcgggagggtcttcctaatttgctattaggatgaattcctagcaagatattatggaatgacaattccacatgcctgtgagagtcactttctaaagattgctctgaggaattcataggctttgtttccaagcttttaattcttccaagcccttaactctcagtatctaacaaccttccctcacaggctgccgggtgatagaaagggtcattgacgtccagcccttcagcagccagtgagaatagcaggggacagagcttgacttagtggtagcttctcagaaaaattcctgggtgggactttggtgcttaaagggggacacatccactcgaatgtttgtctttctggttagaaataaacactgttggccgtgcacggtggctcacacctgtaatcccagcactttgggaggccaaggtgggtggatcacgaggtcaagagattgagaccatccagaccaacatggtgaaaatcctgtctctactgaaaatacaaaaattagctgggcatggtggcacgcgcctgtaatcccagctactcaggaggctgaggcaggagaatcgcttgagcctgggaagcggaggttgcagtgagctgagatcacaccactgcactccagcctgggagaaagcaagcctcagaaaataaaaaaaaaagaaaagaaaaaaaaagaaacagtgttcctctgctgtcttccttctcgtaaattaaaactgcctaacacaccttctcttcaggtatgcagaagtcgccagaaacaagtgttttgtgatatcagtctccctgtcttttctctttgtaattcccaacaattgaggctgtatttctaggaagtgctttgaaagacagcgtccccttctcttgtcctgccgtcattggtcaaaacattttggggaattgcaagggagtagtcagattcatcttttaacagaagaatatgaaaaccttggaatatgatatcagtttggtgcaaaaatgattgtgtgtttgccatgcgaaagtaaccgcaattacttttgcaccaacttaataaaaatgtatctttctgagtcccaccctgagacattctgatgtgaaagtgagtaccaggaatctgtacttggagccagggtctggaaattcagcaggacccactttggaaatattgctttaatactttattagaatggaacttggaaaacagttcccagcccccagttttccctgaacacctactgcctgtttttcacataggcctgggtgagctattgtatcccttccatgtatatgaaggaagcatattcctttccggctgaatcttggccatctcaaaggtgtgaagatttctttcctcccttgttttcctccctttcttcctgtaggattcctgcgtgctatctctcacgttcattctcttttccctactactacaagcaaagcaaacacaaagtaaactaaaatgccccttgttttataaaaatatttcttctgttgctcattttcccatcccccccatcctggccaagcatgccttgtttaggaggttttgcattgttttgatttctccttgtgaagcatttatccccagaaactctctagtacacaaggaccttcctgaaaatctctcaaggatgtgagcaggagccttaacaatacttgaaaatacccagtgtgctctgtaacttctctcccactggtaaacgatgtcctcacaagctcattgatgagagtctctaagatgtacttgttaccaaggatgcaattttaatcagtgatttataaaactgaaatgatagagaaaaatgctctttcatttactaagtcattctttaatttgttcatccagccatctttccatctgtccatctacccatctacccatctacccacaatctacctgccagcctacctatccatttacccatctctccatctagctatccattcatccatgcacccatccatccatccatccatccatccctccatccatgcactcattcaattaacatttattgaatccccatttatgttctacagtagagccaaaagtgatgatttgaacagtgttagtactcaggaaggccactgtcttggtgatagggatatataaatatatatgtgtatatgaacagatattgtataatgtagtggccctaagcacagagtcactgatattcacaaagcataatgtgaaatgaggaagttattcttgtcacgcactgcatcctcatcgattgctgtcctgttgtgaaccacggttgaagtcaggtgtgtttctttacttggttttgtcagtgtgcactgggcaggttgtaaataccacaagagcaggaacagtgtctgcttaattgaatatgctctccccaggacccggcacaatgcctggcacatggtggacgcccaagggctccaaaagccaatgttccaagcagaaggtttgacatggtttggctgtgaccccacccaaatctcatcttgaattgtaacttccacaattcctacgggtcatgggagggaacccgtgggagggaattgaatcatgggagtgggtctttctcatgctgttcttgtgataatgaataagtctcatgagatctgatggttttataaagagaagtttccctgcacaagctctctctctttgcctgctgccatccatgtaagacgtgacttattcctctttgccttctgccatgattgtgaggcctccccagccatgtggaactgtaagtccattaaaccttttttttttcctagtcttgggtatgtctttatcagcagggttaaaatggactaatacaaggcacaataagaagaaaaggccaaagaggccaaaatgcagagtctgtgtggctgaggagagaaagaaaggtatagggaggcaggggaggaaccaaaactgcttttgttagtgggtaaaatgcagagatgaccttctgaagggctggggcttggttctgtgtgagaacagggagtcacacacaggtttgaagcagaaaaatggaacggccaggttttcgttttctatgggttcctctgaaggctgagtggagaatggatttgagggagagtaaaactgatggaggggagggtggcagaagtcaggaagctgttttaagtattccaggcaggagatgatgagaccctgttgaggtggaaacagagaggagagatgtgtgggaggcattcatggcccaggcagaaggagagtaatgcagaatgacttctagatgttagacttgggatgatgggaggatgcaagtggatcagcagggaacatgagaataagagagaacagactgcagaaataataagtttagcctgagattttcttccttttttttatatatataattttttattatactttaagttgtagggtacatgtgctcaacgtgcaggtttgttacatatgtatacatgtgccatgaagattttcttttagagacttttgagaatatcacagggagacatctggtcaactattgcctttatgcatctaaagctcagagaaaaactctctcagttgaggttattgcgttgagatcaacaatgtggtgtggtttaactcatgattatagtcagttcctgcaaagagctggtatagaatgagacaagccaaggataaagtgggaaccagggaagcttattaaccttgcctctgaactccttttttttttttttttttttttgagatggagtttttttttgagatggagccttactctgttgccaggatggcatgcagtgggacaatctgggctcacagcaacctccaccccctgggttcaagcgattctcctgcctcagcctcccgagtagctgggactacaggcacacaccaccatgcccagttaatttttgtatttttagttgcgacagggtttcaccattttggccaggatggtctcgatttcctgacctcgtgatctgccctcctcagcctcccaaagtgctgggattactggcgtgagccactgcgcccggccatctctgaactctttaaaggtgaggctcatttgattcagcatccctgttaactatacacagagtaggtcctttcacttttttaaatttttttttattttttagggatagggtctctgtttgtcattcagactggagcgcactggcgtgattatagctcacttcagccttcaacttctgggctcaagcaatcctcccacctcaacctctcaagtagccaggaatacatgcacgtgccacctaatgtttaaattaatttaaaaactgattttaatttttaagcctagttaattttcaaattattcattagagccagggtcttgtcatgttgcccaggctggtctagaacttctgggcccaagcagtcctcctgcttagcttcccaaagtgctgggatgacaggcgtgagccaccacacctggccagtaggtgcttttaaaaatattattggtttctggagtattggtcaaaagttttaagattcccattgcatcttcaaaaggtagagaatttggtttaaatcacttcattgttttcggaaaaatatagattttaaacttaaaaaaatttctcatgtaagggacattcaagtaacatagaagggaccaggagtttggagtatgttatttatttactcaatatatatgtatcaatgccttctgtattcaagtgatgaatgtgggaccctagggggcagtgctggctaggaattatggccaatgacttaaacaattacttacagatccttggtttcttcatctgtaaaatgggaataagaacatctactttttaggattactattctaattaatttaagttaatatagattaaatagagttagttatatttactataaatgttattctaaatcattttatttatttagtgtctgcattataataagggctgaaagaaaaccaaagagagaggtgtcctgatgcaattatgattacattacctttgcttgtcagccacatagcgctctttttactgagacctaaaagtgtttggatttcccaaaccattgccaaactggtaggtgaggagcctctgtctagcatactaataagctaaggtttgtgttttgcctgtacttttcattttccaggaatgaaaaatacattttcactctttgtcattttaatgaaatcaagtctagggaaacatgaaacgcaagtcacattccttttcaacgggaaaacttcgaaaaccgcacaccagattgcgaactgttaaaattcattcattaaaagttcatggtctattggactttttttccttcaagcgttgcattatgtacatttcctatctgtgtttgtgtgacagattgtctaacagatttcttgtacagtggagttacagagtctgccagaaaggcctagtttggaacctgtggccatcggtgaaagggatttggaaatgccatcttgttagctaccggataatttagtaatcatggcctaacagatccctcaagaccaacaattacatacctgtttgaagctaattggactatacagaaatgggagttatatgaattatatgttataaaaatgaggtaggcgttaagtggactgatattacattctgaaacctagaatgactttcaatcattttagtgcacaggcttagagtagccaggatgcttggcggaggttgtctgtcatatcagagtgcctgtttttagaccgtgtgctaattctgtgtgtcgctatatgcatatgaatgcatactgtgtatctctacgtgcgcggacaaatcacatatttgtttacccttaaagtttgctgataacaagcgttaaaaattagaattcataatccagattttgaaagccgcctgtatgccacaccaaatgctgctgaagagttatgggaaggcttttatttttagcactcagtaaattaaaccttttattcatcattcccaaagaagagaacatccgttcttattaatttaaggaaggggaaagacagccgtccaatcggagtgaacctgtgtgttaggacttgttcaagggagtgacatcacacacgctgtcatccttacatcagttaattaattatctgtgttacaataacaagatatttcagacaagagtctctctctctctctcataataactttaagcatggtagttagagtgttgagttctggttgcaaagacatttcccttaattcaatgcattttctctgaataattcatgtttgttcgtttggtttttttataacatataactgatcagacatttttcttttttttcttttcttttctttctttttttttttttttttttttgagatggaatcctgctctgttgcccaggctggaatggagtggcgtgattttggctcactgcaatctccccctcctgggttcaagcaattctcctatcttagcctcccaagtagctgggattacaggtgtgtgccaccacacccagctaatttttttattttaatagaggcggggcttcaccatgttgaccaggctggtcttgaactcgtgaccttgtgatctgcccgccttggcctcccaaagtgctgggattacagacgtgagccactgcgcccaaccaggcatttttcaaccacagcagttttgacatttcgggctagatgaatttattttaggtatggacatttctgtgtatcacagaatgtttagcagcattcctagactttacctgcccatagcaccctgtgcagttgtgacaaccaaaaaatctctagatgtttctttttccccctaaatgtcacctggaggacaaaatcacccctgattgagaacccatgctgtctactcatgagactgtcatttaggatatcatcaactgaaaaaatgttaaaatgaaagtatatgtgcttcagttgtattcatcctgcagtatttttttgtgccttcagccaccttatcctattaaacattttccaaatgtaaggtacatatgtagccactatttttgtactggttctagacaatatattttattttgagttgagagatagcagccattttcagtcattttaaatttgattaagatttaatgagaagagaaaaaaggcatacattttcgtaaactaatttcagcagatgtgtggatgcttttatataaacctacattgaaaaagaaggtagcagttatcattaggacagaaagacataaagtcctatatttctgccattgtaagtatatgtacatcatacaggtctggaataaaaaaatgtaaagtgtttctatgacccttcgctaatcacagaggaccaaggaggagagaggaatggagactttggaacaggtcaagtgctgcacatagcataatatagcttccctagatggctctgtattaaaatctcagaattaagttattctgtcatcgactcattccgaaagaaatcatgcttgctcgtttctcatgtctacccttactgccttctgtggggcatccagatgtttcaaaggtctgaaatgtaacaattatgttgcaggaattgcagtggctttgtttcggggtagaacattccaggctgtgagtttctttggaaggcaggcttctgattaggtgttgccaaaggctctgcctaaacgtttgttttctgttgatggagtctaagagctgagtggttttattttcctagaaacagctgcttcctttcagttggctgaatcggaggatttattccccttttccactgcacacagagccttatgatgggcactgggatgtggaaggagtggtatcaaaggaaaagtcatcttgtctttcagtgtttagcgtcaacactggggtaaatctctaacgttgcattctggagtgctgtttaagagtgtttttattttctttgaattcaagcatactggaaagaaggggtacctggtggcccatattttattagcaacgtactgcagcctcccatcaggttcttgctaatgaaggtggcatggccccactgccccctgaatctgcaggaaagtggatatgagaggcagtattcaggaagattttgaaaaggatgttttcccttcatttctccagatgctgtaaaacttcatgctggatgatgccaggtcaggagagagctgtgtgcatggagtggattgcgttagttccctgctagaattgcttttattggattgcaatttggggtaatattaggagcccatctttaaggagatagtaagaaacaggcatgccttttgtgcctctttgaggaggtggtggggatatgtacatctcaggtcctctggcatggtgactataaatcctggcttccctgtgtttcagaacacctggatccaaatcccagctctgcttttttacctaagtattttttgactcctataagcatttgcttcctcatctataatatgagggaaataatagctcccacatcacgagttgtgaagctcccgataaagagagtgggttagtcacttacctgcactgaatgttcaaaaattgtcactatcctgcttgttacatgataaaacctccgtttgctccagccttaaggaataactgtgctaattttattggttatttattggtttattttcacaatataggtacctggaatggtggatatcaaccataagatttccttccatgccgattggtaggaaagccagcaggaaatgttggcctctacccagccaacatggagtgctttgaggtttgtgtgtgggtattaacttcattcctggcttcagtatgtttccaacccctgtttccatttctttacttttatcacctcttaacaagatagataaataaatctgttttatgctgctgtattgtgtttgtcaatatgaagcaaattaatcctttcttgacctgtggtggtggcaggggaataaattttatatatatatacatatatatatgtgtatatatatatatatatatatacatatatatatgtatatatatatatatacatatatatatatatatatgtgtatatatatatatatatatatatatatatatatatctcctctgaaatattgatcttctcttcttctttataacccctgaataacaggagccacaaactcaaacatctaagcagatagcatcaatgagaaaaatgggcccagtttaagacaatagggattagtgggtactgccataaatagacaggatattttccattctccaaccacacctccatatttcttcaccattgagtgtctcagttaccccgatgtccactcttcctttctcatcccatgtctttcaattcaacacagtattcttttgatccagtgcatgcttgtaaattttgctaaaactctacctattattcttttatttttttatttttgaagcaaaatagcatgttctgaggtagcctagaaatgtgtctgacacaaagcattctgtggggttagaagaacaactaataattatggaagtatcaacattaggaatagtggttgctgacatttattagtacttgctatgttctgcttaactatgttgcatgctttagatgatttttttgactttcaaccccaggagttaggtaatcttcttatctccattgttatcactaggaatatggagatgcaaggagacagagagactcactcgggccaaaatccagttgctcaacacttccacctgtcagcctcctgggcgtgacttccccaacgtggggaagatctgatgtgtgttttgtaggtattaccaccttcacctggaaataattcaccactctctaacttagatacttcctggtcatctttcgagactcagctctgggctatcaccagccttagaagccttcccttaccaccctttactggggcaggtgtcccctcctgtgtttcttggctcacaccaccacagacagagcacatacagtattatgagcaacttttggccctgtgctgctcttcctcccgtgactccatccatgactccttcctcccatgactccatccatggctctttccttccatggttccatccatggctccttccttccatgactccatccatggccactccctcccatgactccatccatggccccttccttccatgacccctccctcccatgagtccacccatggctctccttccttccatgactctatccatggttccatccatggctccttccttccatgactccatccatggctccttccttccatggctccatccatggatccttccttccatgactccatccatggctccttccttccatggctccatccatggctccttccttccatgactccatccatgggtccttccttccacggctccatccatggatccttccttccatgactccacccatggcttcttccttccatgactccacccatggctccttccttccatgactccatccatgactccatccatggctccttccttccatgactccatccatggctgcatcctttcatgactctatccatggtcccttccttccatggctccatccatggctccttccttccctggctctcttctttccatgtctcttttccttccataactctcttccttccacgtctctcttcctgccatgactccatccatggccccttccttccatggctccatccttccatgactccagtgccatattttgtaggcaaaaactcatggagagaaaaagaccctctgagaagcatctaccagggatgtacctagagatcgtcaagtgatacctgaacaataggggccacaaactcaactatctaagcaaatagcatcaatgagaaaaatgggcccagtttaagacaatagggattgatgggagctgccataaatagacatgatatttgactataggtggttcacagtttagcctttgcagttagactgctttaaagtggatccttgtgccttatttcactagctatgtgacctgggttaataatgagtctctctgtgtctcagttgccacatccacaaaatgaggaaaataattatgcctaccctaggggggtcctgagtagatataagatggtgttcataaagcccttagcacacagctttgcacctagaaggtgctcattaaattagttcctgttctccatgcttagtataacttctgtatgatgttcagcgttgctttggggcaacactgcaggcaattaaattgtctttctttaattgtcatttcttcctcttattccacaggtatgtattgtacaactactctaaagtggggcacaaaatagacaaagcccctgactttctttttttaattattatcatccttttaacttctgggatacatgtacagaacgtgcaagttcgttacataggtatacacatgccacagtggtttgctgcacccatcaacctgtcatctacattaggtatttgtcctaatgccatccctcctctagccccccaccccttgacaggccccggtgtgtgatgttccccttcctgtgtccatgtgttttcattattcaactcgtatttatgagtgaaaacatgcggtgtttggttttctgttcctgtgttagtttgctgagaatgatggtctacgcaaataaactagaaaatctacaagaaatggataaattcctggacacatacaccctcccaagactaaaccaggaagaagccgaatcccttaatagaccaataacaagttctgaaattgaggcagtaattaatagcctaccaaccaaaaaaaagcccaggaccagacggattcacagtagaattctaccagaggtgcgaagaggagctggtactgttccttctgaaactatttccaaacaatagaaaaagagggactcctccgtaactcattttatggaagcccctgactttctaagcttattggtttcactggtgttgtctgtaatggcagccatgagccccatgtgactgtttaaatttaaatgtaaaaattcagtgcctcactgggactagttacatttcaagtgcttactgaccacacagggccagaggctaccatactggatggcacggatatgtgagtttgctgaagctgccatagtaaaatgccacagactgtttggcttaagcaatagaaacttaattgtctctcagttctggaggccgaagtccaaatccaaggcgttggcatggttggtttgttctgaggctttcctgcttggttggtagatggccgtcttctctctgggttttcacatggtctttctgtgtctgtgtctttgtctttgtctcctcttcttgcaaaggcagcagtcatgttggatgagggcccaccctatgacctcgttttaactcagtcacctctttaaagaccttctttccaaatacacattctgatgtacagggggttaaggcttcaatatatgaatttgggagtggggcaagtatgccattcagcacatcacaacaggatagaaaatttttataattacagatggtggctcattcctgcaactgtagcactttgggaggtcaaggcaggtgaatctcttaagcccaggagtttaagaccagcctgggcaacatagcagaaccatatctctactaaaaatacaaaaattagctgggtgtggtggtatgtgcctgtggtcccagctatttgggaggctgaggagggaggatcacctgagcctggggagatcaagactgtggtgagctgagattgctccactgcactgtaatttatgtgactgagtgagacaccttctcaaaaacaaggaaacaaaaaatgaaaacaaacaaaaaacaccttaaacaaataaatgtccgtgttatttactaatactgaatatatacttaaaaccagcacttcacctacatgtgcattcttctgcctgggaggtgttgatagagtgaccttaggaaaatgtctttgtctgtggttcaaaaatgaattggacttgagtgagaagaggcacacatcttctctccccctccctccccttgcttcttcccatttccatgttccgtcccctattattctctcatactctatttctcctcatatacaggtttttttttttttttttttttttttttttttttttttttttgagttggcgtctcgccctgtcacccaggctggagtacagcggcacatctcggctcactgcaacctctgcctcccaggttcatgccattctcctgcctcagcctcccaagtagctgggactataggcacccactaccatgcctggctaatttttttttttttttttgtatttttagtagagacggggtttcactgtgttagccaggatggtctcaatctcctgacctcaggatccacccgccctggcctcccaaagtgctgggattacaggcgtgagccgccacgcctggcctaccaggtgtttttctaggccctattttagaagaggaagaaaagatttttaccctcaaggaatcttcagtctactggtgtctgagagacctgaacaacctaaccacgatgtattgccaaagctggtgagacagaagcaggggaaaaatgaaacaggatcccttggaagggagatgtcactcctgctctgcggtcgtgggaaaggctgcagagagaaggcatttcctctacacccaaccttgaccttcagcaagtcccttagcctcccgttgagtggcaggcaacatgtaaacagcagctatctcttagagggcaggagttctatgaatgcacttattaatcactgtgaagctgatgaaaacgatcaccataaaactatgacacactccttttcttttccaagaccagtagtgctgaaaggccttcttgtccgaggcttaccatatagacaggtacctcatatcaccatgaatatatgacgactttttaatcaagtgttaatggtctcctacacttcacaaagcaggaatggagggggtcgttgcagctggtaatgaccgtatttgcttttattgtatgattacctttattcaatctctagttccaaaaagggttttagatggcttataataaaggtgcagattcaataaaccatgagattattaaaagaaattacgtggtgagcctagtaatgaaataattggggggtggtaagaaaatattcacagaaatcttaagatttcattttttccaattgattaagaatcttagactaaagctagccactggaactgagcacaaagcttatatctaaggattctgataaaatgcaaagaaaagaagaaagaaaaaaagaaacaaagattatatgtctttatatgtcgagctatattgctttcttctttcaacaataatttatttagcacctactctgttgctggggttttgatagatgctggggagtggagggagaaagatataaatactattaagaccaagtcctttcagatagaagaattatgtatttctgtaaaagagaattgtgtatttttagaaaagaacatggattagtgtgtgtgtatgtgtgtgcgtgtgtaagagtgtgcatctattcaagctttgtttttccccctagatatgggtgtctcaccctgtcttccaggctggagtgcattggcatggtcatagcttactgctgttctgaagttctgggctcaagcaatattcccatctcagcctctagagtggctgcgattattcaagtttatcattgatgattgggaagagccacagtcaatgaacctagagaccagataacttagggccctgttaaggcaagttaaggagtttagcttttactttaaggacaattgggaaccattgaagtggatcaaattttctatttagaaagataactctccctgcagtgtggagaatggattgcggtggaaggagagaggagaggaacatcagttagagggcggttgcaggctgatgggcactttgggtgggaataatggctatgggaatgaagacaactgaatggatccgtgagacacagagcaagataaactatttaacttgtagatcaattgtacatgaagaatgaagttatgagaggaagcaacgtggactcaagtttcattctggtaccttctagttggattcatgtaccatttaatgagatggcagaattagaaaaaagagaaagtattgggtcttagtgagaagatgatgtattaacttgtaggtatgatgtctgagatgtttggaagacacttaggagaagatagatgttaagtaggcagctgagtataagaatctcacactgagaagtgagaggggattggtgatttgggagccttggagtataaacaggttttaagccatgggaattgatggagtcctctaggtagagtttaaagaatgaaaagaaaagaaaatccaagacgtctttggaccccaaacattgagacgtttcccagaggagaaaggatttataagacagtctaagcaccagtagctagagatgtcagaaaatcagcaggaaatagtggtgttatggaagcaaaaggaaaactacgtattacagagcctgtgatggagtggccatagggtcccttgccaatggaagccatggcattggatgatagactcaagaagtactcagagtgagagaagatgagagcccaggacacatctctgggcccttgtgttattttctggtgactgtgaatttccggaagtccccccccccgcaatagctttgatttgacatggagagaagtgtgccttccatgatacactgtgaattactgactaccgttccaggcatcttaactataactttaatcatctgagctctagctcccatcaccattcctgcagtgccccaggactcattaaatcgccaggggtattcgaagacctcccaattaaggacccgttttatgagcatagttgaaatcctggaaattattgcctctttgaggcacaggagtaggtgctggtatctgctaggatgaatgataatgtggaccccggtgatttgctgtccttcatcgtttgatctgctttaatgaccagagagtaattagtccgttgttgtgtgcagctaggtgttacaaatggagttgtaaattcagcgccttggaataaaaagtggctattagtttctcccctgcaattcagtttacagatagttctggggcaaagtgagaagaagcccagtgtgccctttcaggggtgacatggtggtcacgtacatgtgcaaacagatgcgtgtgcacacacatacataggtttgtgttctcaaaactgaaaaaaaaaagaatctctttgatgtaatttctttgtagcatgtttttaaatgaagatattgaagctgatggcatccagggctggggaagtttgaagaagggaacagaaaattttgcaattggatttccagcagtaactgtgtgcaaacacggcccctccctgtatagcagaactctgtgttatcctgagctctggaagttcgtctgcagcatgaagttttttaccttgctggcatcactcaggaccacagagggagcatgcctgctggttaaggatctgtgggactacctgtgttctcagtctggctgtactatttactattggtttcaccttggaaaagacacttaatgcctctaaggcttcatttctccatctattaatgaagatagccgtagaaccagactcattgatttattagaagactcaaatgagaacattcacggaaagagcttgccatgacaccagagatataccaggtgctaaataagttgcttattattctcacatcttcatcacagtaaacaacttggagaatacagacaaaccaggcatcaaccattggtgtttcagagcaagagaataactgacatccagtatcgtttcctaagttgatcaaactcttcctgaccatgtggcgatatatgcagaggcccctcaaaccacagggaaaacaaggtaaagtggccagtgctatgctcatttgacctaggagtaaggaatgaaaaacggtatctgtgttaaagcaattacagatatacgacagagttgcatgtaaaatgcatgtggatttctaggacaaacacatcatatcaaatgcatcttgcccttgcaatacttgattccagttgtgtttcccagaattactggagggttaggtcactctcctctggggacagctgattttctccacaaaactggtgattaggaggactgtggaaatgtgcccacacttcccagtaagcatttcttcttgtgctttattgaagattccactagaaattaagtgctttggaaattgaagttttgaaatcagcacattttcagccaagcctggtggctcacgcctgtaatcccagcactttgggaggccaaggtgggtggatcccgaggtcagcagatcgagaccatcctggctaacacagtgaaaccccgtctctactaaaactacaaaaaaattagccggccatggtggcgggtgcctgtagtcccagctacttgggaggctgaggcaggagaatggcgtgaacccgggaggcagaggttgcagtgagccgagatggcgccactgcactccagcctgggcgacagagggcgaaatcagcaagttttctttattcaggatactcactcggcttaccatgccatcctttcaaaagagttttaattttatttctcctctctgcatcccctcagtatgaatttaggtacaccaagaatttatcaagcttcaaaataatctaaactatttgaaatggaagacacctaagaaagaaaatcgctttagagctgatcagtcactgacctctatatctcatctcaaagattttcttttaattaccctatatctcatgcttctgatatctttaaagattaataaggcatccatatatccaaacaatatagatatatggaatatagaaaataccaatgtctttagagtcaatacttaaaaaatcttgctcttgccgggcacagtggctcatgactgtaatcccagcactttgggaggctgaggtgggcggatcacctgagattgggagtttgagaccagcctggccaacatggagaaactgagaaaccctgtctctacataagatacaaaattagctggatgtggtggcgaatgcctgtaatcccagctacttgggaggctgaggcaggagaatagcttgaacctgagaggcggaggttgtggtgagctgagatagtgccattgcactccagcccgggcaacaagagtgaaactccatctcaaaaaaaaaaaaaaaaaaaaaaaaaaaaaaaaaaaaaaaaaaaattcttgctctttctcatgaatagctgcccaatattctgtaatgtaggttatattagattgcttggggctgccataatacagcattgcagacttggcagcttaagtaacagaagtttattttctcatagttctggaggctggacatccaagattaaggtgtcagcaggattggttccattggttctctctccttggcttgtacgtggccatcttttccctgtgtttttccctgtgtgtgtgactgtgtcctaatctcttcttataagaacactggtcatagtggacaacctataggatgagagaaaatttttgcaatctatccgtctgacaaaggtctaatatccagaatctacaaggaacttaaggaaatttacaagaaaaaaaacaccccatagaaaagtgggcaaaggctatgaacagacacttctcaaaaaaaaaacatacatgcggccaaacatatgagaaaaagctcaacatcagcgatcattagagagatgcaaatcaaaaccacaatgagataccatctcacaccagtcagaatggcgattattaaaaagttaagaaacaacagatgctggtgagcttgtagataaataggaacacttttacactgttagtgggaatgtaaattcattcaaccattgtggaagacagtgtggtgattccttaaaggtttagaaccaaaaataccatttgctgcagcaatcccattactgggtatatagccaaaggaatataaatcattctattataaagatacatgcacgtatatgttaatagaagcactattcagaataccaaaaaaaaaaaaaagtggaatcaacctaaatgcccatcaatgatagactggataaagaaaatgtaatacatgtacaccatggaatactatgcagccataaaaaggactgagatcatgtcctttgcaaggtcatggatgaaactggaagccattaccttagcaaactaaagcaagaacagaaaaccaaacactgcatgctctcacttataagtgggagctgaacaatgagaacagatagacacagagaggggaacaacactcactagagcctgttgggagagggtggggggaagaaagcattagggaaaagaatgaatgcatgctgggcttagtacctaggtgatgaggctgataggtgcagcagcccatcatggcacgcatttacctatgtagtgcacccacacatcctgcacatgtatcccagaacttaaaaaaattaattaaattttaaaaaaagaacactggtcatagtggattagagcctacccttatggattccttttaacttaattaactcgttaaagaccttatctccaaataagggcacattctgaggtttgagggattaagacttcaacgtatgaattttgagggctactatcagcccatgacttaggtgtatgtaatttatttaactatattcccatccatgatctttcaggctaattttacttgttttgtatttcttcacattaaacaatgtcatatcaactaatccaaccataacacttgtgtggctggataaaacagaaatgttttattgtgatgtggaattttaactttgtcttttttgttcaaactaagaatggcttatgtctccccatagggataacatgattttgttttgacagaaatctttaatggaagattattttttttctcagtggcaatctgcagattaatgggataattttaggtgaactgaagagaatggagggctgttctgtttaagctatctttgtgcttatgtagggacagtaatatcatccaataaaaggacatatgcaattatatcagctttgtggtaattatatggatattttcattgttcagtacatttaattatgctttgttaaacagcctgtattagcttttggtggggcaagctttgactggattaatgccaggggcttgtatgttgaatgtttcacacgatgcatctttctagaaggaaagagcaaacaaaaattaagaaaaagggtcatgattacctttcccttatttttccttttcaacaacatttttaatggacagttccagagacaatttcatcctttataaaatccttatattagtcatttgaaagaaaagcaactaatatatggttttggaaccgttaacccaacacagaactctttagagttaatgtgtggcctcctccccatctaccttcgcagtcctccagtctcactctgggaggggcagaatttccattgacagcctgatgcatgctcttctgtatggtcccctttgctgatacaattatccatgtgcatgcttatgctttttaaagggtggcctcatcctccgccttttattcagtaacttgccttttttgcaaggcatggttattgtccacacatgccaattattaaaaatctacttactccttttacatatctgcatagtattccatagtatggatgcgtcactatttgttcagccatccttccactgatgttctttagattaattcttcgttggatttgtgtatttttttcttctgccaaaataagcattgctataagaaacatttggcacgtatttctttcattttggtactttctgttggctaaaattctctgaaatgaaataattagtaaaagctcaccaattttttaatttcaacaaatattaccatgtttttaccccccaccgccccccacacacaaaattggagcaatttgaagtcttcccgacgctataaactacctgaacaacactggatgttagcaatcttttaaaaagtattgagtatacacatggcacattgttgctttaattttcatgttcttgacgactaattatacacaaaatctttcctcttataggaattatttaggtacaatatttgttcattttcaattagtttatctttttcttgttaatctattaattcttcgtatcttaaagctgttcaccttagcttgtgaaacttgtgataaacacatgctgtgatttaccttttgagtttatctacaagatcctagtccacttaaaagtactttgtgatcacttttattaataacttaaggagctatccttcccctattcaacttttataaaaacagcctcttgtaatactttatagttttttgctttatctttaggtgtttaaatttacctggaatttacttttgcaaagctaagtatgaaatctaacatgcattatttttcctgtaaagggtagtcagatggcctaatgacaacattaattccatattccaccctttctgttaactcggatgtgtgcatatactcacacagatcacaatttctgaactctattaactcaggtcaactatttatttgctgttgtgtattaaagagttttgcctactaatatattttagccttggcaggatgctatgagatgacatagtaacgataagaattccttactttaaaagttgggcaggtaacatttggggtcagaagctttttgaactgatgaactagttagatttgatggggggtcggggcggagtgtaagtggcagaaatctgacccaagctgatgcaagcaagaaggaagagtattgactttcagacaggaaaaccaagggttgctctaagcttactgaattcagaagctcaaccaatgtcgtgagcaccggtctcgttcaccatgtcatttagctctcttacagccatgtttagcttggctccgccattatacagcagaaagatgcttactaaccgccccaagtttcatcttattccctgaacagcaccagcaaagcacactgaatcacgtgcccatcactaaacaatccccactgttagaaggaggtgagttcctcactggctagactagctctcgcgcccaccatgacctaggaggtgtaatcaatcctgcaggaaccacccagcttgatagtttatcctcccagagaggaggagagccactaagaaaaaatcaaatgctgttaccagaaagaggggctgaccatttgataggctaaaactagtgaatttcactgttcctgattaatgtgaatcaaattttcatgttagttccgaaaattttatcccactgggatgaaggcaactttttcatcgaaatgtgggccacatttaattcctgcatgtaaatgttggtatccagagaaaaacaaattaagataacaatgagatgcgatctttacaacttgaattggcaaagattaacaagttgctaatagccattttggtactactgtgagtaaaacaaaaaaaatcatatattaatggttggagtgcaaactggaataatctttgaagagctgcttttacgaaaagatatacagcttttatcagcaatgcttttttaatgaattaactccatagcaaaaatattttcaattggtttgaaaatagctacgccaatacacaaaagtatgcttgtgaaagtcttggatgacagcaacaacaagcgttgtttgtaataacgaagtcctaccctgatctaatgcatactagtagtgagctgattataaaattgctgtctagttatgcatttgcctgacatttgaagaaaggacaattataccttttaaattaataccattgtttaaatgaaaagaaaacagctacttaatgaagatttagccctaacatcgctgctatagttaattcttcgcaatgattcaccctagagtggtcaggtcacctctcttgtgctttgattacaccttccatatggattacggatcatatgcaaaacatttaattactgagctacagcattaatcacttggctgaatgtatttcaccttttctccttcctgcaatgtttaagccaagttaactgatagcagtgcgttaaaaacaggtagtactatacagcagtaggagaatgtagcctccagcacagagatcccgggggcaattctggagctatcatttattagctctgttgccctcgggcaaatcacttactagctcaggtgagtctgtatcttcttttgtaacatggtcataataaacacagtttctcatatctagcctgattatcgtgaattgtccacacagtatatataagccctgaagccctggacacaaatgtgtaaacattgttcttatggaactgctgattattattattaatctccattttcttgtttctgtgcgatcaggtttttacccatgcaaagtggttgtctaagactatatagatgtgtagagagaggcagagtaggttatttggaaaaagaaagtggtggagtgaggttttgttgttgttattgttgttaattattttatttcatagggagaaggagggcactctccgtgtaccttcgtaaagaatagtacatactctttattttgacagtgtagggtaaacctgtaagagtcaagaaaataacagatttgatactaccctttagtggctatcttgcatgttaatgtatatcctttcatttctgtctgagttcagcagttagactcagctcgtgggttcctacagctcaatttctaaaatctacgtaagaagtaaaatgctgctaagtttacctgcacttttagtgtacattcagatcagagtcttctcagttatagatgtatagggctgtgtgtgtgtgtgtgtgtgtgtgtgtgtgtgtgtgtgtatttatgtccttaaattaagcgctattggagcatggccctgcatatttgtttctgtattgcctgtggtcatttttgtgctaaaagggaagaattgaggagttgcaacagagaccatgtggtccaaaatatttactatatggctctttgcaggacaaaagaaatgctaactgttgatttaggctacagtttactttaagtcactgttacatcaatgaaaaacttggaaactaaatacatttgtgtgtttgtgtgtgtgtgtgtgtgttctttaaacttttaagctaatccttagtttaaccaaaaagaaagactgggtgtcgtggctcatgcctgtaatcctagcatattgagaggctgaggtgggtggatcacttgaggtcacgagtttgagaccagcctggtcaacatggtgaaaccccatctctactaaaaatatgaaaattagccaggtgtggtggtgggcacctgtaatcccagctacttgggaggctgaggcagaagaatcgcttgaacccgggaggcagaggttgcaagtgagctgaggttgcaccactgcactccagcctgggcgacagattaaaactctatctcaaaaaaaaaaaaaaggattaaggattaaaaaaaattgaaatcatccatggttataatattcttgactgcatcttaacatcattggtttgtttttcaaatattgttaaatgcttactatattccagttatggtgcgaggtactttcccatatgttatttagttttagaatcctctcagccaccacctgaagtagttgctattaaacccattttagaggtgaggaaacagatgttcaggaggatttaaataacttgccacgtttcttgaaacttcccagagccagaattcaaccttagatatgtatgaattcaatctgatgcttgctgggttaagaccattggagacaccctctctcctctgtccttttgacaattccatgggcagaatatcacaggaatggcaaatagagggataaagaatgtatgtgacatgcacccaaagagtctccaggccccttttcatcctttcaatcatgtttctaaggtattttgaactaggcgaggctctcttagttcgaataatagcatgctgttcaatgtggacattaatagtcagaatctggtagtgcagctacagaagaagcaaagaaaaaaatgaaatcctctcattgatttctagtcagagaggtgcagaaaccctaagagtccttatgtgagaataagtgttttctctctgtgtcaatcttaatataactaaatgcagcagatttaatcctttctataatttaataatttgtattaattacacttaatgaaatataaattaattacatttaatgaaatataataaagtttatttaatatattaattacgtgtaatgtaacatatgggattttatttaatatactaaccatttaatgtaatataataaaatttacttaatatatgaattacagttagtgtaatataataaagtttacttaatatattagttacagttaatgtaatataaagtttacttaatatattaattgcagttaatgtaatataataaagttttcttaatatattaattacagttaatgtaatataaagcttacttaatccatatttaataaattgaattccattaatatgtattatgtgggttaacatacatacagtgttgtaacaacaccaggaccttagtttacattaaaatagtgcttatttttatagtattgttattttaataattatttatgttactgttaaataagttgacatatatttatgtccaggcaaggtgactttatagtagctgggttttccaaagtgccatatttatatcccctagaagtatactatgctgagacaggagttcttagctgtagaataaagagagctggttttgtagaacattaattttgctccaagcttttggaggaaaaatgttgtttcctattaaaaggaaacaaatatacaggaaatagacagctaatgtgcatgcagtttttaagagaaagcccgagactgcagtcatcctgtgtgatatgccactggactcttccatctatggctctggagcccctaagggtaaggattagacctcatctgccattagctagcggtacttaagtgggaaattttgcaaagcagtaaattataacactactcaaaagtggtttctatttttgtaatattatgatgtaaagttactgagtttgataatgcaatctacatccctttgttgaaactgtagaatatggccaataaagggttaatgggaaaatcccagaatctgctttctttttaatgtttctaatggtcatcttagcaccagagcctctttgagagttaagagaaagaaattaccagagaaggagagtctgtgtctcctgggagatggatggtttgggggaatacggagtggggatggtgatttttctctgcacagaaatactttcttgaagtcagccctttactgtgcaatgtgggatagaattctaacacctccagtataatggcaggaggaggaatggttaggaacattggagagctatttggcctatgtctctttgttatgaagggcccacagtttacgtttttgactttttcaccaaataaaggcttatagcaagttacccagatatgttggcagaatggcaaggctacattcatcatagaactttaagcttgtgccccactgctgggccatactgcctgtcaggcccaaattaatatcttttataagccccgcaacgatgttgtaaagaatacaattatagcttaggacattgccatctgtggtgggacatttcaaacagaattaagtctagagattatgagtgatgcatcattgtcactcaaactgaaattggtatagcaccttctgttttattcaaaattctaaagggaaattattctgccacaaaaattctcatctgttaagtagcccttaaatgactttttttttttgcctttgcaaaaacaaataaaaccattttatttgtgtgtgagttagaacattgaaatgttgagcctagatttttaaatgtgtcgtgatttttgcttctcttgctcagtcctcttttctacttctttctgccttttttatttctaattttattttattattttttagtcttttattttaagttcagtggtacatatgcaggtttgtaacataggtaaacttgtgtcatgggggttcattgtacagattatttcatcacccaggtattaagcctagtacctacccactagttatttttcttcatcctctccctccttccaccctccaccctcagatagggcccattgtgtgttgtttccctaccttttcttaggaaccagaagccccaggcattggaagtggtcaaggcatttttttctttgacccctgggaaggtcttttcttagtacacaagcaacaagaacttcagacagagagtatatgatgctgcattacaacctgaaccattggagttctgtcaaaagaatattgaagagatcctggtagaaaagaaaatagagtcaagaaaaaagaaagtgcagagtaaaatatagagaagtagagggaaaataatgtaatgctgccaaacctaataagagtactgaaattgttgcctctcacaagccagtgactttctcaagttacaaccaaggtatgggattcaaatgatcccactgacaatccctctggaaagtctccagttgaagcctaccctatcatttctttaagagacccacatagacaagttttctccaggtctgagctggatttccttcgttgattgagcaccagatgaggaattggcgtgattttaagggccacgtgcactatgcgaaaaagagttagctttgaaaacaagacaaatacggggtgagacgagatgcaaatgctcggaggtatctcagcactcaagaacaaatgcatgttcacatctcctgtgttaggcttgctcactgctttgatagccggtggaatcactggcaacgttcacattttttcctcctcctgttttcttacctcctcatgttttagttgaatgcatgtaacttgagtaagattaaaaagtgattctcagaatcggaactttgagcttcctgcaaaaggaatatttaagcatctctgtatccaagagtaccatcttatctcacgggctcactaagtgggagttaggaatcctacagttcccttcaagacctatagggcagtagatttgaaccttacaatcctatattgtatttcatgttgaccaatctgtaagcaggtaaagaactgccatcttactggtgataaagagtttatgatgttaactgagctctcattctagacaacaaagtaatccagtgtcctattcaaacttaattcatagttatcaaacagtcattaagtatctactttgtgcctgatagacatttctttaaccagaatgctttgccactgtatcctcattcatttaaaatagagtatatagaaaccagatttagatactgcctctagttgaaattcctgcatccaggtagggctggctgtttgtcttagagaatatgtccctttatgtcctgtctggataggtggaaggtgagtaggtttaacaagtaacatttgatccaggcatttttacagtaacagtttgttattgctggaatttgaccatctcaattcattttcgtaggtataaactagtcatggatattaaatgtgtgactatattgatatatgaaagcttactgatggcacagttttatcatcagtgcctttattcaaatgagttttaaaagttgattagcaactgcattctcctatgttggcttggacatgaatagtgcaaatatgtcagtctttctattcttccaagatgaccttcagctctctatgtgcatgaattccagttggcctttagccactcctccaagtagaacacatatctatccagttgcctcttgtgtaactctttctggagcttccatagcccctacccaacttgatgtggtcaaaatgagcctcttatctttcccaggtatttgtctgatgcccctgaacctggtcatcgataccaccatttagtcaataacttgtaacagtgatctaggagttggccttgactttttggcttcttttacacttgtttttatcctttttttaacacctccagttatacatgtcttctagtgtttctttcagtgagtcttgtcaattctatttatcaaatatttaccaaatcctcttttccattataccgttactgctgtgtctttgtgcaaaccctcatcatcttttaggctaagatacaataaaataatcttccagaggctcttcctgcttccagtgttcctttctgcacacacgagggtagccttcctagcaatgactgttccattttcttatagaggaattaaatctaaatttcttggcatgacacatgggcccctttatcatcttacctgtgccccctttccctgcctggtcttcagacatcaaccctttccatcagttcacccagtcacatctctgcacctttgcataagctgtttcctatggtttgaatgcctttctcccctgactatcgaacaacctgctatgcatccttggagatccaactcaagcatcatcaccttttgaattctctgaaagatgccctttgcctttagttagaacaagaggcatcctctaccaagtagatgcatagcacaatttattccattctgtcatctagtacgataattatactactagtttctattataatacttgtttgttattttccttctccagtaaacgtattctactttgcattctccaggcctaaaagagttctggaatgcaatgggcattcatgtaagtaatgttaaaagaatgactccatcaattatatttctgtgacattctcaggtaggaagatatctttatgcttataattggaaaaaaaaaaaaaaaacctctagtggcagagaatttgtatttctgttagctctcagtattgggattgtatttctgacaggctggcccaccagctatgcttcatgaaagaccatgagccacagggaagaggtttattcatctcagcattggggtattttgcttttcttcaaggcaaagggatctggagactcctttgcaggctggccatgtcttgtgcaatcccagctgtgtctggagattctagcagggatgcagagtgtggttgggacttcacaggaagtcgacttgcatcagaagcacatagggaaagggaagggaaatagaatgaaggaagaaagctttcagcagccaaggcaacaacttcccccgtctctgtctggctctggggccaaacagactcctgatttctctttatctccttgtctctccacctctattcctctgagttcttttcccatcaccccccattctttctctatatactgtttcgctgactagtcatcagactctaccgacaaatttacctgatcttcccagcctagcccttgagcttaaccattccatccacttctcaattccacatttcttggagagaatctgatttgaccaggtaggggcatgtgtctgacccaggtccctggacaagggaccgatgaaggccaggctgtgagagaagcagtgtctctaagaaaccctgcagcgttagggagaaatgattggtatctctatggtacacgtggtggagatgctggctgcacatcccaagagccatccctagaagatggcttccttcccatcctgtaaaccctgagtcagggatgcccccaagcatgtgagatgttgaccctatttctgcacttggcccaagtcaaatccagtcattgctattgggggtcttgttgcatcctgttgtttcctttgggaggtgacatactgctgacatctgtggagtgaagggatttggggaaagtgtgagtcatcatctctctgatgacattttattctcttattctccaaactctgcccagcttctttcttttttctttctttcttttttttttttcaatggaatctcactttgttgcccaggctggagtgcagtggcgcaatcttggctcactgcaacctccgcctcccggttcaagtgattctcctgtctcagcctcctgagtagttgggattacaggcgtgcgccaccatgcccagctgttttttttgtgtttttagtagagatggggttttaccgtgttgtccaggctggtctcgaactcccaaccttatttgatccacccacctcggcctcccaaagtgctgggattataggcgtaaaccactgtgcccggcccagtttcttatttaggaccctcaaggaagaattgttgtaaggaagatagcatgatcatatagggatatctccaggtgaaactcttccacctttacaagatgtatgctggtataacagagaggaacacccatgattacctatgtacctctccctatgtacccctagtcttctgcccggggaccccaggatgccctgcaacacatggaaataaaatttacctcctgactcttggctctcacagctcttatcctgaatctttgttttctagccctgcctacttatctattttgttttctggtgattagtgaacatggatcaccctccgaggctttttgttggcagggtacatgtctgtctcatttttgtagttctgtagtacaaatcagacagcaagtgctcaattaatccttgaacgaaacaaaagaaaggagtcagttcatgcaataatggatgctgacaaccctagcatcttatcgaaggtatgtatctccactgactcacccccatttcatcacaaggctatttcccacccaacagttgcaaaaatctgtcatctccttgtttcttatctgtctccctcactagaacataagctacatgagggctcttgttttgttaatcctgttgacaaaaaacatagcttctgttatttttatttggttggtctttattgaagaaataaagaccaaccaaataaaaataaacagaggctatttattcagagcttgctatagcaaggagtcagacatcctcacttgcattttgccagaaactcaaaggcaggcagaggagtaggaaaattttatagtagataaataaagggacagcttcagatatggcctggctagaggctgtttgcgtggggaagctgcagatgggctaagtagaaaggggtgttccttgtgatcggttaaggtgcacacttggctttctctgattggtccgaagttggaggtgtggacaaaaattaggaaagctgtcagttacgaatctagtcctgattgtttctgagccagtggatttttgtttggcttcctggaccagttactagagatagtaatctgacttccttgaatcgtgacttgtggatagcaggctggcttcctgtagacaataagctggtttcctgggctggttactgcaaactgtgggtcagatttctctttttctatatggtcttgccagtgtccatttgtgtatgcagtctatccttgatgggagggaaaattaaaaaggaaggaaagaagggagggaaaaggatggggacatcatagtactattatccagtttttattatccagattctatttcgaacactttaatcccatttcgatgtgagggaatagtaattcatcccagagcggacgtgacatctgttttcaggaccctttaatcatatcccgtggtccaaagctataacacagtgaagaggaaaaagactcttttcctgtcagtcgcccaaacgggagccaaaggcttttgaggaggcacttaaagaattttcactttgcaattgtgcagaagctgttgttcaggtaatttaacattgattttagtttaaaaggcaattaagacaaaatgggcagccaccagccacttatgttaaataagcttagatttaaattgctcctcatcaccacctttgttttctatgtctgggctgttctatgctactttagcatgggatggtgtggtgccccaagtggggcaggtggataggcgagggaacccagccagggaaacggttattgaaagagaaagaagttggccaaaaattgttctcagtggtgagatgagttccctttcatactgctgctgggaatatggattcatgtaagcttctagaattctggttccttagatctaaaaacttaaatacggtgcccacttttttgactcatcggtttcacttttaggtatctaccctgagataaggcacagagaaaaatatcataacatcaggaagtgatgttcactgcagtgttatttaacataaagagaaagtgtgtagcattagagtggaatacataaactgaccttgtacattttttgtccttacagcacaaagtgttcatgatacattgcaaagtgcaaaagatgaaggcagcttatacagtaacatcccaattgtgtgcttataatgttttagttctatatgcagtagaaaatgtctgaagtggatagacttccaacaaaatagtacttggagctctctttgggtggtgaaataatgttagcttttctggtgctttttgaaatttcctaaactttccacaataaacactcataggttttataattataaaacacattgaaaacaatgttggttgtaatactattagaagaatattcctgtcagcagtgtgcttgattcctgccatctcaaggatgaggctatatgtgcatgctaagttataaggagatggaatggatattcggttgcaataattctgtttcttgcttaaaggaagtctgctacgcttcaggaatgagggtcattcacctggtctttgtttaaatttgtaaggtgaaccattttgtagacaatgcttggaaaatatgcccaggtgattcatgcatttgtctattagaaaacgtggtcacttaccagcaaccaatatagagctaatgggattcatttagaaatgtaaccacaagtccactataaatcgtatgttctcccatctcaatatgcttcattaagctcacctttcttaatgtaactggattattaggtgtcaggacaaagaaaatcagtaggtcctagtgttctaatcctgcaaactttcaatgtggttgctatgtaattttatttttttaggtggagcttgctttgtgcttttctacaggaaaatattttcaaactggtaaagaagtaatattactgtattgtgaggaatatttcaataggtcattaccataacttctagcagaaaggataatctacgtcgcattttacttcaaggataagattgatttttataaaaatctttagtgcattgaggcttaacgtctttttttccccctatgaagaagcaattagatgctggagttttccagaaatgttaggtgggcataaaccaaaccttgatgcttttctttttgaaggttttatcatccagcgtttgaagagaacaggcagttcccaggtgaaaaaaaatgttattggtacaatgtcagtcatcgacactcacatggccagggacgccacccttttcttatatttacatctgtttgaaaaatagagaaatacaggaaatgacaaagaagaaaataataagcacctataatctcactagcaaatactacccattttgtatgatttcttccaggggtgtgtgtctacaaatatccgtagagacatacacatacactttaaaaaaatagtaaatacacatcttgtacacttaaagcaagacctatagatgtacaggcacaccttggagatactgtaggttcagttacaagccactgcaatacagtaaatatcataatagagggagtcacactattttttgtttcccagcgcatataaaagctgtgcttttgtaccatactgtagtctattaagtgtgcaatagcattgtatctaaaaaacgacgtgcataccttaatttaaaaagactttattgctaaaataaaaatgccaacaatcatctgagcctttaatgagttctaatctttttgctggtggagggtcttgcctcggtgttgatggctttgtactggtcagggtggtagttgtggtagttgctgaaggttggggtgactgtggcaatctcttaaaatgaggaaacagtgaagtttatcacatggattgattcttcctttcatgaaatacttctctgcagcacctgatgctgtttgacagcattttacctaacgtagaacttctttcagaattggagtgaatcctttcaaactttgctactgcttaatcaactaagtgtatgtaatattctacattctttgttgtcattgcaacaaggatcatagtatctttactagatgtagattccatctcaaggaaccactttttctgctgatccataagaagaaactcctcatctgttaaagttttatcacgagattgcagcaatgtagttgcctcttcaggctccacttgtaattctagttctttagctatttcctccacatttccaggttcttcctccactgaagtcttgaacccttcaaaatcattcttgagagttggaatcaacttattccaaactcctgttaatgttgctattttgacctccttccatgaatcttgaatgttcttaatggcatctcaaaagcgaatattttttagaatatttcagtgtactttgcccagaaccatcagaagaatccgtgtttatggcagctataaccttatgagatatatttcctaaataataagactggaaatcaaaattattccttgatccattggctgcaggaacctatattgcattaacaggcacgaacagaacacttatgtccttgtgcttctccatcagagctttccggtgaccagatgtgttgtcaatgagcagtaatatttttaaaggaatccttttttctgaatagtaggtgttaatagtgggcttaaaatattcagcaaaccatgctataaacagatgtcctgtttcatttctagagcataggcagagtagatttagagttattcttaagggccctaggagattcaaaatggtaaatgagccttgctttcaatttaaagttaccagctgtattagcccctaataagagcgtcagcttgtcctttgaagctttaaagccaggtgttgacttctttctatgaaagttatagataccatcttcttccaagagaagactgttttgtctacactgaaaatctgtcatttagtgtagccaccttcgtcagtgatcttagctagattttcagggtaagttgctgcagcttctccatcagcacttgccatttcaccttccacttgcatgttacagatactcctccttgccttcaacctcatgaaccaacctctgctagcttcacactttttttttgtcagttttcccacctctctctgcctccatagaattcaagaggattaaagtcttgatctggattaggctttggcttaagagaatgttgtggctggtttgatcttccatctaaaccactaatactccacaccagcaacaaggctcttttacttattagtagtgtgttcaagggagtagcacttttactttcctttaataactttttcatcacattcacaacttggctagttggtgcaggagcctagcttttagcctgtcccagcttttttttttttttttgagacggagtctctagctgtcacctgggctggagtgcagtggcgtgatctcagcttactgcaacctccgcctcccaggttcaagcgattctcctgcctcagcctcccaagtagctgggattacaggtacctgccactacacccagctaatatatatatatatatatatatatatatatatatatatatattttttttttttttttttgtatttttagtagagacagggtttcaccatgttggcgaggctgttctggaactcctgaccttgtgattcacttgccttggcctcccaaaatgctgggattacaggcgctgtcccagctttaaaagtgtcttcgtcatgaagcttaatcatttctagcttttgatttaaagtgagaggtgtgtggctcttcctttcacctgaacacttagaggctattgtaaggttatttattggtctaatttcaagattgttgtgccttaaggaatgggaaggccaaggagagggagcgagcagggggaatggcctgtcagtggaacagtcagaacacacacaatctttatcaattaagtgtgccatcttatatgggcacagtttttggcaccccaaaacaattataatagtaccatcaaacattgctcatcacagatcacagtaacagatctagcaataatgaaaaggtttgatatattgtgagatttacccaaatgtgatacaaaaacataaagtgagcacttgctactgaaaaaaagtggcaccaatagacttgctcagcacaaggttgccacaaaacttcaatttgtacaaaatgcaatatctgcaaagcatgataaagtgaaagacaataaaatgaggtatgcctgtgtgtgtgtgtgtttgtgtgtaagcgtgtatacaactttaaaagtttcatactgtattagtccgttctaacactgctataaagacatacctgagactgcgtagtttataaagaaaagaagtttaattgactcacagttctggaggcctcaggaaactttcaattatggcggaagaggaagtagacacatcttacatggcggcaggtgagagagagccagaaagatcagggaactgccttataaaaccatcagatctcaggacgctgaggcaggcagatctcttgaggacaggagttaaaggccagcctggccaacatggtgaaaccctgtctctactaaaaatacaaaatttagcccggcatggtggcacacacctgtagtcccagctactcgggaggctgaggcaggaaaatcacttgaatctgggaagcagaagttgcagtgagctgagatcatgccactgtactctaccctgggtgatagaacgagatgctgtctcaaaaaagaaaaagaaaagaaaaccatgaaaccatcagatctcatgggaactcacccactatcatgagaacagcatggaggaaactgcccccatgatccaatcacctcccacctggtttctccccttgacacatgggaattatggcctcttacagaaaaaagttcaccaatcaccagtctaggccaggcacggtggctcatgcctgtaatcccagcactttgggaggccgaggcaggcagatcatttgaggtcaggagcttgagaccagcctgaccaacatggtgaaaccccatctctactaaaaatacaaaaaattagttgggcatggtggcgggtacctatgatctcagctactcgggaggctgaggcacaagaattgcttaaacccaggggcagaggttgcagtgagctgagatcgtgccactgccctccaggctgggagacagagcaagactccacctcgaaaaaaaaaaaaaaaaaatcactggtctagaaaaatgggactgaaattcacaatagtgtcatctctaggaaaagaggaaggagactagtttttacctgagtttgagagctccttttgttcttttaagagaacacttatgtactggctttatgcttttaaaagtgatacacatgtacacacatataacatatagagtatatatacatacacacttttcacttaaaacaagttatatgtatacatgttatatgcatgtaaagggccagagagtaaacattttagacttcctgggccacttggtctctcacagacactaaactccgcatttgcagatgaaggcagtcgtagcaacccataaacaaatgggcatagctatgtttcaataaaacctcattcatggatgctgaaatttgaatttcctacattttttacacatcacgaaatattattcttcttttgacttttaaaaactatttaaagtatcaaaaccatttttaactagcaggctgtacagaaacagagaatggctgagtttgattcttgggctgtagttggctatcttctgttttggactgttcccagtacattcacaaatatttatatatctacggaaaacctataatattatattagtgcattctctttcagaaatggtgtcataagtgtagaagtcatttaaaacttgtatttttatctcagcaatttatttttgctgagaaatatttgtatatatatttgtaccttatagtgtgtatttttatttctgttcctacatattcatgtctatatagcaatggaggtattcatatgtggctttatttgattcttttcactgctatatggtattccatcatatgatatgccatatttttaatgctagatgggtatttagtctgttgcctccccccacaaccccatcctgtatcacaagcaatagcaattatatccaaacatatccacaaatgtatcttgtgcatgttttttaggacagacattagaagtagagctgtttgataatagggtatgcacattttccattttaataggtactagtaaatcagcttcccgagagacaatatcagtttacagtgctcatgggagactctactgccattcttggtttgggaggttgcatcccttcctgttttacttatggggtgggagcaagaaaacaaccttctctctgtatcatcttgccttgtagttacagctgtaaatgtgggccttcatgtccctttgggtggctgcagacatggttttaactgtttgctgtgccccttgcacatgagaatagcaatttatatcaataaccaggtctggcaacatctgccaaggttgtcacgctctgtgattaaatggccacatgtgctgagaacacgaggacaatggggttgtaattagggcttgctgtctctccatcggccacccgcaccatgcgtcccttcctataaccttgcttttgtgaactgatttgtgaatcaaattattccactgggcatgccagtgtgtgctgggttaataataatactctatatttgtgaatctctgtaattgtacagggttctggataagcgaaagtctaaacccctttttgccattttacctggtgctgttggaaaatgtgtcaggggatcatacaagataacattagaagttaactttaaaaatagtagggagtggagcatgttcttcatggcatcattattgtgaaataaggttttactttatggttatctcagcatccgttaaatgccactgaccctgtaagaaaggcaggcagagagaacacaaatagaattttgttaactctgcaaggagaaagttaaacactgtgttaatatcatattaaaaacactcttaatgcacagaagaaaaaaaaatccctcctcgttttgttcctggtatgacaaagatggatgatggttacataaggaattggcatgttaaaaaaagacacacttgaaatattgcctctagatatgaagttgtaacgaatgtgaaaatatttgaaagatttattagcattttaatatttgcttaccaatgcataaaatcctaatcagttgtatacaagttgtatactttaactcaaataaagtatccaagaaggacacaggcaggaagccaatgaatatttcactcattgttgatcaaatataggagggatatatgtatattaaattttatttcccatttagatccttcctgtttaaataagtgcttgaggtagcaaagccatcttagtgcacacagcttgcagttctaactgtgaagagaaaggaaaaagaacaaattagtttttctacatccaagagtcatttccccagccaattaattttttggtccctaccaaaatcagcacttaagctgaagatagctagaacctgtgtaactcattcctattaacaacagcaacaaaaaaagtgaaatagatctatgaggacttcttgggaaaataacaggaaaattactttgatgatattattattcaaggtacacatatttaaaaggtgatctctaaatttcaacagagacgacagttgtttttctcctaaaagcaggctgaaacctcagcgcattctcatttagtacgtaacgtggaaaaagagttgagatcctaaagcttcgctcctaaataaagtgcagctgcttctcggagatgaaataggatgaaagcctagctgtttggggcgggaggcgagattgggggcgcggtgctggggtcttcgatgttttaccagtatttctaggtgaagcagcatattggaagtcataaatactgtcccgtggacattctgaataatgcaggagtagcgtaagtaattgggagtgcttatatccgcctttagacatttgattgctcgtgagttaaaattggttgtcaagtgcggactcagggaaccgtgcaaggtgccctattctgtcatgtggtacatatttaatgcctgaaagaacaagggaagggacacgtgcgggcgagagagggcgagcggcgagataccgcagccagctcggagctttgcaagtgcctccgacccgtaggggcgggacccacgcagccccagtatccactgccttcccccagctgcaagagtttgcaaaaacattgggcgtctcatttggcgagcgttttggcgcggacagaggccgaggccggccggggaagccggacccgggccctggcgccgccgtggcctccctttgtgcgcgcccgggtgttgattgcctccttgcacgggctgctcgctctcgcgcccgcgcgctcggggcgttctgcacctgctggcggtcgtgccaggcagcccgggcgagcgaaggcgcgcggcgcgcacgacagatgactggagtcatttacattgctagcacgtgggtgccgtttgctgttgcctcggacttctcccgtgctgtgttttcccggtgaggaaacaggaggcactttgcagccgacaatgaaatcttggcagctaattgcagtcgtgggagatgcccttcaggtacggcgagcgaagaagactctaaaacactgtcagggaaggagagaaagagggagagagggagggagggaagggagagaccaggcagcttctgcagaggcttcctgaagcccactgactccgcgggagggggttgcagagggacgggggcgggcgacagggggaggagtgtgcaaattgacatttttggctgcctgtggcagaggagcagccgtcagccgctgtccaacgttagcgcagacacggtggcggcgtgtgcgcctccggggctgctgattagaataggggacttggccgtggatggaatccgggaaacccaaaccggagatggaaggatgaggctgcgtttgcagcgcgtgaatgggacgcggtatgtaagccgagctccagctccggggacctcggagactgtgctcagggctcgccctgggtgccccgtggtgggggtggtctggacacttggagagggctagggggcgtttagagggattggggagcccggagatgcatcgattttctttacccactggaagttagtgggcaacttccttgccaatgctcattggctccgtttaactttattcccagagatgaataagcgtttattaagaaccgatgtaaaagtcccaataggctagccatggttttgcaagagatgcgcggctctggaaatgagaggtttatgaaatgaatggccagatgggttgtgcatttgcgaagttggcatgctcacgttgcaagggagcatgtgtgtgcaaatgtgagcatatgcgctgcatatctgtgtaaacatgtccaccatgctcgttgcgctggtgtactcttcatcttctctgcctgtttcccatggaagagagattaaattgacaatactgaacacgcttcgacttgagaaataagctctgtaccattttatgacatggaataagagttgccttcttctgagatcaaatgggagaaatgtgccttgccttctcaagtgatggaatgaactgttatgcatttatagaatatattatatacagagtgtcgaatgtgacatccatcagtctacaatgatcacctagcctctcaagcacagctcatccctctagcccttattttcagattatggggaaattgggggttttattatttcttttgacaaaagagctgcgttttccaccttcctacttaagagggctccaagcagaattgtgaatccaaaagttttgttggcagtgtcaccttagtaaaacgttatgaaattatttgctaaaagagtcactttctgagtgtcttcacgtagaagaatttactcattgttgacatggtttcaattttggttacacagaaatgaatgcggtttattgctgaagcaggcaaaaatgattgtgtaatcctctctttagtagggtagctgggtagtaaattgtttggcttaaaatggggacatctttctccactgtgttccctattttttgatttaaatgtgtgctggaaaatccaaagagtgtgagtaaaagggtgtttgtggcatggagtaacttgcctttgtggtttgctatgactaagtttgaagagggttgtttgttaagtaagtgaatgcaagtcaatcagcaacagctgcttgccactcaggctcacaggaatccaggcttttcatttaaaaagcaagattttccaagtcttatctgcccacacgcttcccacacgtgtgatgcctcccctctattagaatactcagaggttatgaagagggaattgttaatctgaggaatgaggtagggggacatgtagaaggagctcctccctccctctcttacccctcttctcttctctctcttggtctccctctgggtatttcttcctccttatcccattttttttcatctacgtgtatttctttccatctttctgtctttactgttttacctggtgcacagaaaccttttaggtatctttgctacactttaacatatgttttgcacgctggaggatcaccagagcctgtttttctttctttctttcaggaattctccgctcacctgcaagaattatttagtatcaggcaattccactgtacagcagtcttataaaaagtgaatattcaaacttttttatcatttctttttaaccaagcaactagactctttgaaaacacttttactatgtaaaaagagcagaatcttttctgttaccccaaattgagggtttatacgaaagtactttctgtctcatgactttattggactaagcttatttttacatttgtctcttaaaatcttatccttcaaacttctgtttttcctatcacttgtcttaattttagagtctggattcattttaatctgtatttactcagacttggtagaaataactatcagtgctgacttatgggccaggtaattgaagtacaacaaaaatagtttttcttttttgtatgatattgtgttcctttttgctcttaaaaaggaccagctaattatttttctttttttttttcctctctctactaggagtatgatacaaaagttgaaggagatctcagtaaaaggctttttttttttttttttttttttttggcattgattgccttcctataaactatagttgcaatatttggaaaatatattgtcatattttatgacactaattggtgtatatgacttttgttttgagaatccaggtacacactcctcattgttgtctttgatttgattatagacaacctgcttgaatgggccaatcttgagctaaacaaatattacaacatctagtgaagaacaaacttggtcttgttttctgtctaaatttataatttttatattagattttgagcacagttgtaatctggtgaaatgaaaagtcatctaaaagaggaagaagatatctgaactaataataaaatgattattattaattaaacttagttgtgtttagcttttagcttttattttaaaaacttcacgtgtcttagtctcaaagttatcaaagggagttggcgtaagttcttggaaagtaattctgttgggattaaaagtcctctctatgagacttcactctccatcttgtgttgattttctgacgaacataaaaagaaatgaggaaaaagcttgaacccttaattttattatttttttttttggcattttagactttactttgttatggatccaaaaactttggagtgtgttaaaatatcaaatctttgtttgcatttatgggtatgcgtttttgctctttttgttttctttcattttcatgcagggttgtgtgtttgtgtgtattatgagcagtagtcaacaggagcaaatgagaagaattttacaattatgaattctcatgcataatttgattttaattaaatcatagataatcagaatagcagtctcaaggatttaggatccctgctgaaccccctcttcttgcacggcaccaagagaaagataaaacgcctttaaaagtcagcatttaatatacagtgtttggtttggaaaccatcgcatattaaattattcagcaactataatgtcccaaacagttttcagggtgtgtttttattaagctaaataaagtttctatgaaaagttgtggggtttcagtaagttgtggggtttctgtgtgtgtgtgtgtgtgtgtgtgtgtgtgtgtgtgtacccaaaaggccgaaacagcttatgtcagctacagcaactcgtttttgattcagcaaaactaggttatgaattcaagcaattaaaaatgacagaaagcccaatttcactgcctagattaatatgcttccaatttttcctgctccataaaaatttcaaagtgttctttctgttgaggtgcttgcataacctatagggtattgggagggtctccatttcttgtttgcttatgatgtctgaatactttgatgtagcaaatgtaaataggatcagttggatatttgtaacataattttgtgcttgcaagttctcctgaaattattttggttgggtttaaaagaaaagagctgtggttagtttctaagcatttaccgatagtgaagaatctgtcggcaagctccaatgtcatgaaggccaggaaagacttttcaagaaaagatacaattatagtagaactagtgttttcagcttccaaagatggcagtgatatatgtaaaaaaaaaaaaaaaaaaaaaaaaaaaatatatatatatatatatatatatatatatatatatatatatatatatatatataaaatattatgcagtgatgggcatgtttattactttttctctattcctaaagtaatgtctggaattctagattcatgtttatctaatgagccaaatctctccctgttatttaaaatggtcctttttccttacacactaattagtagtcaaaaccagccgctttaatgatctgtagtttttggtttgttcgttaagttttctaacctggtttgaattaacttgttcacacaaagagtgtacacagacacagatatacactcaaaaagctcatctcccagcaccatttactccacgctttcaatccaatacagaaagcaacaaccaaacaaatcaaggtgcactatttgcccaatgtttgttttacagagaagacccctaaagggctgtatatgaggaaggcctctgccagcccttcctttgctcttcatggtaattctgcatctgcatttgccacagtactgtggatgtatttctttgttgtttagttgtagtctctagttgtgaggaaatcagttgttgtctgcaaagaagatgtaagtactagttggatttattgtggttagctgaatgtgtaagtacaggtcttccatttgtattaaaatgatgaggatgaggatgtgataacctgtcaacagaaacagcagtaacaatacaatgccgatttcttcccgggcacttactgactccctctgtgcatcagacattggacgaggagctcctgtgtattttctctgttcttacaactctgcaaggtaggtattaccatgcctaatttagagatggagaaacaattttcaagactttttataattagaaaaagtgattagactgcaaatttttctgattccaatatgctaagataccattgaagtttattaatctgagtttagaatttagcatttagaatctgtttacacataatgggtacttaagagatacactacgttagggtttctcaaacaggatcaatttcctcccctaacccataataatatttaacaacattttgaagacagtttttgtgtctttgcgagaggatgactccctcctgcaaaacaaaaacaaattacctggccccaaaccaacagtgccacagctgagtaattataccctaggtaatatcagtgatagtctaatataaacatggtctgatttttcaagagagggtagaaggtatgtgtacttcaattattaaacatttaaaatctctggttggatactgtgactaggatcatgatgcaaaatcagacggtccttattcccttacagtctgacactaaaattgttacagctgcttccttggaacatctttctttataaatatggcatgggtcgttgtgatttaaagtgccctatttttttccaatttacttactctttagtacgagaagtgctggaaaatgaaatttctttccttggtactcttgtcactagaagagaaatgtaacgtcactaaatgaataatggaagagcaattctaacaaccttcccatatggtccttcttttccctcagtattcaaatggcattattttcctcttatctttaaaggtttggcacataggtttattggtttatttgtttatataatattttatatttgccgagcactcttgcaaatgctttaaaatattaattcattgaatctttaagataagcctaggagattgttattgtttttatctactttttacaaagagggaacagacatccagagaagttgagtaatctgtatgagatcacacagcttctaagtggcagagctggggtttaaactccaaagtctgtgttcctagccattttctcatgtactttagtaatttgagcttctaaatgtacagaagcctaagcgttgaggcaccatcttcacccgagttttgaaacaaaagacgtttttagtctcattttggagtgcttgatgaggaaaacggacttacctgtttttgaaagagcatgagtgataatgctcacagctttatatgttgctatttaaatactcctgcagatgcacttcacctgggtcaggaggtcttgtgaattctctctaccatgaccacctccaacaacagcaaaaaagccaccaaagggaaacactaatgtacaggagggcacaatttgcaggatgagtgatctccattttatcccctacttaattgtcatgttggaaaaatagagagaaattctgcaactggatctcctaaggtgtcttcaagaaacttaagtctttgctttctgatgctcttaaaatgttctagagagccccatgtggtccatgccaggtgggtgatggtggatgtgagtacgttgactcccagcttgatctcagctaatgccaggctgtttgttgttccacatttaggccacgggaatgaccatgcctatctcagtctcagttgggtttttagtgaatagcaaatgctatgaaaagaaaaacaatttaagtatatttttaaatagaaatgccaatttgacacattttattctgctttagaagggaaaaaaagatcttgcaagtacgcaattaaatacataccagaatatccagaaaaccaagacagaagtagagagcgtcaatgaacttcagttgaataaatgagtacatggatggaacattttgtatttttcaaaatttcttgtcaagaatatgtatgggtttgtacttgaaaatgtctcacatctcgaatacaagccaccgtggtgggaaatacaggtctgacaggcgtccatttcataccagctgtcctcagcttaccaatctaaatttgtacgttacttaagtgttaggcataggtatctgcttactatttattgccctgcagaaagctcagagatgattaagcacagcttacaagtatggactgcattttacctgaggcaggacacagatttttttatacaagaaagaaagggtcacccatgaacagctcgtatctggtcatggagcaatattaaagtctcaaaaagggctgttgagctacctcctcccagcctggagacagtttaggaactgggctggaagtggaatccattactgttctttatatttcaggcccaataaactcacgtttgaacaaagagagcgaagagtgaatcccattgcagaactgtcaaaagactgatgttggatccattactgtcaaatgtccttttttaatacagttcattaaattggcttttgtggaatacctatttcatctaagtgttggttcaggaaatggtttaaaatgaaaccagaatttgttgttcagtgggaaaataaatgagatgaacccacataaccaagactacccagtaaagttctgtagatactatctattagtatgcagtactaaaatttaaattatacgtgtatatatagttatatctatagttaagctatagatatgtaacttatgtatagactagaagctacatagtctatagtctatttatatgtacatataaactatatatagatatatagttaaactatatatatagtttaattgatgaaagaaagaatgggaagttggatttaaaatagccattttaattccatatccagaagtatatggaatacttccgcatcttaaggtgagcctccttttagaaataaagataactagtgataaaccttgtatgccattaaaaagagtgtacccaacactcagtgaatttctgcccagtcttgattgtgaaattttcttaggaatctaaacatatagaagttacatcaatgttataagtggttcaggattcacattctgctgctgacagagaaagaaacctgattttgttgtaatgtactagctaattgttcagtatatagaattgcacatcattatccttcttattgatagtgtctattgagtgcctgcaataagctagacactgtactaattcccagatgtgcattattggcctgaatatttccagcagccctatgaggcagatgtgattgttatacccagggttcatgagggaaggctgaaacttgggatggtttttcaagggttaccaacagctagtgactaaaagggctgctaatcaaatttgaagctttgaggcttcgaagtccctttccccgtttttttggcccaaagctatatcaatcattgttctaacattggtgaaaaatgaatctgatgtagatgaagagatttatgtagctataggaagttcctataactctcctattaggattaaccttcttatcatcttggcaaattatgcaagtggctggatattttgggtagatgggtggatgggtagatgaatggatagatgagtagacatatagactgagtagtaatggagaagacaaattggcaaaggacatgaatataggttttggaaaaataaacataaatagcaagtatatgaaagtgtgtgtgtgtgtgcgggcgtgtgaaagtttcccttgtatatgtgaaagttttatatattgtattggaaaataatttgttgatgaaacaggcattttatatactgttagaatgtggaatagtaccttcttctgtagaggactatttgggaattcttattttgaaaaagtaggctgggcacgatggcccacgcctgtaatccaacactttgggaggccaaggaaggaggatcatgaggtcaggagttcaagaccagcctggccaacatagtggaacctcgtctctactaaaaatacaaaaatttgccaggcttggtggcaggtgcctgttagtcccagctattcaggaggctgaggcaggagaatcgctt[135 bp omitted]cctttctgcctctggaatctgtgtgatcgctgaagtttgtgaagatgcagcttggttcactgccgcattgtgaacagtcagaaggaaactggagcggaggaaatacctaagtagggtgattggaggtcaaggacccttgtaggaatgaagtggatttgcctggatgtaaaactacatctaagatgttatgagtgaggaagagcccaaaactcagaaatctgtttgaaaaactttgttagaaagcaaacatacacatgcaattgttttacatagagggcaatactgcaaaagataatgaagggactataaacagtgattatctttgttgtagctgtgcagtatgactaagagaggggcagggaagagatgaagcttttgcttttaagattacacctttattctttgtgattttcagcaaagatgccctatttggataattaaaaaatatttaagagaaaagcctccattttgcaaacaacctgtgatcactttacccctgagctgatacaggtcagcttagataccaacataggtattctgtgttggacataggcaacctaaattgcttggaaaatatatttgagccttagaaaagataaaactgaaaatcattggattcacagttatgttttggttgaggtttggggtcagtatgctctttggaatggggtggtggggtgttggaatttcctaaaaatattaaatatgtgttaacagtaatggtttgaccacagaagaaaatcaaatttccctgttgctgtacacacttgtcattcatcgccggtactgcaaaatcatgatccttatcctcccagctgtgtgtgtttgtcagggaccgtaggctgctaaaagttgtatacagtactattattttttttattcatctgtgggtcatttcatcttcctgtgcaagccacatgaatagctgtgtatgaaaattgtattttgtgccgaatttcccactgtgaaagatgtttactatatatttatgaaaacactgcagtaacaaaaccctttatatagcctttcaatttgctgtaagggcagataaaatatttttatctcaaactgaacttcataccttgggagattcagctggcctgactcagaataataaaacacttcagagaaaggcaggtgctgttcagattgcttcagaaacctgtgcacttcactcggcagatttcacttcctttaaacacgccaactgaatatacgaaagctagaaataatcagtataaactatgcaacgttaagtacaagaaatcatctttttttattaaatagtttcttaatacatctacagtagcatcagcgtgatttttaatgagtgatattttcctgtataccagaagatacagagagaaggttggcgatcattccagtgtattgaaaactttcattcctcatctgcatttaggctttggcaatgttcttaattgaaatttttacagagataaatgtagcatatgcagttgtaagaaaatatagatagatctcttgtacactattctctaatggtaatattttaccaaactgtagtatcacatcgtatcgaggatactggcatggctgcaatccactgaccttatttgaatttccctaaggttacttgcacgtatttgtgtgtatatatattgttctgtacaacttcatcgtgtgtaggtttctgtatccaccgccacaggtaaggtactgagcagttccatcctgaggttccatttgtataaccacagctatctctcgcgaccacctgcccctgttcttaacccctgtcgatcatgaatctgccttccatttgtaaaactttgttatttcaaaaatggtatataagtgagatcacagagtgcttagagttttgggatgggcttattgactcatcattccctggagttgtacctacattgttacatcagtaattttgcatggtatatatatgtaccacagcttaaccattcacctgttgaaggatatctgggttggctttgaccatcacacataaagctgtcttgaacatttgtggacaggtttttgcgtgaccgtgagtttcacttctctggcataaatgcccaggaatgggccttggagatctttgatttatgcatattatggaacacatcaatatgttgcacccattggaagtcaatgccagttgcgtacaaactgatacaaggaaaaaagaaaattgtacccacgtcttaatgtttatttttacataaacacggcactaaatgcagagaatagccagcatttatgtagcatccaccatatgccaggctgtattctaagcctgttatgtatgctaactcatttgtcctcagagcagccttatgaagtatgtactactgttcttacttatggaggaaacaccaagcacaaaatggttaagtaacttgcccaagattatacagtcatcaccacttagaggtagtcggtctggctggagaaccccgcattttaaccactaatcaatgtccccgctttcttttgtttgtttatttatttatttattttgagatgaactttcactctttcacccatgcgggagtgaagtggtggaatctcggctcattgcaacttctgcctcccggattcaagcgattcttttgccgcagcctcctgaattgctgggattataggtgcccgccaccatgcctggctaatttttgtattcttagtagagatggggtttcaccatgttttccaggctggtctcgaactcctgacctcaggtgatccaccgccccccgcccccgccttggcctccctaagtgctaatattacaggcttgagcttccgcgcctggcagacagccatctataagatgatgtccccactttcgtagatcggttggtcataacttgtgggttggctgagacagtaatattcatttagagtaaacatctattgatatcaccctgaaaagaaataataaatgaaactgggtatatagaataatcagctagctgacttcatcagcccttagctcacagctctgccttaaagcttgctttatttggccgtttcagacagatggatgcctcttatggcttttggatctccaagacgtagatttcacaaccctcccttggttacacactgtaatatttaacagctctcaatagcagtatgttctgcttttttggtgtggcccaaatctctcctatggcaaactcaacacccctcactccttcttcccacctattgaagacgtggaattgttggttgtccattgtattcacaacataaaggtatctgtttgtaacagaatattgtttggctgctttacattaatccttgagcttttcgttcctccaaaggcattttatatttccaacaggcttataaagtatttaatatttttatatgcgtcagtgtaaagccatctgttgcagtgacaggacaaaatgtggaagacaagaacaagcgtatgtttatggaaagattccatgaaatgttaacaagaaagatatgtgctactctggggtgtcttgtagaaaacggtcaggggaatttggaaaggcatggcttacagcattggtatttgtaaattagtgtttataaaaggcatgtgcactttttttttctattgtcctgcaaatttagactagattgttgacataaatggtgacagtgaccactctgaaaggaaatggtggtgtgacctaatatttggaacttccttcatttgttgttcttcattcacaggcttcaactttttccttttcatttgaacaagtggattgggaacctgctttgcggcaggcgtttgtgttgctggaatagctagattgtgtttctaaacagctagaactgtttctcagtgccttacttttaatagccgtgttgtggtcttgctcatacagaaacaatcagacgggaatcaattttgcctgcccacttgaacgtatcagtttaggcacagttatccaaagctgttgctgcattacattgcccctcgtcgaactgggctcagaaaatcaaagcaagttgccccaagcgaagacaccaatgctcttggggaaacacatcacagctaaattacagcgagtattggccgggcacggtgtctcatgcctgtaatcccagcactgtgggaggccagggtgggtggatcgcttgaggtcaggagttcgagaccagcctggccaacatggtgaaacgtcatctctactaaaaacacaaaaattggcctggtgtgatggcgggtgcctgtaatcccagctactcgggaggctgaggcaggagagtcgcttgaacccaggaggtggagattgtggtgagccgagactacgccattgcactccagcctgggcaacaagagagaaactccgtcttcggaaaaaaagacaaaaagaaaatgcactaagtatagtatctgccaagtactacgagaggcactgtgtcttggttggcttatatgaggctctcaaacctcttaggtagcataagaagtcattgtctccattttacagatgagggagcaattttagagaaggtaattaaccaaatattacattgctaacatggagtggactgggaacttggcaacaggccgactaaacccacaagcagcttgcttaaccactgtgttttgtaactgaggctggagaaagaggaggagcttgtgaggtgccttccagaccagctcttctcaggtgggcattagctgggatgtgtgggtcaaagatgcagtatgttgttgagatgtgacattgacatggagcttgatgccctccacagactttctctaaaagttcttcatttctcagctacttttcccactctgtagatagtcacttctcaaggcccagagagcacttggagaaagaagttggtgtgaactctagaagaacagctcttcaaaatgccgcaatggagcaaggacatgtggaataacctccagtataaatcctttacaccgatttttgaagtttttaaaaaaaaaaaaaaaacagagttttgctcttgtcacccaggctggactgcagtggcgcgatcttggcttactgcaacctctgcctcccaggttcaagtgattgtcctgcctcagcctcctgagtagctgagattacaggcagataccaccatgcctggctaatttttgtatttttagtagagacagggtttcaccatattagccaggctgacctcgaactcctgacctcaagtgatccacccatctcagcctcccaaagtgtaggtattacaggcgtgagtcaccactcccggccctattttatattcacaagtgtgagaaagtgcctaaaagcattcagaggttttcaatcatatttataaataaattaatcactgttacccatgtcaaaagatgacaattccaggccaggcacagtggttcatgcctgtaatcccaacactttgggaggctgaggcgggtggatcgcctaaggtcaagagtttgagaccagccttgccagcatgatgaaaccccgtctctacttaaaatgttataaaaaatagccgggcatggtggtacgtgcctgtagtcccagctacctggaaggctgaggcacgagaatcactactacctgggaggtggaggttgcagtgagccaagattgtgccactgcgctcaagcctgggtgacagagaggaactccgtctcaaaacaaaaaaaaaaaaaaggatgacaattccagatagctattcctaggttgataaaattactgagatagtagaatttagagagacttatgagcagaaatatatattgacagaagagcaaaatatcattgtatttcgttaatagaggaacaataatcaggctatctgaaagagaagacagaccagttagcttctaaatgctgttcatttatttcagtcagccttctcagaaggatattggggcttggttcagcaatcaggcccttttagacccatagattttgcctgcaggtgttcctctccaacgattagattgtgatgataggctataaacttcatgaagacagagaacaggtgagcaatatacaattagttcctagcacaatgtctgcccatattaaggacttcgataagggtttctaaagaatgtgtgatcacattggattgtcccagagtatttacaatgtattaagtcctggaaaatctaaataataattatatctataataattggataatgtttcagagtcctattgaggaaagatagtgttattcccacctgctagttcttctcctgaagccaagatatgcatggtaaaagccatggcacagttagtatctgatccctcaactaaaatactgacaccaccttctataggcttatacggcaagtagcagtatgccttggagccttctcctccaatacaccccattggcaaaaagcgacttatggttaatgcaacagtgaaaataaattattaccattctatgattgtgtgacaggttagtaattaacttatgtcaccagttggcttcgcacaactgtgtttattcagctccgtggagcacttttcagggaaaaagaaattatcagccaggcagcctttgtttactgtggaagctggatgctggtggactgcatctcctcctattgactaggaaataagttggttgttaggacatgattttccattcttcaaaatgatatggtgatgcaaggaatttgaaagctacactggaattagaaaagcataaagaaattgccttttatgcactaatcgagccattatgcctgtttcctttggggtatttttttactgtatagacaccacaaacagccatgtgtaaaaaaaaaaggtatgaaaaatcttaattaaaataaaaactgtagtatgtgtttttatcccattgtaggttaagtgggtatcacacagcctagggacaatggtattagatttgtaataagcacaagtaaagcttttcattttgattggattgggtgtatttttcatcagcatctcccgtgtgagccatgattccaagacagagtcttgtaatcttctgcagtgggaatgattcagcttaaaaatcagtagggcatgaggtatttcaagttctcattattgtaatgtgtcaacatcacttcagtgaccccagagtcctatgttggctggttttccccctgatttattgtgcaatctcgtagggcaaactataatttcacttggaatcagaaagtctccatttatggtttgtgtcccagtctccagtcattagggcattcgcgggtaatcgatacctcctcttgttgctaacagctgaatgaagttgtcacctgcttagattacaaaggagtcgggtaaaaggatgtggtaagggtgagtacattgaacaagttctgttttgagaagggctttctctgatgtttacctgccgcctcgtgaagggctttcagcattttttgggacctcctttctagaaacccttatcactgaattagcacaatgttttatttcttcttttgtgaaccgggtgtgaatgatgtcatttcctttggttaaaaaacaagttgaaggagccattcttgaaagtctgcatgctgacacattttctagaaacctttgagtcacgccaactctttttaaatacctggtcatcatgctacaattaaaagaatggtatcttctattttttcctaattggcaaaatacctaggagcttattgaggcctttagcaagaagaccatcatctgtgttcaacacaccatgcttcaaggtatacacattctattttgctgcacatggacatggatgcacgtgtgcacatacacacacacacactcagagcttctcactagaggatattcactgaccatttatatgatattgttaagtcacacaaagcacagtgactccaaattgcagctccaacacctagtacttggccaagggtgagaaggtctacacagatcaacttttgcagaaatatgattaagtcatctcaggaatgttccataatattctgaacacaatagagtcccttccctcaagaaaattaatatccagccatggaaaagagccaaggtgaagaggcaattgaagtacatggactgtaactacagaggcttaagaatggcaagaagaggcattgaactcagggtcttagaaaacttggacactgacatcaacacttgacaacatcttgactgcatgtcaagatgttgttattctcctcacaaagattataaaccaactgtgatatgtgtgcaggagaaaaatcatcgtgttttaaagttgaccttgtccattaagatcattgtcttttatctcagcccttggggagtagtttttttttttttttttttttttttaatgctgagacatcctctgtcccttgttaagttttgggttggtgttgctggaccagccatgttcctgtcttttcttcctatccttcctggcagagccccttcctcccagagctacttcagcagggtaggatggtctcactgcccatgggagtctgcccctggaccctatcctgcttgatgagttcagaggtctttctgctgagcctctttgtcttgccagttaaacattctttttttttttttttttttttatttcacttgaagttttagggtacatgtgcacaacgtgcaggtttgttacatatgtatacatgtgccatgttggtgtgctgcacccatcaactcttcatttagcattaggtatatctccaaatgctatccctcccccctccccccaccccacaacagtccccggtgtgtgatgttccccttcctgtgtccatgtgttctcactgttcaattcccacctatgagtgagaacatgtggtgtttgtttttttgtccttgcgatagtttgctaagaatgatggtttccagcttcgtccatgtccctacaaaggacatgaactcaccatttttatggctgcatagtactccatggtgtatatgtgccacattttcttaatccagtctatcattgttggacatttgggttggttccaagtctttgctattgtgaatagtgccacaataaacatacgtgtgcatgcatgtgtctttatagcagcatgatttagaatccaaacattcttatagacaagggctccttctcctgacgtttctgatctcattctaaaacattcacccagtccactgacctgtactgggcgctgtgctgggtgccaggcactgcttttccatattcttttctaaactgctaaaatgggtgattattcctccaggctctttgctgacactggggggaaattcttcttggttttcacacccctcttaggacgtgtcttccactctggctttacttgttcatagattcatgaaatcctcaacagagatccttgcaagtgctgaggagatagtggtgaacaaaatagataagatttctgcttttgtaaagtttacattcttctagggatcgtgtgtccttgatttggaatgcctgcttaggggggtcatgagggtataaccctggtttcctagtttccagggaatgggttgggtcattccttgtgtaacagaatattacccaactggaaccaaaaaattccttcagtgtcccttcaggcattggctttagctagtaggaggatgtagagaaattttgtgcttctgttatatctttctcatggggagctatgcagatccatctgtagggatctagatcggctacaatagtagtggccccagagaaagttgacatcagaacccctgatctacctggcatgccacctttaagggctttaacttcagctctgtgacgttccctaggaaaatcccaagaagaggtgtcccaaaccagtggtataagtaagagcttaggtcttgagtccatcactaaagaccttgggcaagttatttaatctctttaagtctcagtttgctcatctgtaaaataggatggcagtataacccatctactattttaaggattgtacgacattctgcacctaacaccttagcatagtacctaacacataggagattttagtaattattaactactatgagagaggtcaaggaggggagggagaggtgccatccatggtggataagttgtgctagcaagtgtttgtatgtggaacttttctattgttaactcttttacctctgctaatttttgccattaccaccggacccctatgtaggactcatctcctctagggtaaggtgccccgatggatcatgattatcagcatcctttttagacatggatgtaagatacttctttcttggcattctattctattctcgctggttctggattgaatccaaatactaactggggttatgtccgttttatagcaatgccatgttacaacttgtaaaccgtcatattatgtagccacttaaaggatgaagtaggccttaatctgatattatggaaagaagataatatcgactcagctgagatattaatgtatagatagataaatggggaaaaggatggtaaaaagtagtataatatgtatttataaagatttagacatatggatgcatggatatattctcaacagacctaagaaactatgaagagtgattattcaaagaaaggatgctgagacttcatggtaggagcatactaccaatttattatatgtgatttttttattatttgttttcataacatttttttaataaaaataacgttaaaataaatcttaagcacagcccccaaatatctatacttatctatgggcagtctttgtttatctcttttccacttctccagacgagatgggataaaggagattgtagaagcctggggagtcatagcactcttgttcttgtaacagttagcttttgctggtaacaaacaattccaatatttcgtggcttaaaaaaatcatatgtttgttcacatttccctgggtggaccatgtgggctgtgctcagcaggacatttcttctgatggtttcatctgggtttactcacaccactgaaattgaattgcctagaatgtcttgacacacatacttggtgatttgctgggttgcctcagttttcttatttgtggccttttcggcaggcttgcttaggcttggtcagcaagctaacttgagtctcagggaccccagtgcagcagtgtagcaatctctaactgaggagcatctttcatcccttccatatgttgcattttctgatgtctactggaccaaatcaagacacacagccaatcccagagtgagtgatgtctcgcgatggaggaagcttcacactcacctggaaaaggtatatgcaaatggggatgggataagtttgtggccattgtttgcatctacccaggcctctttaaggcaagccatgcactgaagggaataatgctctacgaggaggatgttccttaagccggaccttcatccctaaatcatctttggcacttgaattcaagatacatgtagtctctccctttttaagagcagccttctatttgcttatacgtatgcatctttcttatcttttattgtttcagcaccactgataattttgctttttggttcttttttgttccttcagtgaaatggcagcccagaggtaaggtagtcagtagtcatatacctctagtgacaaagaacaacccctggataaagcaccatgtatcttcagggagctgtgcaagcctgcatgatagagctagcaccaacggtgttctgacaagtatgtcgattctgagcttctccacagtccacctgttgggaatctatttgctttggattaaaggcaccagtgcatccagcttcaacttcacattcccctgcccttcaccatcagacagtttatttcagagatcatttgggatctaatgtgtttgcttttctgattctgctggcactggtgtatgcttcaccattggtttatggatgcacagagtaccggggtagtatagagtgagaaaatttgcatgagacctttgtaatgtgaaacttaattaaaagtgcagaggactcaaagtaacagggagctagaatgagggatgagtttgcctatctacattccaaacatactgagtcttatttgacacctcatgttggtagatagatgggcaagtgtgaggggtagtaggtatgacctgtcccactgccatgttttccaaaagctccttgtacatgcattgaattgcatacttgcaagctttatcttacaaaagcagaataaagtgcatcaaatcggcacttctatttaaaaaacaaagtctggccaggtgcagtggctcacgcctgtaatcccagcactttgggaggccgaggtgggtgaatcacgaggtcaggagttcaagactagcctgcccaacatggtgaaactctgtctctactaaaattacaaaaaaaaaaaaattttgtaattttttaactgggctagtggcaggtgcctgtaatcccagctacttgggaggctgaggcaagagaatcgcttgaacccaggaggcagaggttgcagtgagccaagattgtgctgctctactccatcttgggcaacagagtgacactccgtctcaataaataaataaataaaaattagaaaaataaagtctactcaaattattttttttccttcaccagacttgggggtttctgccctagttatgcagtttcttgctcagtggttggatttgaagtattccttaaagctcttgattgtcagtcacttttatgtagttgtcactttcagtatgtcacagtcaatagcagaaatgtgaagcttgtagacattcattttcaccctgatattcatcactcaattgagctttgtttatataaggaatctaaaaatgcacacatttatgattagtaaaaatggcatttgggaaaaacttttcaacaggagaatatttggaaacaaaatgctcccattacatccaggaggaatgtgaattttggaaatcccaaataaaatcagaattgaaaaatattaggtattctcgaatgcagtttttagacacacgtttactctgtgtattctcaccgtctagtacagctagacagagattatggggtcctggcttatgtttgggtatagcagagatgaggtgaaataaataaggtattgatttaatcctcaagaactctactcatttaaatggacagagaaaacagatgtacatgatacattcaaaggaaaaagtgtagtactctttggtacagactaaaaactcaagagtctaatgaaggagaaatcacatacgtaagagtggtacataagagaattccttggaggcagtggttctgataacacattcattcatttcaaatgtatccaggtcctactcagtgttggggtaaggagctggtgccactgttaaacaatgggcgaaagtgacagagaacctgttacctaggagcatacagttgagtggggtcaggagaggaggttagtgacatgggtggaagaggaaatcacatcatcacaatagcaaacctctaattactatctgagctaactgggataggtgacctaaaggaaagattcctgattctagcaaagcagttagcaaaggtgcacccttgcatatatccagacatgccctactaagaaagtggcactgagctgagagtgggaaaaatgagaaacagttaatttagaagcgaagagtcttctggacaacaggagtgggcaggtcatgtagatgccccaagtgggaggcagaagtcagtgcttctggactaagggaggaccatgtgggatgggggagagaatagagtggggaaatgtagtgacagcagccagcagggagtatggggagctggagggaagagccagacactcagatctatggggaaggcattgcagtattgaaaacagcttgggtgaaggcagaaccagggtggaaaaggcttagttggagaaacaaaaggagagggtttcgtggtcaaaggcagtgagaaagaaggctgagggaatgaaccaagactctattaaaaaagatgcgtcagggttaagtggggaccatttataaacttgggacatctatggacccacagtgtagtctagactcacctttgatgttgaatttgtcagtataaacggtaataacaatcacagtagctaatttttttttttttttttttttttttttttttttttttttttgagatggagtctcgctttgtctcccaggctggagtacagtggcttcatcttggcttaccgcaacttctgcctccaggttcaggtgattctcaggccttaccctcccaagaagctgggattacaggcaccaaccaccatgcctggctattttctgtaatttttagtagagagagggtttggccatgttggccaggctggtctcaaactcctgacctcaagtgatccacctgccttggcctcccaaagtgctggggttacagtcatgagccaccgtgcccagccttagtagtagctaatctttagtgtgggatttctttatgtcaggcagtgaacttactgtggtagagggctcatgactgcttccttttcaaccctacgctgtccatctgtgaacatttccttcaaatcctacctccaaggtacatcccaagtctccgcttctgatgttttcactgcctcagccttctgagccagcatcgttcctcacctccactgcagagatggcttcctagccagacatcccaagacctagttttaccttcctccaatccattatacacatgatagacaaaattacttaaaacataaatcaactatacacccattttcatagcagcatgtttacaataaaaaagaggtggaagcaactcaaattaaatgggtatacagaatgtggtttgtctataccatggaatattattcaaccttaaaagggaaagaaagggctgggcatggaggctaatgcctgtaatcccaacactttgtgaggctaaggcaggaggattaatagaacctaggagttggaaatcaacctgggcaacataacaagaccctatctgtacaaaaaaaaaaaaaaaaaagcctggcatagtggcacacacttgtagttccagctacccccaggctgaggtgggaggatcacttgagcccaggaggtggaggctgcagtgagctgtgattgcaccactgcactccagcctggacagaaatcctgttatatgtccaacatggatgaaccttaatggcattatgctaagagagataagatagtcacaaaaagacacatacagtatgattccacttatataaagtatctaaagtagtcaaattcataaagacagaaagtagagtggtggttagccagggctagaaggaggggggaatggggaatgggggttttgttttaatgggtagagatttcagatttgcaagataaagagttctacagatgtattgtacaaaatacacttacgttcattgcatcacttttcacaatagcaaagacatggaatcaacctaaatgcccatcaatgatagactggataaagaaaatgtggtacatatacatgatggaatactatgcagccataaaaaagaaaaagatcatgtcctttgcagggacatgaatggagctggaggtcattatccttagcaaactaatgcaggagcagaaaaccaaatactgcatgttctcacttataagtgagagctaaatgatgagaacgcatggacacatagagtgaaacaacacatcctggggccttttggagggtggaaggtggaaggagggagaggatcaggaaaaataactaatgggtactagccttattacctgggtgatggaataatctgtacaacaaaaccctatgacacaagttacctatgtaacaaacctgcacttgtccccgaacataaaacttaaaacaaaaatataatgtaagtagacttaacactcctgaactgtacacttaagaattgttaagattatgtgggttttttaaccacagtaaaaaaaaattcaaaaaaccaaaaagaaaacataattcagctaatcccttaaaaccttccaaaggtgtcctactgtgcttagaaagagagaaaaaatgactgttgtctataaggtcccgtaacatctcgtctctgcttccctcaaagacgtttcctattgctgtttcttctttacttttctcttgaacttctctctctcctgcttaccgtaaaacatggcaaggtcattccatcctttgcatctgcagttacttcatcctaaaattctctacgcctaaattcacaggatgaattacttgccatatttaaggctctgtattaaatttagagaagaaatttgccatttatattaggttgatacaaaagtaatcacggtaaaactgcgcttacttttgcaccaacctacgaatcataacaaaaaaaaaaaaataaagattcttaacactgttgttatcattaatggtattcattatctgtgcctcaggttgagacctggtttctcagtactatgtgaatgtaaagtttttattttgtaggatttaattttaatggcagttaagatcacccttcttcatggcaccatacatttggatgagattttaaaatataccactgatcttgagaaaagactgattttatttcaaaggagtaaccagattttgttgtgctttcttttgtcttaagtaacccttaacctttaatgcagagaggatcttccagtaaaatcccattatctggtaaaggtatttttggggggagctggccaacagatttaaaatggaggaatttttttcctatgcggttatttgagctccttatatattctggttattaatcccttgtcagataaattggtaacgaaaatatggtacatatacacagtggactactattcagctataaaaagaatgagatcctgtcatttgcaacaacatagatggaactggaggtcatgatgctgagtgcaataagccaggcacagaaagaggaactttgcatgttcttgcttatttgtgggagctaacacttaaaataattgaactcatggagacagaaagtagaaggatggttaccagaggccaggaaggatagtgtggaaggaagaaatggggctggttcatgggaacaaaacatagttaaaaagaacgaataagtcttagtgtttgctagcaaaacagggtgactgtagtcaaaaaaaatttaagtgtacatttttaaataagtaaaagagtataatcggattgtttgcagcacaaaagattaaatgcttaaggagatggagacccatttaccctgatgtgattattaagcattgcagatctgtaccaaaatatctcatgtaactcataaatatatacacttaccatgttctcccaaacatgaaaaatataaaattttcaaaatagaaaaaactgtaggagaagtcagatttgaggagatgtaaaataaactatatccctgataatgcaggagacgctccataagtgatgggatgtttactcaaaggcaaatgtgaagttggccaaccttagacaattggccacatgcgattcagggcaggggtggtgtctgttcctgtgattgaagcagcttcatatcaggctcctgtcttcctagggatgcttatagttactgaaagcttctgactgtaacttcctctatcctgagctctttgatgggagtcagtagagaaagagaagagtggaaacatatgtatgctctcttcctcattataaagatttatttttattagcccctttgtctcatgtggctggcattgaacagccacaccggaaccattattggattctgcaagcatctctgaaagccggcttttcagtcacctcaagttgaagtgtttttgagatttgaactgcttttgttcgtggaaggtcacatgtgatgccacagaagccaactcccagtttcccgatgccgttctgctcttgttgttgatgacacgctgagtccctgacctggctaagctccctcactaagaaagatgtgattttggtcacagaggagaccaggtgagggacagcaggcacagatgacaacacattattatcattcatttgttcactgactacccaagcaattggagtctgttggattccatgtgatggagaagtcgggaggatgaaagcctgcgtatgcctccagaggctccctaccaaatgatttttaatagtctgtatccctcccacaaacacagttggttactctactgggcaatgaagtttaaaggttggagaggctccaaatctgggcacagagaaatctcagcttaattgtcccaaactattaaaaaaaagacaacaatttgttgccagtacctggcggactgctaaaggtttttgtcatttgttaagtagtgttgcacccttagtgctgcacccttaaaaaaaaaaaaaggaaaaaaaggtatgccctctttaatacttactagtggctgactcataattttaagcatgaaagacaaggagtggatttgaaatgtggtgtgtgctgcttctgtctcccacggcagcatccaatgctgtcacgagctgttaaatgatgagttctgaggggtgtatgtttaaaagcaacattgaggttgcaagcatccaggaccattgaggtagcgtggatcagaatggcttttccacgtaagagcaggcactggataaagcccagtgtgcctcctggtgttacgctgggttggtggaaaagcctctggaaaatcccaaaagagaaagatggaggagcgaagagtgtgatactctgatactcagatgtgttggtgcccccataaaaggggttcacaggaaatagggaggaataggccagtgtgctggttcactttggcttgacacatgcaaattgcctaaaatctcttctatgctttttcttagtgtctatcatgtagcagaaatgaatccctcttggtagattgagaatatcatacgcaaaatgaagacctgggaattttcctgctctgttcctaggccctggactgacatgggagaattttaaaacatgcgcttttagaatcaaaattagttttcatgtctgcagagacaaggagcccatggaaactaccaactggcattgctgagaataattattgtcaaattgagtccattgtgaatagtcctcatacataattgccctggttagaatgagcgccaaagagggagctttaatatttactaactccctggtgaagaaagaaaccttttgctttattaaaggctgtggtgatagtaatttgctgatggaatgcattagtgacatgcactatagatggattttataagaagacattgtccagaagagattattcaaattctactagtggctttcctctttgtagaagtatctagacttgaagtcacggctttcttcttttgataatatcttgattcagtaggaaaccagtgcctgtgcagctctttgtaggagtgtctatttcataaagttcagattatgtcagtatttcataacagccaggtctttccctgagacttacccctacagggataagagaacaagcaggacatggtggcttatacctgtaatccaagccctctgagaggccaaggcaggaggatcccttgagcccaggagttcaagaccagtgtatgcaacatagtaagacctctcttctctacaaataaaatgaaaaaaaaaaaggaattcgccaggcatgatggtgcatgcctgtggtcccacttacttgggttgctgaggtcgtaggattgcttgagcccaggaggttgaggctgcagtgaaccatgatcacaccactgcattccagcctgggtaacagagcaagaccctgtatcaaaaaaaaaaaaaaaaggtaagagaaaaagagatttatgcatgtatttaatgaaaaacatacattatcattagattaataaaacttcaatcaagagtgctcaaaattcaagcctcgggtaggatagggaatgcgttgcattcaggccttggacatgtttttcttggataggtcatggagttgaggggtaagcatgggacaagtccagcatcagaccaaagaagcctaatgtagagggtctggaccaagactgggtgttgctagacattacacaagagcctctttttagtcttctgcctccaatggacacccatgactgatcctaggaaatgttacacatttccagagttctcccaagaaaatgggaatatctgtgaggctttctagttcagtccccacatgctatgaggacccttgctgtcttgtgttttggagaccgtgacgtcactgtcttgtttctgtggccacaggagagtcagtcagcaggagcaagaggatggagtagtctcattgtcttagccacagccaagcctaagctttgctctaggtcaaatgatccaatgctggcccatgaaggggagtcaactgactttattttgaaggtttttaactagagagaatgtcaactctgcattggccttctatcttttgctgttacacatgaagttttgtattgggatggaaaggagaagcagaataattttgttacgaattcctacttctcatcgatgtctccttcccactgtgaaaatacaaaatagcacatcaatcaatatggcacagtattgaagaatccaagtcagccagttctagtctggcttcaaatcccagctctaccacccattcttaagtgaaatcttaggtagctctctgagcttcagcgacttcatctgtaaactcatgagagtaagaatgcctagcatattggggcttaggtaagagtaaatgagttagtgaatgctgggcacttagcacagtggttgccacgtagcaaatgcctggcaaagggactgggctgctggtagtgattctgtcagcttctcctccttgttgtctaactttgtgcttggatagcattccttatggcctcatatctacacatcaaacttttcaggggaagagagagcacattggactcatgactctgtgtaaaagtttggagaccatgaggccgggcgcggtggctcacgtctgtaatctcatcactttgggaggtcgaggcaggcggatcacctgaggtcaggagttcgagaccagcctagccaacatggtgaaaacctgtctctactaaaaatacaaaaattagctgggcagggtggcacacgcctgtaatgacagctattcgggaggccgaggcagaagaatcacttgaacttgggaggcggaggttgtagtgagccgaaatcgcaccattgcactccagcctgggggacaagagtgagacttcgtctcaaaaacaaacaaacaaacaaaaaaaaacaaagtctggaaaccatgacatcattgtcttgtttctgtggccactgcagagccaatcagttcaagcgagagggtggagtgttctcattggtttggactaggacgcataatccaatactgtcacctgagggggcgtcaggctgaaagagatccccaagtggaaaacgggctgatgggaagaacagaaatagggaaaataaagatggaggaggctcaacacatgtccactgtgctttgcaaatggcgcatgtccaccttacagagaatcaacacctcaaggcatgaactgtgttgctctgtaagtccgtagccattggtcgtcaagaatgagcttccctgtcattaggtgaacccagaagtaatcagccctaggtgtcacgttccatccagtgctctttctgcttttgagccacttactgaaaggcttatctcccatcctttggggatgctctctgcttaaaaggatgtttagaatgccatttgtagcacacacacgtacacgggcaatcctttccacttcatcttaccatattcatctgaatctggcttcccgagagtctctgtagtatggcgtggaggcttaagagcttctgtgtctttcagagggtagaaggagattcagtcgactttcttttgcccacatgaattgatgctatgctcctttaagtgccaggtttagtcccctgctgagatcacacttacctcaactaaattatttttcatttaaaagcagccatccattcacagtcttttatttgtgtttcaatgatgtttgtaaatgtgctctagcagttgaaagtgtaggcacgtatgtgggggagcattcctgatgttcccctcaccacgcatttgtgtacccctcacatgccctttgtctgtgtctcatccatctctaacatgaccacaaaaatggtgtctcctgaagtgttcaaggatctaccctcctccatagtcatgaagtttctagtaataatggtaattattcttattgtaataaggaggaaggggtggaggagaaaaaagtgatggagaaaaatggtgtctcctgaagtgttcatggatccgccctcccttgtagtcatggagtttccaataataatgataattattttaataaggaggaaggggaggaggagaaaaaagagggagagaaaaggggagaatgaggacatgaaggaggaagagaaggagttggagaatgaaaagaaaaacaagaacaaaaacaaccagagaaataacagtgtagtattagcacatctttgacacaagcttcaataatttctgaagaagtgaaggaaggaagaaaagaatggaaggaaggaaaggagagaaggagagaagaaatgggtgtatattacaggtttacttatgtgctaagtcctgtggtcagaccttgacatttcattttctcctgtaatgttcactctggctatacaagatcagtgatttcattatttgcactttctagataaggatgctgagcaaagtggcttacttttctgtattcttcctctcctgacccatccattttatgctcagctgctaggcttgtctttgtcagacacattgcttatgccagtcttctactcaaacaaccttcagaagttcccagttgagcattacgtaaaaccaaacatatgagcctgagatttagagtcctcccattttggtcctggacatatttttcttagaatctaagacataactaatatgctgtctacccactttgggtcatacccaaatggccagttacattgttcccatgtcttcccttgagagcagacatttatgaacctctgtttaaatagaataatttttttctaaagaagcctttttatggatcaaaatccttccattattctctgtgcttacagagtcttaagtctaaataatctctttaatctgcctgccttctcttattccatttctcaaaaccctcccctgctttgacttcaggctaccccatacctccactgtgctgaactaatgttagccataaacatacttgcacctgctgtttcctttacctggaacagctccttcatccgcctgaagtctctcacccaccctaatggcctcttgggtgaatttcactctatcctttaacacctagctcaaatgtcagctttgcataattttccttgactctcctagatggaatgagtctgtgaaacctgtatttttttaggtactggtactgaaatacctgaaccctgtatttagacttcctggttttattttttattttattttattttttgagacagagtcttgctctgtatcccagagcaatggtacactccaatcccggagctggagtgcaatgatagaatcttggctcactgtaacttccgccgcccaggttcaagcagttcttctgcttcagcctcccgagtagctgggattacaggcatgtgccaccatgcctggctaatacttgtatttttagtagtgacaggattttgccatgttggccaggctagtctcgaactcctgacctcaggtgagacttcttgtctttaaattttagctctgccttctatgaaatgtgtgagtttagataagctgctatctaatcctcagtttcttcatctgtaaaatggacataggcttcaaacccatatcacatagttgtaagaaataataaaaggtgatcatggaacacttagcagtattcaacagtagcactcaacagcccctgttgttaagattattttatgttcatatgtttaaaatgtctttgtttcagaggaaaaactcctcaaacataaggcttgttaattttttataaccctagcactttgtacatgaagagtgactagttcataaaacccaacactttcatggaattgaaaaatacttttttattgaataaggcattggaagacaatctgttgattgtcaagatttcagtaacatcaccaattattcgtggtgctagttgcaagtaaaatgaaaaaatgttgttttctccattctcattgtggtttggggtaacttcgattaaaatgcatatataaaccagtaatttcaccaatagttggtagagacattgcaacacaaaacctgcccaggtgtggaggatgggcatacagtggggtattatgggaatgttgcatttgaaaaagagccccagtcttggcaccttgacatcttcctgggaaaactaaccgctttcctccacaaatatgctctgggggcagagataaagtatgaggctaggtcagaagctgtgagcataaattcctactagtgtagacatcaacataatgaatgttccttttagcctctcattccaaatatagaggtggaaggcatgtccaaggttgtgacacaggatgactggcttgttgtgggccacttgtgaccaagacatttcccagtacatgctggttcctaatttaggtccttggctcgcttctgacaagccactttatggaagggcgtgatgatatatggccttcccctgctgaacagctcgcattttgacatcacccacaattctgcatattcagtttgctctaatccagacataactgttctcccttcacctttagtattcaaggttgcatcctgatccgaatacatctgtgtttggggcaaaactggagggtcgtcaattaatcttaggcatgacagtttattactccctgaagtctctctttctccttctctgctggacagagaaacagagaattcccatttctgataccagtgtctcctgtctcccagctggcttctctttggcagcacttctccacctacactgccgaagtgggagaggatgtgaggatttatattcaaggagaatttagaaatgctttgtgtttcagagagtgctttgcctgggtgtttaatcccgtgaccatcaaacccctcgagatagtacttgatggctacaataaactggcctctttcctattgtctcttcttgattacaaaccctgtcttgcacgatggtttcaaaattatcctcctgcactttctgccacatcccttcatggccaagatttttccaagttgtaaaatatttttgcttttcttccattcgttattttattttccaattcttaaaagtacataaccagagattgtatgagaaataaatgtcttataaagtctggggccttaatacttgtggtgatgataatgagatgtcgatagtagtgatgatggtgatggtaattgtgatgatggctattttgcattttggagacatgagacccactgagttaaatgatgttcttgatgcctcattgactctgaagttcttgtctgtctttgttgaactaattcaagttggagattttccttttgtttcttttcacccctaaatgtcaccattcctgcaatggatgaaaatgtggatttgttttttaggaagtctaagtggatgagattaatagcctgccctgtggtttgttaaataaacttgataaggttttattgattaccttgagggttgtctgggccaaacaccatgtaccatttaagaaacaaacattagttaagaaaagttttcatctcacttgaggaggggaaaaaattattgcaagatacgtgatccagggaaaggacaaactgagagattcatggctcaaggctttctgtgggtgtcaagttgggggtcatggggaaagaaaaagtgcaccaatcaggggccaggtgatgaccgtgtgtcatttcaattaatgtgcttctattatacagatgggcacactgagagtcagttattttgtgtagttttctctgggtcatgtagatctgattccagttcaaaatcatgctctggcacctcctgtgctgggaaaacatcctgggaaggtgaaattcagaccacttactgcctccagctcttggggcttcttgacattgtcctagtgtttgccttaagggccacccggagtaactgccctttgaattttatctatgtatgtatctgtccatccgtccgtccgtccatccatccatccatctatctctgtctgtctgtctatccatctatctatccatctgtctgtctgtctgtgtgtctgtctatctatctatctatctatctatctatctatctatctatctatctatctgtcttcctgcagaagtagcaaacgtgccccgttcttccctggagctagcaaaagcagggatagcatttggtcagagttcagccacacacttcttttctttctggcttaccaccacctagtggggccagaaaataaagggggaaatattttctcagtgggctcccaaggactgtgagaagataaacacttaattctaactactttctcccttctcggtgagaagctgccacccatcgtatgcacaaagtggaaaggcacaaagtggaaagcttgacttgccaagccagccaaatgtctctgcagtcaagatatggggggaaccgtctgtgtaatttatctctaaaatggaattggtaatacctgccctgcctaccacactgggttgagtgaagagtgggagtgctctgtgcaccagaaagggtcaaatgaaatgagaatagtcaggtgatactattgtgttgcattgtcattgcagttaatacttccttttggagaagaaatactgtacatggggatatagccctccaccttgggaaaacccagagaatattcatttctgatggaaactgtggctgggcgcagtggctcatggctgtaatcccagcactttgggaggccaactcaggaagatcacctgaggtcaagagttggagaccaacctggccaacatgacaaaaccccgtctgcactaaaaatacaaaaattagccaggcgtggtggtacatgcctgcaattccagctactcaggaggctgaggccagagaattgcttgaacccgggaggtggaggttgcagtgagctgagatcacgctactgcactgcagtctgggtgacaagaatggaactctgtctcaaaaagataatagaagaaaactctgcgagaactaccaattacccaccacctattgtatgcccggttctgtattagcaactcagtagacactttcttatttagtgtctaaggtcttcattatctccatttcataggactgagggttagcaagatgaaaggacttaaccagaactaaggcaactgatatataccagaactgtgggtttggccccatgctcttaaccacccttctgcaatgactgagcaggtgctttgggtcagtaggcatggtattaaactatcagtctgtcttccttcctgggagagacacaaaaacattgagaactcatgggcatgtttccaccgtgcaggtgctaaggtttcttatttcgtgaccagagaccaggcacattcagtgaactgcttcattcggaggtgcttggagcttcttcatggccatcctttgcaacttggagtatgcaaacaacatttcttctctaaattaaaagcttccaaagttatgatggtatgtgctttttaaagaaaggatgtattcaaaatttaaagcgatgttgaattttgatagtattgctttgtaggttgttaaattgtggctttagacaatgagttgtttatagaactacaaaatccttgtgaggaattcagatttgtctacctttcttagagggtcctaatgaggttgtgttttaagaaatgttacatagactataaaatcctaatttttaaaacaatctggttcattgtctgaagggcctcatttaacacatagtctctgtacacttggtaaaaatcataaaatgaaattattcaacgtaactgccatatcagtgggactatttgtttataagcaaaaaaacattggttctaacttgtgaaaaaaaataattcattagaaagatatgtgggcacctttagcttgaaggggagggctgaagactatctttgaaaagggcaggacccaggacagttctgcagggcctcagcagcaggaaccctgcttagtttgatccagacacccttagaacctctaagtggcttcgtttcgatcaagtgccagtcccttgatttggttataccaagccatctgcttaattaaccccacaaagcaggtataaggaggcagagggaacttccaaaaaggactttgaagtgctattgtcaatagaaagtaggcagacgttgctgagagaaaaaaatccaataaaatttctgtgaataaccagtgttggaaagagtgtagggggggaaaaaaataattgcttcgccactagagagatgtaaattggcataaattttccgaagggtaatttgtcaatttatatcaaaacctttttacaatgtttagatcctttaatcaagcaattccacgcacaggaatagcggctgacgacaatcaggcaggtgggaagcaggcttactagaggctcaaaatggtgtttttctgtaattgtgaataaatgggagaagaaaaatacctaacaatgggtattgcttaaattatagcaaatagacattatgacagggaagcctaggctgtgctactgttgctcattggtcaaggaaaaggtgcatgcacgtttttaaagaatggatatgttaatttctgaagcccaagacatccctgtctaacattccactactaattgcatttctcctcctcatttaattttaattaaacctttccttccctctctccctcccttcctcatttcttttttctcttccttcccttccctcccctcccctcccgtcccctctcctctcctctcttctcttcctctcccctctcctcccgttttatcccctccccttcgcttttccctccctccttcctctcctctcctctccttccctcgctctctttgtctttctctctttaatcttttttccttaaaacaccagcaatcacacatgttaaggccatattatgtttcaaagaaatacttgtaggctagcttaggaattctggctaattatagccttgtttggatagccagaaaacaacaacaagaaaaaaaaattgcaaaatttctgggacttgactttagatacgctttgtaaacatgatttctatctcctgtacaactgtgattcttaaagctaaatagtgaggaatcctcatgtctaaaaatggaaggcttagagttaggactaagaaatgaagtccttatcactggcccattttaatctgtgtttgggtcttgttgaattcgagctaagggaaggggaatacttcttttgcagggctcaggaattaaaagttcagctctcacttttctcaccaaggttatcgaccagcttctacaaagccaaatatttgttttctaatgaaagtgttaggagatttggcagagtaaaaacgtccttgcatctagaaaaactggcatgtgttttctttgaatcaatttccaaagattatgcagtatcttttaatggcactctggggacccacagtgtgtgtgtgtgtgtgtgtgtgtgtgtgtgtgtgtgtgtgtcttaaaaattaggatgaacattttatgtctcccaagtagataaacctctgccctacccccagtgaagagatcataaagcacaatgttattaattcagaagtgatgggagggaatgccataattccagagatgatatttgttaaaatattgatggcttaccactttcccctgttggattaatttttacccaagctggccatttatcagaaggtacataatgccatcgtattgggaagatttttttttgaaagatatttatgaagacatcaacttcagtcaatgaaattagacagttaaaagatggcaaaatatgctttggcttagcataaggaaagcaattctggatgaagctgtttctattaatttagctgacaggaaagtgtgagggtggcttgtaaagttaaatatgacctgttcagaaaccataacttgggttggcattcagtaccggggttaatactaataaccaggttaatctttaggtacagtacctaagaaacagtgaaccataagaagggatattttggtaaaggagactgaattgtgtcttcttctgcttaacccatttttatgccttccatgtgcactgataatgcaacccaaacctttgccttgacctgcaggttttgtggggtatagccccttcctgctcacaaacttctctctctagccacactctttgtttctcttccttgatcccacctaagttcattttggactcggggacttcgctttactcctggctttgggatgttgtccaggttctttaaagaaccagctccttcttatcttttaggcatcaaagaaccattgtccatcctacataagaaaactccttcctgggagtcactagcatttaatacgtttattcatatttactgctctttaaaataatcttatgtgtttgtttgaattgttcaattgcctttttctgccaactggaacgtaggtagcatggggtgactgtctttgtcctgcttactcatctctctcttctcagcatgcagaggaatatctgataaagagcaagtacttgggaaatacctgaggagggaaggaagagaagaaggaagagacagagggagggggggttagtactggcaataagttgataaagctactagccatttggacgacagaggtgtttagatggtttggtgtggggctgaggggcatcggaagctgtgattttgattgtgtctatgaacttggcaatgttaacggtcattgaacatgggtgcacattttgtccaatgcagtgaagaactctgaaggcagctccagtctttcagtggggtgtgcccatacttgatcactatcaccctatgctaactggatgactttggtacgctacttacccttttttgaccttgcctttcagtctgtattatgagtgcatctgtcaaatcagagattttcacattctcaagattttatccaatcttcaaatacatcataagtatgtttgttttaatgtcatgaattgttcaaatctgttaaagaacttcaaaattatacattcatcagaacagccacatagccccattggttgactataaaaaagcgactattacatcctcatgaaatgccacttatttagttacattttgaaggtacaggtaagattttctttgaaaaaaatgtgccttgctaccacagttttttatatttaatttttatgagtacataataggtatagatacttatgggatgcatgagacattttgatacagggatacaatgtgtaatacacacatcatggagaatggggtcttcatccctcatgcatttatcctttgtggtataaataaatccaattacactctttattttaaaatgtacaggtaagttattattgagtatagtcaccctgttgtgctatcaaacactaggtcttattcattctatttcatgtacccattaaccacccttatttcctcccccgacactacctttcccagcctctggtaaccatccctgtactctctatctccgtgagttctatcatttttatttctagatcccacagattagtgagaatatgcactgtgtgactttctgtgcctgacttatttcacttaacacaatgatctccagttcattctgtgttgttgcaaatgactgtatctcgttcctttatatggctgaatagtactccattgtgtgcataccacacttgctgtgtgcattcatctgttgatgggcacttaggttatttccagatctttttatggcagcagtgtttaccgtagttctacaaactcactttcgaagcgtgtttgtcttccatgttacctcgttagacatcaagttcctagtaaacatttaggatgagggtaagggtaccacaaggttgtgggcacagtttttgagtttgttttgtgttaaaagggcctgtggaggattgtgtttgtgttctgggactgccataacaaagtagcacagacttctctcacatttctagaggcttaaagtctgaaatcaagatgtctgctgggccatgctccctgtgagggctctaagaaggaaacctacctggcttgtccacagcctccgttggttgtcagcatccttggcattccttggtgtgtattgtcattgccccaccttcttcctccatcacctggctccttctctgtgtgtctgagtctatgtgtctccaaatctccctctctttataaggacaccattccctggatttagggcccatcctgagccagtatgacctcatcttaactaattatatcggcaaggaccctatttccaaataaggtcacttctgagtatctgggtaaacataaattttcagaggacactcttagtacagagatcttcatgttagtgggaataggctgggttactgtttgtacaggacattccctccctccacctaaattatcaacacaaaactgtaaaacagagatatttggtcaacctgtatttattgggaattgcttgcaaacatcctgaactatagtaagtgttagaaggcaaacaagaagataagaacaattctagcttgaagaactgtgtgatgtcactgaggagcaaagtggcactcagagaaccactgcagaattatcaaatcctaaacttactggggagtatgtgatgttagagtttggagaagtgcttgatgaatttgggctggtgtagttgagtacacttctcctgagcaagagcgtgagctgagccatgaagcattggtaggaccctggagacattgagaagtgatgctataaggtatcttaaaagtcaatgaagatgtttgtgctcaagtcaggagcaaatgcatgtttcactttgttggttggtgctgctataacaaaacatcacagactgggtaatttctaaagaacagaaatttatttttcattgttctggagactgggaattttcagacttgggaaatgtcacatgaaggcaccagcaggtctggtgtctggagagaaccccgtctctacttcctagatggtgtcttgttgctgtgttcactggtgggaggaacactgtgcttttaggtggtggaaaggagggaagggctgaaaaatggtcttactattgtctccagcaattttatagggtcatgaatcccattcatgagagcttttctcccataacttaagcgcttcataaaggcaattcacaactaagtttgaacacatgaattttgaagtagacacaaacattcagaccatagcacacaggaaatgcctgtgtctgctacaagcagagaaaaaaagcaagggaactaatggtggctgaatgcgggaagtaaaggtcaagtaaaaatgaccccaagatatccagtatgagattgggaaaaatggaattaaacacttggaaatggtgttctcatcacttacatgaccaggttttcattccttggatgtgcgatagggtaagaagataaagtgagtcatggaatctttacttgaaatgcaattcaataaacatccacctcaccaaaccattctttatttcaggactggatgaattaattcgagtgtttaaaaaagagggggctcaccccaatgtttctgccaccattgagtaatagagtattgggtttcctatcgtgctgttatgattgggacaagcggagccatttgtcttttgctacatgggagaggtgttaataccaagcacatccagttatgttgtgaaaggctctgttgtaattagtctgagtcgaatcatcaatcaagagattctgcaattataagcaccagtcacactacattgctgtagaaggcggtcattcatgctacagcaatacttgtctattaggtctgaggctagatgctttatacacaatatctcatttaattcttaatgaaataccctaagagggccaggcacagtggctcatgcctgtaatcccagcactttgggaggtggaggtgggcagatcacgaggtcaggaaatcaagaccatcctggctaacatggagaaaccccgtgtctactaaaaatacaaaaaattagccgggcgtggtggtgggcacctgtagtcccagctactagggaggctgaggcaggagaatggcttgaacctgggaggcagagcttgcagcgagccgagattgcactaccacactccacccttggcaacagagcgagactctgtctcaaaaaaaaaaaaaaaaaaaaaaaaaaaaaacaaccagaaaaacagaaatactctaagaggtaggtattattactatccccatggtacataaaagatataatcacagagagattaaataaatcacccaagatcacatgcctgtgcattcacagaagagaaattcaaatctggaaatccaacttaaatctgcttttaaacgttattattagccgcctcccaaaagaatttgactatatttttccattagtctctttgtacccattgcctttctttttaaattattttatttattattcaatatgttaaaaccttttaaaacattcaaaaatataaaaagggatatagggaaaaagtaagtctcctatctacctatgatctctgactccacatttccctttccagaagtaaagacgcgttaccagtttgttttgtattttttgtattgtctgtatattttcagaaatgtgatatcttaggtatatactaagaggggtgtgtatgtgtgtgtatgtgtgtgtatcctctccttccttcctcccccaacaaagtgatttctgtacaggctacttcgtccttccccccatcacttaatgtatttttggggcttgggggtgtctatgttgccagcctgtgaaacacgtggataaatattcaagttgaatgtataatttttatggatttttggttatgtttctgtctgttcactgcctcattcaggccacttgaaacacatttttgttttattatttaggaccctctaaattgtaattgcatgcacctgcaatgatgtggaaacccccttatcttgaggactggtcttgattgtgttcaaagccacatatttaaggagactggagagcctgtggtttatcctcctgagtcagagcctgaaatcgttgaccctaaacccagagtgttttgtctctcaccttgtgggcgagttaatggttgccactccgagctgctgcctctgtagggtagggacgtgtggatgcacacagcagaggctctcataaggataaaggcctccttatgcacaattcaaaagagtgaccacacccctcagtcacgattccatgctttatccactttcttcctttgttgtcccttttcccatggcatcgctgaaccgtcatttcctattcatgtttcatgctctccttacctgtgtgttgatttgcatggatttctctatgttgaatttccttctaccttacatcctttccaccctcaaagatcaacaaaatcttgtcaccttcaggaaacctttcctgattcacccaactggaatccttccctttcttttacctaaaccttgattctgttatctttgtcttcggcacttttatcctccccccataaattgccctgctcatagtagttgctcaataaatatttgatgccaatcccatggaaataccagcatatgtgtgcatgcccttcaactctcagagacaattagacttccacttcccaaacttaggatgcctcactcattagagaattgacaagctgcctaactgtttgcacagtctccaacacattataaatatttggataagtccaccatcaatgcacagtcattgcagagccaataaaacatgaccttgactttctcctgtttgtttacatgcaccctacagcatcatctccaaaggcaacaggagcaaatggtgaacagctgggcaaaggaggtgtccttcacacgtcctatatttggaactggtggaaatagccagtatgattctgtgtcagtttaacaggatagatacgattttaaaatgacatcttcattgtgaaccagctgtgggcaggggctcatcttgatatcacttgtgctaggctttgagtagggcagagtttctcaaccactccagtattgatatttgggaccagatacttcttggttcaggggagctgtcctgtacactctacgatggttagcagcaccttgcttcaacccactaggtgacagtagcattccacaccccacctcccatccaaggccaggttgtgccaaacaaaaatgtctccaggcattcccaaatgtctcctggtggaagaaattggtgtaggggccagaggaatatttattaaatgaacaggtaaaattatccatgtttgaacattatcaatttctatttctctacatgaagaacaattaatcctccttggcaggtgtgcaagagaaacgcattttactcaatacctaattaattggttaaaaaacaaaaaaacttcttgtaaaccgcccccaaattctagctgccaccttgttatactccgaaatgtggtgaatttgtgcctccatctgttacccaatctatataacttgacatttgctaaaaagtaccctattaaagagggttgtttttattgtaaactacttttcaaataaaagcatattgcattgactgtaagttctactatgcataaaaaataatttaccctgtccaggcacggtggctcatgcctgtaatcccagcagtttgggaggtggaggcaggcagatcaagttcagaaggtggagaccagcctgaccaacttggtgataccccatctctactaaaaatacaaaaatcagttgggtgtggtggcacacacctgtaatcccggctacttgggagactgaagcaggaaaatcgcttgaacctagcaggcagaggttgcagtaagtcgacattgcaccactgcactgcagcctgggtgacagagactccatctcaaataataataataattattattaataatatattattatttatcctaaatgtaacattgagtcagctgttttcactgatagcacagctatggtatgaagtaagatactacaggtatattgaaataagaaccattagtgatttattgctaaataattgcatagactccacaacacgtacggaagaaggtgtttaaagttctacaaaacgccaagttgtagtaacacttgagaatctgaactgcatgtcttgttgatatttctttaacatttttattaaatattatccctagtttattgaacagagtcagctcagtgagatataaacatgaggtgactttttctccactcactgctcccaaattcagaattgcatattcttccccttcccctagaaataactcagatttttcaactttctggtcccttttggttattagatatagtctcaatgggtatttatgtctctgtcattttctctttcaaagtagctattttacaatgtgtttaaagtttcttttcttcccttgtcagtcagacttgtagcttccgaaaaggagacagtgtgtggtgtttttctttcctccccttcttttatcttagaatgaagagggaggattttgtatgactttggagcattttttcctttcttcttccggccctctagatctgatggagtttgggggcaggaagaagcggcaaagagtcatagctctcaagctcaacagtgtgcttgcattcctcttatttggcatggtaagcatgagtgagtttactgtcactcacatagttccagcagaaacagctgagcttgagccagtttggtgctacattccaagaggctcacctgcaagatggggagacagtgggctgtagcaacattgttgctatttgtctggtttctttgttgtaaatattcaaattctttctttctcacgatgcataactatcacagatacctcaaatagacatgcaggggcttctttgctccttgtattagtctattttcacgctgctgataaagacatacctgaaactgggtaatttacaaagaaaaagagattgaatggattcacaattccacatggctggggaggcctcacaatcatggtggaaggaggagcaagttatgtcttacatagatggtggcaggtgaagagagagagcttctgcaggggaactcccttttataaaccgtcccttccccacccccatctcatgagacttattcactatcactaaaacagcacgggaaacacctgcccccatgattcaattaccttccaccggatccctcctacaacatgtgggaattgtaagagatataattcaagatgagatttgcatagggtcacagccaaaccatatcactcctgtttcttgatttggaagatccggctccagaaaaaccccaatcacctcccttcctggtgtctgttccaaccatgcatcgcacaggccattgtcccccaccttgcaggtgagcctcttgaaatgtactagcaaactggcccaagctcagctatttctactggaactgcatgagtgacagtcaagtcacttgtgcttaccatgcccagtagtaggatccaggttgtttccctgcttcccttattcccactctgcccccggtttttcccaaattctatttttctccagcgctcagggacatctctgagacagccatcaagtttgctgtgtctgtagacttctaactggggaaagacatttcaacctccccttgttgcaggagcctctggtatttgcaggtacttcacttagcatggactcatggctttgtgggtgagctgaggagcaggtaccagagctctcagacataggatcagttttcttaagacatcttactcgttgctagattgttcctaagacctatggatgtcctgattatgattacatttaggacaggttctcatgaacgtgggaaaatggtgaaatatttttacttttcatagtttttaattttaatatcattggcttttggaaaatacctattgttttaaaacagctacctagggtttcaataaaagtggccttaatgttctattcctcagtgtacgaatgacccattctcggagcatatgttgtctagtagcccttgtcctgcctttctaggagatagagtttctcatggacccaaacagggcttcttaatggagatttataacatcaaaagggattacatgagaacaaagtaattatccttcgtgtatgagtatcaacccaatttacgaaggagtgaaattagacactgcagttaattacagggacagtctcaactttgtggaccaattagggctcattggttgcaagcaacaggaaccaattccccttctacattaagcaaaaagaatacttattagcagtagtcagtgagcttacaaaatttagaggtagttgaaaaagcagtgttggtagcatgacaggcaccaagccactgtgaggtctcctccatgggaagaaatgaattccaactaagtcttccgtccatgtatcattctgctccagttctggatcccagaagagcacatcccattggccagacttaggcaatacctccccttcttgagctcaccctggctgggagagctaagatgtcaaagaaagttcctttaggaaactctttatcttccagagtgggaaggcaaagtacccaatgtatggtcttacaaaggctgcataaaatgggggagctgtaacttctcttgggtactcttaggaaaaggaagcaccaaccagtgagcaagtgatctccattcccttttcatagagaaggtcgatttctatcctcttgcctggagggtttcagagctgccctaggctgtactccactccagggtggccctcagagaccattactgtttcctcatttcttgaatgtatggaggaccctccagttactttctgctttaaggcgatgtttattaaacattgtttctattagggctgtgctccttcctctgtaccctttaaatattcatctccctcatgctgccatccccttcatggagatcattcctgcagagcggtagtccagtttgctctacttcctggtgatcgtctcttctcgagatttcttcctgcacatgcacactctggactgtgcacttttctgctctggattcctctcctggacagttgcactggactccattcccatttgtctgagcttagggtttatgtctttttagggcatttaccgtccccactcctgtgttaccgtctctctgtgctcctagcatgtacacattgtggaatgtgagaaggcaaagatctcagactttccatgtgaattgaagacccttctctggccccttgagtgccagtgtcaccaacaccactggtcactctcctctcactttctacctgtacaaaggacagtctcccagtgtccctgtggaacattgtgattactcgaagttgtcctagctacttgggaatgagtcctaagaagattcatcttacttctgatgcatcacatgctctgtgttgcaaagcacacttggcatagccaggagcatcctaggttggcctagtgctagatggcaggcattgaaaactgtcaacaccagtacaggaacaggaaagacaaaccatggaactagatgagaccctgatactgagttgtggacagatcaactatagtgatacaggattcttgattgtctgcaacagagaacttttctaagtaacctatgcacatgataatttgatttgaatgcttttggggagaatgcagtatcatcaggaaaatttgagaacctggctcagaaaatagacaaaagggatgaaggtaccattaggatccctgggtagaaactccctgctaaggatgctgttaccagcactgtgatcactgccacgtggcaccaccagcatccatagtcctgaacacagagcagtggttctggactctacacttgacacagcctccagggatggtgcttgattgatcctgtgcttttacctagccccttaagacccaagacatatggtaacatacagagtcaagtgattttttttttttccttgaaaaagcaccagtgcaatttgaggaggaaaagcaagtcttttcaacaaataatcctggacctactggatgctggaatggaaacatttaactcagatccatgttttccatcgtagacacaaattaactgaagataggttgcagacctgactacaaaagcaaacactcgaaagcccctggaagggaacataaacatctgcctttgaaaactgagcatggtcaacattttcccagataaaacacagtacgtactaaacataaaagagaagtttgacagacttcctcaaaattaaaaactttgtcccataaaaagacattaagagaatgaaaagtcaagctgcaaggaggaaatataacaatgtatattatatatatgtgtgtatatatacacacacacatacacacatatacatacatacacaaagagctgtggctctggacttaaatattttatcaagagaaatgaaaacatatctgcacataaggcttcttcagagatgctcattgcatgtttatttgcaatggcaaaagaagaaaaaagggaaattacccaaacatccatcaataaatgaatgcataagtaagttgtatagtcactcaatgaaatgctatccagcaataaaaagaaatgaattgctgacaaggacatcagtgtgtatgtgtgtgtgtgtgtgtgtgtgcatatgcgtatgtgtataacatactcagcaagagaagttatccaccaaagagtccatgctttatggttctagttttatgaagctgacgaacaggagaaattggcctatggggatggaattcaggatagtgattgtctttcacccgctaagatgcctcttcagtttctacccaaagacttcatatatatttacctctaggctgtccacaaaatggagatgtgtgaatcatgcttttcatgccattgggaaaggacatcctgttcacagcagaggtgatacaggagcattaatcaccaaatgtttagtaaatattgatacccgggtgatttacactaatcgtcacaagaccgcaatctaccttttatataaatgcaataaaaaaatcttggttataaaagtacttgcttcctttgcattttttctgctgggggagaagcacagaatgcaaagagggagaagggaattttctaaggagatggcatttctatgcactttgactggggtactggttcatgtatatgtgtgtgttggcaaaacaccatggaactgtatacttaagatctgtgcagttcatgtaattacacatgaatgaccatgaaaagtccaatgaggcatatcctagtggtcaagcctggtcatatgtgcgcattcaacatacagaaaacttgtttggtttctgtagcaggaggtatgagctttctgcaaatacaaatggtatttgaaggaaggacagtcattcatgacacaggtctgctacagcattggattccgcatcctgcagcaaaagccaggttgggaccatggttgggatgagattccatgggaacaagccaggagtgaacaactgcagttagagtggaaaacgtgtgctggtttgtctgggactttttctgtgtgagcactcaaagtctcatgtcctgggaaaatcctctgttctaagccaactgggagagttggtcaccttctttccagccagagctctgtctaaagttacatctgatggagaaattgagggatcacactggaaaaagtgaacccagagatttactttgaagctcctctgggtatgaggtcagtgtgggataattgtcatggacgaagattcactagaagtctcacaagccctgccaccctaaatcacatcagaaaagaacccctatgcattttcttttcataccacccaacatcctaaaaccatcagcttagtgttttcactcccattccctataaactccatgtggtttgttcacatgtcaggtttattcgtcagtgtatctttagcacatgtaaatggctgtcacaaatgcttaaatgattcagtgaatgattgaatgattcaatgaatgatcccatccatcaaccgttgctccaggcttcttgtaaagaccaggatcctgacccatggacatttttgaggctttaagccacagcccttcgagcaagggctggaaggaagcctctttcatctttctctggggctatcacaaccagcatatgtgtatttaattagtcactgcctatttttatatgttacacaagctcagtttctccctctctgttctctttttctcaatagtggcaatgtagattttttaaagtttatttttcagtttcttcccttttcctgcagtctccctctagagatgacactgactttaaactttgacccactaagatgcctctttagtttctatccaacgacttcatatatatctatctctaggctatccacaaaatggagatgtgtgattcatgcttttcatgcctttgggaatggacatcttgttcatagcagaggtgatacaggagtattaattaccaatgcttagtaagtattgatacccaggtgatttacacaaatcatcacaagaccacaatcatcacaagactacagtctacctcttgtataaatgcaacccaaaaatcttgaattataaacttacttgcttccttggacttcagataaatctctagtatcctcaagagtctttgaatactttcctgtctccagcaaatctcgtgggaaggaaaaaaatagatatcactttgcaatttatgtttttaccagcatgcaattgagtagattcaattgactccaaatgttttgcacattctaatttctgtcccctattgtcctcccctgttgacttcaagttaatgcataatatgatatgggacatccctcataaattccgtatcatcagagtaatgtggctttgatgatgtactgcattttaaattagctctgtcacaaaaggacgatggggggcccaggaggttttttttttctttctaattttccttctgttcttgaagtgtgataagtctaattatagttggcagcaaacagaagtgtttcttcagctagtatggcttgtgagggttcttggattgctatgatatcttcagatttttatagtaggtgtcttagacccaacaagtcaagatggcttctaagtggaaaggttttaaaagattaaagagagattaacaatacaagaagttagtaacattgatctgtcatggccaagttcagtggtgcattcctgtggcttattttactcatgggaattaaataatgataacattttcagaatcttagaataatttggagaagaggatatgacatatctaaattatgtgtatacaaagtaatttttgtttcttctaatactctactagtctaaggggattccttcctatccattgtcttttctggggaaagaaaccaaatgtacagtcctacgtacggtaggaagaatagctatagctcctctcagctctggtataggaaacatgctctaatgaattttccttccagcgttccataccagtgtttctcaagcttttagtgagcacagggatctttccaggaatcttcctacaatgcatattctgtttcgtaggtctgggtggagcctgagattcggcacttctaataagcttccaggtgttgttcctgatgccggttcgtgcaccagaatatgaacagcaatattttatagggtgttaagcaacagaaatgtatttgtacgtggatgtctctgcaatagaattgcatccagaggagaaatgaaatagcttacaattatggatgaattgtgtaggtattcatatagaatagctaacataaatggagccatgcgtgtattatttaacactcacaacagtatagatagacacagtgcttatctccatgacagagttgaggggctataagcttacagatgtttagtgatgtgatcgagttgctgagctaacactcagtggagtttgaacccaggcagtatgatttcagagaccacgctgaagtatctgtactgctcatggactgttgccctgaaatgcagtttatttgtctgaagtgtaatgtctggagttttttgcatcttcatcattataaacctcttacaaatattaattgagttccttaggccattccttaaggttttatagcagataagagaagataatgtggttccaactgaagaccaccaaatagtgctcactggtagctgaaattcaggaaatgatttacatatccagcaggagtgattttctttatatatagaaaaatatatttaaattgagttaaatcattatctgtagtaattatagctgaatggaagaaccggcctaaagagcaagatttttttttttaataaaaaggatatcctaggaactctacagtgatttgcagattaattctatctttgtttatatttctactttcaaacttttttattcaggtaaaattcacataatataaaatacagatacataatataaaattatataaatataaaattatgtgaattgtaaactgtacaattcaaggacattagattcacaatgctgtgcaatgattacctccaataagcatgtggaaatatgctcaacaccattagtcattagagaaatgcaaatcaggccaggcatggaggctcatacctgtaatcccagtacttgggaggccaaggcaggaagagtccttgaacacaagagttttataccagcctgggcagcacagggagacctcatctctacagaaaataaaaataaattagctgagtgtggtggcacacatctgtggtcccagctacttgggtggctgaggtgggaggatcacttgagcctgtgaggccgaggctgcagtgagtggtgattgcgctactgcactctagcctgggcaacagagcaaatctgtatctcaaaacaaaaaagcaaaaaatgcatatgaaaatcatgaggagacatcatgccacacccactaggatgacaagtaataataatagtaataacagaaggtaacaaatgttgtccaggctgtggagaaactgaaattctcaaatattgctggttggattgcagaatggcacacctgctgtagaaaacggtttgggagttaaaccaaggtaaacacagaattctcactaacttttgacgactgaatgtgtttgcctttttccagctgttggttgttttttttcatggcttcttccagggcctctgtcttgtttgctaatatgcggttctttgtcctgtatccattcagtagccaatgtaaaatggtgccaaacttactattttagattgaagggattagctcctctttccagtgattttaccattgtctgttcttagctggtgccaggttggaaagggaagagttgttggctggtttgttggtgtttttacctccaggtactgtgtcattccaatgttatttttactgtctcatgtggagtgtcctatatgatttgaataaaagtcccactccattgctgtctctgcaaggctgactcctttgaccctggcagaaagaacagttgatgatatttggtgaaaaaaaaaaagaaaatttgcccatggtatgactgttcttctccttggcgggaaacttctacttgaatcattgtgcagtatgatggaggcacttataggtttaaaccctaattatgccacttggtagtgtgtataagcatgggcaggtccttcaatttccttgtgcctctgttttcccaaataaatcatggaatagtacttacagaaatggctaatgattaaataagataatgcaggaaagcatttagcgtagcatctggcacacagcagcactccacatcaacgctggctgttattgtattattatcatggttacttctgtcctagtttttactctattacatagtttgggtctatttgcacaatatacttctttaaaacacacacgtacagtcaggtgcagtggctcacacctataatcccagcacattgggaggctgaggcaggcagatcacctaaggtcgggagttcaagaccagcctgccctacatggtggaaccccatctctactaaaaatacaaaaattagccatgcctggtggccagcacctgtagtcccagctccacgggaggctgaggcaggagaattgcttgaacctgggaaatggaggttgcagtgagctgagatcgtgccactgcactccagcctaggcggcagactgaggctgcatctcaaaacacagacacacacacacacacacacacacacacacagactttagaattatctcattgtcttcctacaagctgtctttttgcttctgcatgaacttttaaaccttctccaccaaggcaaggtaactttaaatggttttccccacagatagccagccaatgaaaaaattaccaatgtcttaacagaaaggaactttgttactttcaggtatacacagcaaccctgcagttcaacagtctctgtcctgggtagggcctcacgtgacttgactttgatgaaatagagaagcaggctgccctctgtcagttgaagaacccatgtttttagcataatgacctgattctgtatgtggcttggggaatcctatttgtgaatctgaggtctatctttatgttaatgattcttcattactttaacattcttgaaagtaggttttggccttagaatttgtgcaattctccctcaattgttctttattcgtagatagccatcatataagctggctggctgtaaaaaaaaaaaactcaactcaggcctagcgtggtggctcacacttgtaatcccagcactttgggaggctgagctgggtgggttacaaggtcaggagatcgagactatcctggccaacatggtaaaaccccatctctactaaaaatacaaaaattagccaggtgtggtggcatgcgcatgtagtcctagctactcaggaggctgaggcaggaaaatcgcttgaacctgggaggccgaggttgcagtgagccgagattgcaccactgtactccagtctgggcaacagagcgagactctgtctcaaaaaaaaaaaaaaaaaaaaaaaaaaacctcaagtcagtctctgtacagacgtttcaagaatgcctaatctgtggtgtctgtgttgacaaattcttatacaatgctttaaacatattcagattttaaattttattaacttacctaattattcacttaaagtaactctttaaaaagactggcttatcttactctagctgtacttttttttgctagtgaaactaccagtggattactttatctcagattgtattcatcatatttctccattataaatccgttaaaatgtcgtttctctgacttcttggagttgaggtctgggattatctgctatcagaggaaattcctgccagaaccccctagacatttccacattgcaaagcagcacgaagagcaagcatgagtgaatcaagttcttatataaagagggatcctaggataatgctacttttagagatggaaaagctctaagatatttccaagtaaaagaaacctgtgtttcagagagggaaaataacctgagtgttcacagtgagttggtagtaggacacagatgagaactctttcattctatgcggtaatggctctaggtcctcctgtcttaggctctgaagggagacagactgtagtctctcctggaatagcccgggaaggaactttgacatgaagatattcaacctcccaatggtagaaataggtgactctggcattcattcattcatgtaacaagtatttatggagcacttacccaatgccagacactgttctaaacagaggttatggcagtgagcagcactggacagttccctgctcacatggagttggtcacagtgcagggatcagacagtgaataggtaagtcagtgatctgccgagaaagatgacaacagtgtcacatcagggtgacgtagtagtacctgagatagggcatagtgaatggaatattttttctaagcgcaatggaaagtcactgtagagttttaaatagaggagggataggatatgacttatgttttaaaaatctcagtgacacctaggtggaaatttaattgtaggaagagcaagaatatcaattctgggcaaatgctgtaggtcagagatgatggtagctgctaagatagtagctgtgggcaggagctaatgatagaggaaggatactggacataaatatgaggactagaccctagacttagtggaagaggtgagcgaaaaagacttacaaacaactttaatggttcagcttgagcatctgaacagattaacccaaagagtttacatcaggctctgtgcagcaggtagtgttcactgctttagtgttcattgatttacatctccccctttttttttttaattaaagagattaggtctcactctgtcacccttgctggagtgcagtagaatgatcatagctcactgcagcctcaaacctcccatctcagcctcccgagtagctgggactacaggtgtgcaccatcacacagagataacttttttttctttagagacaggctattgctatgttgcccagcctcgtctcaaactcctggcctcaagtgatcttcctgcgtctgcctctcaaagtgctgggattacaggtgtgagctactttgccccaccaacatctattttaaaaataatcttgagatctataagccattcctgaccagaggtcagatacttatctgtttcttttctctttcttgagtagcacctcacacagggctggattgtggggtgttctaaatgcaggggtgaggcaggtgtactggagggttttaccccatgtgtgctttcctctgagctcaacaactgcagctaagaaaggtgtctcagtggataatcgcatgatccactgccctgtgtgggaccatagtcttttttttttttttttttttttttgagcaggagtcttgctctgtcacccaggctggagtgcagtggccttttctcggctcactgcaagctccgcctcctgggttcacgccattctcctgcctcagcctggcaagtagctgggaccacaggcgcccgccaccatgcctggcggctaattttttgtatttttagtagagacggggtttcactgtgttagccaggatggtgttgatctcctgacctcgtgatctgcctgcctcggcccccagaagtgctgggattacaggtgtgaaccactgcgcccggccgggaccacagtcttaagacgctggctctgccttcctgggtgccacagttaccatcttttgtaagtctgtaaacttcattggcctggcattgacttcctctgggtacattagtggggaccacaccgtgctgagtcacagttagaaggggcgtctgtcttcacagtgcggcatcactcttatcctggatgccctactctttatcattcctcctcctctcactctccctccccagggccacactatcgtttggcagtaatcacatccaagccaattttgatcaatagttttgttcatttcaaatggaaataagctccgtgtttagcagataaggagagttacactcaaaatgtggcacatttgtaccccatcccttaggtggaacatggcaggattcttcaggagggaagaggatgcactaggcttaatgtttaacattctttggatggcgtctcctccatgccaccgttagctgtgagctcagcaactctgggaattggaacagttgcccctccttgagactctttactgcttgtgacttgacacaatggaagggcagatttccactgagtctctactcggtggcttctcaaagacttccactgagactctgcgcacctttattgggttggcctgattcaagcctgcttgcagaggcattttctttcttgactctgacatgtggctcagtttgggaacccacttgttccctctctgagatctttccgcctgcattttgggctttgcgctttttataccttactgtggctccaagaaggcctttactgctgctttgggttgttttgctgttgttttgttttccacttagatgccctcccggtctggaagatttttgcctggttggaaagaggcaccttggcaggggaggagagaggagaacctacgggattatgtggaagtctttccccgaggttcacaccgaagcatcttagaagggttagaatctctttctaaacacttagtaagacacgttttctgaagtgtcactacagagtctaccctggcagaagaagccacatctttccagatacacctgcatgaaaaaaaccaaaagaagaagaaggggaacccaggaaggataacacgagatagaaaggccatcttggcatttggggaataaaaagtataagggcattttgcttttaaatctaagaaaggtataaagaggagaaatgttgaaaagcaccttgtctctggtttcttatgtttgccaaatattagcaagtacctgagatgctcttctaggtgtctgtcttgtgtgccatctggcccatgagctgtttgagatgggagagtatcttatctgtctttgcatccccagcaccagtagattgaaccgagtaacttccacggtgctcatcccaggggcaacaggccctgttgaacaggcattcactttatggtacttggaccacacttggtggggaaagaggtacttcttggccaccacaggtgtggttgcaagaaattagcctcataactttgaatggattcaaatcaagcatatctagagcatagcagaagtgtcatcaatggtggaaaaccaccttttcccctcttgcaatctgaggaacacctggcaaacatttccacctaaattagttcttggcttcactggtccagcttagttgaacggatgttctgggaggcactgtaatttcctgttttgtaggatctcataggaaatttttcatgtgaattcaactctgatctcttcattattgattatatgcaactcttggtattgttttctcttagcattcgatcgtattgattcaaatgctgttttcattaacttcatgggtgcatataagagactggatggatttgaggatcataacttcagtttcgctgactgcgtatccaccccatactaactgtgggactctatataagtttgtcttttcaaacctcagtttccttgtttgtcacatggagatgataacactcctctctcaaagatattgtgaaaattgaatgatgctgagcacgtagattagtcagcgaagggtacccacgaccagtgatattatgatggggcttgatccaagttggaatccgttacctttgcccagtaccattgtttgcacatgtctgctttttatgattattagttaagagtttattttcttacagaggattaggcaaagggtgattaagcataggttattcagtttaaactaataaatcttttttttataggctgaccatctgtcagggaagtggcagaaggcattccaataggactgagttgaattaaattgggagataaaagtaataacaatggctttcctccaaatgatatctaaaaatccgcgtactttttccctagcgccatttttgccactttaatccaaactacccgcatctggactacaagcctcctaactggtctccctcttttccttgccttcagatccaatctttttgtaataggttgatccttttaatattcaaaacaggttacctttccccatcttttccccctcctggccttcaataaaaacccaaacgtaaaataaaaacggataacttggcctgtaatcccagtttcatctggcctcttgcctttctctccaacccctctctctctttctctccaggccatcattcttagggctttcaacaccctgtcctccatgtcatttctgttgcagccttggagacgtgtgcctctccttctgccagaggatgcctcctgtcgtggtcacttggcaaggtccactcttatgtcacatctcggtttagactctgcagaaacgcaattcccaacccctccgataactactctccaccccaaagatctcactgtactaattgcagatttattgatgtggtgcttgttaagttactcaccatggtgtccccagaacccatgttagtggcattgctgaataaaaggtgcttcaaactacgaagggcttataatgtgcattttcccacttgaggctgatggcatctttgtgaggaaggcatatagtggacagcctcaaagctataggagagtaatctaaagcccactctggtgaaaacttggaaatgttaagaatagggtttgaatcccaggtgtctgatgccaggcctaaagctctttcaacttgagtactgcacgtgctagatagtctctgtgtactgttgtctaaaacagggatttgcaatcttttggcttctctgggccactttggaagaagaagaattgtcttgggctctaaataaaatacacaaacactaacaatagctgatgaactattaaaaaatcacagaaaaagattataatgttttaagaaagtttatgaatttgtgttaggctacattcaaaggcatcttgggccacatgtgacctgtgggccatgggttggacaagcttggcctaaaaacgtattgtttgtctaggtagggtcatgattcatgaagctattgagcaagcattttcatggcactcatatcgcctgtcagactttgtcccaagtgcattgtaagctcttccttgcctaatctgcacaaagaccttgtaagatagggtattagttagtatcacaaactgggtggctaaaaatgacagacatttattgcctcaccattctgggccaaggagcccaaagtcagggtgtcagctgggtcatgctccctctgaaacctgtaagggaattctgccttgcttcttttgactcctggagtaatggcactctctggcatattgtgattggcagctccatagcacctctgtctgcttctactttcatgtggcattctccctggctcttttcacatcatcttccttctgtctgtgtctgtctttgtgtccacatttctccttcttataaggacacatccaccttactgacctcatcttaatttgattcctttctgtagattctttttgcaaacaaggtcacattaccaggtacctgaggttaagggtttatctgtctttttgaggggacatgatttaacccctagcggatacatatcctattccattttcacaaatggggtcataggctccataataggaccaaagattctgagcttgccattggcaatgacaagttcaaacacagatcatgcctccgaagtccatgcttggtttgtggaccacacagttttcaaacccttaaatcaaagtgtggtccgtagattcaattaactttcaaaaagtgaagtagggctctttttcttgactcaaagtgagcttagccaggagaggcagatttttaaagtgcctgagcatgcgtattattactagctttgcctgctgaagcagaaatgtgttcttcccctgcccaactctattgcattgagaataaagtatctggcgctcttttactaagatgcaagccattcttcattttaattggtggggaaacgtttattataaaatgctcttcccccagaatagttccctaaagtggcatatagtatctgttttttcttcctcctctttcttcctgggaatcattaccagccccggctggtgatttataatcacattcccaacaaatttcactgttgttaatgactacttattttctatacaaatgatttttgctctccttcctgaggataattaactaagaaactggtaataaattactgataatgatcagtttgtcagagatgattgtcgaatggtgccatcttccatagtaactagataaagtatctttaattgctgataacagaacagacaaattgtggttcttttttttgttgttgttgttattgagatattcatgaaatcttcctcctggaagtcaggcagaataacaccttttttctctgtctcctgagggaggggaaaaggaagaaacagtcatgacttacagacttctagaaatatagtaaatgtgatcgctttttgaggtttgtaataagatagctgatctttgtaaagcagagatcagagaaaatctactctgggatacatttcgtttagaccaggggtccttcctggtcatgtgtgatttttttttttctctcaaaatgtcatctttcctatttgcatctaaaccttggccttcaaatgtgacttctttgaactctggaaaggaatagtatttaattcacagtgtttctcacggttaggatgctgactaaaccccagactgcaagcgaggctgtgaaagacccttagctgggaaacgtagagaagacctatgacaatggatgtacactgaaagtcctttaatcatagcccttattatctattttcttattgacaagctcagactattcatcgtagtaagaattgcaggacctactattaacttcagttctttgaaggatacacatatttcacatactgaaggctggtttacatttaatccagttaaatgtgtcactttactgacatgccttgaatattgtgagtcttgggtattgccatcctttatttataatctccatcagtcttgtaaacttttgttttgttttgctagatgtcagcaactgtcaaaaaagctatagtgtccgagatcatttgaatcattttggcagtttagaaaacagagtggtgcttaaaagaatagaaatgagaattccaaaggcggaggtctcaatatcaaattgttggggggtatgtagtgtctctttgggctttttaggttttgttatgagaagggaaggcacaaccagcatagaattagaatgtacaaggttacaaggatgtttacacactgatttcttcagaatttcttcagttccaagtgaaaaaagaaatttttttaagtttcaagtaagctctccaggtagtcacagggatgacaaagatacaaataaaacacgaataaactttcaaataagctgaaggaaaaaagaattaaattatagaactgggaagcacacggggtagacttcaggcgcggttgagtcagaagatttcacgatgtcgcaagaactctgattctctcagatctgcttcctctcttggtaccaggcatcgttaggtttcttccacacgtagtcttcgagaagttagcatccttggctgggtgcagtggcttgcgcctgtaatcctagcactttgggaggccaaggtgtgtggatcacttgaggtcaggagttggagaccagcctggccaacatggcgaaaccccatctctactaaaagtacaaaaattagctgggcatggtggcggcgcctgtaatcccaggtactcaagtggctgaggcaggagattcacttgaaccctggaggtggaggttgcagtgagctgagatcatgccactgcactccagcctgggcaacagagcaagactctgtccccaaaaaagggaggagggaagaggaggcggggaggaaagagaaggaagaggggaggaaggaggaggaggagggaaggaggagggggggggaaggaggaggaggggaggtgggaggaggaggaggggaaaagggaggaggaggggaggagggaggaagaggggaggagggagtaggaggagggaggaggaggagaggagggaggaggaggagggaggagtaggagggaggagggaaaaggaggaggggaggagggaggaggaggggtggaggaggaggggaggagggaaggaggaggaggggaaaaaggaggggacgagggagggaggaggaggagggaggaggaggaggaggggaggagggaggaggaggagggaggagggaaaaggaagtggggaggagggaggaggaggggaagaggaagaggaggaggggaagaggaggaggagaggagggaggaggaggaggggaggaggaggatgggaggaggggaggaagggaggaaggaggaggaaagcattcacttgaagatactgcagcaaattgtagggaaggctttgattggctaatttgagtcatgtgcctacttctgagcaaatccctagacgatagggctggagtcttctgagtggctggtctccagcctcatgacctacagagtaaggtaagaatgaggggaatacagctctgactaaatgaaataggcagatgtagaatggggcaagggtggttttccaaagtaaaagattttaggtcgatcctaaaacaaaaggaaacacaagcacacagtagtagagagaccttctcatggacccttacgtactttgactactacccagctcagtttgctctgcttaccagttcacagatgctttctttggctggctttgcttttacagtggattttctgacactttttgaacattgtctaagaggggtgacagtttcaaatccacccaagaagtggacaccattccatactttatgactgaatctaaaatgctgttcacttgtgcctccagctgaaacatttttctcttcgctctgtttggagtccctctccctcccctctctctatctctcactgttcttcatggtacacttcttttttgggggttggcggggggacagagtcttactctgtcgcccagactggagtgtagtggcgtgatctcagctcactgcaacctccgcctcccaggttcaacaattctcttgcctcaaccttccaaacagctgggtctacaggtgtgtgccaccaggcccagctaatttttatattttcattacagacaagccttcaccatgttgaccaggctggtctccagttcatggcctccaattcgtggcctcaagtgatctgttcacctaggcctcccaaagtgctgggattataggcgtctgccaccatgcccacctaattttcgtgttttcagtagagacggggtttcatgatgttgaccaagctggtgttggactcctgacctcaagtgatgcacctgcctcagcctcccaaagtgctgggattacaggcatgtgccactgtgcccagccttcatggcacacttctaattctttccttcttcatgagctttttccagcatgagccaaaatcaatttcttcttctgcatccccactgaaattgttatacttcataaaatactttgtacctacttcagttttagtttctaagaatttatgtctttcttgagaaacagagtactgttttgtgattcttgcttcggcacttcacattgattagaacaatgcctggccctaaatagatatttaattctggtgagttcttcccagacaagtctaaaggagggtgtgaatactcgggcaactcaagttatcatcatttgggtctggctgtgttcacttatgggaatacaagtgtgggcattaatagtttggaggagcacaggagaacagtgagctgactgcagaggaggagatggattttgtttctcttgggggccccaggaattttgcctcctggacccattttatgtgataatggctctgcgttttgggttacagagctcaactctctgagattaacacaaagcaaagggcttccctgtatgtctatatagatctagcccaactcaggataagcagcttctcactaattcagcaaatgttgtgtagcatcagctatgtgttggacacatgtaatgagtaaatacatatgtgactgctgccctcatggttggagctttgctactgggatggtctagtctggggctgcctcttattaccagcggcatctcagactagttattcaacaactgtgtgcctaaattttcctgcctgtaaaatgggaataaagagatacttcacagagctattgtgaaaactaaaggatcgtataattttacgctgtctaacataagtaaccatttagcaaatgacagctattacttgtagctattggctcatgaagtctgcaggctggtagcacacacattcatcaagtgataatatttaaaatgtaaattatgacataattgatctgaaggggaggtgcttggtgttaagaacacttaaaataaggaattctgtaaaagcttgcctgggaatgtgtagctaatatagctacagataagactattaaaagattagagccaaaatgaataatgtatccatgtctgatgattgataataaggcagcagttgtggacagctgagatggtccttttccaaccgggacgtcagagctactgtgattatcatgccaattacatctcacattctgccaaggtggttcttctctctcagtgcgttggtcatttcagagtgggaaaagccttcagctcagtgtccttcaggatccagtctactctttaaatttttgagagttatttggatttcagaaggatttgcctctcatcttctagtcatatcccattaccagtcaattcagaacatctattagttcagcaggagaggaaaggatgaatttccatgcctcccacctttgcttggtaacaggttatgcttttagaaatcacttcatgacctactgcttcctgctgggacaataatgttcttgtgtgtggctaagctatgcccacatttttaaaagttggaacacatctagtaaatatacatacctttgaaagtcctcatttaagctgaattagaccagtgaatagagtaataatgaaagtatttgaaggagggcaaccccttttctttaaaaggaaagagaataactaatatcaggaaaccaatcataccagtgaatcagagcccagttttggggactgaaagactcagggtgaaattgctgtgactccttgggctagtctctgtagttctcagaaactcagtaatgtcatctgtaaaatggaataataatgcccaattcatgtgtttgtagtgaagattgaaggagatactacctgcaaagtattcagatgtttgcctggtctatggtaattgccgaataaatgttacctgttatcccagtgttgtgtgcattgatggcaatgataaacaacaatacttgaggaattttgaggtttgattcatcattcttttaccttctgaaatttggcatccttggaaaatggaaaaagaaacaaaatttgtatattccttttgttgcagaaatgggtaattatgtgatatacacatacatatgtgtgtacattttataccaaaaattatatagaaaatgtacacacatataaatacacatacaattatatgtggtatgtatgaatgtattatgtgtaagatatatattataaatatataatatagagtatgtctggcagtatattctgttttgtgttatacataatataacaaaatgtatgttattagattacatagatttctggtatctatgttacaatcttttctaattaaaaattttttaaaaagtatctaaagaaaaagcatcagctgccccctgcaagttctctgaggactggcttttattattatttgttttgacacttcagtggcagcaacttccagttacagccagagtctcagtatgtaatcccgtggaaacgtccctaggtaacaggatgtgcccactggtcatggaagtcagttctgttaaacagggaggattttatctgtctgaataaatatttctgcagctcttctcacgctatggatttgagatgtgaacaggcaagaagggtcatcactataaatcaatagtttccatgaagttgccaccgatttagagcagacagcagcttttgggttgaaataaagatcgtgaagtgcagacgtaggcagcaaatgctggggataatgtgtggagtgtataggactattcagtgaacgtctatcaaggatggatagaaaggagaatgctctttttgagataagttagctaatcgataattggcaagggaaacatggaaatacttggtggaaattgatgccacctacaccaatccacacaagtacatgcacctcaaacctaccacccaatatccaattgtcaccaagtctatctaatcacatcttactcacctttgtgctactcacaagttgccatggaggtgagagtagacgcggtggggatggacgatctctctcaggacaggatgatagaaaaggaagaaaagaagatttgttttaaggatgggccacttctatgaatggttggaagaatggaggagagaaggacagcaaaaggtgataggagaggtggcaggtgaaccagggagggacagtttcctaaagggtagaaggaatttcatggagacagcaacccgtggatggtgccaaatctcatcatgaattgacaagagtccttggacttaccttcctgggagtcggttttatagattttgcacaactttgtacctaaatcattcccaacaattaagtgtgagttcccagagggcaggtaccagggtttattcattttggaaaccccagggtctggcagacatattagggatgaataaatgtgttttgaaagtatgaatgaatgaatgaatggataaataagtgctggccttaacataacagtttaatgtctgtgcaaaatgaaaataacaaagtgttaaagaagtaattagaaattggcaaaatggggcacaagaaaccatcttacatatgtggtagctctaggggtttaagaaataacatccctttatttccctactgagtaagaaccaatggagaaagaagctgggcaggaaggcaaaaggaaataaacaatcttctttcatttagcctaatgtttttaaggttctgctcccatccccgtgaagtgttgggaataggcaagtctatagagatgcgaagtagattagtaattgcctagggatggagcgtggactgcaaatgtgcacgaggcttccctcccggggtaataaaaaaaaagttctaaaattaaattgtggtgataatggcaccactgtgtgaatatactgaaagctactgaatcgtgtaccctgaattagtgaattttatggtttatgaactctatctcaataaaactggttttctaaacaagaaaacaaaaaggtttccgcttattaaataaacccaaatttaaaggtatggccgaatgggcttgcttgtactctcctgatttgtgcagacttgtccatcagtcactgaaagtgtggaaatcttcagtccatcctctggcctccagtagacacagacacacacacacacacacacacacacacacacagacacacacacaaaggtacacagacacacacacagacacacacagataaacacacagacacacagacacacacagactctccctctcactctcgctctgtcgctctctctctcactcatgagtgctgtagctgagaaagaagcccagagtatgctttttctgccagctggagaatttgacctagggctaagtgactagcctgagtacatccaggttcttttcccaaaggaaccaatttgataaaccattccttcttagcatggaggaatgagaagctggggagaggcccagaatattatgctagaaaaattcttgcacatggaaacacagggaaggaggataagggggtgcctccattcttatgtctcatactttttatgtccagtagtgtctgcatttctatcataaatactcttttaaaatcaggagtcctagaccagagaatgttccctgcattccatatcaggtaagatccaagtatacaaagcctgtctctttaattaatttcctttcacccaaatcctatccattgggcatgatcaatagttataaaacccatcatttccagtgttatggtaatgcgaaagcttgatgaaatatgggtttgaccacacagtagtcagaagtctagttcttcatgtattaaaggataccattccagctgggcacggtggctcacacctgtaatcccagcactttgggaggcggagacaggcggatcacgaggtcaggagatcgagaccatcctggctaacacagtgaaaccccgtctctactaaaaaatacaaaaaattagccgggcgtggtggcgggcgcctgtagtcccagctactcaggaggctgaggcaggagaatggcgtgaatccgggaggcagagcttgccgtgagccaagatcatgccactgcactccagcctgggcgacagagctagactctgtctgaaaaaaaaacaaaacaaaacaaacaaacaaaaaagatatcattccatctattgtgtgtttatctctgtttagttacgcacttgtgtgtagttgcattgacatttaggcagacttgcctattctagacattttcttactatgaaatgcacgtgactagcacagtgtctggttattagtcaattctcattaaatattggctgcataagggatggggatcataggcattcggaatataggaggatcgactctattctggcattattggatgaaaggggttctttattggaaccgactacatttttttgtccttggtaatattagtcttactttgaggcactagggcattttgagactagtgaaactcccatggccttcagaattataatttaaatcttctattcctccagaactcaggacatttaatttatcatgattcataaaagaccagtaataaaccctgtctttatttaaacgtgggcggcattgacttcccgctgtaggaattgggtgttctttatcaacgtctctctatctacttatcacggatcctgcatgtgtacaaaaaggcatctttgtcagtcagggggagattttattaactaaaggttcatttgttcttcaagtgacactatctctttggaattaccagatgttgttcaaactgtgccggctctccttttattctgatgatggcaaatgttgaatgtggtgaataaatattgggcactgtcctcggtcatctcaaataaatgtgataaaatgaaaacatgtcgcctctgaggtctcatttgttcccaggaagtccacggcgcattaaggcccacagacaatgaaagacgaatcagccattcactgggtattccattatgagacattcttgtcattttccagattgaattttagattaatatatagcctgagataagatggcatgtattgagatgatgccacagtgccatggccaaattgttttgttataatcacatgatatagagaattaaatgtattgtgatgatctgccgtagaaatttgcatttaaaagaaaaagtggcagaaaataaattaatagtaaatttcttatgacttagacctgaagaggctcatgtgactgcaggtgttatgttttgacccttctttgctaccatggcaagactggtgactgtcttctgaggagaagtagaggagatttcacttaactggatgatcacagagttgaggtttttgtcatccattgctgagccatgtattaaatattcattatatatataaatatacacacatacgtatatatacatacatatatatacatatatatacatatatatacatatatacacatatatatacatatatatacatatatacatacatatatacatatatacatacatatacatatatacatacatatatacatatatacatacatatacatatatacatatatacacacatatatatacacatatatatatatacatatatataataaaaaagtgggaaagaacaatctggcaaaacagacattttggaatcaccatgcccttctttttcgggtgatgcatgacacccatgaattaagatttaaaagaggatataaagcagaatcttgctttcacagtggggagaagaacttatgaatgctttgaaaataattgctaagaattatactcaaatcgtattacatcaagaaatggagatgtgaaccagactgggacagtacgatttcacaataacagccacaatttctctaatttattacattgtcatctgtcttgtgatttaacatcctttttcacagtctgcagtaatatatggaattactaaaagttggcggctgtctgacgttcagaaatgttgaaagaaatgaagtatttctgtgggtgttgccgaagtcctgttgaaagggtagttaagtatcgctgattaattcccattctatctctgatgaaatggagaaggggaaaatgctcctttcgaccaagtatctcattgcaaactgcagcccagaagttgcataagcattttccttcttcggtataaattgatttgctgtgaaaaatttcagacggttccatgtcaaggcaatgttttatttcgtggtgcaggacaaatgtagagctaagtagatttgtaggctaatttattggtcattttaatattgtgtattctcccctttggtgtgttaagtacttccccaatgcttcttcagcgatatactgcttatggcatgcccaactcatcttaattaaattctttcttgccacaacctcatttttgctcatgggatacattgctgtcactgtgaaacattttctaggaaaattgagatctatttttcataaattaggctcttttttaaggctctctatgttagtcacttaaattaatattaagttattatgtactccaaatcagtgctttataagtctttcaaaaaatatcggttgcccagaagcctgggaggagtgcgatagagctggagcgtaacgtgcaggtgtgttgggttagtgatgggtgaaatgactctatgtggctcgtccccacctcccattgttagaggcaatcagagaaagcattttgcaaatcgagaataagaaagaggccttacagagcatgttgccgctgctgctgctgctcctggcacccctgctgagatcagctcagtgcagtcttctcttttagaaagaggagaagagtttatcctgaactgtgcattttttagttttagaaaacatggatttcctgacaggaaatgggaagctttttgaactgtatgacttgagtcatctgtcacgttggaaggacattggaaaaatcagcctcctgatgtagaactttgtcatgactttcaaaagtttccctacaaattgacacatggggcttttggcttttgtcctggggatatggcagttgtcatgtcaatgtctagaaaaattgtcccttataaccaaagatggctaattaaacaaaacaaaacgcccaaacaggtgcttattcattccctccgtccgtcccactctcacacaggtaaagaacgtgtttcagctaagatgattaacatgcttcccccacccccaccccctgacttaaatcctcaagcccactagctcttgccttaccgccatgctgacttttacttccccaaacatacccagctcctcctgagtgggacgttgtgagcattctgctccctctgtctggaatgtgcccctcctgcctcaccacaacctttgcagagttagcttttacttctcctttcactctctactcaaaaatgccgcttcctccaggaaagtctttcctggaattcccacccctaatgcaactccaactccctaggatagatgagaatatgtctgtatttggtctcatagttccttgtacttttcctccagtttatatatacatatgtgtgtgtgtgtgtgtgtgtgtatatacatatgtgtatatatatgactgtttgtgtgtacatatatatatacacaaacacacactcacatagtcacatgtcatgtcaatgtctagataagttgtgccttataaccaaaagtgtctaattagacaaaacacccaaacaggggtttattcattctctcagtctatttctctcacatatatttagaacatgtatatgtatgtgtgtatatgtgtgtatatatacacacacacgtatgtatacatatatagatatagatccacacacagctgctagtaccactgctgagatcatctcagcaccatcttctcttttagaaagaggagaagagtttatcctgaactatgcattttttgagaaaacatgaatttcatgttgaggaaatgggaagctttttgaactgtatgacttgagtcacctgtcgtgttggaaggacattggaaaataggacgtgtgggtgtatgtgtatatatatacatacatacatgtatacacacacacatatatgtgaatatatacccacacacacaaataagtacataggtatatatctgtgtatatatatccctctataatctgtgtgtgtctatatatctatatctctttatatccatatattgaacacctactatgtgccaggcgctcttcctgcatttggaacttgttggtgtaaagacgacaaactgaagttgttccctgaagctcccttatctgcctaaagtctggacccactaaaaaagaaaacaagaacctctggttccttccctgagttctcattaattgaactcatattgcaggaagaaagactgatgttttccaacccacatgaacagacttttgtcacaggccattgttcttcaagcccattgagttcccgtaaaaatcacttactacctatgctaaaatcatccacactttcccatttccctttcccctaagaagaaggatatataaccatctgtatcacattgtgcggtggggtaatcactctgttattctgccccatgcatggtaatcaattcgtttgccatttatcaaaaaaaaaaaaaaaaaaaagtcaagccctcatgaagtcaatattctagttggggggaaaaacaatgaaaagtgtgcgtgatgcctgagcaaattgtgttagaacatgagcagtgctatggaaaaaagaaaaccaaaacagaaaaggatgaggagggcaggagagtgggggtggaagaatccattgcaattttacatgaggaggagagggccagtgtgggccttactgtgaaggtgacattttggcataaagccagctgcatggatttggaagagcattccaggcagtgaaaacagtcaaagcaaaagatctaaggcttgagagtagccgtctgttcaagagacaatagaagggccagagggagtggagcggaaaatagcagggaatgagttgagggaagaagcaaggtgaggaggaggtgcaaaccacttaggacttgtaggcattcagggcctttggattttacttgagtaaaatagggtcttgacttacatttcaaatgaataatttgaacttctgcattgaaaattgattatgagggcgcttaatgcagtttatagctgtgtacttgtgtgattatgtggttgatgtctgtctctctcatagactgtaggccctaagagggctggagtactgtctgacttgctcttcatggaatctccaagatcaagcctagtgcttggcatgttgctgtccaataaatatttaatgtgaaaggataaaatgaatgcaggccacatcaagatgatgctagttggcattcatccctcagaggcatgtgctgtagatagtcaatgtgcaaatttcaacttgtatccatccacttaaagacaacttcaaacgcaccctccaaccacaggcttaagttgaattatctgcttaattgttgctatgtgcagctgtttttcattagtgctgttttaatttgcagtctatgaactttgatatttgtaacaaaaagtaattggatactagtctggaaggcttccctccttaaaatgaatatgcttcacgcccaagcaaatgactggaaaggttccctgctgtctactagggaaaagattcacgggggcaggggctgtccacagcagaccagaatgttacagtctgctgggtaaatgttccatggtttcagaattaatatgcatgcattccgtaatacatatttacctggtagtctgtaaccattcagtagaactgttacagtctagtaagtaaataacatgtttttcaaaattagaacgtgtaccaaatatgtatttacccaataggctgtaacagttctgaggaaaccttccctgttgttagtctatcaggctgacttatggatatgggtttaatgttgttttgaatatgaacacagtataaaggaagatgtgtgatttttagaagggcgaggggttgtcatgtagaacaaaccaattttaggaggaaaattcaattcagttgcagaatctgttcctgctattcttttcctttcttttattttatctttttgttttttcttttatgctagttgctggaagattgctaatgacaccaggatgaatttttaaatactgtaatttaattattggtaacataatatggctttataagtgattagtggacagatttctgaacatgtgtaggggccagttttttagttgctaacctcatggccttggaggaatccacaagttggattctggtgaatgatttaatgacggtattggcagcactttgcctaatgagtatgtatcactctggcctaggtaagtcaagctaaagctaaccacattcacatcatccacctagatctgttatacaggaacaaactgtgtagagatcattatgaggccatgttggtgctttaaggcatggagttttcagcgggatattactcatttccatcattactgatgttcagctgcatttctactgatgtcggctgcatgggtagagaattagactccatagttcaagatagttcatgggtaagtaacattgtagtcaagagtttgtggctctggaatcagatgacttgggtgccagccctctgaacttgtatcagtgatttaaccactttaagacctgattaccttatctgtacaattagagattgccttatctgcacactaattgtacagaacagtcattgtacagataaggcaacactagtattcactttataacattcttgtgagtgaaatagtatccataaactgtgtatcactcttcagagcacatattgaatatttaataggcatcatcaacttttgtctatgatcactgtggaaattcagctgtgctggcatacaggaggtatatgtagcaggattagcaagggtgactcagtccaggtttccaagtatttagtttggaagtaaatgaagacacgatgtgtgtaattggatatttcactaataggttataagtggttgtgcaagtttctaaacatcttgcatgtactaataaatacttttagttgacaaatgagaaagcagccatgaatctgagtctcttacttggaaccaggtgaaacagtgatttatgaaatgccctttaaaactccttggaggttcacattctgcacaagttgctttttttctttctaattgagaaagctgctatattttgagtctgtgtaagcaactgcaggccttgattcttgattcttttctttctttctttctttctttctttctttctttctttctttctttcttttttttttttttttttgcatagttgttactgtttccttgggcagagagccataggatgagtcccacagccctttcctgggtatgtccttctgtgcaatgtaccttccatgaagcttaccagcatgttttatcatgtgttcaatgtcatttgcacaattagactcagatgctgcaggggcagggggccatggagtatactcacttcttccaagtgctgtttccccaggcccaagtgcaatgcctggtgcaaaatgaatactcaggtggttcctgtgttgtcgtcctttgtgactctgtctctctgaattagttctagtccatggcactgcgtgacttccaagacaattttagcatcctgtgcaacacgcatgagatttagaagcattgtctgttgacattattctttatgaacatttactgagagcttacaatgggccaggcactattctaagcatttcacatcaatatttcataggaatccatttaagtccatcttattattaccctcatttatcagatgagaaactgggatcccccctagattggatgtgtataagttattgagatgtaagtcaaaaaatttggtgcatccctagagcccagagtcccttacatctactctaccttgtctcccaaggaaaatactatggtcaggagttgggtaagccgataaaaagatggctgggtgtggtggctcacgcctgtacttccagcactttgcgaggccaaggtaggcagattgtttgagctcaggggttcacgaccgttatcagcaacgtggcaaaagctcatctctacaaaaatacaaaaaaagtagccaagcatggtggcacacactggtagtagggcacacacatcagtagggcttgggaggtggaggttgcagtgagctgagactgagccactgcaatccagtctaggagacacagtgggatcctgtctccaaaaaaaaaatatatatatatgtgtgtgtgtgtgtgtatgtatgtatatgtatgtgtgtgtgtgtatatgtgcgtatatgtgtgtgtgtgtatatatatatatcccattaggtctgcctgccacagtggggatcattcttcaacatgagatttggaggggacagacatgtaaactacagcacccatgttgtttctgcttcttcccagcaagctatttctagccacccttcacctccaccaaccttaacctcacaatcacttctggatgttcttgtagcctacactgtggattgttctaggctctttaattttctgttttccacgaaagtctgtaagcttgatgaggataaaagccatgattgccttgcttaccctcactgtgaatgaatgaatggagtggtgcagaaactcaagagcatcatgtacatatggaacatgctctatggtttttaatgaaaatatgtggcagtattggctgggctgcagtgcatacagtggagtattattcagctataaaaagaaggaaatactgtgttcgtaaaaacatggtgtgaacccaggagacagagcttgcagtgagccgagatcgtgccactacactccagcctgggcaacagagtgagactctgtctcaaaaacaaacaaaaacaaacaaaaataaacaaacaaacacatgggtaaacctgggggacaccgtgctaagtgagataagccaggcacagaatgacaaataccgcatgatctcactgatatatggaatctaaaaagctgaactcttggaagcagagagtagaaaggtggttggcaaggtttgggggtgggggaaatggagagctgttggtcaaaacacacaaatttcagtaaaaagatgaacaggttctgaggatcttgttccccagtgtgggtggtgatggatgtgttaatttatttgattgcggtaatcattacacaaggcatatataaatcatcacattgtacaccttgaatctgttcagtccttatttaaaaattttttaaaattaaagcatttgcggctgggcacggtggctcatgtctgtaatcccagcactttgagaggctaaggtgggaggatcacttgaggtcaggagttggagatcagcttggccaacatggtgaaaccccatttgtactaaaaatacaaaaattagctggatgtgctggcatgcacttgtaatcctggggagactaaacaagaattgcttgaacccaggagacagaggttgtagtgagcagagattgcatcactgcactccagcctgggtggggagactctgtctccaaaaaaaaaaaaaaaaaagcatttgcaacagggaaggtaaactacagtgataacaaaatactactcattgtagaaaagacaaagtacaaatagccataggcccccaaatgtgaaatgactttttcttttcttttctttttttttgtctgagacagagtctcactctgttgcccaggctggagctcagtggcgcgatcttggctcactgcaacctccatctcccagattcaagctgattctcctgcctcagcctcccaagtagctggaactacaggcgcccgccaccatgcctggctaattttttgtatttttagtagagatggggtttcaccatgttagccaggatggtctcgatctcctgacctcgtgatccacctgcttcggcttcccaaagtgctcggattacaggtgtgagtcactgcgcccagctcccagattcaagccgattctcctgcctcagcctcccaagtagctggaactacaggagcctgctaccacgcctggctatttttttgtatttttagtagagacgggggtttcaccatgttagccaggatggtctcgatctcctgacctcgtgatccgcccgctttggctttccaaagtgctgggattacaggtgtgagtcactgcacccagctcactttttctttaatttttgctataagctcacctgatgaaaaaaagagctggaaggattagcagctatgtgaggctatcaatcagggtaagacaggctatgctgtagtaacacataacccccaatatccatggcttaaaagaaccaatgtgctttgtttttgtttttgtttttttcctcacatatttctctctgttcatcctgcactggctgggagtgctactctatttgttcttcatgcagggtcacaggttacacctcttctgcgattaccaggacagagaacaaacagagttaattgcacactgttccttcaaggtgttatcccaaagtaatgtgtgtcatcactgttcaaatttattagctaaaacaagacattcagctatgcctaagtccaagtaggcaaggaggtacaatcacctccgttgttttgaaggagaaacataattttttggtgaaaagcaactgagatccaccacggtgagaaaaagccacaggccagtctcacagcatcatggcgaacagctatgcctaattgcacctcgattctaggtgtgatcctgtcaaaagcagtacctttaagatgtgtagttatagtattgtcattctaaaatatgtaacttttaggaattttgtggctagacgtagggacctccatttgattttttttttcttctcttcttagtgagcctagtttgaaatgttggctttcttaatctacagagactttgtcattaatgtgtaatgaatatctggtttcaaaccataggctgcttatcccttgactatttgtcgagacctttgtttgccgaaatactgctttatttcatttcttattatctttagaaggtattactgataggtattcattttgacccctttacgcacactcctcaagtctgtcttctccacaggctaaatcagtattccatccacttttcatctttactgttcctggcactctcatctatatgagaaacaggatctgtgtttgacaagcatgcttaccctttgcttactgttttaataaaaatttctatcagcgtttttatctgcagtagcagtcgagacactgtttgatattgagatgctagatttcatggactttgaaatattttccccatatcttttttggcaagtctttgaacatagaccacaaaaaattgacatgttggagatgaatttacagactctaagttaactaatgactacctgtcccagcttaaattgtgttctaggattgaaacattatattacacagtcaaatcgttgaaattaatggtcagactcttccataactgagttagtttcccatgagactgatactctattaaatgagcaggctgtccagatttctctgcatcgcctttggtttggggataatgttgacccagtcttggcagtttcaaagcagtaccaagcagtcagactattttaaatggggaatgatgaatagcagcttcctaatctccaaatttcattcagatacggtatcttatttcatcccctttatcctgtgaggcaaattattattgtcctgaacacagagagatggggaaactgaggcatggatgttactctgtgtgctgaagattatacaactactgagtagctcaggttcgtttggtctttctgtccctagatagcctcttggctggcagttctcatgattcaggactcttctcaaatatctctcatgagagaggcctttcttggctgctccagccacagagacagtcaccctggttctctgctctgtcaccttcatagcacttattactatttcattgtgtttcttatgtgtctgcttgttctcagtctctgtccacttgagaacaaaggaaaggaccttgtctctttcatttcagcgccacatcccagcactacaccagtgcctggcacccagtagatattctgaaatgtcagtggatggatgcctatttacatactgtgcttttcttgtccctcagggccacatttttgagttggtccatacaaagcaacaaattaagcatttagggctttatggacaaaccccactatttttttaaaattttttaaaattcctttttagagacagggtctcactctgtcacccaggctggagtgagtggtgagattacagtttgctggagccttgaactgccaggctcaagcaatcttcccacctcagcctcccgagtagctgggactacaggcgcatgccaccatgccaggctaattatttaaattctttgtagaggtagggtctgactatgttgaacaggctggccttgaacttctggcctgaagtggtccactatttaaggtctttgacagtgcagctttacgggtaatgacatgtattagttatctaataccatgtaacaaattactcccaaagttagcctctcaaaacaacaaaagtttctttttcatctcatagagtttctgaggtccaggaatctgggagtggctctagctctagtttccttgtgaggtggtggttcagtacatcagctggggcagccgtcagtgacagttggaagtactgcttctagactcactcatatggatattggcaggcctcagttcttcaccacatgggcctctttacaggctgctggagtgtcctggagacatggcggatggctctctaccaaattgagttatgagacagagaaagcggggagagaaaagggagaaagaagggagagatgctaagatggaagccatagtcttttataacccaacctcagagtgacataccatcacttctgccatgttccattggaactcttgtacagtgtgggaggagatggcacaaaggcacgaataacagaagatggggattatctcagggccatcttgggggttcattctcatgtatcttattctgattctcagaagagagccctggatagaacatgtaactctgtataacagtaaatcatttcctaatgtcttcttccatttcaggggccagttgggtggaaagtttgattaccagtgtgcttataactcttttttttattattttttgagattgagtcttctctgacacccaggctggagtgcagtggcgcgatctcggctcactgcaacctccgcctcctgggtttaagcgattatcctgcctcagcactgcccccaagtagctgggagtacaggcacgtgccattatgcccacgtgatttttccatttttagtacagatgggatttcaccacattggccaggctggtctcaaactcccaaccttaaatgatctgcctacctcagcctcccacaatactgggattagagatagctcttggataatatgctacttaagaatacagattctggtgtcagcagcccagctttgaatactctctctgcctcttgatatccatgtaaactgaggatattttgaagcttttcttcttacagaattgtggaagcaatgtataagttatctaatactctgtattagttatctaatactgtgtaagaaattactcccaaagttagcctctcaaaacaacaaacatttctttttgttgaatgagttttcatctcattgctgtagaataggatcctagtagtatctacctcatggagttgtgaggattcagtaagttacttcatgtgatgctcataccagaatgtttgccagactaagggcacttaggaagtgttgacttttattctttggattatcccacagctaatcagtgccaaagtaattgttgcttcccatagcttatccttcactagatggaagtgtcctagacagacctctgagacgaagtcagtctaaacaacttctggcaagctatgagctgtaattgggttaaatagttgcgacgtggagaaatctacttttctgttgcagaagtttcatgggctctgtcaacctttctgtccatgggtggttttctgtgggaacccatcctgtgagtaccttgacaataacagcttacctaccatccagaatttagtattctcccttcattctctagagaaaacccaagcataccttcctgagtggttggccagtggctgaattccacggctgtttcgttaagttctctttaagcagatttttcaagtcttccctatttatatcttttgaaatccaatctccttcaatcaattttaatcccctaatgtgtttgctataagtactgtacaattcacttgtcctcaataataaaattcattttggtgcagcctgccggtaatttgtttgagaagaagtcgttaggaaacccttgcattctcttctggtttagaggacgaccttcagtattgatagcattttgttgtcatgcgcttgaagtattctttcatgattgacagtgccgtttaaataatggactacagagccatgtgcttaaatgaaatctgactacactaatttcgttatatattaggaaacttcaagtgttctacaaggacacgatttcattgaccatggatttatattttcagtttgtatgaattatacccattgtgtattgttcccccttcactgtaagatactcttttgttttgaaaatcagtgtttttgtgttttaactctcaatgtatgctgcataagcaaaggattgtgttccaggcccctcctggaacaggccaaagtaagtaaaatcgagaattttttatatgaaagatagaagaagtacagcattattgactcagcttaatactgagttaatacactctaataaggctcagaagatataaaagatccactgtactctctctatatatatatatacacacatacatacacatataaaatataatttatacatgtatgcttaattggaaaaaataaagatcaagagcatgttttattgtttatctgtatctctagctttttttaacagcatataaagacaaagcacctttttatttaggcttggctaaaaattatcagtcatatgtagatgattttgcagtatccgccaacttcctactcaggaaaagttatagcagatggcagaatttatgtgccatgtggcatttgtttaagtgtggaaatagctaatattttttcctcaattattataactattttacttttaaagactcaattaactttgaaataccattcttgatgggtgcctcagttaaggatgggatggggagaaggaagagaaatttgaaatcttgcagggcctttgattgaataacggttatattgctcattaatcagaggctctgggtaccctgttttcaaaataacattattgtttactaaatatagactcctgtggaactgttaaggagaaggtcctactgagatgagcaggcattgtggattggcctttctactaccaaggactgggattcacatttgcaagtttgtgggtcctcagggagaatatcttggagttgacatcatttcaggcatatagcccgtaatttgttttgacaactacaaacaaaaggggtctattcccaaaaggcttcttcgaaaattgtcagaggctcttgccgttgataatgtgagctgctgctcccagggctgagggcctgagaaccacagcaggactggaatccagtgggaggagcaaggaagctgcagggggtgacggtgggcatccttccagagagaagggcacatttgaaacctaggagaccattcctgtcaggaatcaatatcaggtgactgtgatctatggcagagacccagtgctcggagtgatttttttaagttgtgtatgcttcatatagattttctttcctgatttgagtttttctacttgggtgaaataaaaggcaaggggtttgtgtgctggggtagtcggggagagaggagaggatttgatggagaacatcaaggacctgttgcttgcctgttttctaggaatccttacctgtaatcagctcattacagagaatcttggggttctcttgagcctgctgaaggcatgcctcctgagatccattgaatagagcaaaaggatcagtcaggaaatatttattacacagaggaaagaagaatgcaccagcagagttctgggcctgctgcagccactcagtaaatattttttgagtgaattaatttatcaaaaaagcatatgtaaaaatatgagtcattatcatgagtggtttgattgaggatgatatttcttttcttagtttttacaactgttggtaacatttgattaattacttttattacaattatgattatcatcattttatatacagttgtactccttgcctgtgttaacaatttggtgatagcctttcacatttttatacctttacatggcctgtataagtatacagttttgtcctaatatacatgaaataataaaaagtggatttttctgccaatacacacttagcaagcgttccagggtctctttatgtattagaacataatctcattgtcatctcattctttttaaaacgttacttgatatcccgtcgtggaagtataatatttatttaaatatgttttgcctatatttgatttcataatgtatatttttaagtgacaaatctgtatcaaattctataggacatagagaataaacccatgactcttccaagttgtctgagatctagttatgaattttgcacattttcttaatgagtatgttctgcttttaaaacattaaaggttgaagaacgttttaaatctacttacaggatcaaaactatgcacatgaaaagaatgtctaacctttgttgggctcttatctaagagacactaagcgtgcatgtacaaatatatataaactcattaaaatcccttccattatttagcgtgaaccgtagcatagccaggcaagattgctgagtcttccccagatggac[133 bp omitted]ctcttgcctcagcctcccgagtagctagaattacaggtgtgagatatgcacccagctaattttttgtgtcttttagtagaaacggggtttcaccatgttggccacgctggcctcgaactcctgacctcaagtgatccacccaccttcgcctcccaaagtgttgggatttcaggagtgatcccgcatgcccagccatcaataaatacttactaagtgcctactttgttcccaagagtgctgggaacttagcagtgaacaaaataaataccttccctcggggaccttgaactcaagtctagtcagggatcactctattaagagatcaagtcaacactcaattctcctacagactcagataggatagtattttaatttctcgttgatctgctccctcagaccctagaccatgggcactgcagatttttgcaccttttgtagaggcagggtttcaccactaccagagactttaccatcatttctatgtgaagggaaacagtgccctttcagtagacaacgttaaatcagccatcagacgtgggtcatggtgggtttgccgtgactgccacaaacacgcctcaccgaagtctgccaggggacgccataccctcccctagaaagtaagaaacagagaaaggctttctcctgccccggactgtctttctctcagctctaagaaatttctttacagctgttactttatcctggcctgtctcttgagtaagaaaactgctggaaagagtctgccattcactcagatcataatcagggagcctgctgtcactcaggaagggctttaaaaaattcttctgatttactgtgagtgcaaatctctgatattcctgcatctccccatccatcttattttgattttacacatagtgcgattttgaaaggaagcggtgtttttggagaggtagaaaaactctggaaaataaggcttatgacgttggccatcagcacggggctgctgtctgctgtgtgacatgctcaggggtgacgcgcctcccgaaagagacacttggtagagaaggcacgggcgcgaagcccggctgcgggagagctgggagcctgaatgtcgctggctgccgttcacagcaggctctctctgagcaccgtggggaggcagtgacacccgctggcctcgcagcgacactccggcagctgtcctgttttccagcctggacgtgataggtgtgtcttggaggacagtcagaggaagacaggcaagccatactggcctccctcgaggttataccctcgcttaggttaggttgcttctaacagacatcctccgcgggcgttgaggcagccagcttcactgtcacccagacaatttttctctcgctctgccaaccctgttcccctttcaagaatgtttaaactcttcattcaagcgatgagagggaaacacttgagctgcacactcaaggagatgtgggtttccattctggccttgcgatatattattggtgggaccgtgggtgagtcacttaacttctctagtcctcagttttcttatctgtaaagtgggctccagcatacggcttaactgaggtaacacacgttgttcatgtcagctgttgctttcatgccggctctgcctaggtctccccatggcaacaggataggagttctctgcctgtgcgtcagtttttcactagcgtgggaatgctgtgaggagggggcggaactcggtgtagcaagggtttctgtccgtatcttctattttttttttttttttttttttgagactgagtcttgctctgtcgctcaggctggagtgcagtggcgcgatctccgctcactgcaagctccgcttccagggttcacgccattctcctgcctcagcctcccaagtagctgggactacaggcgcccgccaccaagcccagctaattttttgtatttttagtagagacggggtttcaccgttttagccgggatggtctcgatctcctgacctcgtgatccgcccgcctcggcctcccaaagtgctgggattacaggcgtgactaccgcgcccggcccgtatcttctattaagaaccagcaaccacgggctgggcgtggtggctcacgcctgtaatcccagcacttagggaggccaaagtgggcggatcacgaggtcaggcgatccagaccatcctggataacacggtgaaaccccgtctctactaaaaatacaaaaaatttggcaggcgtggtggcgggcgcctgtagtcccagctactcgggaggctgagggaggagaatggcgtgaacctgggaggcggagcttgcagtgagccgagatggcaccactgcactccagcttgggggacagagcgagactccgtctcaattaaaaaaaaaaaaaaaaaaaaacagcatccaggaatgctatcgtgtagttgctttgagacatggcctggggtctccccgcaaggcgacaggacagattacgacacgttgtttgaaatctgcctttagaaaaagacacggcctcattttatgcctgtgagtgatttttcttctgtgtcatatcataactctgataaagataattacatcctagtgtctaaaggcaatgatgtgcttgattaagcctatgcatgttgtttggtccttgtatatttatattttcttcaaatttaaatggatactaagtcctctcaacattgtctatagattgctggaaactgtgactttaagcaaaatgacgtgtaacagaataccttttaccatgagctgattgatacaaacaagagttaagttcctgcagcacatttctggtcataaaagcatcactgatcttctaaataaagacccaaaacacttctaaaattaaacatgaaaacacatgtgaaccatacatacattttaaaaagattaataaagggctaggcacggtggctcatgcctgtaatcccagcactttgggaggccacggtgggcagatcacctgaggtcaggaatttgagaccagactgatcaatgtggtgaaacactgtctgtactaaaagtacagaaattaactggtgtggtagcagacgcctgtaatcccaggtactcgggaggctgaggcaggagaatcgcttgaacccaggaggtggaggttgtagttagccaagatcacagcactgcactctagtctgggtgacagagtgagactccatctcaataaaaaataaataaataaataaataaataaataaataaagattaataaaaacatgcaagataatttagccagtttttgattaatcagtgatggtggtggtaggcatggtgcgttacatcaaaaaataattttttatttttgcaaagcaaaaactgtcaggagcacctccccccatcacacagttcaaaaacaatgactagcatggcaggctcactgggcaccttcataccgcattgtttattgttgtgcacttttatgattagcatctactttatcagtttttatttggcagtcgtgagtattcattctttcattttgcaacctgcttattccagttcaggctttcgagtgggtggagcctgtcgtagcatctcagggcacaaggcagggaccactctggtcaggatgtgctgacacacacactcactcatgctgagacgacgtagacatgccatttccccaaacacgcacatctttgggatgtgggaggaaaccggagtacccggagaaaacctacgcagacatggggagaagatgccaactccacatagtggacccagttgggaatcagatttttttcttatcaacattgtaacataatattattcgaagacctgctgtactctgaactgttcattcttctaagggtcttaaaaacttgaggacattgaaatgctatggctcaccctcctattttctttcttaggtatgtttttactgagtcctctgaaccttctttgaactccaactgggaggaaataacagctaatggggggttgttcctatttttgttggcagggtgagggaggtggtgactgaggtcaaactatgtggaaggatattttatttactaaaacaaaagaggcaataattttttactgcaacgttagggatttatgctagataaaaggaagttcccacaatcctgggggaagggtgttaagccaaggcaaagatttcacagctgttgggaaattgctttctgaaaatactaaaggatacagtgccagagtcactggccatctgctaataatttatgttcctcatccccagcaaagataaagaacctgtaaagaaccacccatctagggatacatttccagccccccttttatcaaagcggtgacatgtgaccgaattctgcccagtgacatgtgggaagaagtggctctttcaggactgttcccccaaaactgtctttgggatgctccaaacttctttattcccccaatcctctgatgaacatgcacctgacattggatgctacatgttaaaaacggagttgtcatcttctacctgggtcgctgaatgactgtgtggatcaggaagctccccactcttccctgccatgactgaactagccactgtcatctggagggtgtctgtaatagcatctagcattgcctaacatcatactaatggaacactacatattttcatctgaagtgatatcagtggaatttccactgaaagcaaaggtttagattttggagcaataatgcttaatatttgtcagtaggagcttattaaatataaataccagtcccagtgcttagaactttttatgtgctgtctcctttcattttccttccaactctccagtttgtatcagtcggggaacaccaagttgtgctgtggtgacaaatagctctgaaatctcagtgatataacacaacaaaggtttatttcttgctgatgaagattcactgaggttctgggacactctacagagaagctcttctgcatgtattggctcatcattcccagtggttttactcttaggaacccaccatgtcaataagtagttccacatggtcccaggggaagtccacctggatgtctcacagtggtagtcaagtgctttgacaaggaagtgacacaccctactatcaccaaatcccattggccagaaccagtcacatggcctccttttccctcctgtatccctactatgtgctcaggaaaaaaataaaccagatagtgaagcaggaaggactatatggaaggatattttatttattaaacaaacgaggcaatcattttttactgcaatgtcatacaaatgagaaggctgggattcagagagcttcagtcactaggacaaggttacccagttaggaaagcacaggttttgtgatgaagggtgtcacccaacagtgcttatttcattgaagagccatttctaaaattacttttctgtgttacaacaaaaaataaggtaataagttagtcctcaagcatcttgcagttcagagctggaaacagacaagtaaaacgaccagttacctgcattctaactactactagacatcagatagcactttacatatcattacctcatatcttacgtagtgataagggaatgtgagaaaacttttgcaagtcatcacaaaacacttttttcaggggcataagaatcttggcctaaaatggatcatcatgtaacaggctgagaacagggtagtgggaagttagcgaagcaatgtccccgggacacagcagtgggtgaaagtgtgttgtgattcatgaccttatggatggacggtgttctcatccatctgtccttggctgggtagctgatggaacagtgatctgcttctctgggtatttgggagaaataaataaaaatccatggtaaaatgaagctgtgttctgcattttactcagcacaagcattctgtcctaaactccaaacattgtgcccaatggggatgtcggctatgggtattggtgtgtgtgcgtgtgtgtgtgtgtgagcatgggagaaacagagggacataggaagagacaaaaatatagagaaggagagagaaccccagagagagagaaacagagagtgaagaagaaacagaatattttccatttatttcaagtcagttatcccaagttttagtgggatcaaagtaaaatagataaaaatgtatttattaaatataatatagatttttttaagtatatttcctggttgctaaaaaataatctttgctcgaggcataagaatgatacaatggactttggggacttgggggaaagggtgggagtggggtgagggtaaaagactgcaaattgggtacagtgtacaaattacggctctggtgatgggtgtaccaaactgtcggaaatcaccactaaagcacttatttatgtaaccaaacaccacctgttttcccaaaacctatgaaaatataaaaataacaaataatttttgaaaatatttgctcaaaaatgaggctactgaaatgatgttatgttttcttctattttggttctacctagagaaattttaatgttttatgccaagctgttcatgcttagttctgtttttgttttgttttcttttttgttattgttgtttttgtttttgagaaaaggtcttattctgttacccaggctggagtgtagtggttcagttatcgctctctgtaggcttgatctactgggctcaagcagtcctcccacctcggtctcttgagtagctgggactatatgcatgcaccaccacacctggtgatatggtttggctttgtgtctccacccaaatctcatcttgaattgtagttcccataatccccatgtgtcatgggagggacctggtggaaggtaattgaatcatgggaatggttacttccatgctgttcttgggatagggagcgagttctcacaaaacctaatggttttgtaacgggcttttcctcctttgctctgcacttttccttgctgctgccatgtgaagaaaagcctgtttgcttccccttccgccacgattagaagtgttctgaggcttcccaagccatgctgaactgtgagtcagttatacctctttcctttataaacactaagtctcaggtatatctttagtagcagcgtgggaacagactaatacacttggctaatttttcaatttttttgtagagacacggtctcactatgttgcccagggtggtctcaaactcctggtctcaagctgtcctcccatatcagcctcctaaagtgctaggattataggtgtgagccactgccgccagccttcagtcctttttaaagtggtatacatattctatgtataggttcatggacctgttcatcttttttttgttgttttttcttttttcttttctgagacagagtcttgctctgtcgcccaggctggagtgcagcggtgtgatctcagatcactgcaacttctgcctcccgggttcaagtgattcttctgcctcagcctcccaggtagctgggattacaggtgcccaccaccgcacctagctaacttttgtgtttttagaagagacagggtttcaccatgtcagccaggctggtctcgaactcctgacctcataatctgccctcctcagcctcccaaagtgctgggattacaggcatgagccaccatgcccggccaggcctgttcatcttttaagggtttatgttgtttgactttttccatcacaaatttttattcacctcagtttgctgataactatttccaggtaagctggagtcataacacacatttgccaattatctggagaggagcactacttcctaattatgtggtcattgaagagctagttgatcattaagctacactgatatgcaaagccacaataataaacagcaggcaagattaaaaactccgtaagacataatcccttatggtcctcttcataaacatacaaataatgaaaaaataaatacacgtttgctcaattctgcaaaaccagaaatgtcacagggggggatgcataatagtgattgtattgagggaccaaccttggttgattcttttgtggggtatacacagtaaactcagacataaacctgcaaggtaggcatcattattctccttacctttctagagatgagaccagctgaggctcagagaagtaagttccctggccccacaaagctaatgaagccctggagtttagattcagacacagattctgttatccccaaagactaagaccctcaaaacatgtcaagtgttaaccgatgcctaaatggaactcaatttttccagaaagaccctgcatatctcatttgggcttgcttttttttttttttttgccctttttttcccccaaaatcataattgcaaaggcaagcttctgaagcattgatcaagaatatattttgctttggatgaagaatgtgaaaaatgtgattttagaagaatgctgtaaatatttctcccacttcattttcttttcccttctcctttttccatgctgtgccttttgagttatccccatatactctaagtgccaggtaggtccacgtgggacaaccagagtctaatgagttcctgcgccacgcccacccctaatgaagcatcttcaagtaggatttctaaagacccagggaagctttccctttggtgatttgcaaagtctggccactttagaatttatctcctgcacagggttctgtgtctttgctttttcgatgatccctgtgaagcatgaacccagcacccttgccttcctctttgttggagatggtggttatttgtttgagtcttttagggtgctttattttgttggtttcactgttggcagctggtacaggcttccttcccccagctgtgttggctgttgttttgggaaacaagccttgctcttttccatgcagacctctaccctgggctctgatggtctagctgaggtgaagcaaaccgtaggtgagtgccaacaggggatggccccttcctgggcagaaggcggatatcgatctcatgtcagtcatgttgcctgtctatgaaaatactacatgagcttctcagaaacaggtgatctattgatccccaagctgctaagggggcctccctcatgggttctgcttagctccttaatgagggactcacagctgtgtttatggaggtcacctggaactagaggcaggttttactgggaactctcaaactttgtgaaaattggatgtgtgtcccagattcttagctttggtgttatatccctcaaaggatgccactgagattacatgtccaacacaatcagaggcatttcaacatgtcaaggttttcttttgccctaggcattcatataaaccaatcgttatgaaaccggggcatttttgcttcccaaaggatattgataatctttggttgttgcagttgaagggatgctaccagcatctagtgggaaaagccaggggtgctgtactgctgcacatctaacaaggcaaagaccagctccccacccaacaaagaattattgggttcaaaatggcaatagcattgaggctgagaaagctgatttaagtcatattaaaatggaccccttgtaaatataaaacacaattttgtgatagtaaaaatttccaaagaatttttatcactttcctattgaagtgaattaactcttaatagctcattgaatttatgattagctattatttctcagtaatcatcgcataaacttgaaaattctgatgagaaaaataatgtacaacttattttccaacatgataaaatatttatgaacactaaatttaacaattaatgatgctgacataatgttgcattttggagaaatataattaagcagttattaattttgtctttgttccttgaaatgttagcgccaatttttttttttttcaatttttagatgcccttggacctcaaaggccctgacactgcatgtggagtcaggtgcataaaacatccttgaatctattaattctgggcctcctcaatgaaaggttaaattcatttaaaatacttaaatgatgacatcgtagatccaagaggtcaaataaaataaggatttagtctttttttctctcctttctttttccctccaccatttctctcttctcacttcttcatttctcatcttcttcctctcctgaccgctccttcctccctttctcttctttcctcccctttctttccttcctctttcccttccctcccctttcctagcttcccctcccctcctcacccctttttgaaatgttggagttcatttcaacagaaacaactgagctacagttccagctggttttctaagctacagttcaattattactattatttgcaatttttctcccctcccctcccctcctcttttctcctttccttgaatctattaattctggacctccctcttcctcactcttctctcctctcctctcttgtctcttgctcgatgtctctctctctctcacccttctctttggtgttcactccattctcaggtaaattctccccacaaggaagaggatggatagtatcagagccagcattctccactcagaaagccagctggaagatagagatctcatttcttggttgcttcagcaaaaggcccaggagtagttctaatgggtcctagcataaataaatcactgtggtccggggcacatggcactcattggccagcttggaacacatgtgcaacttcaggaccaggaactacctttccctgagacacttggtctgacagtgggaaatgggtgggttgcgtgcagagcaatgggcctgctgatgccaaacaagaggaatgataccagccaatcaacaaatgtctgctccttaaacaactgcaatgttaagttttgggggagcatctcacactagccctgtggatgaacagtgcttagtcaatggaggaaataactagaactttattagcttccattttacattttattcctttcttccaagtaattgggattggggagagcatcttgttacctgtcgcctttttaactggattctatccattctctgtaactcttagttctttgctctctggctggttttgtcaaggtaactaggtattttaaatcacagtgcaatttcttgtggctcagaaaactgaactgaagtagtaacttttaataggtcaattacattatttttcagcagcctgctgcagcctaatgaaactgcagtttaattaggttggtgtgacgccaaaataaatgtttcattcccagcttgttttatttactcattgaaaagtaggggaatctacaaataataggattggaaaatgttaaaggctaatcagtttggctgcacttgtttgtaaagaaagacgattgtatcttcatcactccagtttggtagttgagaaagctgaaaaacaaataaacaataacaacgacaacaacatttaaaaaaaaaaaagaaactcaaaattgtaggattccttagtagaaggttcttttaacaataataaagtcaactgcaaatactgaaagaccattcagaaagaaacgtaaccaagtcagagtctcctaatgtattctgtgttcctattgtgtggtaagcattgtccctgctgtaattacatctattttctcagtaaaacaaagggaagtcttgtagatgaagttttagggcccatcaaaggtagtactctgagtgtgatcaaaccacactttcactatttggagctcagtgagttaggaactagaagagcagagaacagcagaaaagttgtgttttattttcattattattattattattattattattattattattattattattgagacatggtcttgctctttcacccaggctagagtgcagtggcatgatcttagcacactccaacctctgcctcctgggttccagcaattctcttgccttagcctcccaagttgctgggattactgcccttccccaccacacccagctaattttttgtaatattagcagagatagggttttgccatgttgaccaggctggtctcaaactcctcacctcaaatgatccacctgccttggcctcccaaagtgctgggattacaggcatgagccaccatgcccggcctgtgttttcttttaaaatacagcacccctgaatgacctctagctactcccagtccttccaccctcagctggaagatgtgaattgccacccaccaaggcaggaccagcctggcaccgatcactgaaggattgtgattaagtcagatggttttgccagcagcctccagccgatgtctcatgctgagctattgtttcaacaaaaaatgagatgtctggtcatgttctctcttcctggggcagagattggggacctgcgttgaaaaccagtgacaacttccctttgccttactgaagataaaggggaatcaggcaaaaggatgctcaaccaaagctgcaggcaagcggattcccaggcagaacctggtcaaggctttgtaggcatcacttcttctctgagacacagagagcttggcatctctgtgcactttcataatacacaatggttagcattttaatctctggcagcctcatgcaaagaaaaaaattattccaaggcagtgccaggaatcctaatgtcctccatggtatttttccaaaacaattccttaatagataactatcatctttcctatcttacagaagaggaaacctttatcgtcatgtaggtgtgaaacaagaggtacatttgcagggctgccatgaagcattgtcattacacacatttatggtgtgaggaagtgctgttatagtctccaaaactttgaaatcatctcttcttgacttttacttcgactcttttttcaattttaattctaaggttgacttgtattctcggtcccctttgaatagaaccttagatcccccatgtcacattcaaaagacatgtttcaagtgccgtttttcatcttgacatgttttgcaaggtccttgcctctgtgactttgagatctgtttaattcactgcggtgggctgggtaggactcttccagtcttgtgatagtgctgtgttgctggttagatcaatgacatagactctttctgtttaagaataatgcagtaagcaatggtgaatgcttggaatgataactgtaatcatgcacctgttcactgcagttcaaagggggcaaaaacaggtgtacctttgctggtcatcacagcaaaactaatttagtttttttcttctttctttctctcctctttgacaatttgtgtaggggtctgtgcattaaaatggataattttaaggaaattctgtaaaataggtatgcatgagtattgtagaagtatcatgtagtagagatcatacgcaattatttctgtattaattaaagtgtgtccagatacctttaaacaacagttttaaacgttcaaaacagtggaatacatgttgcccaataagtgaaataatatatactgcaatgtatagaacaggtactagctgtatttaatagtgaagttatgcttaatttgaaatgcttcacatttgtttataaatccatcatcagaagcaatgtttgttatgatcaattcagacgtttggaatcaggaggtccagaaggcagccgtaggcagttgtttgtgcattcagactacagagtatcaagaaaatcccaatttgctcagataggtaggtgtgaaaaccaacaatttctttgaaccactcgtcttacaacctcagtgtattctatattgtgcatagatgacagaagaaacattcattcctaagatacctacaaaatgagcaaaaccagcagcataaatggacccagtagtaatctatctccagtgcgtcttaattttgtgcatcatccatttgtgactttcttttgttctttctgttaatcagagatcttttcagtggcaggtgacatatgcccaacttgaatggccttaaggaaaaaaacagtattgtctcatgtgattgaaacatctatgtatatatagctggtttggggcaaagctgaatcaagatgatcagatgatgttgccaggaatacttcttcccacattacacactcttctgtatgccatgtattttcaggctgttcccttaaagtggcaagatggcttccagcagggatacgcttacatcatcccagctcaggagcctgacggcaaagagaaccttctcttcagtggttcaggataagtcccggccagatctcagttgcttacccatcctaagaagcagggttttgttttaactgcactatcaccacgtaattataggagaaagggaaaaggtttcttcaatgagtctttaaaatatttaacattaaaaaattgacactaaaaattgtatattatgtaaaacaggatgttttgaaatatatatatattgtggaatgcttaaattgggtttaaatgagttaaattaatacatgcattacttcccctgtttattgtgtgtgtgtgtgtgtgttgagaacacttaaaatctattcctttagcaatttcctagtatacagtacctaattattaactgtagtcaccatgatgtacaacaggtctgttggatttattcctcttatctaactgaattttttttatccattgactaatgtctccccagctcccctctctccgcactggtaaccaccattctgttctctgcatttatgggttcacttctttaagattccacatacaaatgagataatacagtatttttctgagtttggcctttttttttgagacaaagtctcactctgtcacccaggctatagtgccgtggtgccatcctagctcacagcaaacttcgcctcccaggatcaagcaattctcctgcctcagcctcctgagtagctgggattacaggtgcacaccaccatgcctggctaatttttgtatttttagcagagacagggtttcaccttgttggccagggtggtcttgaactcctgacctaaagtgatccacctgcctcggcctctgaaattgctgggattacagacatgagccaccacgctcagctgtgtgcttggcttcctttaaggcatcttaatgctagaagaagctagaccatgacagacaagtaaaaaagaatgaaaatctactagggtagaggtttttagtgtaaaaaacagagagatgatttttcaaagaaagaactctcctcaaccctctttttacatacaaacttgtagaaaaattaaaacacacagtgaaaacccatataacttttgtgtagtttcaccaatgattaacattttgtgacatttactttctctttctaccctccgtcttcccatatatattggacaatttgaaaattacaggcaccatgaacaactcatgcctaaaggcttcaacatgcttctcttaaaaacaaggcggtttttgcctggcacagtggctcacgcctgtaatcccagcactttgggaggccgaggagaatggatcacctgaggtcaggagtttgagaccagcctggccaacatggtgaaaccgctgtctctactaaaaatacaaaaattagctgggcgtggtggcacacacctgtaatcccagctactcgggaggctgaggcaggagaattgcttgaacctgggaggcagaggttgcagtgagctgagattgtgccactgtactccagcctgggcacagagcaagactgtgtctcgggaaaaaaaaaaagaaaggcagttttgctatacagccacaaaacaattcttatttttttaatgtagatactaactggaacatgcatcgcacttagttgtccttatttctttcacagcttttgatctagaagagtactctcggctgggtgcgatggctcacgcctgtaatcccagcaatttgggaggccaaggcaggtggatcgtctgaggtcaggagttcgggaccagcctggccaacatgacaaaacctcgcatacaccaaacatacaaaaattagccaggtgtggtggtgcacacccgtaactcagctactctggaggctgaggctggagaatcgcttgaatctaggaggtggaggttgcagtgagccgagatcatgccactgcactccagtctgggcaacagagtgagactaagtctgaaaaacaaaaaatgagaaatgcaccttcctccctgcattttttggtcttctatgatgttgatttacaaagttagtcttggaccattttcttgtagaacatctgaaaatcaggacttacttgattatttccctgtcattcagttcaacttcagcactttgtggagagtgctccccaggccatgctgtctcactgcctccttagctggaggtccttgatgtcactttctcccatgatgtgtggcagtaaagttggtcactgggtaactgacaaatttccccaggatacactagtcttgtacttaggaaataacctatgcatctgtactttgatactacctaactatccttttttccatcatcccttcatcattgaggaaccttttcagaatgggttattacactgatagtagtgacatgatgcttttctaattttatcattccatctatattacaaaaaaacccctaaatattggctgtacccactttagtagaaccatggcacccagctagaataccactgccagaaaagaaactatttttaaactatttggcaaaaataacagaactctaaccagccaatgggttctccttgcctgctgcctagacaaagctgttttatcaagacagggaaattgcaatagaaaatatgtgtaattcacccagagccagctgtatgggagaccagcgtgttgttattactcaaattagtctccctgaaaacccaggaactggggtttttcaggattatttggtgggtagggggtcagaaagtggaagtgctgactggtcaggttggagatgagtcacttcctcggtggggtccacagaccagatgagccagttgatccatatgggtgatgcccactgatccatcaagtgcagagtctgcaaaatatctcgaccactggtcttatattttacaatagtggtgttatcccaggagcaatctggggaggttcaaaatcttgcagctcctagctgcaggactcctaaatcataatttctaatcttgtggctcatttgttagtcctgcaaaggcagtctagttcccaggcataaagggggattgtttggggaaagggctgttctcatctttgtttcaaaattaaactataaactaggttatttccaaagttagttcagcctatgcccataaatgaacaaggacagcttggaggtaagaagcaagatggagccagttaggtcatacctctctttcactgtttcgatttcctcagctataatttttacacaggcagtttcaactccacctgtagctacatcatgagcttgaagaaaagaatcaataatgaccacaatttccagtcactcctcttctgatagaaaggccaagaagtagctcttagtcttggttggggatctcttggccaaaaagaaaaaggaaagagaaaagataactgaaacagtgacaactgagagaagaatgatagcgttttgtaagcatcaccattttttcagcgttaaatactcagaatggagtatggggaacttctaagttcacatggcatattcaaattctccttgtttagaatttcaagagctattacttttctttgattcagttcgattatctttcatgatcctcagaaattgtacttttctccccatttcagactaagaaagtccttagccaaatggcctcaaccatcggatttgcctgtaggtgtcattcatttttgttgtttcttcccacctccctggggtttttcagtagtgcttcctttcaatcaaaagctaattttttttgtgtgtgtaggtggtatagaattccatgcttttacacagtagcaggcctgtatttgatgtacctggttcagagacaattgtcctttatagctttcgggagtaaattcaatgagagccccctgcgactagtttgtaactcatttagtgagagttctacaggattatttcacaaagcagttctcagcttaagaagctaaattggcttcatggggcctagctggaggcctcttcatccctgcattcagaggatatttacatgcatactacgaatctttctagaaaatgggaggagggttcgtattgacggtcgtacatttcctcaacttagctgtccgtgaagggtgttgggatgggtgtttgataattagggagaatattttgtttcataatacatggacagctctgtcatattggcaagtgcgtttgacatgcaagaattgtacagttataaggagtgacccgtggcaaaagcagaccatgcatttgcacatttaggttagtatagtgggtaagatgagagactttggagtcacactgcgagagtcccagtgctggactacactttgggaaggtacataacctctctgaacttggttttggcacttgcaagatgtggacaagtataattgtgtgctgggcaggatagcttatgtgtattaagtgctgtgattattcttagatttctttgtctaagagttcgcacactgtgtattatacaataaatacattcataattgaaaaacctggccaggcgtggctgctcatgcctgtaatcccagtgctttgggaggccaaggagggtggatcacttgaggccaggagttcaagaccagcctggccaacatgatgaaacaccacctctactaaaaatatatattttttaagtattagccggtgcagtggtgcatgcctgtagtcccagctacttgggaggctgaggcatgagaatcacttgaacttgggaggcggagattgcagtgagctgagattgtactactgcactccagtctgggtgtcgtagtgagactctgtctcacaaaaaaaggaaaatgaaaaacctttgtgttatgcatattatacagagccctttctaaaaagaacagcagggcgacccctgcctgagttcctggtagagctgggagaggagaccatttatgcactgggagtgacccagtcatttttgtcagatgatagaaactgcttttcttcagtatatctctgtcttagtcttagctgttgtgacacggggcaactctagtatcttctgctttttctacagcttaatttctatctaatttgtactattatatttaattggaaaattgcccagaaagcagagtctgcatttgtaaatgaagaaggagaagcattttaaacgcactaacaaacctcactttttaaaacaagattaacgtcttttacatgaaggaacccttttgaaagaatttgggaaaagacatgagaaaacacatttgctttgtgaactggaattttatatttggaactggcttcacagaagacagagatgttaagtaatatttgatgggtgtctactgtgggctgtatgacttcctaagcatcctattatttaatcatatagttgtaaatataaaacttaacagtttcagacttccatgtgtgtgaaattggagatttggagactttagacacacgttccaatgtcagggtaggacgattgagtcagccagaatttcacatgtatctctccaacttcttttctttctgtccctcctttaacgtctctgcaatatttcaatttcagaaaattgaaagaataataactaccagccattgggctttcttttgtgtggtactaggcagtaagttggacattgcatacatattaattctaagcttcctccatgatggatattatctgcagttgtacatttcttctcctttctcttagctatccacaaagggtctttggatgggtgcttcataattagggagaatattttgtttcataatacaggaacaagagtgtcatatgggagggtgcattttacatggcaagaattgtgcagtcctaagaaatgaccagtggtaaaatggagcgtgcatttgtacatttaggttaggatagtgaataaggtgagagactttggagtcagattacaggagtccatatgctggctccaccatgtaatacctttctttgctttgaagagatatacatatggggaagcggaagttctgctactaagtaatggaatttgctatctgtttagttttgaagctcatagtcccctgagaaatgtcgtgtgtgtgtgtgtacccacctgtgtgtagatgtgcacagagagctccccctggtagatgaaatagaggttattctgttgtaggcaaatgttccctggacattaaaatactggattccagttctattcatccaggcaagttgctgattagctgtttttttctcaggggtttcttgagcatgtgattatgcagagagagtggagatcattggctgggcacggtggctcatgcctgtaatcccagcaccttgggaggctgaggcaagcggatcatctgaggtcaggagttcacgactagcccggccaacatggtaaaacctgtctgtactaaaaatacaaaagttagctgggtgtggtggcaggtgcctgtactcccagctacttgggatgctgaggcaggagaatcacttgagcctggaagacagaggttgcagtgggctgagatggcaccattgcgctccagcctgggcaacaggagtgaaactctgtctcataaaataaaataaaaaagagagtggagatcaccctcttccacgtacccatctctctctgccctactggatctcatgtattccctaaaatgtattgctcaatacagggtgtaagtttaccaggtggtgttataatcagttcaggcactaaaagaaagggttaaaatcatgcggaatcacagagaaaaaataatgatctgcctatcctttttcctgagagtttcctgatgccccaagaggaaatattcagtttggtgatcgcctctttttgatgacatttgccagttttccttgtactagagggagaattgagcctcaggctgacaatgggatccatctagaatcgaggattgtggctttgctttggtcctatttgttttcatttgttgcttctcttcatgatagaattcctggttttcaaattatgctggtaatgtgagtgccctgttcatttgtttttcagaatttaatgtatgccaataaaaaggtgaattgtttgaaggaagtaagatttttacttcttattttacagaggcatgccattcagtagcactggaacagagaggaggagaaactggagagcagaaaggcaggtggcattagcatatgtcagattttcaatgaggactacggatatggcaatattgggaaggtgatctctgaatgatggaaatttaggaaagatgtttaaagtgcttgtctctcattgcctagcgatttactggcattgtagactccaccccaatgcttttgttcaatttggcgtttaggattagtcatgcacgtggaagattccagcctccctccgcccagtgttacagcttggactgaatatttattaactacccagggaacatcacactgtttgaggacacttgagttcatctatatccacaaaatgtgtcctcatcatgttgaagtggaacagcaattcataagaaatgacaggagcttagcaagaatatataggggaaaatcctttgtctagtaagagtgtgaagtgcccaggaaggtgcttccagcaaataatgctgaatgttggtgactgctaaatgaagaaggaaacacgaagttcagatttaacagaaccatctagacagccatacttcccatgaccctgggaggccgacaagatcccatatttaacctatccttaccaatgttatgagaaaaacaagaatgcatgtgcgattataaatggtggctgactttcaattttaggttgagatacaaaagcaggtggtgggggggtctgtggcaaactcggcaataaatgccccaggtgaagaggctgcccagctctcacagattgttgacatgtaggaatcagtgcctctgattttccaggaaaagtcaagaatctaggtttttaatgtaaaagctcctgtttttcaattatgggcaactagtttattatttaaactacttgggctaggaccctaaataagtatgttcaggttgtggattgtacaactcaagggacccagcacgctcatctttgtacttttttttttgagatgtttttattgaggttcacttactatatggtatgcgtatgccacaaaattcacctatttaaagtgtacacttcagtgttttttgttggtttgtttttgagacggagtctcattccgtcgcccaggctggagtgcagtggcgtgatctcagctaactgtaacctccgcctcccgggttcaagcgattctcctggctcagcgtctggagtagctgggactacaggtgcgtgccaccacaccgggctaatttttgtgtttatagcagagacaaggtttcaccgtgttggccaggctggtcttggtcttctgagctcgttatccacccgcctctgcctcccaaagtgctgggattacaggcatgagccaccgcacctggccttccgtggtttttaatgtattcacagagctgggcaatcatcaacacaccatcagcgcattctaaatttagcatatttttattgctccagaaagacacgttgtccccattagtactcacaccctgtacacccttaccccaccctgtagccctacacagccagcattctgctctatctctataggtttacctattctgggtatgtcatgtaaattgaatcatgtaatatgtggcctttcatgtctggcttctttactaagcataatgttttcaagggccatcaatgttgtaccatgtgtcaatttaattcacgttttgtagccaaataatattacgttatataaatatacgacgttgtgtttgtccattcattggttgtcaaacatttggattgtttccacttttcagctattagaaacaatgcttctatgaacattgatgtacaagtttttctgtgtacttacgtttttatttctcttggatatatacctacaagtggaatttctgggtcatatggactctatttttaacattttgaggaacttccaaaccgttttccaacgtgggtaccccattttacattcccaccagcaatgtctctggcttcccttttgtccacatcgtcacgaatacttgttattatttctctttgacaatagccattttgataggtatgaagtacagctcatcatggatttgacttgcatttccctaatgattactggcattaagcatctttttaatgtgcttgttgggcatttgttgtatcttctttggacaaaccctattaaaaaaatacttcgccaacttttaaaatagggctatttgtctttttattaagttttattgttggaaacttttttattaagttttatataagggttttaatggaactttttatttttaagttgtatgtaagggttctatattctgaataaaaattttcaaatcacatgtgatttgaaaatattctgtttcattctgtggatttcctttttacttcttatatgggattgtcagcagcacaattaaaaaatggatacagtccaatttattttttattgcttattcttttggtgtcattttttagaatctgtttttcaccccaaggtcacagagatttactcctgtttcttttttctgggagttgtatagtattagctctaacatttaggcctatgattcattttgagttaaattttgcatgtggtgagataaggatttgcatttgtatctttgcatatggatatccagttaccccagcaccattcattgaaaatcctattttctcactgaattgactaggtacttcttactgactttgaccctagggtgcgtcactgcagttgtttaattgtagaatgtaaatatatgaaggtatattaattctcctactagggaaaaattaactgcaaaaggaggggtcccactcctgtgttcctggcatttttagtttctgcatcagcctcaactctaggataagagatgggtaattcttaatgagaacagaacttcagaataaaagtctcagctggaaaataacttgattttcagtaggcttgttcatatgttgtatatatgtgacttagataatcattataaatacagttgattctaccaagtcttttgaactgtaagtcttagctgggctctgagcaaagcccttcttccttcttggatatacatgcatgcacagccacacacaatacacaaatgtaccctggtggataaggcatttacaattgagaacagctgatagttctatatagtgctatatcgagatagagaaatagctaaagatgtaaatatacacacccttgatacattcatacacacacacagcattaagttaggcagcccctggtttctgccactagcacagctttctgaatgaatgagctctcgagaggggaacttactggaaagctttcttatcaacttggtaaaggtttgattttcttgccccctacagtggctgtttgtcaccctgactgcagctagaattgctgtgttctgttctttttctggagaaattacaaaaggagttgacatctactgtataaaatgaaacctagcaaattttataaattactaaggacgattctctaatcttcatatctcatctccagcatccaaggaggtggagaagtagttgggtgcgtattcacctagactttgttttgcagtaatgtgtgccagttttataccctaaagccatctgagtccccttttcctttccctgtctccattatccatctggataagccagatcttcaatatcctagcctcctttaaaaccagggacccaaccaggcgcggtggctcacaccagtaatcccagcactttgggaggccgaggtgggcggatcacaaggtcaggagtttgagaccaccctgaccaacatggtgaaaccctgtctctactaaaaatataaaaaattagccaggcgtggttgcaggcgcctgtagtcccagctattcgggaggctgaggcaggagaatggcgtgaacccgggaggtggaagattgcagtgagctgagatagcaccattgcactccagcttgggttgagagcaagactccatctcaaaaaacaaaacaaaaccaaaaaacagggacccaattctggctgctgaaacatcagaaagaagtccacaggaaaggtagccaggattttcttccagtttaaaaggagcaagccacataagcagccacctttttctgcactgacagttacctgtgccttgcctttgggtgtggtgttgatccttggagctgccatggccatcttggcaccatgaagtgagtatcctcagaacaaacatttgttgggctaaagagggtgaaacagaaaagtagaaggaactttggtccttaataacaccgggagttgctcagaaagtccagggctgccttttattctggaattcttatttaagacaaaatgatatctttatggttatagtcactttggtcaggtttggttttctggtacttgtggcagaaggcatccttatagatgcacctatacatataccaatgtatccacatccgtgtcttcacacacacatctgtttcctatatgcagaacatgcattcataaatatgtagggttttttaaatgtgatcagacactatatagtttctaacttgcctttttttcattccactatataattaagacatcctttcttgtcaggatctaaaattattatttactcttttaaaagactgcatgttattttatattatgtatggacctgatttatttaatactctcctattagtagatgtttaggtagatgtgaattgattggccagtacaaagtaaaagtgtaaccagtgttataaaactaatgttcttgttatctcccagtaatcctattaatcagtctgtagaaaataaagaggacgtcagaccgatatatacaaagatgattattccaatattaagcataatggagaaacatgagaaacactttaaaagttcaatataaaaggacttgtagtttatgatctatacatatgataaacagtattatgtgaccattcaaaatggcttttaagaatacgtagtggctggctgggcgtggtggctcacgtctgtaatctcagcactttgggtggctgaggcaggcagatcacgaggttgggagttcgagaccagccggaccaatatggtgaaaccctgtctctactaaaaatacaaaaattagctgggcatggtggcatgcacctgtagtcccagctactcgggaggctgaggcaggagaatcacttgaatccaggagatggaagttacagtgagctgagattgcgccactgcactccagcctgtgtaacagagcaagactccatgttaaaaacaaaacaaaacaaaacaaactcctctgtttcccatcccagtgtcagcacgtaaggtgacaactgacaagatctgtctcataatgtgaataatggttttctctgggaggtgagaagatgaatgcttttagattaaaataaataccagtcagtatgttccaaatcacctgatacggtcatttggcgttatccatgtacttgtacaaatttttctcttctaacccacatgtttctactgttctcatccaaagacgtgttgcaaatcattatccagaacatgggtattgataactgcaatgttcttggggctttgcataacttccaataaagcaaaaccacatctctgaatccattttaaatttgcagtcagccaggggtcctctaatggttgtgcgttttggggaaattgtgacctgggtctagtaatgagtctcttccttgggagttaaagtactctgggaacatacaccatctatctcagaatactttgctgaaataagaataacaaggacgcttcaaaaaaatactaagcgacacacctaaagggcttaaacactaataagtgagagaatctagtggctaggaacttcagttctcaagccagtaacaaaactcctaccatttcttacttgcaaaaacttgattttcccccgtgtaaatcaggctaatctttttattcctttactagtgacactaatactattcagcagccatatggcagagtgcttcagaactgctgctgtggagccgaacttctccactactctgtttcccatcccagtgctcaccacctagttaagccatcttgagcaggtgcgtgtaacttaatgcaaccttcagttctgtatttctgaaaggcaattaatgagagcacttagcttagagagctgtgagcattacatgagctaacacttgttaggcaactagaacagcaccctgcacatagtaaatattctgtcagtggtacaaagtgttaacccacaatcaacaaagcattgaacgcagtccataactcacagtaaggtatgcaacatgttgtcctattgccatcttcttcccaaagcccagataactgcaaagggcatctgggtggcactgctgggactggaacatgtagaggaagagggttagggaagcattcatgggtttttcaagctcatttttctcacttcccttaccagacccatcacccaatttagtaggacacagaatcagattattattactttttgtcttctcaaagacacatttttccttgaaattaatggtggtgctgatgaacacgaaatccaccagacagaatctcggggcttttgttctcagtcctcccctacctggttctctctcctcccccatttccctcctgcccagcattgagctccagctgagctactgtcaggaggctgctctgctaagcagtctgtcacatgttccgttacaatcatgttttattatagctttcaaaagatgacctctcattctgcacactcgtgttcatagaggacttctggcattctgaaaagaaccagatagcagagtctccaaaccctttatttgcttcagctgataactgctctggccagagacgaacgctgtggtgattataagatgtaatttactacaaaagaccgttaatattacttacaaacctgccatcatttctggggaaatcagaactgaaacagtggacgggacacatctgaatccacctaaatatcttggcctgatagaattacaagtttatagatttaccatttaggaaacagccccgttatgaaacatttgtcctcacagacagacagtataagtaacaagcaagattatatccttttatgtggatcaaggacatagtcaatgtaagaaaaaaaagatagaaaaaaaatccctttagaggaacgtaaatgctgcccttgtgaattataactggggaattagatctatgaaaaagcctctaatatgactaaacaaagtccctcaggtgatactctgagtcagaaaagtgtgagaaaatatagcctcttaaatgtgattatagtcagagctgcagttactccctgagaaaggacatagaaggtagaggaatgaaagaaaaaaacagtgtttgaaaactttttgtgtcagaccagaaattatagagtagcaacagcttagggatttaagtaacccctttagcctagttgtaaagcctttgggctttaaactgaagaacagaaaggaattagatatccaacttagtacttgtttttttaagatcatgaaatggaagagtcttttttgctgaatgacgaattgaaccagcatataattccaactagggctataattagaaagatacggctctagtatttaagcttcttacactctcccctctctcatgaactttcattagagtttcttgtctacttggttatatttaatggagatgaaggtgagagttacggtgcttttgttggtattgtggccagactccgggagagtcctaaaatcggtgtttgtcatttacctctcctctttgagaaattttaagggaactctacatacaagaagctataccagcgtaaggatcctggaccattctactcatagttttgcaagcaccctatgcttggagttagctctggttaaaggctgtaaaaggaccactgttcctccatcctatccccagtccaatccttgggactagctcgctcaggaactctcagaggtacatattaaaaagaacgtataagaggtcagatctgtaggagaggcttcatcttaagtcattctcccgggtatatttgttgaggtcaagagcaaggaaggagaaaagatatagctgagtttaaccaaagcaaacaggaccttgctcagccaactagtgctgcccgcatggaattgaagatgttaaagagaggggttagagcttgaagaggatgttaaagagaggggttagagtcacagtttgtgcattttaaaggacagtgaccttgactagtggtaatggggtcaaatcattaattcagaccattcagataaacaactcttctctcttgtcaggtaggacaggggatggaggaatgaagtacctagaagcagcttggtaggagaacaaaggcgtcctatttctctcctttccctccattattcatttattccctaagttgtttattggccatttgtctgtcttctttggagaaatgtttgttcaaatcctttgcccattttttaatttgtagtttgttgttgctgctgttgaattttaggagttctttatacattctcggtattcattcctgataagatagatgattggcaaatattctctcccattcagtgggttgccttttcactcttttaatagtgtctttgatttgctaaagtttttaattctgaaaaagtccgacgtattctttttcctttttgttgcctgtactttttgtcctgagctgtttataaggaaaacagcaaaccgtttgtctgagtataggatggtctctctagagcaagaagggaaggcaggtgaatctcatgactccagctggaaggagagaggatcagtctgtgctgaatccccaacagctgacctccaagaggtcttgatgttcttacagaaaggccacctgcaggacagggttgtgtgtgctgctgggaggccaggcggggactcctgggaaagccttctcctggctccagttccatttggctcatctccaaggtggccaggtactcactgatgcatggacagctcatatgttcatctgtgaactatgtccaggctcaagatgagctggaagtgcaattttttttccacttgctgctttatcccttctgtgcattcctcttgctatcatttagcacctggaaaaatgtagaattcaagatcagaaagacaactggagctcatgccccacacacccccaccatcacatgcaaatgaaattactgaggcctggagtgcttaagactctttcccaaatcctgtcactaataaaacgagagctggagattgggaatcctgacttgagccggtgctgttattaccctttttctaatcatcagtgcacccaaggaaaaagaagtttcccaattttatttatttcagtaagtatttactgtcattgtctactcttcatcctagtagcaaaaaaataaaatttgcaagtggaaactaatcatcaccgttgtggtcttagctgaattgttctttacagatctaaagagagaccacagaaagatctgaatggcagcatgccttaagaacaagattgacccagcttacttgtctcagggccaagtatatggcagaactcagtcatctaaaggagagactgaccccggggaaaggcagcccacattgccagagcttctgattttttcaagagaacctggcagttggagtcttgtatgaaatagcttgatgtatacaactaaaggatttaagggaatctgtttcttaaaatttaatatgaaggccaccatctcctgcacaaaacaaaaatctttttgtgttatcaaaatggactgttgatttaagaaccttgctcttgctttagatcagagccctcaaacacattggaatgattcggagagctttagaaaacatgcatgccttagccccactccacactccatgattctgagcctcttggggtaggctctgggcatcagcacttgagaaagcccccccgggcagccgctatgtgcagctgggggttatgcaccactaggctgactgtagtgtgaacattgaggatcctaccccaatcctcttctttcccatgggtaaggacatctggactgtgattgctggacatcaggatggccttaatattagggttaacatctgaatcattggctgccttttttatttctcgtcctgctgtttgggtactttatagacatagacagttgtccatgtgaccccatttgcctcgagttgcttctgtagagttttgatcccacactttgtgatgtgtctcagctctggggcgagggggctgttcagtgaagttggtttgtggcttcttccctctgatctccttttcttctcccagccttgggggttctgcagctaactgtggtcctttcatgtagctgcctttggtctgctggggactttgaaggtttgcctttgaaacacccagatccctttttggttccttcctctaccccatctgcttctctccactccccttactgttggcagcatcccctcgccttggcagtccagcttttgagagtcactgtgatcaacccagcaattcctactggggaaaaaaaaaagaaaaagtagggagccatgataggtgcaccatgtctatcaaagccatcaaaatggctattttagaaaaaaacctcaataaatattattgttgatcttgttacacatgataacagcattttcttatttttttaatttattttttttaagagatagggccttgctttgttgcccaagcaggacttacagtcttgcatttaagtgatcttcccatctcagcctcctgaatagctgtgcattcttgttatataagaaagtatctgtaatttttagtggcacaattggattataaagtagaggttaaatgataggaactctggagttgcttcaaatactttagaaaataaatgaataggtaaatagcaaggtaaagcaatggtggcaagctcttaattactgttgtatatgggtactgagtatataaaacccattatataacatgttctacttttgtgcatattgaaactttttattaagcatatacacatgcacacacacgtataattgtcagccctataacattctacaattcaataggaatatatgattccaagattctataattctttctttcttaccaattaattggtgcttgagattgatgtaactgaatgaatagatgacttcataaaaagtaaatgagcttgggcctggtggcacacgcctgtaatctcaacagttttggaaccttaggcaggcaggttacttgagcccagaatttgagaccagcctgggcgacatggcaaaacctcatctttaccaaaaaaagtaaaataaaattatatataaatataaatgtatttatagtgtgtgcatatatataaaaatatataaacacatgcacaacgtgtgtatttttatatatatacacacacaaattagctgggcacagtggtgcgcacctgtagtctcagctactcgggaagctaaggtgagagtactgcttaagcccaggagctcaaggctacagtgagatgtgatcaaaccactgtactgggtgacagagcaagaccctctctcaaaataaaataataatttataatgaaaccaacacatacaattaaagaaataaaaaataggccaaatagcatctatacttcaccttcccaacatgttagcttttacaggtagctgtctggcatttgtttcattgctgtccatctagtttggagttttgctttattgatttatgatattatcaagcacagactgtgaactggatcttatattgtggcaatattagctttctggctgctttgaatttgcagtcttaacccccaaagagagaaatcagaaatgacagcattttggccaaatacaagcgtccagtgcatttgtcatcggagtgatcggagtgaatctctcatttttacttgtgctgctactttacatgtagtgacttcaagtacagagtgaaaacttaatactcgttcattgttccagaaatatttattgggtactggctccccgccaggctctgggcagggcctagatgctgtgtcagcgaacaggagagattcagtccgtgtgttcgtggaggttgcatttagacgggcatttcattatgaaacaacacacgggaaactatacttgaaatatgcatcctggcaggccacagtggctcactcctgtaatcccagcactctaggagtctgaggcgggtggatcacttgagggcaggagttcgagaccagcctggccaacatggtgaaacctcgtctctactaaaattacagaaattagcggagcatggttgggggtgggggcagtgcctgtagtcccagctacttgggagactgaggcaggaggatcacttgaacccaggaggtggaggttgcaatgagccgagatcacgcccctgcactctagcctgggtgacagagcgagactctgtctcaaaaaagaaaaaaaaagaaatatacatcttataatgctgaatgtatttccagtaacatgcaagtgttgtggggagataggcagagacttggacaggtaatcggaggctaaaataggaatcctgtgaagtactactgcctttgatattttttccaagccaatatattagaaagccacttcttcctggaattcatgtatccagacacatttttatcttgatgaatttggggttgcatgtctcaaaaatgactgtacgtgttttaaaattttatgttctggggtacatgtccaggacgtgcagatttgttacacaggtaaacgtgtgccatagtgatttgctgcacctatcaacccatcacctagttattaagccccatacgcattagctgtttatcctgatgctttccctcctccttcccctctacgaggccccattgtgtgtagttcccctccctgtgtccatgtgttctcattgttcagctcccacctggaagtgagaacatgtggtgtttggttttctgtgttagtttgctaaggataatggcttccagttccatccatgtccctgcaaaaaacatctcattcctttttatggccgtatagcattccatgttgcatatgtaccacgttttctttatctggtctatcattgatgggcattttggttgactccacgtctttgctacagtgaatagtgctgcagtgaacatacgcgtgcatgtatctttataatagaatgatttgtattcctttgggtatatacccagtaataggattgctgggtcaaatggtgtttcttgttctgaatctttgaggaatcaccacactgtctttcacaatggttgaacaaatttacattcccactaacagtgtaaaagcattcctatttctccagagccttgtcagcatctgttgtttcttgactttttaataatcgccaaaaatggctatacattttttaatatacctgaggctgctgccttccaaacctactgactaatagtccctgagagtggaagtcagcactctgcattttagcaagcttcctagagaatttgtgggtgaacagatgagtgttcatctgactactgattggggacaatgacagaaagatatcagaatgtgctttgaaccatcttggaacaattcattgtggttattaggattaaaagggaagagaaatgtcagctctcatattcacatcccttaaaaatcaagcattaggatataataattcatttaatataaatgttataaccatatgaccaatttccagttatcataagcagttaggtctttcagtctctctcctctctctctctctctctcgctctctatctctcttcctctctctcttcctcctctgtctctccttactctttcttcctctctctcccctctcttctctctcctatctatctcctctccctctttcttcctcctctttccctcttcctcctctctctccgtcctgtctccctcctctctctctctcctctctctttctctctcttcttcctcctctatctctcctctctctttctgtcttcttccctctctgtattatgtctgcctatgtgggcatgtgagtgtgcaaataagaaataattattttagaattttgtggtttccccctgctgtatatggttccaaaattcagtgtctacaacatagctcccgaataatgtttcacatcctaatgagcgatcatagaatgggagaacaaacttaacatgacttacatcctcatttagcctttaaaattctctttgtccacaaacctccttgtttctggagttggcaacatactgaaatagaatatatacaaacttggaaacagctatgagcttgacctaaaaccttaactctgaccctttactgggaaggctttggtaggtgatacatcctctgtaatattttatcttctacatcaaaaaagtccttcattgtacagaattttgagagaaattaatgagacaatgtctcatagcacctgaaacaacgggttctcaagaaatactatttcattgattactcctcactttcttaactcttaccagacctattttgagtctgtatccttggtatcatcattttttctcaaattatttctaaggcagcattggtttgtgttataatcattaatagatacctgaattaagtgaaatatttcaaagtaaagccatatagtatcctgtggggaaaagcctatcttttgagccagaaagactggcttaaatcccagtattattgttcacctctttgtgggttttgtttatatgtttatacacattagttttaccatctgcaaaatggggataacagttttcacccttattcgtttcctgttactatttcccaaattgtcacaagcttagtgacttaaaacaacagaaattgcccaggtatggtggctcacatgtgtaattctaatattttggaaggctgaggtgggagaatcgcttgagaccaggagtttgagatgagcttgggcaacatggcaagaccccatctctacaaaaattaactagtcatggcggcacatgcctgtggtctcaggagggtgaggtagaaggatgacttgggtccaggagtttgacgctacagtgagccatgattgtaccactgcattctaacctgtgcatcagagcaagagcttgtctcaaaaacaaacaaaaacagaagttggtcatctcatagttgtagagatcagaagtctgcagtgtgtctcactggactaaaatcatggtgccagcagggctgtttttttcttgagcctgtagaggagatcttttttcttgcccttcccaacttttagaatccactctgctcccttgggtcacagccttttccaagttcaaagccagccatggccaggcaagcctttcttccatcaggtcactctgacctgacccttctgtctccctctcccatatttgaagacccttgtgattacctggagcccatcttgatgatcctgaataatttccctatttaaggtctgctaatcagcaaccttgattcccttttaccatgtcatatgatacattcgcaggctccaggacagacatggacatctttaggggccacaattctgccttccacagccactttatagatggttgttgggattactgggaagatgtagtaaagttcttagcacagtggctgggtatggagtgtagtatgttctgtagatggagaggttgacgtggaaaatgattttcttttttctcttttttatttttattttttgagacagggtctcactctgttgtccaggctggagtgcagtagtgcagtctcagctcactgcaatctcctctgcctcccaggctcaatcctcccacctcagcctcccgagtaactgggacaacaggtgcatgccaccacacttggctaatttttgtattttttgtaacaacggggtttcactacattgcccaggctggtatgatttttctaaaatcaaggcatttccttaatttaaaaaaaaatttgtttatttctttactggattagctgtttgggggaatcctgaagttaaccctatgtaaagattcacccagatggttcagtgtttccttcatagataaccccctttaaaaacactagcaatgggtcaggcatggtgaatcaggcctgtaatgctagcactttgggaggccgaggcaggcaaattacaaggtcaaaaggtcaagaccatcctggccaacatggtgaaaccccatctttagtaaatatatgaaaaatagctgggtgtggtggtgcgcacctgtagtcccagctacttgggaggctgaggcacgagacttgcttgaacccaggaggtggaggttgccgtgagccgagatcacgccattgcactccaggcctggcagtagtgtgaggctctgacacaaaacaaaacaaaacaaaacaaaacaaaacaaaacaaaaacccactaacaatgatgatgtgggggaaaatggccagacagaaataaaataagaacggaggtagatgacattcaaagtgtgtttcatggacctcacgttgattctcaaagcctgaagctcttcggtgtgcattagactaaattatcattctgctgagagtgcatctatgttttcttttccactgtttgtttttaaatgttgtaaaaacaataataaagtatggcattattagtaagcatgaattatggaagaaactcatctggaccagggaaacattgacattcttatttttttagaggaagacagagtatcccactatcacccaggctggagtgcagtggtgcaatcatggctcactgcagcatcaaccttgccggctcaagtgatcctcccacttcagcctccagagtagctggaatcacaggtgcatgccaccacactcagctgatttttttgtactttttgtagagatgaggactccctttgttgctaagactgctctcaaaatcctggtctcacaggatcctcccaccttagcctcccgaaatgctgggattaccggtgtaaactactacaccccacccgatcaacattatcctgattatacattaactcaggtgagcttcatatatgtgaagaaacactgaaagatcagattgcgaagtggtcttgttactcagcagcttccgccaaacaatcactaccatgataacatcaccaacaaaatgtctgtgactttcacatcccctgctttgagaagtagaaataaaaatgttctgggcatacataccacttatgaattgactgccaaactgttcttttaaaagtaggtcatttgatatgcctgttccactgataacatatcttaatatatagtagaccataaaatgtggaagatcataatatacaatctgcattcacttagcagcaactttttccttagctggagcacagatatacttaataccaaattagaagaaagtgtatgttattgtggaaataagattttaccattaaggcctaagaagcaaaagcaggaaaccaacaggaacccataaatggttggagatgacaaagtggactgtaatagtctttgtgtagttatttttttgagggggaggggacgaagtctctctgtcacccaggctggagtataatggtgcaatctaggatcactgcaacctccggctcccaggttcaagcaattctcctgcctcagcctcccaaatagctgagaatacaggcgcacaccaccacgcctggctaatttttgtatttttagtagagacagggttttgccatgttggccaggctgatctcaaactcctgacctcaggtgatccatctgcctcagcctcccaaagtgctgggatgtcaggcgtgagccactgtgcctggccgtcttcatctgcttttacatgatgcttcctgtttccctcggagaggtctccttggatgctctttgcccccgtgtgattctggtactcatacaacttgacatttcttctcatcacatgagactccacagtgagcatggtttttcctatccgtgttccgctgttcaaggaaactgcctgcagatgctcagagctttctttctcctttctttgtgctttatcagagcaaggatgattccggcttaccttgtccgtggcttctggatattttcacccagtagagggcgtgagtggaaactctgaatgcaggagaagccagaactcatcttccccttctctctctgcttcccaaggcaccctgagtcctccctcagggccctcctccaaggccctgtctcccgctgggcagtgtccaccatggcacgtgaccctggtttctggtctctgaagacacctcctcttcccattggttgcaagggttttggtagcttctgcagtcacctcttcctcaattctgttaccgttccttctttggcctctcagatctcccgagtccccttgatgaaaaaattccttttggttgaaaagtcccggaatagttcctgtttcttgcattattctaatatatttacgtctaaaacaaccctcccctcttgcatatggtacatgatgcatctagggattatccctggtaagaatttgctcatcttttattttctgtttgtttaattattttgaaggaattttagactcagggtaagtttagctttatagagagtcctagtatactcttgaccaatattcccctaaatgttaaaattttgcatgatcacaacacatttctcaaaactaagaaaccaactttgggatgatattacaaactaaactgcaggcatacgtttttaataaaaccaacattgccactgcttttaaaagtagtaaataaaaacacatatcatgtatgcatatgtgtgtatgtgcagatctctaattacgtatattgacttatttaagtttcacgtgtacttacagcacaaactacttttacaaggcagttggaattggatggtgagcttgccatgaggctagagccattcatttcccagatgttaaaaacatttgtttggcccgggtgtagttggtcacacctgtaatcccagcactttggaaggccgaggcaggtggatgacttgaggtcaggagttcaagatcagcctggccaacatgacaaaacccctcctctactaaaaatacaaaaattagccgggtgtggtggtcggtgtctgcaatcccagctactcaggaggctgaggcaggagaattacttgaacctaggaggtggagactgcagtgagccaagatcatgccactgcactccagcctgggagacagtgagactctctctcaaaaaaaaaaaaaaaataataataataatatttgtttgttccagagggctgtttccttaaaactgaaagtgaagattaccaaattcagtttgacaaacaaagcccccgtacagttcacgtgccaagtgagagaaggcaggtgccagtcccagcatgtgtgtgtgtgtgtgtgtgtgtgtgtgtgtgtgtgtgtgagtgtgtgtgtgtgttttggaattcacaggataaatactgtggtacaggaactgtcaggcctgattaatacttttgcactcgcggtgcatgtgccttgatctataggcattatgcttgctgcgtgggtccctcacaaggcagccattagcatcagcttccaagcagctcccccactgtgcacttcccttccctgtcatatgcttggctgtcatctttgctaaaggattttcaggttggtttgcaataagggtaaacttgggaaggatggagagcaatttcctttgaatgctcaggatggtgggggctggttcttagcacacagaaaatccatatgagaatgcctaggacaaagcgggggaatgatttctgtatacggtgtggtgtttagtacgtgaaacccttaggcccccttaaagtcttccgctccaacccttaaacagttaagcatatagattagcatcacttacatgcaaggacattgtaaaatatgatatgtttacaaaatgctatggaacgctagatgattattaaacataatgaggttgaaatctaattccataatatgaagatgcccatgttttattcagtagaataagcaacttgtagagtaacataagtagtgtgttatctcattttttaaaaaaggtagataagtaccaaggagggcagatcactcgaggccaagcgtttgagaccggcctggccaacatggcgaaaccccatctctactacaaatataaaaaattagccgggtgtggtggtgtgtgcctgtaatcccagctacctgggaggctgagggaggagaatcacttgaatctgggaggcagaggttgcagtgagctgagattgtgccactgcactccagcctgggcgacagagtgtgactcagtctccaaaaaggaaaaagaaaaaagaagatagattcagatactgcaataatttggaagctttatacagcaattactaaccagagtttttcttttgtaagtgagtttaggtgaaactttccctttctacattgtaagttgctttattgtttgtagattttataacgaataggtaatatttttggaattcccaaaaaatattgaatttcccatgtaagataatattttctacagatcatatcattcagatcttgtttcttctaagtaatgaaattctgatgcatttcatactgcctgctgcaagtaaggatgtctgaaatggacaataataaactaaagatagaaagaatcccttctgagtcttacactggatggacttcctgccctccagccatctttaaatatcatgccaggtatgaagaattaacatccctgatttttcttttagaaagaatattggtatctgcctagaaagaagatggttattaaaaagaataaaagcagacctgctttttcctgcccagttaatctttaccgggacaggacaaaccaatcactgcggaatgttttgtgggtgtcctgaggctgctgtaactgagtatcacagactggacgacttagaacatcagaaatgtcttcgcctagttctggaggttgcatgtctgaaatcaaagtgtgggcaggcttggttccttctgcaggatctgaggaagtagcctctttccttactcctagtgatttgccccacagtctttggtgttcctcggcttatgggtctatcactccagtctctggctttatcttcgtgtggcattttccatctgtctctgacttcacatggccattttatttatgaggacatcagtcatattgacctagggactcaccctactccagggttacctcatcttaactaatcacttctattaataaagtgactctgtgtttgaaaatgtttgcatttggaggtatccggggttaggacttcaccgtatctttttgttgctaacagacactttaaaaatatagatgactgcatcccaattaccagtcgaattgttttgggcattatttattaagagaaataaccattgtgatgcataagatgatctgtgagccctgtgctgcagacgagggccatgtggatggtatcgtgaaaacagttgcacctttgcttaaggcaaactcattgtataaaatacagtttgcaaaacagttattttgtgggtggcctatttttccctctagaaatggcattttttactctataaaggaatgaaaacttcttatacagagaacttcccagtggatttagactagaatctcattcactggtgctaataattccaaaatacattcgtatttaagatcctcatgccagtaattctagtactttgggaggccaaggcgggtggatcacctgaggtcaggagttggagaccagcctggccaacatgccaaaaccccgtctctactaaaaatacaaaaattagctgggtgtgctggtgggtgcctgtaatcccaactacttgggaggctgaggcagaagaattgcttgaacccaaggggcagaggttgcagtgagccaagatcgcaccacatctctccatcctgggagaaagagcgaatctccatctaaaaaaaaaaaaaaatcctctgtcccaataaatatggccacaggaaaattcctcatttcctcaaaataaagaacttctttcacatgaaatgtccatgtgctttccatcagcctttccctctccaggagaacatcaatgcaaacacttgtatttccctcctttgaaagtctctctatatagcttccgtcttttctcatgcacgtgagaagtcagctctgccattaacagcagatggatggagacacagccgcatttcccttctcacaggcactgtctgcttggcacgtggaactgcgtttccttgctcgcgaatcctcatgtgatacgcatctccccatccctcataacctccctcggtgcagaaactatctgtgaacagtggtaccggtcccttgacgttgtagcttgacttgctgaactctgattctgaatccatatatagacgcagggacactgcccagttttgcgtttaggaaagtcagactgtcatcggtgtggagggctgtgcagcagatgaggacagggccccaatcccaaactgaagaatcttttataggaagtgtcaggcctttttgcaggagcaaatttttcatcattgtatgtgtatttaacttttctgttctttggtaactggataaacagtgaataataaatgaatgtctgtgctcatattctcctgtcctttaaaaattatattaacttatttttaatcagtttattagttatatgctatattacatgctataatctgtagagaaatccacccccaaccgtgcccagtgatagtgactcaaatacagtaaaaatgtttggtttttttttttttggccaggcgtgatggctcacgcctgtaatcccaacacttcaggaggccgaggcgggtggatcacgaggtcaggagatcgagaccatcctggctaacaaggtgaaaccccgactctactaaaaatacaaaaaattagccaggcatggtggcgggcgtctgtagtcccaggtactcaggaggctgaggcaggagaatagcatgaacctggaggcggagcttgcagtgagccgagatcgtgccactgcactccagcctgggcgacagagcaagactcaggtgatctacctgcctctgcctcccaaagttctgggattgcaggcatgagccaccatgcccggcaataagttttcttaattcattgcaaaaggcagggcttttctgacaagagtgagctacagccattattctgattaatgctgccataatctaacatcacggaatggcaaactagagactatgggccacctctagcctctgtctgtttatgtaaattaagttttattggaacacagtcatgctcatttgtttacatattgtctctggttggcttcctgccacgacagcagagttttgcaacagagaccttatgtcctggctttgaagatacatactatctgcttctttgtaggaaaagtttgttgattaccggtatacagtgttgatctttgagcagggtacttaagaacgtagaggtgctttggcccaccacgaagagttttggaagacgtaagacttaagtggtacaaggagaggtcctccatccctgactataagcacttgtccaccttgatctcatctgtatagggttcagtgaaacttctgcttggaaaaatacatgtttgaaatcaattacatgaagcaaatattgtctagagtgtgaaggaaagggaacctgatcttcctgcttggaggtctacaaagcctcaaaaacagataggcagttgcccttaacctatacagcagagacattgtgtatctaaaggcatggatgtccagctaggaattatgacactcatgcagagggacatgaggagggggtagtttgggtctgactctccagttcacttctcatggatgtaattgatttcaaacttgtatttttcctagcagaagtttcactggaccctatagagatgagatcaagatggccatgtggttatagacagggctggaggacctttcctcctaccacttacatgtgggggttccaaagatttactaaatgctttgcatgtgttccaggtgtcagagcccatcacaggcagggttttgactctcagggagcctgcagtcttgtggagggaaggtgggcaataaggaagaagagacagcatagatattttgtgcaatttcagccagaggaaatatggcaagacagtagacagtgggggataaagtacagcaattttcttttatttaggaagattagagaattcctccttgaggaagtgatgtgagtttcaataaggatggaaagtaccatggaggtctagaagtgtctgggggcaggggtaacagcaaaaacaaaacttttcaaacatggaggtggtgttggtgcatgctggtgtcttgcaagtgctttcagaaggctacccttatcttttcctatccacctggcaaatacctcctcatatgcatgcaagactttgctcaaatgcagcaatccttgtgtttgtttctgctgctctaggcgggaatcccatcccctttcttccaccttatcctaaccgtcagtgctcccagtgttacagggacatgaggaggggttagtttgggtctgactctccagttcacctcccagcaccctgcctagtggtctacccatcactgatacttaacagttattgaatatgattatgtgtataccctagaaaaataagcaacaaaaccgttcattgtaatagatgacattgactgaacacttacttaaaacgcagtttcaagcccttagcatatataaagccattcagtatgccaaataaccataaaaggtagggactgtcattatttatagaagaagacactgaaacacaggaagactagtgtgtcagaagtcctacattctgataatagtagcacacacttcctgatgttcattatacatttaccactaggcgtttaatgtggattttgcttataatcctcataaaagtctctggaacaaatgctgacatgatactcgtttcgaggaggagagaatcagaatacagaaaggtaaaatcacttctccaaggttacgtggctagtgcgtgagagaactggctttcaaattcacatcactttaatgtgatgtgttggtattagaaagggaaagcatttcaaaagccctcaccacagtgtcataaagctggctgctcatggtaaacattccaaagaatccaccaacacagtgtccttggagtccgtctgcgtgcctgtgcaactgcaccttgcttctcttggtgaaaaattcacctctttggaccctgtgttcactcttgttgttgtcctccccttagatgaggaaggagcagggccatccgtaaaaacagagtcatagggtgaaaacacatcacagagaatgcaaaagggttatttatagtccagagtgggaagctgaaaagacactgtgagaggaacttaatcgtttcccaggggatcagggagaagagtggacagtggtgatgccacgctgcagagggtcaaggttgcataccaattaaaatgacttccagacacttaacacacacatggtacttcgctacagaccgctgacatgttccagccaggaaggagaaaaaaaaaaacaacttctgatgtctcatgcctctgtcccccccttaaacagtgaggcagctgggctaacactgttgttgccaaacaactctaataatttcaggttccatgataatgagttggtggccttataactctcgtttgcatatcttggtacaagggaaaacattcagtccagtatgactctttaaatagccatctatgccaagccccacataaaaggtgggagggcttgttgatgttccctttttctgcaaactcatttgtgaaactacatcaattacagttcaatcagttctcccattcttttttcttctcattaaacttatgcctttctgcttagttaggagaggactgtaaactcagcttaagcaaaaataagaaaaataagaaggacttattcattctcatgaaacctatgcgtctaagggtaggagactgcctttttggtgtgcgtaaacctgtgcccctgagaaactctctgcttctcaaaactgctttcatctttgttggtttcctttttttttttttttttttttaataactttcattttaaactcaaggttacaaatgtactgtttttacataggtaaacctgtgtcatggggacttgttgtacagatgatttcatcatccagatggtaatcctagtacccattagttatttttcctgattgtctccctcctcccaccctccaccctacaataggccgcagtttgtgttgttcccctctgtgtgtccacgtgttctcatggtttaagtcccagttttaagtgagaacaaggaatatttgattttctgttcctgcgttagtttgctaagtgtaatggcctccacttccatccatgttcctgcaaaggacataatcttattctttcttatggctgcatagcattccatggtgcatatggaccacattttctttatccagtctatcattggtaggcatttaggttaaactgaaatcataacaaacagtctcttgcaccacagcataactaaattcaaaatcagtcagaattcactcaaaaccatacagttacatggaaattgaataacctgttcctagatgacttctgggtcaataatgaaattaaggcagaaatcaagaagttctttgaaactaatgagaacaaagataaaatataccagaatctctgagacgcagctaaggcagtgttaagagggaaatgtatagcactaaatgcccacatccaaaagttagaaagatctcaaggtaacaagttaacaacacaattaaaagaactggagaaacaagagcaaacaaatcccaaagctagcagaagacaggaaataaccaaaatcggagctgaactgaaagagatagacacgaaaaaccattcaaaagatcaatgaatccgggagctatttttttttaaacaacaacaataacaacaacaaaacaaacgattagctagatgaataaagaagaaaaggtagaagattcaagtaaacataatcagaaatgacaagggggaatattacccctgggcccacagaaatacaaacaaccatcacaagattatgaaaccctctctgcacataaactagaaactctgaaagaaatggataaattcctggacgcatagatcctccccagactgatttacaggaagaaatttgttttactttcaagcacgttctcatattgtcaccaaagctccacacttaaaatcccttgtattagtttgataggactgccttaacaaattaccacaaactggtggcttaaaacaacaaaattttattctctcacaatttgagaaggcagaagtctgaaatcaggatgtcagcagggttgattcctactagaggcttggaaggagaatctgatccttgcatctcttttagctccaggggactgccagcaatccttggcttatagccacatcatttcaatctctgcctctgttgtcacatggctgtattgtctgggtgtctctgtattttaaatctccctctcctttctcttataaaaacactagtcaggccgggcgcggtggctcacgcctgtattcccagcacattgggaggcctaggccggcggatcacaaggtcaggagatggagagtatcttggctaacacggtgaaaccccgtctgtactaaaaatacaaaaaaaaattagccaggtgtggtggcaggcgcctgtagtcccagctactcgggaggctgaggcaggagaatggcgtgaacccgggaggcggagcttgcagtgaaccaagattgcgccactgcgctccagcctgggtgacagagccagactctgtctcaaaacaaacaaacaacaacaacaacaacaaaacagtagtcattagtgtcaggctgtaccctaaatcaaaaatctcaagaggcttaattacatcggcaaagccccttttttccaaataaggtcacattctcaggtaccagggactaggaagtgggcatatcttttcgggggcacattgtaattgactacacatattactgtatcaaccccattgcaaacagagcaaaccccagaaatactgggctaatgctcgttagctctgatcacctggcctgactcacagatcaacctttaggctaatcactgcagctagaaggacatgtggcaaccccagataaagaacataccatttaaagaccacacacatcacacaaaacctattgagagacgcttgacgaacaaggtttgtgctcagtgtgttaagtggatgacatgatttaaaaaaaaagtaactgaagagctaagagagagttatggtggaagaagtcgttacacaaaggtgctacataattgctgctaggttcgtgttagccaaaggggcttacaccattttcaagcctttacaagacctgagagtgatgtgttggtttgagttggtgtttatgtggaaagggaatatgtatggaatattattaaatagttttactgaattattggcatattgtaggcattccttaagtactttattgaatgatagcacaaaatattgctgaatatttttgctacattcttggcaggttgtaggcatctcttaagtatagttctgcaccacataatgacgtttcagtcaacagcagactacatatatgactgtggtcctataagattataatggaattgccctatacagatgtataattttttatcttttatatttttatcgtaccttttctatgtatagatagatttagatacgtagtacttaccttttaatgacagttgcctacagtattcagtacagtaacaagctgtacaggcttgtagtctaggagcaataggctagaccatatagagtgtgtgtgtgtagtaggctacaccatctaggtttgtataactgcaccgtgtgatgttgtcacaaggatgaaatcacctaacgatgcatttcttagaatgtatcctgactcttaaagcaacatttgtggtttattgactgaagggataaaaaataaataaatgaatatatgaatacaaaacaatttttagaagataaatgaatgagtgagcaatttgtccttctctttcctcctgagattttctatttttaaaagtgtgcttgtatttttgtctttatatttaaataatgatttaaatgatttatttaatactgaagccactgatgagctgagaactcataacacattgctaggcacagagcaaatgtgaaatttagtttttgttgtttttatccacatgttgttctgccaagttgggcaacataatgccccctcagaatgctagttaatgcacttaattctctcagggtcttcttactttagactctttgacatccttgggcaattaaagattagctattttaatgaacacaccacatcttttacaaagcctctttggcaaaagacctttgtcagtccgccatcgacatatattgcaaattacctgctgtgtcccttgaagtattatggaaacgggaaacatatgggtggactggcacaggctctgcataccccattccagaagcttacattgtagtaaggcaatatcaaaacatgcatgcaaatgaattaggttagtcaatttgagattatctgggagggggctgcttttgtgcacaagacagagctaacctggaatttgaaaggtgcagttgggcttagctgtttcagtgacagtggggagcagagatgctgagaagggcctgagaaggacagtgaaacccaaatgacagctcaagtgttctgattgtcactttcatgcaacccctggtactgagtccatgctgcatattgttaggtgaaaattctttttttttttttattatactttaagttttagggtacatgtgcacaatgtgcaggttagttacatatgcatacgtttgccatgttggtgtgctgcactcattaactcgtcatttaacattaggtatatctcctaatgctatccctccccctgccccacaccccacaacaggccccggtgtctaatgttccccttcctgtgtccatgtgttctcatcgttcagttctcacctatgagtgagaacatgcggtgtttggttttttgtccttgcgatagtttgctgagaatgatggtttccagcttcatccatgtccctacaaaggatatgaactcatccttttttatggctgcatagtattctatggtgtatatgtgccacattttcttaatccagtctatcattgttggacatttgggttggttccaagtctttgctattgtgaatagtgccgcaataaacatgtgtgcatgtgtctttatagcagcatgatttataatcctttgggtatatacccagtagtgggattgctgggtcaaatggtatttctagttctagatccctgaggagtcgccacactgacttccacaatggttgaactagtttacagtccctgttaggtgaaaattctatggtccatttcacaactacgtaccacagaaaagggagatacggacaacactggaaaaacaaaatataagtatgcaaaggaacacagacttggatatgaggaaggggcataaatgctatatttaagcacatggttactgcctttcctaaggagtaagccaggaaaagaaactttgggtcagttaaatatctcgttgcttcctttgcaaaagtaccttttaatagtctgtttttagagttgtttaaaaagaaaaaactgtcccttgcctactttaaattcttgacatttttttctggttttggtgagatcagggtttttgcagggcagtatccttcattatatatgtcagaaggctgagaaatgagtggggatggtgaatcaaccacagcccttctgaatttctcacaaggtaatctacctaacagaacataccagtttccacccacctttgttttggttagagtgatattttgtcccttggcagtgaggacgtctttccttcacatgatttttgtaagactgtaccctaaaagtagccacagtgcagctgtgttttatatgaaaacaaatggggttttgttgggtacattttgtggcatttcttgaggtcaccagaaactcctagacgtcgttgtaaaacaaagaaagaagaagaaaaaggctggaaactcactcctcctgctgttcttatgtcaagtcagtgaaggcaattctttaattttttcattttttcagtgaatacttagcacataccatgtataaccccccatgtaagaccagccctttgtcttctaagaaatgacattctgggctggacgcggttgctcacgcctgtaatcccagcactttggtcgaggtcgaggcaggtggatcacttgaggtcaggagtttgagaccagcctggccaacatggtgaaaccccatctctactaaaaatacaaaaattagctgggtgtggtgtcgcaggcttataatcccagctgtttgggaggctgaggctagagaatctctttaacctgggaggcaaaagttgcagtgagtcaagatcgtgccattgcactccatcctcggccaccaaccctatctaaaaaaaaaaaaaaaaaaaaaaaaaaaaggtattctggtggatagtgggggagtggcacacccccaaaacaatttcacaaacaattatttaattgcagttgagttaagtgctaaagtgagaaggacacagaatagagtcgatttaaattagaaagaactaaaaaatgtagctaatttcttcattcctgtaactctgggtttgagacaacaacaatttgagtgaatcagtgaatgactgcatagatggcatgtataggtgtcaagtaaaaatcgtcttgtagctaaatcctcagttgtgaaatgggatacaaagtccaagctcctttccttttctaggtatttctgatgggattcactcagttcgttaaaactttaagaaagccctctctgtctgttatttttctctctgcctactcagatggttcctccattctaactatggtagaggccaaccttgtcatgattttcagaactatgtagttccccaccgcccccgccccaagaaatgcagagcaatctgccttatcagtatctcttccaattaatgtaatcttgtttctgttatttccaccatatttttcaatccagtgagcctcattacatttgcaagtgcattaaattagagcctctatagaaggagaatgatgattatcagctaatttaattatgtttctacatttgcagcatttaatgatgtctgccattgttgttggggattcttacattggctccaggtagaaattagctctgatcccatgtaaagtttacgttatcagataatacttgagagctcattgaggtacatgttcagtaatttttgaatctaatcaaaattgatttatgtgcaatcaaattataggaataaagaaacagcttcacctaatttagttgccgattatagtgttgcctgcctctgaagtcacaccaatatgcgtctcttagttttgtaccaacattgcatcaaggcctaaaattctgcaggtttttttttttttttttcccaaattgcatagttggttctgtatttctgaccttctgctgtccatcagattgaacatttatgccctctgattttgtgtcctgttcaacaaatgttgcccgggtgtcctttaagtgttggccatgtgactcttgcactagaggcccaggtcacccatgaacctagaagagaagatccatggtgtggaggagtgggtgttgcaggacctgggagctgaggctcgggagggctgattcatcattcttcctcctttgctgtggattctcaaccaaggcaaaaatagatacacacactcaacagggattaaggtacagaattcacgctgggcatggtggcttatgcctgtaatcccagcactttgggaggccgaggcaggcggatcacctgggatcaggagttcgagaccagcctggccaacatggtgaaaccctgtctctactaaaaatacagaaattagctaggtatggtggtgcgcacctgtaatcgcaggtactcaggaggctgaggcaggagaattgcttgaacccgggagacagaggttgcagtgagccaagattgcaccacagcaccccagcctggatgacagagtgagactccatcttaataaataaataaaataaaataaaatagaaataaaataaagtatagaattcagtttatcaccagtgaggctgtgttgtaaacatgcttttatgtttaacaagcactttagtcatagttattttgtgccagacacaaattggaaggaccttatacacaaaggccctttgaattgttatgatagcctaaatacaaactattattatcctccatgcacagtttatagacgaagaaactgaggcacagaaggctgggctatgttgccgaaggctacccatctgccttctgaaagaaccagggttctagtcctggcggtctggctctaaaatccatggccgctgaacacaaagtcctattgtgcctcccaaagctgaaattagcattctgtcatccaacccgcattactcctacaaccatatctagatcttgggatgggcagagtagtttggaggatattggtccagcacaggggaatgagatggggctttgaagctggcctctagaaggcggggccctgaaacgtccctacttaggtgtgcttacctgttctaggtataccttacctactctaggtgagcttaggacatacggatcaaaagcaaaacatgcactgcttggaggaagtgagacagagaaagagagatggagagaaagaaaaacttttccattttgaaaagttacccatcagaaaagtctctatgatgttgattgggtgaggaagaatattggaaacttgctccctgaaacagtcataacacagtggaggatttgagtaagtctctaggtctcaaaggaggaagcaggaaggatgagaagataagaactatgaacgctagactgagaatatactattaacgcctatacttaagaatataagatgttcttgagacatgtgataaagtaactttccagaaaaatgagcagcacactgtgaaaacaaagacgcaaaagtgaggtgtcagtcatcccccctctgaggccggagggagggtggagatttggtgcaggtcgaaactgaagccaattgataaaatgctgtgtgtgccctacaaggaagagagaaggtttgaataaaataaagtgtgtctcagtacaaaaggagaagtttcacaaagcatttagacatcttataaaatggagttgcttcatcactccctaaaggggccatcctcaactgtctcctgttcaaggcccactctcagcctcgctggatgtcaacagccataaccatgtgattgttactgcagcagagcaatgtctccaagtgtgcaaaggacatctctgggtcactgagcgtgaatgtccatgagcccagccaggctcccttctctgttcaggaggcaaagtttttccacttcgcagtccccaagatgtctctgtgatactggtatggcgttaccttctgcctcttcctgcttacgggtaccttggtcatctcaccagtctccctgggggttagcatcttaggaatgtgtactcaatgacagccaacgtaaattttgcaccttgctcaaaatttgactgctttcccgttaacggttcattaattgaaaactaccggtatcttcctaaacctagagtatgtcccaacagcaggatgtgattttatgttttgtggtacatggacatgcattttgttgtaattgcagatgtatatgtatgaggctggttttcaaatatagaaaatatgaaagaatcataatatactatatacccagcattaagatgttacaattcacatttttatcatatttgttttatctcttatatatccatcacttcatctaccaatccacctcattttgtttttttatgcatttcaaagtgacttgcatcagtatctttcacccttcagcagggtgtaaatctttaatgagagctcatggtttgtttgtggtcttttatttttctgaggtaaaatttattgatactgaaatatacaaaccttgaagggaccgtttgatgaggtttgacagctgagtacacttttgtaacacgaagctctgtgaagatatagaactgtcattcttccaaagtttaggtatgatctgtatgtttattagaaaaagaatcacagcctgaccagtatggtgaaaccccgtgtctactgaaaatacaaaaaattagccaggtgtggtggcatgcgtctgtagtcccagctactagggaggctgagacaggagaattgcttgaacccaggctgcggaggttacagtgagccgagattgcaccactgcactgcagcctgggtgacagagtaagactccatctcaaaaaagaaaaagaatcagcatacatactaaacctatgattccatgaacagtttaaatgaaagagtacatacttttgtgtgtgtatatgtgtacctggttacatatatgtgtgtataatttacattgataagaataatgcagtatgcagatgtagcagaatttgtaattgtgatggaagttcttctgtatttggcaattacaggcctagggaaaaggtaacctcatcccattagcattgtcttcaaaaagaacacgagcatataaaatgtgcgaggctacactgatgtaacgtccaagataaatggaaagaaacacagtgttgctcgtttaattgaggatgtttaacgacttttggccctgagagtaccaacagctacaatttttcaaagtcagccttgatttatgttttattttttaagtactcattaatgtcacaaatagttaagttgggatcagctgtcttcatttacaaaaaatgggttatactttcatcttttgaccctgaaacgtgtagataaaaatcaacattaattggcaggatgaatgagggtggttagggtgggtgtctggctgcaagattcttagagtattgggagagatgctcagagccccttaactggagatgacaacgagattttaattaacagcaggtgagtcttgtggtcagccatttgacatataggtggatcacaaaatagcctttcctttctaaccacatttatttctagcttaattagtccttctgagatagcttcgctattagccacagcctctccatttaagatccttttaatcagacgttttatttttttattttttattcttctcattttagcactagcttaatgttatgaaggacctggactaactcattttaatgacctctgctacataaatgctaattttacatttggccttatttcggtaggttttttttttttttaaaaaaaaaaaagaccattgctttcagaaggagaaaaatggaaagattaaaccccttagtgtcatctgcctgaaaaatcctgtggtttcttctgacaggaagagggttttcaaatccctccttggtctaagcttctgtgcttgacatctcattattttactcagctacttcagcatcaccttcacccagttaattaagtaactcattgaatgtattattcagttttgattcccctgtctgtgacagagagggatggaagatgcttcttcatccttcttctcctgcctttttctcttctgcccacacccaaggaatggaaaagagaaaggagaggagagaagacattaatttcaaaatccatccatccatccatgcatccatccatttctgcagcagattgtttgatgtttttaatgatactcaaaagaaagtgaagttgatgatggtaaggttaatggtcataggtcttaatggtgatataacatcagtttgcaccaggcactgttaaaatttccttctaacatggtcttatttcgtacttaaaacagcctgatgaggtaagcactattcataaggccactttacaggttaagaaagctaagatctagtcaactaatttgttcaagtctccttgctagtaggaatcagaaacccaatttgggcccagaactagctgattggtaatacttatattccctacagcatttctgttaagtatctccatgtttgtagtcaagtttaaattcctaaaatttaagctggaatttatgatgaaaataccatgagaaggaggttgaaattgtagttgacctatgttacccgacctgctcgttacaggagttaagaaagaaacttgacttcctctagggcagtagtcctcaaaccccaaggaccaggacatttggccaaacagctatgataaatgctgctttatttgagtacattagacttcaattaaaaaaatgttttaaagtaccttattgaatgcatttagatttgggggagggaaggaggctatacttggacctaactccttggttgtcaacccagctggaaataagcaagacatgatgtttaatatgaatgaaagtagagagagagggcatttggaggggggttggtgcagagggaagcagaaagaattactaacatgaaaaggcagatagaaaatttagaaggtcaaaggcagagtaattgaaatagagcctcggaaattgtgaatctgagaaagaactggaggttaagtgataggtaagaaggaagataaggacaagtaaagggatggaataaaaccaaaaatggggggtgagtgtgtgtgtgtgtacgagagacagagatgcattttaatgcatatttaagaaaaaggaaagtagaaccttataaagaagatgaagtagaaatattttttagaaaacactttttattatgaaacatatttttttttttgtaagggaaagttcccagtgacagagtgagctgtgtagcaacgtgtgtaaaaagcagacatcacattcttaaagttactccattcgctcctgaacaaatattaagtggaggttttgttctgggtgtcagaatacagcatggaaaaaagacaaaggaaagtctctgctttcatggagctaagaagctagttgatgtggagatagaaaaataaacaaggaaatcaaggttatcaatgcaaataatggtacgtgcaataaagaaaacagaacagagaggataaagcattgctggctgggggaagagctcactgatgagctggtgtctgaactgaccttggggtagggaggaggagcagccaccgggaggctcagagcagcagctctgcagggggcgggggtagagcgggtgcatgcaaacaccccaaggtggccacaaacttaatgcatttgagaagctgtaagaaggtcattgtagccaaagaggagtgagcaggaaaaggtaggagaggtcagtagcgaaatgggcaaagagctatgttgggagctgggtttattctcaatggaaggagaggccattagggtttcaaatagagaaatcacactctatttggataatgtttggataatgtttggacaatgtttagtaaggatgtgctggaaggaggtgctgggtttggtttctgagtctgtcccttgttaattgtgtgtcctggacacagttactgcatctctgtgatccttcacttcctcctccttgaagacacttaactgcatcgggtttctttagaaggaaagctggaagaactttagagtctgttttccctgcatgctagctacaaactgaaaccatcgcaaacaacaaggtcaaaacatctgtgaaaccttgcaccagttgtaataaagatagccagggagaaagaaaaaaaaaaaaggtctgaacttgttggagaaacaaaaggacctcataaacagtatggagaccagttgtgtgttgtcatcagtgacttacctgagaatgatattcctgtggttatgaggatagtgttacagtatttccttggctaagtgtctgtggctgttatccatgtgcagaataaaagtccacttgaggaggagacagaggctcctgtcttttaccaatgttgatggatttcagtggaacaaaaatgagtctcttgaggttagaaggcaggcctggccatgggtgttttgcttgagctattccactcatgacactgggcctgactgatatccggcgaaggccttctttggctgaagtgcttgccaggcctaaccaacctggaatttattgataaagcttaagcagccgcaaggcctatgacctcaaagagtgacttaggctgactttatcagccttggctcttcttttcattatatttgctattactggagctgctctcttttcttaaaacctgttaaccttatacaaggggatgggaccatttgagctctcagacaggatgctgatgggaaattgtaagccttcgaaataggttgagagcttcctgttgtttgggttctggcagaggttacaaaaataaataaataaatataaaaaggagagggatggggagacattgaaaaataaatacttgatgtgttttcctggagttgagctggcttcttcctgggacatgcttttttccagcccttggaagaaagttgcagcgattgtgcccacttcacagatgcagctgacgtgcacccctgtgctgcgtggggatcttagcagggcaggtcagatgtccagaactacttacatcctcacatcagtggcttatagaccaagaaacagtcctctccaataggtgcacagaaagtgttcttgagtctttatttttattttattttttttgagacagagtgtcactcttgtcgcccaggctggaatgcagcggcacgatcttggctcactgcaacctcctcctcccaggttcaagtgattcttgtgcctcagcctcccaagtagctgggactacaggcatgcactaccacacctggctgatttttgcatttattattattattttttttagtagagatgggttttcaccatgttgagccggctgatcttgaatacctggcctcaagtgatccccccacctgggcctcccaatgtgctgggattacaggcctgagacactgcgcctggccacatgttctggagtctttaaatcaacagactgtttaacttggctaaaggaagtcaagtagttacttggtttccagccagttactgatggctgtaattagccacatgttttagtgactttggaatcgaggctctagccaggcgctgtagctcatgcctgtaatccttaggctttgggaggctgaggcaggaagatcacttgagttgaggagtttgagactagcctgggcaacacggaaagatgtatctctataaaaaaataaaaataaattagccatgcatggtggtgcatgcctgtagtcctagcgactcaggaggctgaggtaggtgggaggattgcttgaggccagggggtggaggctaccataagcgatgaccgcactactgctgtccagactggacaacatgagtaagaccccatctcaaagaaatccaggctttgtgtaaaccgatgcatttcttattgaataaacctacacacacacatacacacacacatacacatacacatacacacagactatatctatattctactataccagttattgtgagtaattcatggaggttcagaatgggtagaaaagtcaataaacagtaaagttgccttctgttgtgtgctcattcactcttccattaaaaaatatttctgttactcctttaagaaaatgattagtgcaacaggaaagcagattggctgagtccctcagatcacccgcttctgagtcaaaccaataaggttcatgtcccagatccaacaactgtcagctctgtgaccttgggcaaaaaaccaaacctccgtgagtatgtttactctaaaatagggataatcactgtggctgcctcccgggcttagtgaagttgcatatatatttaatataatagatgatacatacttatataatattatatccatttaatagaatatatgatatatacttttatattttttaatttaaatataaaagtatattacatatttaaagtattcaaatatataatattaatctatgtaatatatgattaaagtattatataaatggaaattacattatataatacaaatatatgtatatatgtaaatatgtacatatataatacaaagatacatatttgtattaaatatataatacaaagatatatttgtattaaatatacaaagatatacatatatttgtactaaatatataatacaaagatatacatatatttgtattatatataatacaaagatatacatatatttgtattatatataatactttaaatttaaattcaaaatatatattataaattaaaaatacacatgtatatattttaatttatataatataatataatttaaattagtaatttagtttataattattacatatattatacatgttttaatttatatataatgtaatataatactttattatgttacacaaattatatatgacatgcatattttaatagtttaaatatatgttatatattttaatttatatatcatatatattatatataaagtattatatgtaagtatacattatgtattatattaaatgtatatgatatgagtataatatattacgaaagttttaatatatattacataatatgtacatatttttaatttaaaatatataatactttcaatttatatattcatcactaaaaatgattttttggaacattagttcttgttgttaaccttgtctctgagtagctgataacttcatgaaaaagtcagatattgtataaaatgccctgtaaatataagtacaagtgaaatcatttccaccatagcccatgatccttatccatgcaggaccaaagacttggtgccacaaggaacagtcaaatctggatggggaggtagaggaggaagtgataacaggtttggtaaacagataattgggcgaacagagggaaagtgattcagcaggaggagacagtgagccaagtttctggaaaataaaaagaggtatcaataaaaaggttgacagggagcatagggtctgggaggaacatactagaatatgagtctaggaaggaaggtggcataggcacagaagtaatttcagtaaatccaatgagtcttacggttttgtgaattcaaaattatttttggaaaatcatgctgcctaagagagatcaatttatttttatttattttacccaacataaactattttgatgcacttgaccagtcagtcttagggtttaggtcactatcatattcacctgaataagtatagtctgactattccttttattcaaaatgttcgagaccagaggtattttggatttcagatttctttttcagattttggaatattgacacatacataatgaggtatcttggggatgggacccaagttgagaaccgtcattgccttatgctttatatgcacatcatacacataacctgaaagtacttgtgtacatgtttaataatttatgcttgaaacagttttgagtgtattttgactgcagtccatcatatggaggtcgggtattgaattttccacttgtggcatcacctcgcatctcagcagtcagacagttttggatttgggggcacttggatttgggattttttcttttttgagatggagtctcgctctgtcgcccaggctggagtgcagaggcacgatctcggctcactgcaagctctgcctcccgggttcatgccattctcctgcctcagcctcccgagtagctgggactagaggcgcctgccaccacacacggctaattttttgtattttcagtagagatggggtttcatggtgttagccaggatggtctcgatctcctgacttcgtgatcagcccggctcggcctcccaaagtgctgggattacaggcgtgagccaccgcacccggctggattttggatttttagattgggagtgctcaacctttaataacaatattaaaaaattattaaacctctaattactgtagcacatatcagaagatttctcttttatttggtttaagttattttggagaaataaaaattgtattttttgtgtgcatgatcttttgaaatgtgtaaacattgcgaaatgcctcaaccgagctacatcacataaacatttatattctatttgattgtgtgaatctcaccaatctggaagtcataaaataagccaattatatataatatagtttatatatataatatataatatatataatatataatatatgttatatataatatataatatataatatatgttatatataatatataatatatataatatataatatatattatatgtttaatatatttatatgtttaaatatatgtataaacatatatgtataaattatgtataaatatacataaaatatacataaaatatgtatattatgtatatttatgtatatgtatcattatgtataaaatatgtataaatatgtgtataaacatttatatggataaattatgtataaacatatttatatgtataaatatgtttaatatatataatacatattaaatatatatattatataatatataaatttatattatatattaaatatataatatacaatatatattatatattatatatattatataatatacaatatatattatatattatatatattatataatatacaatatatattatatattatatatattatataatatacaaatatatattatatattatatataatatataatatacaaatatatattatatattatatatattatataatatacaaatatatattatatattaaatatatataatatataatatacaaatatatattatatattaaatatatatattatataatatataaatatattatataaatatatgtaaatgtatataatatgtattatatattatatataatatcctatatattatatataatattctatatagtatatataatattctgtatagtatatacaatctgcatagtatatataatattctatatagtatatatataatagtctatatatatattagaatgtgcatttaacttgaaaaggttgaaactctaaagtactccccagataactggtggtgaattgggagccagatgatgaagtggcagcagaaagtacagctgaccatgagtacagggtctagaagaatattgtaatacatctacatctcttcaagaacacaacaagttggcgttatttagcaggagggcaggatattccatggtctccaaatcttggaggtcctttctgcactggattacaattctgaaactcatcatccatatttagaaaagtggagacagtgaattacattttacagggattttacccaaaaatggttaaaatgacaaagtctctgtgcttcagtatattagccttcataattttcaacacccaacatttagttttttatctcattcccaggatgacatgtttgactgaagtatctaagacacctttaggggtagactaaacttctgccactctctcccaacaaaatatctgtgtcatatgaatgttgtaggcctgccattgtaaaagagaaagtaatcaagactttaatgggattatttttaattgtcttcttgcatataaaaatgaaatgacaggttctgaaaggaaacttggcatttgggaaagagggtggaaaaaccagacaaatgtaattatcctaaactgttttaaggtacatttttcctatgctcatgtaagaattaaaattagtgttttaaagaataagttactggtaaatcgcatggcaaaagaacatacatgttcattttttcttccttatttcaattttctgagaaaatttaagtagttatttctcaggtgagttttaaaattcatccttagagattggaaactcaagggccacgcattgagacttacacatttattataataaaatatgcttctggcatattaacttttactaccatgttgtcaaacttagaaatattgcagtggaagcaaaaccaagaaaatggctatcggtatgttctttgatgaatgaaggtgtgtacacatagattgaacaaattttttacactaatttatataatgtttagccctttaatgccaaatattacacatttaatgttgtcttattacgagcactcattccggagtacaaaaaattgagaggaaaaacaaaagagacttctcttcgctattgtaactccatgctggtttggttggtgcaggtgtttgggtgatggccaccattttggtcttgtcagttacttaaggctgtagacaataaaggttgcattcctgaaataaagagttggttctctaatcttgtggaaagaaccagtattcattttctaccaggaagcaaaatgccaaggtcacagggacagaaaatattgcttcccaagaaactgtggttgacaagatggctcgagttcaagtgaatcctgaaagtatcagtttccaaggagacctgtggccccacccagccacctacaaagcttagccatcgtttcactcagagcagcagccatttcttgcaaactggcagctcatttctggatactcaataggatgcataagaatgataaatttttttcaaatcatgtgcgctagctctgttgaccttcagctgtgctgcgccttctttaattggcataaatcttggactgcccattggatgtctttctggaatctgatgtctttctgtctatctgattcctaagaggaagtgaaatattcaattaaatagtttcgttgagtccttgtagtgctaggatctttacaagagcggtttagtaggtgttgagatagactatctatcagcttcccttcccaggagaacgtgtcctgttagaaattgcatcttttgtggccagtaggggtctgtttaattgactgaaatagtaatgacccggaggaattaagacagtttttagaaacatcttatattgagaaggaagaacaataactatgataaaattatacaaatacacaataataataaatacacataatttaaagattacaattgtgggccgggcacggtggctcacgcctgtaatcccagcactttgggaggccgaggcgggcggatcacgacgtcaggagattgagaccatcctggctaacatgatgaaaccctgtctctactaaaaatacaaaaccaaattagttggtcaaggtgttgggcgcctgtagtcccagctactcgggaggctgaggcaggagaatggtgtgaacctgggaggcagagcttgcagtgagctgagatcacgccactgcactccagcctgagcaacagagtgagactgtgtctcaaaaacaaaaaacaaaaaacaaaaccaaaaaaacaagattacagttatgacaggtattttgacccctaactatgtgtcagcactctgtatagcttatctcagtactaacactaacacccatatgatgataccagagcttttaaccccattttctgaaatacagaaactaaagaacagataagttgctgcgaaaagccatataaatattaagtggtagagtcaggattttaaacagggtacactggtttctttcttaatgtattttgatccacatctacaggtgaaattcaaatgcagcttattgaattttctctcaaatattatggtgaattattttattatcttagtgtttcagatacgccttttgccacatttcctcaagaagttgatatactattaagaactaggctatatttttaattttttgttaatttaaatccttcatagaggccgggcatagtggctcacatctgtaatcccagaacttggggaggccgaggtgggcggatcactggaggccaggagtgtgagaccagcctggccaacatggtcaaaccccatgtctgctaaaaatgcagaaattagccaggcatagagcaggcacctgtaatcccaggtacttgggaggctgaggcaggagaatagcgtgaacccgggaagcggagattgcagtgagctgtgatcatgccactgcactccagcctcagcgacagagtaagactccattgccaaataaataaataaataaataaataaatactactttatagagccagtgtgggaagtaggtacattggggtatatcacatataggaaacactgggcaaatacttgtgaccctctagaaaggaataaaaaaactccttctgaaggatacaagttccagttctggtttttccttcagttggccttgaaccagaatacgttctctgggcctctctgactagtccctgtcatgttctagccccatcttaggattaaggccaagacccaaaacaagcaacatgaacatcagaacagcaccagaaaccccaggtaggcttcgcagatgaaaataatgactgtggcagccatgctactcaaatggaaggcctgctttctttttagaaggaacctaattggcaagtaagttgctatctgacttgatgggcgtaaactcaccgttctgcatcccactttcccgatcttcacttcagttgcttaaatggagtgcactaaacctcaatttgataattgcatcctcaaaacctttaatgaaggtgcctatcaaagtgtaaataattaccccgtaatcttgtatttgcaaactgcatcttggctgtttacgcttcaccgaggttcaaatcagaggttcagggcttccccagccctcacattcctgttgacgtcagaggaatttcaaggacctagaggacagcattgtaacacggttcaaccaaggcgttcaccttcactccctcccaacgctgacatctgtcattttctggtgctatttataaatccaagggagcattgctgttttgttttggtgctggtgatgcagacactcatcctcattagaatttttgccctgacgccgggcacggtggcccacacctgtaatcccagcactttgggaggccgaggcgggcagatcgcttgagcccaggagtttaagacaagaccaggcaacaaagtgaaaccccgtctctactagaaatacaaaagttagctgggtgtgatggtgggtgcctgtaatcccagctactcaagaggctgagacgggagaatcacttgaacctgggaggcggaggttgcagtgagctgagatggcaccaccgcaattcagcctgggtgacagagcaggactccgtctcaaaaaaaaaaaaaaaaaaaaaaaaaaaaaaaaaaaaaaaaaaaataggttctgccctgagcctttcaggcctggccttgttgctctgggacttgctccctcctcgctaacgtgtttccttctttggagattacccactttagctcacctggggaacacacacaccactgacccagttagggcttcttccagcctcttctcttttttccattcttttgactgcgttaattattcacaggaacccgtcaatgaaagcaccagggattatccaggaggctgaccaccaaattagaacaagaaaatacttgaaacagtttgcatgctgtctgagggtgcagctacggagagggtatgttttaggtgctggggtctgagagaaatgaaaagagacgccaagccaggtgactgacagaaggcaggcgacaaacccaggcttcccaggctcgtactttctcttcggtgctgtatttttcagcacacaaacttgctgagagtttgcagctgacatctcgagaagtattcttcttaaaagctgagcgaaaattattcacctcatgtgaaaacaagtgcgatttacatctaatgtgggtaattacttttacagttaattaaaagcgctctcattaaactcccgctgtgatgccaatgcatagctcttatttgcaaacagacctttggtttgagctcacctggtgacaggagactcctacctgaaacagggatgccgttctcggtactatgtttaattgtgctgagccagcaaccctcgagttacccggccttttaccccacgccagctctgcttgtctgcatggctagattttgagatatggaagcctcttgtcctctcataaccacactccaaaaaaaaagtaaggtgaagaaaacaaaataactcacaggaggtagggatgccaaagaaaggtaggggactcaaagaaagaagtcaagatgaaaagcctgctgtctttatttgcataatagtttggttggggatcgttttgtagttgttctggctttacagctttttcctgcctaagaagatatttactgtcagagaaaatatccccttaggccccctgaagattcctccaaatgtttataaagtcagcagctctgccctgcaacctacccaactaaggtaaactttactcccttggttgaagtgatttgtgttgagattttacttagtttacatgcgttgtttgctgtttgtatgatttcaggtgaaatagctcttacatcgtgagtcatcttcatatttaggttgaaaccatagacttttcggaatattctttgccctgaagcatctctgccacgctgaaccttcttaaacacatattaatgaaatgtctcctcaaatgatcacattcctagtaagtaattagggcttagtaattaaaacatgcagtcatttgagacttaaattttgaaggcacagaaagattgagaaatttaaaaagtttacggacctgatgaattggatactcttgcataggacttggtgctttcggtattttttgcaaagttatttgctcccatctgctggccatttgtgatattgcaggtgctgagctaatttgtgaatggaaaaggaagtgaataaaatctatcactgcaaacattttatactattcttcatgtattcaagtaaactgatttgaatcttggtttttgtttgtttgttagttttgttttgttttgttttgtttttgcggttggaggattaagtgaacacagactctgaagaattctgctgaaaggcaagcatgatttgaaatttttaccaacatcagagttactcaagttttgaaagccagaacaccctcgttatctttaataaagcaattaactttagaacattggtttaaatattcaaattcaagcacagtatattgtgtaagggagagtataaaatacatagctcgtagaccagatggatttcaatctcccttatgcttttaatcatcggagtggtaggaagccaattccctacactctaaaactcagttttttcacctgtaaaatggaaacactgggcaaaagggtccctaaggcttgaacttattctcaaaatctgagtctttgtgaaggttaaaaaatcatataaggctgagcacgctgggtcatgcctgtaatcccagcactttcggaggccaaggtaggtggatcacctgaggtcaggagtttgagaccagcctggccaacatggggaaaccccatctgtactaaaaataaaaaaaatagccagacgtggtagcatgcacctgtaatcccagctactaggtaggctgaggcaggagaatcgtttgaacccgggaggcagagtttgcagtgagccaagatcaccctactgcactccaacctgggcaacagagcgagactccatctcaataataatagtgtaggttgcataaaatcaccagtatgctcttagtcttagcatctaaactcatattcagtgacttgtcttaaattagaagccgttgttattttcacaacaataggcaatgtaagcatgcatccaaactatcagaaagcttgcctttgcaaaggagaccatctgtaatgttgagtcaagatttaaaatgcaccttgaatgctttttggagtgtgatgtcaaaaatgtatcttgtgttaatattataaaccgttctgctataacatttatttgctgtttaagaaggaagagcaaaaccttcttcctcagcagtaatcaatttctcagttgatcataagccgatttgggcttgtcagatgaacctttgactgtgtctcctcacactcctgagaggtggcttaagctgtcctgtatttcctatgaaaagctctctgggactttgtatttgagtccaggagaacaatgctgtgcccaggatatgtgatccttacttagcttctcatgacaagtctaagcatcctggtcttttctttccattgctcttccagagtgaatgactgcaataatcaatttagaggttttcaggggctgtattgtggaaacacctgggccctggagcacagcagcctgtgattgccctgggattccttttaaggaatttttcttgtcccctagagcttagactaagcggaggtggcctctggaccacagttatcttttttcagtattaagtagccaagcatcctgcaagagagatcagcacaaagagctccttgatcctctgtatttattttctatgacttccgtagcaaatcatcacaatctaggtgcttaaaacaactgaaatatattctctgacagctctggaggctctacgtccaagttgaaagtgtgagcaggacggctctcccagcaaaggttctggggaagattcatctttgcctcttccagtgtctggtagcttagtgtcacatgacttgtagcagcatctctctaatccccacctgtcttcacatggctttctcttctgtctcttaaaaggatacttgttactggatttagaacccacccagataatacagaattttctcatttcaagacccttaattatgtctgcacagactccatttgcaaacaaggtcacattcacaggcactagggactagtcggcttgagcatatcttttggggggctgctgttgaaccccgtgctggctactcacttctaaatcctctgaggtctcgggagcttcgttgtccggtgtttctctccacattttctcgggaatctttaagtgccagatacttcagagctgggaatgctgctggtaagggatccgggatgctggcatccttgcattgtgggcatgaataaccctgacctacaaaaattatcaaaaacaaccaacacaccaagtgtagaagaaaagaagtctctctcgggagagagaactgcttctgaaaagaacggacacatgagtgctttgatgtctaaaatctcaaagaacctagaggccttggaagagaaaactttaaaaatagacatgtttttaagttctcaatgcttcaatcagaaccaggtttcacaaagcctgttggaagatgtcatcaaggacagctgacatttactgataacttgccatatgctaagaccctggcgtgtattggatatgcctagccacaaacgaggcaaccatgattgttaatatgcttctcttacaaatagggaaagtgaggctaagcaaactcggcctccttgtgcagagttccaaaactggtgtggttgagtccggtaggataaaccctagcagtgtgattctgctatctgtgtggaatcccatctgtcgccagcaagtgagcctccgctgttcagggtttcccggctacaaaaagtagaagggctgccttctgtcgggaaattgattgcttggtgatgagtccacagctcaaaattcatacttaacacttttaagtagttgagctgttttccaagcgaagtggtcgagtggggctgaagtacttacttgacgagtctggttcagaaaaggtcaggtcggaacccacccagagacaccggctctaggcagcgtgatccgaacaataatttgttctcgccaaagtgacatttttccaatttgagtccagcattgttcagaagcaaatgcagtcccctggggcgcctcccgcatagatctgcagcagatgacaaactaacaatatcatctaaataaaaaatccagcatgggtttagtaaattaatcctgacaagaataaattgaataatcttagggaaatggcgagagctctgattctgccagatcgctcttttctgtcgcttgcgtgggtcctcggtggcagattaagagcaaaaatctgcctttggtttattgatttcgttagttcgttgattaacacctgccacttctgtgtgggtaaatcataatcggatatggactcttcctggcaaacttaacatattttcactcaaggagagaaaggaaatgcttatttcacctggtcagaacgggcaaaagcagacagagagctgcttttcctcacctcgtttctcagtggtattttctaggtttaaaagtaatctgtgattttcatcactcccatattgagttaatctcccgtttctgtttaggttgcttagcagacaaattcaaggagagtttttagtaagagtgaggggtgtttttcctgactcagtgtccgaagtcaagcagagacttcagccattaatttaggagacagggtgagaaaaggaagataccgcgtgtacacatgatcccacgtcctaggactgggccttacaggtcgtctgggaaccttgtcttagtcagcctgggctaccctaacaaactgccatagactggatagcttctgaacagaacatttactttgtcatagttcttgtgtctggatattcaagatcaaggtgccagcagtgtcaggttctgatgagcaccctcttcctggcttgtagtcagtcattctcactgggtcctcatttggacattcctgggcttacgctaccagagagagagagagagagaaaatgagtgagctctctggtgtctcttcttaaaaggatactaattctttctttattttattttatttttgagatggaatcttggtctgttgcccaggctctagtgcagtgacgtgatctcagggctcgctgcaacttccgcctcctgggttgaaatgattctcctgcctcagcctccaagtagctgggattatagatgcccaccaccatgcctggctaatttttctattatattgaaatccaatggggtttcaccttgttggccacgttggtcttgagcccctgccctcaagtgatatacctgccttagactcccaaagtgatgggattataggcgtgagccaccacacccagccaagggcagtcattcttaggacctcatttaaccttaatcacttccttagagttcccatctccaaatacagccacactgagggttagagctatgacatatgaattttaggggggacacatacattcagtccatcatactacgtgttaaaaatgttgattctgattcgatgtatctgggatgaggtgtgatgtgttgcatttttttttaaagatgggatcttgctctgtcactaggttggaatgcagtggtacaatcttagctcactgtagccttgactgcctagggataagtgatccccttctctttgttttgaaacagagtcttgttctttgttgcccagtctggagtgtagtggtgcaatctcggcttactgcaacatcagtctacagggtttaagtgattctcgtgcgtcagcctctctagtagctggaattacacgtgtgtgccaccatgcccagctaatttttgtatttttagtagagacaggggtttcattttcttgcccagacaggtctcaaactcctggcctcaagtgatccacctgccttggcctcccaaagtgctgggattacaggcatgagccactgcacccggcttcaagtgatccttccatttcagcttcccaagaagctgggaccacaggtgcataccaccccacctagctaatttttttcttctttattattattttttttgtagagacactgtctccctaaggtttccaggctggtcttcaactcctggactcaaacgatcctctggactcggcctcccaaagtgctgggattataggcatgatgcattttaactggctcccaggggcatcgtacttgctggggttgcagactccacgttgactaggaagttcctcatactccccttatgtgcggatgagggaaatttgctgaaggaccgcatggttattaaatagtaacaccctgctttaagagtctagtgccgtgagtctaatgccaggagtctaatgccagaactggaattacccgcagccctgtcctcccacccttcagccttcagtccactgccacatcccctggagggcttggtagcatgcatcgacgggccctcaccctttgaattttggattcagtaactgagggctcttccgtgcaaacctcatatttttcacttcaggagagaaaggaaatgcatcacctggtcagaacaggcagaagcagacagagagctgctttttctcacctcatttctcaatggcattttctacagaaaatacagcctgagaatctgggtatttttctttgcttatttatgtaaactgacaaaagttatatatatttatcatgtacaacatgatgtttggaatgtgtgtacattgtggaatggctaaatagagccaatatcatatacattacctcacaacgtcatttttttgtggttagaacacataacatctactttcttagcaattttcaagattacaacatgttgtgaactgtagtcaccatgttgtataatattttaacttattcctcctgtctcactgaaattttatgtctttaggcccagatctccccagcaaaccccctggtagtgagggtagtccctgccagcccttggtaaccaccattgtactttttagtatattttttgtatttgtttcatgcagtatttgtctttctgtaactagctcattcaacttaacacagtgttctccaggttcatccatgtcatcacagtgacaggctttccttctttattaaggctgaaatggtattctgttgtgtatatataccacatttgctttatgtggttcttccttgatggacacttagttttttgctttttgttttatttcagtaggtttctggggaacaggtggtgtttgattacatgaacaagttcttcagtggtggtttctgagattttaatgcacccatcacccaagcagtgtacaccgtacccaacgtgtaatcttttatccctcaccactccccgacactttcccctgagtccgcaaagtccactgtaccattcttatgcctttgcttcctcatcgcttagctcccacttatgaatgagaacatgcaatgtttcgttttccattcgtgacttgtttcacttagaataatggtctccagttccatccaggttgctgtgaatgccattatttcattcatttttatggctcagtagtattccattatatatgttggggaagtattttattacatatgtatatataagatgtagtattccattttatatatgtaagtatatgcatgtatattgggtaagttttctgttatatatgtatagtatattatatattgtattcatctatgtatagtattccaatataccacactttcttttatctacttgtggattggtgggcctttgggctggttccatatttttgccactgtgaattgtgctgctataaaagtggggtattcagtttgattccctatcttggctattgtgaataatgctgcagtgaagaaggaagtgcagagatctctttgacatacggatttcatttcctttgagtgaatatgcagtagtcggattgctggatcatacagtagatctgtttttaattttttgagaagcctccacaccgttttttgtaataactgtaagaatatgcctttttaacagcagctgatgctgctggttggagagtctcactttgagaagcacatgtaccttgcttctccaggtttttttgtttggttgcttggttttatttttatttatttttttctttttttgctgtgaataaccccttcttcccatagcaaggaaaagaatgaaacctgtggataaattatgtggactgaccaaaccaccttgaggaaaataaaattacctggaggaaagggaaagcacctgatgagggatcacttctggttacagatttaagctccctcattgtgtgattcagtatgagttacctaatggctaatcacaattatcatgccacagagtaactaaggaatacccactttgtcgaatgttggtaatttagagacagtacgaaaaacaccaagcacagttcctggcacgaaagaggtatttaatcattgctcaccggttcagtcccacttgactgataggaaaacagtctgttctacataaaacaagatatttgctatacgagtcttcaccttatgatattgtctctttttgttccactctggattcaaagggacctagaatttgctgtgtttactaataaatcaccagcttctcatattaacctttcctaatgatgcatccgcagagaaaaccccactgcctcttggtgagaaaatcaacatttctgtagacttaaccacaatggagtccctaatgttttttggttgtttaattgattggttggttgttttttggaaacagagtctcacttcgttgcccaggctgaagtgcaatggcatgatcccggcttactgcatcctccgccttcccggttcaagtgattctcttgtctcagcctcctgagtagctgggattacaggcgtgcaccaacaagcccagctaattctgtatgtttagtggagatggagtttcaccatattagccaggctgatctcaaacacctgacctcaggtgatccacccgcctcagtctcccagagtgctgggattgcaggcgtgagccaccacacccggcctggaacccctaatgtttgtaactccctacacaaccctgcacatccatgccctccctgcctccatggagagcatggccaggctacagaccgtgcaacggccccaggtcgccatctttctctcccaagctgtatcctttctttaaagacgtcccattgattttatctggcctctgactacttctctccccttcccctgctacacccttatccatccaccatcatgtcacacctggactcctgtggtagcccccaaatttttctccctacttaaatttgtaacccctgactgccggttctgttaaaatagaagtcagatcatgcctgtcctctcttcattatgcctgagtgaaacccacaagtgcccatgaggatgtggacagattggaacacttgtgcactgttagtggggatgtaaaatggtgcacctgctgtggaaaacggtagggtggttcctcaaaaaatgaaacattgaattaccatagggtttggcaatctcacttctgggcatacgcacaaaagacttgaaagcagggagttgaatagatacgtacacacccgtgttcatagcagcatcattcacaatagccgaaaggtggaaacagcccaaatatctatccacagatggcgcttatgaatggataaaccaaatgtggtctctccatacaatgcaatgttattcatccttaataagaatgaaattctaacacatgctaccacatggatgaaccttgaagacattatgctaagtgaaataagccaggcacagaaggacaaatgttgtatgattccacttaagcaagtgttaagtcctcaattgtataactgtaaaattcatatactgaagtcgtaacttccaatgtgattgtgttttggagattagtcctttagggaggtaattcaggttaagtgatgtcataagggtggggtcttaatccaataggattggtggccttaaaagaaagatggccacaccttacggtggctcacacctgtaatcccagcactttgggagggcgaggcgggcagatcactaggtcaagagatcgagagcatcctggccaatatggtgaaatcccatctctactaaaaatacaaaattagttgggggttgtggtgcatgtcggtagtcccagctactcgggaggctgaggcagaagaatcacttgaacctgggaggtggaggttgcagtgagccaagatctcgccactgcactccagtctggcgacagagctagactccatctcaggaaagaaaaaaaaaagccatgggtctgtctccctttctctctctctcagaaagtatagagcagcagctatgtgaggcaccatgagaaggaggcatctacaagccaggaagagggacctcaccaggaaccctgagagagccttgaccttgaacttccacctgtagaactctaagaaaataaacttcagtcgttgaagtcacctagtctgtaatattttttatggcattcctagccgactcatacaatgagaggagtctagagtagcaaaatccacagagacagaaagcagaaggtggttttcaggggctctgggaggggaagtgaagagttattgtttaatgggtacaggtggaaaaatgaaaaaattctggagatggagggtggtgatggttgcacaacagtttgtatgggtaatgccccagaactgtgcacctaccatggtaaaattgttaatgatattgtattttatcacaataaggtaataaaactctgagtggtttctcactgatctcaaaataaagtaaacatctccctgtgatctcattcccctttattttcctctcttacttccctctaaccacagtggcctccttcctcttgcttggctctttccagtgcatttcccccttggggctttgaacttgctcttcgtttgcctgggatgttctcttccccagtgggctacttggctcatccccctaacttccttcaagccttttctcaattgccactttttcaaaaaaatcaacatcaacatcgtattcccctaccctcagcatttcccacccccttctccttggtttatttttcttcatagtacatattctttctggaataccattaagtgatatgcatggtttaatgcttgtcttgtccagaagaatgtaagcatcaccagggcgggcctgccatgtgtcttctacattgttgagtcctccatgcctagtgcaaggtctagcagccaagagttgctaaagaaatatcttccatttgaataagttaatgccactattgcttgtgggactgtgtctgtcattttgtctaattaatgagttccctgagggtaggaattatgtttgtttcaccttttcgtaccaggacaacaagaaaatagcagaaaatcataggtgtgcaataaatatgaatgagtggatgagtggaatggtagatggatgggtggatggatggatgaatggatggatggatgaatgggtgggtggagggatgaatggagggtagatgaaggaaggaaagatggatgaatagatgagtggatagaggatggatagatggatggatgggtgggtagatgaatgggtggatggatggataggtgggtggatggatggatgagtagacggatgaatgggagaaggatgcaggatagatggatgattggatagatggggatggctgggtggatagctggatggatgaatggataaaaagatgaatttgggtggatgggcgagtgtgtagatgattgatggatagagggtggatgaaggatggatggttggacggatggatggatggatggatggatggatggatggatagaggaagggtgggtgggtcaatgaatggatagatgggtggatggataggggaaggatgcaggatgaatggatgattagatcaatgggcatggctgtttgggtggatggatggatgggtagaggaccaatgaatgaatggagaggagatgaatggatggatggttggatggttggaaggataaaaaatagatcctgataatttgtgttgaagtgagacatatctgactatcctaaattttgaatgggagagatattaaaggcagtctctgctgatgtgaacaattgtatggagggcagattattttatgagctatcagttcctctttgctgtgacctctgatccatagcctttgcctacattccacatctgcatgtaataaaacttacttatgagatacatatgtctctaatgcaaacaccgcagtatgtacctttaaaaagcactataaagagcaatgactcgagaaagaactattaggagcatgagctctttattattttaaagggcatttcaacaacaccactgaatgttctctgaccataagtctgactcctgttctttctctcactttcctttcttttcttctcttctcaggatatcaaagcagactgcaatacctgcgtggaaatagaagacagaaaggtgagtcaatatttttcatttttagggttgcaaacaaaacaagaactctgtgaattgaacccaggtgtttaaggcatgcccctctcgatgatggtttttaggtgattcacggtctatgacatatttaaagacaatcagacttaaaaatgcttgtcattttactcctttacaatctgtgttacttctgatggcttcatgaggagtgcatattgtaattttttacaaaaaatgtggtgctgatttctgtttcagtcatacccttcttttcaggaaaatactttaacacttgtcacattgaacttgaatattgatgttgacgttcattgtgtgtatcatatgtataattaattatattattacttacattatagaatatataatattaggcttcccagggtgtgtccctatatatctgactcatacacttgaaaaagagctcacggccaggtgtggtggctcatgcctataatcccaacactttgggaggcagaggtgggtggatcatctgaggtcaggagttagagaccaacctggccaacatggggaaaccccgtatctactaaaaatagaaaaattagccgggtgtggtggcacatgcctgtaatcccagctacttgggaggctgaggcaggagaatcacttgatccttggaggtggagactgcagtgagccaaaattgcaccagcgcactccagcctgagtgacaaaataagcctccgtttcaaaaaaaaaaaaaaaaaaaaaaaaaaaaaagagctcgcgctcaatttccatcacaacacatcaacacattcatatgagcaacagcgtcctatctgagattaagggggtagggggcaatgccattttctacatatttagagtcccctcacccatttatcttctttgctacacttaatgtgaatcccctcaggaaaagcaaccgttagacaattgtttgttaatattttcacagtctctttttattgacaagagttcacagacatttctgcagcaaagcacatccaagaagatcagattttaccctgtgtatgccttggatccaaagaggtcaaataagcaagttaagagtacatacctcctggctacttttgacatcgttccacaagtttgaaagatgtttctcctttcaagtgtaccattattgtcaaatgggttattatttcaagcagaggttttcagctctgattgtatcatgactggggcatgtctgctgattaataaggtggtggaggacttctcaaaacaaaaatttgcttttaaataaaaagcagttgccacacattattttagggagtgttaatctcctcacattgggaagaataatgatacagtaagttcaattcaatctgcgtgatcccagcttgcagttttgtgttgctctagtttgctggcaaaggaatttcaattcatgtttgcattcaccatgtgtttgcatgctggtatatgcatgtgtgcatttagtgagttggacagatggaattgctgcttaggtgaagcgtgtgtccaaagtcttctaccaatgttctgcccagccgaatcattccgctcatgtcagagtgtttagaaagcatgttccccaacctgcttccaaaggtcattggcatttctcttggacttttatggaattcatcaacatgttttgtccggtatcttttttaaaaatttaattgccaatagtgcttgaaagataacataggaactgatgctgttagaacaacctgagctccatcacgcacaaggtaaataagcaggcagggtaagctctgggcaaggagagtcacccaagctccactccacctatgtgaactgcctttggttaagacatcatgatgatggcaactgccctggtttctggctactctgtgatgcatcttggtgggaaaaagtcattaatggtcatactgtgcatatgtgatttcagctcttctcaagaaaggggaaaatagacacacacacacacacacacacacacacacacttctagttttttcataaattgttggattgagtcaataatgtcaaatgaagccttgtttctgatgagttttcccatttttttctaaacttgacctcatatgactgatagataaatttctaaacaatttgttgcagttaattggtgatgcatcttagtgataagaaaaaataatgcccagttaaaattctcagtgtcttactctctaaggactttttttaaaaaagagtcttttaaacaaggtaactcctctcctctcctctcctcccctcaactctcctctcctcccctctcctctcctcccctctcctcccctttcctctcctcccctttcctctcctctcctcccctttcctctcctctcctcccctttcctctcctctcctcccctttcctctcctgtcctcccctttcctctcctctcctcccctttcctctcctctcctcccctttcctctcctcccctttactctcctctcctcccctctcctctcctctcctctcctcttctctcctcttctctcctcttttcctccttccctttttctctcctcctttccttcccactttctcgtcttccttcctccctccttccttccttctttttccttccttcaaattcccagtaatacagtgaatcttatactcacgctatagtttctctgtttctaacaattgttaagaagagattgggagtgaggttttaggagcttgctttatatatgggagacatttctcttaattgaacagtcaagaagcaaacgctaatgatccctgagggacggcgtgcccctcaccccagcagaacagctccatccccctccctctctgcttggtgatatggtgtgaggccacacagggagccattggctgtggcagccagagtgattgccgtcaggttctgggagtgcactctggtgcctctgccacactgatgggttgtttaggaaatttcaccactggagtgatgacagttgctcacgcacgtgtgtgtgtgcatgtccctctccatttaacccaaatgcttctggcaaaatcagtaatttgataaagtggaattgaagtgacaagagatggcagaggtgccaaaataataagtaaacctgtctctgaagcggcagcctcttggcctatgtggatttttacgactgttgagagctctgaaagagaactggtggtgctttctttaaagctctttttattttattttattttattttactttagttaagggagcttcacagaacccctataggatgtgatggcttctcaagaatcactttattttttattattttttatttttctttcacctcccctggctttctgtctacttcgtttccagatattccacatatatggatatatttgtgtacctcgatttatagctatgtatattgttgaatatcttcttgatagaagaattttagaaaagacaaaaccttaggttttccatggagtcctacggggcctctccaaattgtgcctcattcccattctcttcctttcaatggggccgattatcttgagatgaatgattttcccactgaatcttagaccacatatcatgatagaagataaactgtgaatttcaacagtggaagagagccttcatttttttttttttttaacagtctccctctgtctcaaatctggattgcagtggtgtgatcgtgatctcagctcattgcaacctccgcctcccgggttcaagcgattctcctgcctcagcctcctgcctggctaatttttgtattcttagtagaggtggggttttaccatgttggccaggatgatcttgaactcctgacctcgtgatccgcctgcttcagcctcccaaagtgctgggattacaggcatgagccaccacacccggccgagagccctcatcttgttgtagagcaataaaatcattcttctttatctgcgcacagtctgggctcgatctgagactcttcatagaataaaagaatttttatcctctcctgtttttctatttttctttatcccagaagcctattttctctcaggctgacaggaaactaattgccatttggaaaaccttgcctggctgtttatggggaaattcataatgtgtattggagtgtggctttatgtttttctttcgcttccaagcccgccaattagcagagcccctatgaatgtacctgcttggatggttcctggccattgcttaaactctctcagagggtgtcctagggagatcctaagggatggtggagtttttcaccctttaataggaagcaggagcacaggttttttgtttttttgttttttggtttttttgttttttttgtttttttttttcctcctgcaggtgaacgttgtggagctaatgcagatttagcaaaggtgacgggaggtaacccatcacttggagtggctgtatggcctcacaaaacccgatgcgtttgacatttacagtacctgtgtttctgctggggcactgaagcatttaaattcatttttatttgtggtgtaaaatccacctgaatttcaatactattataaagactgagattcaggtgatgagaggagaggctgatggatcagtcagggggagaatctgtcaagaggagacgagagcccattttataaacacagacagggcttcctcttctcacttatcgcctggcctggtgcagctaaacagtttcagatctgctataaaattgcatgaaaggagtttgagtggttttccaagttatggcgactttcagattgggtccaattgaaggtgcgattgggagatagctttcgtgctgtggttaacactgagagttctgaactcatctttttacaatacttcttccagatcaggtatcttaagtaccgccgaatacttaaaacagttgtggtgtggaagtaccatcattttccctgttttacaggtaaaataaaggaagctcaggcacatttaagtgacttgcctgagatcactcaagcatgagaccaggatttaagctcagagattcttactccagagtctgtcctcttagtttcaatactaccctgcttgcggttttcaatatggggcaggctttcagctcccacattgcagctctagctggttcacagtgaggattcttcacagtgtttacaagcctgcccttccgggaagtagttggcacccaacagtggggtggtcagatgtcttctggctttgagggtgagggacagtagcactggaactggagtgctgacctcagtttccaaagacctgattcggttcctaggtttggcaatttcagcagagtagatacacgggttagaaattattgcttaaagagtattagggaggctgggcactgtggctcatgcctgtaatcccagcacttttggagggtgaggcggcctccaagatcaggagttcgagaccaccatggccaacatagtgaaacatcatctctaccacaaatacaaaaatttcctgggtgtggtggcacacgcctgtagtcacagctacttgggaagctgaggtggagaattgcttgaacctgggaggcagaggttgcagtgagctgagatctcgccattgcccttcagcctgggcaataagagtgagacttcatcttaaaaaaaaaaaaaaaaagcaagaaattcttgcttaaagagtattacggaaaatagctaatgcatgctgggcttaataccttggtgatggattgataggtgcagccaaccactatgacacacgattacttatataacaaacctgcacatcccgcacatgtaccccagaactaaaaataaacataaaaaagtaattcttgcataggtaatggttagtagctcagacaaattaagtcacttgcccaggattattcaggacgtatcatgaggccacgatttgagctcagagattcttactccagagtctgtacatagcctttggagcttgaaatgtctgggtttcaatcccagccctcccaaatagcaactctgtgaccttgagaagctttcttaccctgtatatatcttcatctgcttatctttaaattgggagtgatacaatctgcttgaaatattggcttgagaaattcataatactgcaaatcattttatataatacctggcacaaaataagaactggattaactgtagctgcggttatttttatttttgctggtatccacacctacaggcctaccatgtcatttataattacatttattttatcaaatgaggccctggaaagtgttaggggatctcaggggagtatgcaaccaatgggacctagtaggccttggaaatatttcacaaaggaagaggatccttggtgtaggtcaggaaatacaaatgcacctgcctgccaagtccaggtaggaaataatgaattaatgaagaggcagaggagtgattgtctttaacgtgaagtcctatgtactgcagcgacctggaaggtgataccttcatatcttgggagctgttattcagctaaatgtggccatgtggaatatagattcagtattgctgttttctaagccaatctgaattttcctgtaataccactgattttttacttactatgagcaatccaaatgaagcacacatgcagaaaagtttcaagagacttacaagacttgagtgttgaaagctaactctcagtgggttagaaagagctcccatgtgcctaattccaggctctgtcggtctatgaaaggccctcctggcagagggaacagaatggcgaggacaagacggtgtagagaacatggtatgtttatggcgaatgcaagtccagtgtgtgtgtctgagattggctaaaggagagactacagcagtgagtaggtagcaggttatggagggaatagtttatcaggccaatgcattagggttctgtgtcaatcctctgtccccacagaaggcaaatctttactgtatggggccagagttacacagcaccaagaaggtacttaaactagtatgaagaacccagccaaagtgaaagtcagcaggggaataagaactggggttggagcccagagaaagacccagagactggccctgggtgaatgcaggaagctgaacactttgattcgagcaagacgaagtcagccaggaccctgagaaatcacagggctgggttgccccttccttgtgatgtgtgacagaatgaacatgggaatgcaactgtctctttgaaatgttgatttagcggcgggatgcctggattatttggtagttcaacttctaattttttgaaggacctctatactgttgtgcataatggctataaggatatatgagaatatccattttaacatcatgggagttctacaatggaatattatttagccattgaaacgaagggaaatcctgccatgtgcaacaagatagatgaacctagaggacattaggtgaagtgaagtaagccacacacagaaaggcaaatactacatgagctcacttttacctggaatctaagaaagtgaaactcaaagaagcagagagtaggatggtggttgccgagggctgggggcggggtgaaaaaaaagggaggatcttggtcaaaggatacaaaccctcatcatcagattaagttatagataactaatgtacagcacagtgatgagagtttaattaatgtgttttagacttgaaatgcggtaagagagtagatctcaactgttctcacacacacacaagtctgtgagatgatggatatgttaattagcttggtagtagtaatcatttcatgatatacacatgtatcaaaaggtcacattgtatctgttaaatatatgcaatttttgtttttcagttttatctcaatacagttagggagaaaaagagagatgtggaatagaagaggaacacattttcctgcaggccggtattgtacaagtgttgaaacacttagattagatttcaggtggcaaatgaggtaccttcaggcagttcatggatatggtatcaaatcacgtagtagggaagttatttccttgtcaactatttctcagaccttgagactacatcaaagacataatttggtggttggttaaaaaaaaaagaaaaaaaacctaaaagactcaaacatttgatcatctacctttttgaccaagagacccagagcccctgacaggcaattctggcatctggctataaccgaatgacagtgttttacttttgcattagagttactttctacatatgacaaaaaaaatactgttctttctgctctttctgtttacttcaacgagctatttcttttctttaaaacaaatactcccatagactcgtaaaacatttattgagaacagaaacaatttaaagaaaagcacatggatgtgtaaaaattgtgagtatggatcgcacataactgaagtgtaggaaacactgttttctactggtgggtttgcattcaggggagagtttcttgtttgcattttgtaagtttcaaactctccttgtgtgcaggagggaaccagaagtgggcagggatggatacaggagtacagggtggaaggcagactggaggatgggtctgaactagagccatgtaggagatggggaggaggaaggtttgcattttcaagagactggataagtcctatccacatgacttactgacaatggatgggtgtcatgaatgtctccacccaggaacttgtcacagacggctcagcttaagtatttgtatatagtttgctgccgtgaggaagaagaaaggagttgatcaacactgacaatggattgatctcctggtttagggcttatatgccagtgaggttgcatatgagcatgacatagccagcaggatttgtttctattagtgccagtctcttgcccctgggagtaggagtggactagatctgtgcacttctgatagcagaacaaagacatgggagaaggttcactccttcctggaagggcctctttctagaatggggagtattcatgaaggagtttcccttcaaagaccaaagcgaagatacttaaggcacataagggcagaggctgctgtgagcgcccatctggatgagactcacagagtcccctggggattggatttcttttctgtttccaatgtcctttgtttaaggccgttaggcatatacattaaaatggaagaagctccaaaattcctggaatctttggaaatgaaaattagagcatccctgagaaagggtatttaagtttgagtctgaagggagatggggtggagagcatcctgggccaggtgcagaggagggagtctggaggttgagcatggcatgactaaggaactgaatacacgtcagtgtagctggggctcaggcagcagtgggaaaagtggctagagataaagctcaaagcaggcaaaggctaatccacctgaaaccttttgaccaggaagagtattatgtcctttaatatagaatgaaatctgtgtcacatggactgtgatatcaccatgagaaatggtcaggtgtgtaaagacagtttctttgtcttatagagtctacttgctcatagatcatgtttatgtatgacctttcagacttctgtcagttcccttctggtccagccatctctagccaaggaatgggacaaagagatctaacaccagcaaagctttttgctgtgtcgcttggcttttctgttcattctgcattttacatcctatgcaaattccctaaaactgtcaatcatcttcagattagtaaccctcattcctcttgggcatggctctcattccaaactaatgcatagccactagccagcctgttgtttagggcaacacctcacccctggtcctactatctctggtcaaagaaatgtgcgcggtcatctagcgtcagcaaatcatcttgtatctacagatctgcctcagctcctttgctcagtaagaacttgtggatgggatcttggtaggatgtgatacatataccacaagtagatctcattgtgtcctttttctctgctgagaagcagggctgtgcgagagacagctgcgcatgtagcccaccaccagtgagattcgacatcatttttactgagactggggaccaggcaatagcagagattatgaatccagtgtctgaaattgcgtgttcagaacccacagataggcagggatggaagtcagttctggagatactcagttggtggagatgggttgctgccaagaaatcctcagcagttttgttcactcctcctaatttatttcaaaaggcaaggtagtacagttttgcagtcaaacggatctggagttgaatcccggttctgccccttcaccagctggcagaccttggaaaagtcacattcctgtctgtccacagctgcatcgtctataaaacagggacagacatcgtttgtaaatcatgcatcccatgcactgttcttgtgtgccgcattagtcagggcattttcaattgtcatagaaaatgaagtcagactagcttaaggagaaaaataagtgacagttatgagtaaagtgggactgtcttcagcatagctggatgctggtactttaatttcaccagatgctaaggacggcaaccaccagctgtattaactcccacctgtggagaaaaggcgcttctttttcagtggcttagtaaagttcctggatgtggcttaagaggtgtcacttagctataaagggcgatgtccctcttgtttgtcttccctcagccaccccagcagtgggatggggtccagctaaatgacttaaatggactaaaaaatgagggagggggctgggcacggtggctcacgcctataatgccagccctttgggaggcccaggtgggtggattacctgaggtcaagagttggagaccagccaggacaacatggtgaaaccccatcgctgctaaaaataaaaaatataaaaaaatattagccaggcatagtgacaggcacctgtaatcgcagctacttgggaggctgaggtaggagaatcacttaaacctgggaggcggtgattgcagtgagctgagattgtgccatcacattccagtctgggtaacaagagtgaaactccatctccaaaaaaaaaaaaagaagaaggagggagtgtcacctaatgaaaccttgactgatattttttttccagaaaggaaaataaataataataataatagcaactaccttgcattgaggatttactacatgccatagaccattttttagtactttatgcatattctattattgaatccttagaaagatcctttaagacagatacaatatttatccccatgttacagatgagaaaaatgagggaaagaggtgatatggtttgaccacgtccccacccaaatctcatcttgaattggagctcccataattcccacatgttgtgagagggacctggtaggaggtaattgaatcatgggtatggtttcccccaccctgttctcatggtagtgaataagtctcccgagatctgatggttttataagaggaaacccctttcgcttgtttttcattctttctctgccaccatataaaacgtgccttttgcctcccatcatggttatgagacctgccagccacatggaactgtgagtctattaaacctttctttctttataaattatccagtctcaggtacatctgtatcagcagcgtgaaaacagactaatacaggaggagttgaagaatgtgactgaggccgggcacagtggctcatgcctataatcccagcactttgggaggcttaggcgggcggatcacctgaggtcaggagtttgaaaccagcctggccaacatgatgaaacccttgtctctaccacaagtacaaaatgtatccaggtgtggtggtgggcacctataatcctagccatgctattcgggaagctgagttaggagaatcacttgaacctggaaggcagaggttacagtcagctgagatcacaccactgcactccagcctgggtgacagagtaagactctgtctccaaaaaaaaaaaaaaaaaacaaatcatgtcactgaggtcacccaggtggtaactgtggaggtgggattcaaacccaggaagtctttgtttgactcttaacctctaggctgtactgcctcttccaagcatgcttcacaggaagaagaaaatacgtcccttctgtgctcctcatgctcagggcctgacacacaggtaaacggtgacttacgagagttattgcaacaaaaccctccacataacaggaaaaaccttggccactgctaaatgtcatcctgtgatatatctctgcattgaatttcctcccaattactcagcctaaggtattatctcggggtcctcaatgagtctgctccacagaaccatcaaaatgctcacggttccaagcagtgcctcacttgccagcacagctgacagttatttttgtaggcaagggcttctgactctaggatgggtctctgcacctgccttttatatttgattcacaggttaactcttttactaaacgttgaaaatgagatgttagtcgtactttcctctttcatttatttttgggaaatttgagggtggtggtgggttgggggagagggaggcaggtaaaaagacgcagagcttctaaaatgaatgtggtgttgagttaaattagcctctgatgggccggaaacctaaacgacagatgatgagaagctgctgggcaccctcagcagtgccatggacacagtggtaacccagagagtgtaatgaaaagcactgaggtagatcgggctattggtctcatacaccttcagtcacccttgaagctggctttgggaagctcatctaaagaatgccaggtgtaatcgtgtggctaagagcttcagcttaggattctaaaaggcctggctttgaaccccagcttagtggcttcctggttatttaacctctcagatgctcaagctcttatataaaagggagaggaggagagaatattttctggggtcactatgggactcaatgagctcttacactgagggtacttatcatcttggctaggcacaggatgcaccttgaataactgcaagctggctgggcacggtggctcatgcctggaatcctagcgctttttggacacaagtgggaggattacttgagctcgggagtttgagatgagcctaggcaacatataccctatttctgcaaaactgaagaaaaaaatatagccacatagttaggcatgatggtgcgtgcctgtagtcccagctactcaaatggcttaaggagaaggatctctggagcccaggagttcgaggctgcagtgacctatagtcgtaccaccacactccagcctgggtgacagagcaagaccctatctttaaaaaactaaagaaaaaaaaaataagtacaagctgcctgattattacacttaaatctgctttcgtcctactcttttttaaatctttgactctgtttcttagattcctagtgagatcagagagtatacatctaggacaagttaagataatagcaaagtaaattacaaagcttaaactggataccaaaccctcaattacctgtctagagttttgtgtatcctgtagctacttctcaatctgactgaaagagtatagagttgagagcataagtaaaggtgcagaccagggattggaaacagattgaatctctggtgtcaagtcatattgattgtggcggcacagaacaccttgttgatgaggagtctgagattgtggcatgtgggttctcccagaaagagtgcatgattgattagtgatgcctgccaagggtggaggagtgagagccacagggcacctgccaggtatagtttagttgtttctgtcacagaatctggcatctgaggagtaatacaaagccacgtgttgtgtgtttcagcccaaagatgcttctgttcttaggggcatgcctgttttccttatgttttggatttgcagcttaacaaggcactggtattttcatggatagtgcatggcttaaagataatttagcaaataagagctttatatcaggcatgggtagctagcctttcctaggtgctcgagaagccttctctgttgattacattatggtagcaattcacatgatgtcatcctcatataactagggttatgttttgatgccttaattttaaaagtgtgatttgtctatgatgatatttgtcatctctttgaaattttgtattaattggggctgaaatgcttacattttaatatcattatttatagctattattttcatgtgccacttattttacttaaaagaagcaagtctattttgtgtaatttttagcaaacttctttctttaaactctgaattaaaatgcatttaggaaatgcttaatcaagcacagagctatttttcaaagattgttctgtcatctcttctaaaaagatggcagtggcttttttgtgatgagtggagtgaacgttaattaatttttctttctcttcagttggtgggttttattatcccacttcttgatgtgtgattgggtgacttcacactttagatagaaagcatgccctatccaaatgtgatttatgttttcccagcacttttgcatggttcagctgaaattttcttcgtgttgatcaaggtcagaaaacccagggattatgccatccatctcagcaagtaggttgctggaaaaatttgtgatggaacgtgatgcaataacaacagaattcaagggtggggtgggaaaccatgcccgtgtgtgtgcgtttgtctatcacatgaacacactcacccaattcacttcttatattgtgcttctttttatcaagttacaaggctttttgggcaattctgggttaggatttatttttgcataaagccataaaaactgtgtgatctttttactgtggccatcttaaactaacagctatcagaatttgcagatcaaccagaggtttttcatattttctttgtttttttccagagtgattgcagtatgattgacaagtaaaaattatatgtttaagatatacagcttgacgttttgattttcatatacattatgaaaaagtcgttagaatcaagtgaattaacacatctatcacctcatatattgctattttttcttttgtttcttttcttttgcgtgtgtgtttgagtgtggtgagaacacttaagatctaccctcttagcaaattttgtatttccttttcaactgaaaggttttctgggtgctttggaggacagaaccttcagaatagaaaaggtcctaagcttaaggacttctagcttttggttaagggagcacagtagaaaagcaaatgctcaccatgagccaggcaggcagatctgatggagccagggaggtagacggcacttatcatcctaagtaaccgacccatggtatatggagaatccagtcaaaggagtaacttacaaacttcaagtccacctgtcaaaatagcaccctaacttacagtaaggaaaatctatctctgtctgtctatctatctatctgtctatctctatatattgagacagggccttgctctagtgtccacgttggagtgcagtggtatgatcatggctcactgcaacctcaccctcctgggcacaagtagttatatagtaccaagtgggcatgttgtacttactcagtgtgatcctcctacatcagcttcccaagtagctggaaccacaggagtgcaccgttatgcctggctatgtttttttttttaatttttgtagagacggggttttccctatgttgtccaggctggcttccaagtccggagctcaagcagtccttccatcttggtctcccaaaatgctgggattacaggggtgagccactgctcccagacaaacatatgtatttttaatttgatctattcagattgagttttcatgttgattgaattcaccaattcataagttgacaaatcttaattttgccccatgactggaatgttttcataaagaaatcataaaattagaagagctaaggatataacagaaaacatacccccaaagaaagcataagtagacttaaacacccggtaatacctttccttgatagtggtatgaaaatgcaaattaaaaccatataatataccaatctctatctactaaaattagccaggttaacatgaaataagaatactaccttttcccatattggtgatgttgctataaaactggtttccttatggccgggcacggtggttcacgcctgtaatcccagcactctgggaggccgagctgggtggatcacaaggtcaggagatcgagaccatcctagctaacacggtgaaaccctgtctctactaaaaatgcaaaaaaaaattagccgggcatggtggcgggagcctgtagtcccagctacttgggaggctgaggcaggagagaggcgtgaacccaggaggcggagcttgcagcgagccgagatcgtgccactgcactccagcctgggtgacagagcgagactccatctcaaaaaaacaaaaaactggtttccttatttacttggtatgttgcaatttggtagaaatcatttaaaaaccagagtactcatacgtatgaacaaccagataattatttcttttgacccaatcttactcattatttcttattattccagtcgaatggaaacaaaaggacacctggactgagccaccattgttattttacttgcaatgtcaaaatattggcaacaacctaaatgcttaatcttaaggtaatggcttcttatgctcagcacagaacatgatagagtattatgcggctattaaaaatgatgaatacacttgtgtcagaggtccatggaatagtaattgatataatgtttaataaaaacacatcttataagatattttgaccatgtctaaaatttgcatggaaaagagaaatattcatgttcatattcaaacatcattttattaatttgatatttgaacattagaaagtaagacataatagaagaatagggaagtctgttgggatgcatctaggaaggaatttaggactgagtttgggcaagttccttagtctttctgcatctcagattcctcttctgaacccaatttgtagttttctatccctcacctgctccccaccctttccgcctgagtccccaaagtccgttctatcattcttacgcctttgcatcctcatagcttagctcccacttaggagtgaggacatacgatgtttggttttccatttctgagttacttcaattagaataacagtttccagtcccatccaggttgctgtgaatgccattaattcattcctttttatgacggagtagtattccatcgaatcagcgtatcccagtaattataagagttcatgaaatttttgtgtgccattttacattcacactgccttttcacacgccaagttgcctttaaaaactgttgcgactactaagtagataggatgataatgcgaaataacaatatcgaacagctgattttaaatggcttggtcatatgttaacttatgcactgtaccaaatgtttctgacattatttggaataggtgaacccatccgatagttgttaatcacattcggtttcaaagaccgtaggtccatctcacctaattatactggtattggaggctaaggtaacattagctagaaatagatacttatcttttatttagtttctatttatgagcttttggaaatacaaaggtcattgaaatataatcatttcttataatccaccaccataacgcttagagtccattggagaaatatacatccaatataaatatacatccaatataaaataaccatacaaatattgtggtggggaagggtggcagggagggaggagagtgagagagagaagagggagaaagagagagagaaggagagagagaaaaggaaggacggatggatggaaggaaggaaaaagaaaagaaagagaaaagaaaggaaaggaaggaaagaaggaaagaaaaaagaaaaagggagggaggaagaaaggaaggaagatgggagaaaaaagaaaagaaagaacaggagaaagaaaagaaaagaaaagaaagagaagaaattctgtttatgtgacagaatcttaaacaagcatataagactactgacttcaggtacacatggatccaggtcctgaaatgattccataggaaacctccacccaccatgattccgcttctgcttttctgcttttcttgggtttggcttgccttgtgaagcagtgaggcagacatcagcagtgttagtcataccttctaccaattcacagttctggtagaaagatcgtttctcttcccaagtaatcctaacttaagcccatttcttaggtggacctatctctgatgttatgggtcacttgccccctttcccaagagacccattgactaaactgaatccccctagaccccaggcaagggcgtgtgggatgttgatcaacctggtctgaattgtaccccagtccctgaagtgctgatatgaagccagtgcaatgctaacaatatggaaccacaacaggggaaagacagctccctgaagaaaaaccacagtgcttcttaccagagttggaatagagattggtcacgtaaatgcaacacttgcttatagcagacagaggtgcaatttccaggtgatcagtgatgtctacacttcccaggctcatcattttatggtctccatgctccttccagagtagtcttcatcccatctgtgtcttctctatccactctctgatcccaaaggtccctcatatccctgtacgaagttgcaagtaccagtcattcaaaaatgtattgaggccaggcgtggtggctcatgcctgtaatcccagcactttgggaggcctaggtgggtggatcacctgaggtcaggagtttgagaccagcctggtcaacatggcaaaaccgcatctctactaaaaatacaaaaattagtcgggcctggtggtgcatgcctgtaatcccagctactggggaagttgaggtaggagaatcacctgaacccaggaggtggaggttgcagtgagtggaggttgtagtgagcctacattgcgccactgcactcaagcctgggagacagagcgagactccatgtcaaaaaaatatatagatatgtattgaacacaaagtaatgaaatatggggctgacttgccggggtggaggaccagcttcatgatgggttctgtgacccatgtgcctggcagagagaagaggctatggacaaaggcaaggacagaaatgtatcatctgtcatggagataagtcgcatattcctactcacaaaaaggcaggtgtacatttctggacagagaatgatagccaagacagtgctagagagaaaagtagttacagatattaagagaagaagcaaacacttgttggaggaagtgccatattgggaggatcctgaaagactggccaggtggaatggatctgcacacctccagaacaaaggaaggagactctaggaagggagaaacagtgagggaggaattacttcttttagagacatgttaagagaatcctattttaggattaccctaggaaataagtaggagattcagcactctcttggttctaatagaaacaccattcaaattggcttaagctaagattggtattaagtccttgttgtgggttgaatagagtcctccagaaaagatatgttgaagtcctagcttttcccacccccatacctgtgaatgtaaatttatttagagatagggtctttgcagatgttatcaagttaaaatgacgtcatcctggattggagcagtcgtaaaaccaatgactgggttctttatttttatttttttttcttttctttttttgagtcagagtctcactctgttgcccaggctggagtgcaatggtgcgatctcagctcacctcaacctccgcctcctgggttaaattgattctcctgccccagtctcctgagtagctgggattataggcacctgtcaccatgcccggctaatttttgtatttttagtagagacggggtttcgtcatgttgatcaggatggtgtcgaactcctgacctcaagtgatccacccacctcagcctcccaaagtgttggaattacaggcgtgagccaccgtgcccagcccgaatgggctcttataagatggagacctggagatgtacgaatgtagactcacggggaagaaaccatgtgttgatggaggcagagactggagagatgcacatacaagccaaggagcacgaggggtgctggccaccagcagaagctacaagaggcaaggaaggattctttcctagagtccccagagaaaacaagaccctattaggactttgatttcagacttctagcttccagaactgggagagaataaattactgttgtgttttttgtttgtttggtggttttttttgtttgtcttttgttttttgacacagtctcactgtgtcacccaggctggagtgcagtggcatgatcttggctcactgcaacctctgcctcccaggttcaagccattctcgtgcctcagcctcctcattagctgggactacaggtatgtgccaccacacccactaatttttgtatttttttgtagagatggggtttcaccatgttggccaggatggtctcgatctcttgacctcgtgatccgcccacctcggcctcccaaagtgctgggtttacaggcataagccactgcgcccggcccatttctgttgttttaagcaacccaggttgtggtgatttgttgcaccatccctagggaactaacatatttccatgtctgaaaatcgagggatatctggctttaggtatgcctaaatgtaggtgctcttgcaaatgtcatcagaagtgtatctgtcccaatttctcattttttttttcttggagttgactgcaattcaggtgggctcttcccaagcagagcaaactggcccagaagattatttcaagacttgcatttgacaaatttagtgacaaagccctgggcttggtcaggcttgcatcctgtgttcattgctgaaccaggccctgccacagtaggcatggtgtgttagtctgttttcacactgctgataaagatgtacctgagactgggtaatttgtaaagaaaaagagctttaatagactcacagttccatgtgactggggatgcctcacaatcatggcagaaggaaagcatgtgttacatggcggcaggcaagagagaatgagaaaacaagcgaaagggctttccctttatgaaaccatcagatcttgtgagatttactcactaccacaagaacagtatgggaaaaccactgctacgaatcaattatctcccaccaggcccctcccacaacaaatgggaataatgggagctacagttcacgatgagatttgggtgaggacccagtgaaaccatatcacatgggatgtggtatttgtccaggcctgagacccttgtgaatctctggaactttggacaagcgtcagctttacgtggacaccaagggcgatgggagaggagaggttctcaaaaggaaaagaggtcctcaaaaggtttaaaggaaaactgaagggaagtcaacataggggtttggggttgggggtgttattatcagaagtaggtagaaggatgctgcctaggggacacacacacacgcgcacacacacacacacacacacacacacacacacacacacttccctaggtcaactaggatcagataggtaggctggagaatagtagaggtgagtgttgtagttacggggagttcggaggaaggccttccatgatcagaaaggtgtgtggagaaagtggatagggaatagagtactatcctgccttccagtcaattttggggagtcatgagctgtttcgtttttacaatggcagcgcctgccccagttgggtcctagcccaaggtcaactctcaatagtaaataaaggtgccaggaaggcagtatagcaaccaagagaggaggcagaaaggtcctgaatggggagggccttgggaatgaaaactttgacttgatcattacacattctatgcatataatccacaaacatttacccctatcaatatgtaagctatttcgtattgataggaccagctcggaaaaaaggataccaggagcctttacagatgttattctcaacttactttctttttttttctttttgtttttcttttctttttttttttttttttttgagacaaagtctcactcttgtcccccaggctggagtgccatggtgcgatcaagggtcactgcaacctttgcctcccaggttgaagcatttctcctgcctcagcctccctagtagctgggattacaggcacccgccaccactcccagctaatttttgtatttttagtagagacggggtttcaccatgttggccatgctggttttgaacccttgacctcaggtgatctgcccacctcggcctcccaaagtgctgggattacaggcatgagccaccatgcccagccgttaactcaactttctatgcacagatccaaaagaccaaaagacttgaaaaagaataaaaggcacttttaagtactaaatgctttctacttgcaagactaactgctttacaagcatgattcatttaatctgcctatttaaaaaagtagatagatactttttttcagatgatgaaatagaattccaaaatattcaatgaaagtaccaagttcacataatgagtaagtggcaggactacaactagaatacaggttttccgtgctctagagaccatagataatttagctcctgttagaaggcacagaattaagggtggtcaacacatctgtcattccttaaggcccttttgtaacactgaactgatatatctccatagatacaaacacacatcaagatgtaaatatatgtgatatgtttctatggagactggaggcctattttattagtctaagatccatggacttattgcccctaaaaggctacctacatcaaaagatcctaaaaagaaagttttaaacatccagcctaaattaagaattccatatcaaaaacatcagggagctaggattaaataaaaattaagcccggaagcagagtaatgactcagcagttcattagagccttacattttcaatcaaagataaaatctcattaaaagtatatttttgattagggaacaagtttgggctgttccaaagttggacggctgtatccatagacatgtgagccatgaaatccttttttcctcttttgtaactttaaagatagtgagcgatttatcttctgacatcactatacaagttattaatatagaggaagactgaacaatggtggcagagctttttatgtatctaccagtgacttttaccccataaaattaaaaggcctattaatataggctcttccaattttaggagcaatttttgtttattactaaagtgattaatcagtaaggaaccataaagaacatctaacctagtaccgcctaatagaaatataatgtcaaacatatatgtaatgttacattttctagtagcaacattaaaaaagctgagaagaaacagctgaaattaattttcctcatataatctattcatcctatatagccaaagtattctcatcatctacttaaattaaaagttttgttttgttttgttgtgttgtgtttgagacggagtctcgctctgtcgcccaggctggagtgcagtggcacaatctcggttcactgcagcctctgcctccttgagttcaagcatttatccaacttcatcctctcaggtagctgggactgcaggcgtgtaccaccacacatggctaatttttgtgtttttagtagagatggggtttcatcatgttggccaggctggtttgaactcctgacctcaagtcatctacccaactcagcctcctaaagtgctgggattacaggcatgagccgctgcacctggccaaaagttatttatgatatataatatgtttaggtgtgtgtatctgtgtgcgtgtatgggtcctaaaccttcaaaatctagtgtgcattttacacttacaaaataaagagagtgaaaccaaagatttgagatttctctttagaggttttgtgataacacaagtgtttctattttgacagcggattgcatactagatttttcctttttgctttaccatatgtgggaaatgacacttctaagacacaagatacacagaacaaatgtagggaatcctttaagctctgtgtatctcagagtagatgctctgactgattaattggaagaagtgctaagataccactgacttgaagctttgaaagttaatcacttgccatgaatagctgataaggcttgtaacacggttcatccaggaggctgagtgaggctgggtagatgggtggtttatcgcattgtttccaagtgtagcatgaattccacccttcttacatgaagccatttggggtggcacatggatgtggcattcagtataattgaatcatacagtgagactctaatttctttctcaaatccatttcattctttcagatgtcaaagagatcgactctgcgtgttgctattatatctctaacacctctctaacccttgctaatctttttgaacagagagagagggcaagcaagctttcaacagacaaaatatgcagccagaatttcacaactgaggaacattgcagtgttccacccattcagtctgagtctccatctatttatggcatatcagactggttttcagttttgacgatgacatgaaatcgcgttttaaagtttactgacacgtaaaaaagtgagcttaaagaaaaataataagctaatcatggtaaaggtgactcaaggagaagataacaatgacgagcttgatatgtggatgttctgatgtttgggaaatgcttgtcttgctatattggtgatggaaaggggagacttctccatgcttgctgcagacatcattgcagtgcctcgtttcttggtctcactttcctttctttgacctgggaagtttccacaaatgatgcttcatggtcgcattctggatcacatcttacagagcaatggggaaacatgtacagtcatacccctctcttctaggaggtagcctcattatctttttatgctaagaacaaatagattggaaagggtctaacatttttttgagcatctcctttgctcaaaactttaaaacacctgtataaagcatagtctaaactaaccaccacaccatacaagagtacttgagtgagttctttgaggaggaaatggatgaggatgtggtatttgtgcatgtaacttcccttcctttctgttttcaagttcagtttgtccagtattaattcatcagagatgcagagaaaggctaaacaaacactgggaccttctacataaagccatagtttctacttgtttttttttttttttttttttttttttcatacttttctgagctttgcctaatggtctcatggagttctttaaagtagtgtttttatataatctgcctgacaggcaagacaggatggttgaaatttatactcccaaatatgacagagttcaacccagttctgctgtttcataacagtgtggtcttgaggaaatctgaagagattggcaacttggaacttcagttttctcatctgtaaaatggggtcatagaaggactaccacatagggttgtgtttgggaatgagaagagatagaatagcaatttcgtatggagctgcgcatatattcagtaagtggtcgaagtacaatttttactatgagtatgattcctgtctttgctttgcttttctctctctcttttttttttttttttttttatttgtcgcccaggctggagtgcagtggcgccatctcagctcactgcaagctccgcctcccgggttcacgccattctcctgcctcagcctcccgagtagctgggactacaggcacctgccaccacacctggctaatttttttgtatttttagtagagacgaggtttcaccatgttagccacgatggtctcgatctcctgacctcatgatccgcctgcctcggcctcccaaagtgctgggattacaggcgtaagccaccgcgtccggccctctttgctttttcttagacctcctagcagatgatttgacttgagttttattctaaaataacaataaagtttcaattttatactcttattttagttttccactatcaaagtttaccgcttagaggtaatatttaatgagactttaatcagacttctgcggttctgatttacatgtttgtgttttatctttgtaaggcggaaagatgctagatgggcacctaactttgcaaaccattttttaaataaatgttgcaatattaaaagcttcttggttaaaacatgaatgaagtacctttcactgtttcagctaccatggtgagcatagaattgaatcaatatttatacaaagattacaatataaatgcaaattgagctgcatgataattgggcctgagtaacttttaacatagttcgtagaaaacttcaaatttctgtactggtctcaaagtaagtagaaatctgtttaggctgggcatgatggctcacacccataatgccagtcctttgcaaggctgaggtgggtggatcatttgaggtcaggagttcgagaccatcctgggaaacatggtgagacccccatctctactaaaaatacaaaaattagccaggcatgatggcacgtgcctgtagtcccagttacttgggaggttgaggcaggagcatcacttaagcctggaaggcagaggcagaagttgcagtgagccaggatcacaccactgcactccagtttaggtgacagagcaagagcctgtctggaaaaaaaacaaaaaaatatattttgatcgcatcttggttaagtctttgctaccttggttaaaaagtttggtatcttggtagcaaatttttatcaattggtaatatttgcctggcaagctgtgtgaagaagagttcagaagtataaccagatttagcagaagtagttctgtgatcaattagtgatgttgtccttgtctccagaagaggtgtttttcatctccaaactttagtcagttgagaaaataaagtaacaatttgttgttaatttggcccgttagttaaagccgtaaacaaagaaataagcaataacatataatcacaattgcccccctccacaatggtcatttaaccagaaaaaaaaaaaaaaaatctttctccaatgagtaaaatgttcaaacttatctgacgatattgataataatataattaatagacataaccactctctgtaattcagttctcacgtctgtaatgtggagataatagctaccctttcttttcagccgggatactctaaagacaaagtgagctattttgagtgtcaatccagtaaatctttagtctcttctgctattctccaggaatatgcttgtgaaaagtcaagtatgtcccttaaagtaagttttgatattaatatctttcttttctgaacctttatttcttcttccaaatcttgaagttatctcagaaggatacacccttactcctgactgagaactctttgctcatatctactggatccagtttgttttgcccaatagaacaaaatgtcacgattcttttaaagttcttcctgggcaatagtgaagtgcctgtgccttgaatgtgtattgtttgcctgtaaatttcatcatttgtgcccaaggattagggcaattaaaacaacaacagcaacgaacaacgcaacagagtcagcgctttcagctcccactctcagataggaagcacacagccctgcctcctctggagggattgagctctcaggcgtcgatttcccagctgaccactagaggcgccccttgtgcttgtaccgcagttgctgccatcaggcttcgaagccgattgccccttcttggggaaattgtgaagactaaaaaaaaagtgtttcattttatggaaaaggaaagttagacatttgttaaatattaatgacattgaatgtgcttaatggttttgtggtgatgtagaaaagggtttctcaatcttggcattattggcaaactggaccggtgcatgctttgctgcggagagtgtcctgtgcattgtgggtgctgagcagcagttctggcctccaaccgccagatgtcgagagagcttttccttctcccattgagacaaccaaaaatgactctagatgccgccatgtgtcccccggcgcgcaaaattgccccctgtttgacgatcatggtgtgagacgatgttatcattaccagtagattcatactaaaatatttcagggtgaaattttcacagtttattttcagatagcttaatcagaattgaaaacaggataaaggcaaaaagagaacatttttgaaaaaagaaaagaattaaaaaaaaaaaaaaaaggaaatggaaggataagaaaaaaaactatgagagccaaaattcacaggccaggcaagtcacatcaggcctcataggggttgacaagctgcagtgttgagtgctttacacagctgggcaaggagtgaggacagcttctccatccatatgaccctgcttttaggagaggaatgcgtgtgatacaacatgtagaatactggagactcgagtttaaccacagggttatttatttaatgatgaaagagctaactagcagatgcgtattttccttgggcattacacagaggacttacattaaattgtcacataaaaaaataaaaagggtgagagaactgttctaaatttaaaaagacaaaaaggacatagttccagtgcagaggtcaaattttttcaagcctgttaatgacccttgagacctttaaatacggtcctgggcattagatttaattttgaatcaaagttaatattcttaggtgtgattcatggaattgtggttatgtaggagactgtctttattaggagatgcatgctaatgtatttggggaggatatatctatgtctttcaaatggtttaggagaaaaaaatacctgtaatatatacatgcatccaaaactatatataaacaaaactatatatatatgtatatagcttttgttttgttttcgttacaaatatatacgtttgcatacacgtgtatacatgtgtgtgtgtatgtatatatctgtgtttgtgtttgcatatccaaactgcatagaccaaatggctcataccaggtttaaggcgaaagcaagccctcagatctgcacaccctagtctaagtacagcagggtgtgtgagatggtgagacgcagttcaggtagtgcccatcagagatggagctttgcggtcagacatacctggattgcaatcctccttccaccagttaacaggaagttgactcttcatgggttttgtaactttgaagcctcagcaaagtggaaataacactttattttacacgaaatggttgtaagagtagagggagatcgcatatgtgaaaacatgtgtcacgcagtgggtgcctgctaatacctcttcccttcttttctccatgttaccccgacatgttacaaggtggggaagatagtgaatggtccacagtgtgaacagcaacctgtgggcatcctcaaatttgtttgcatctcatttgtgtgtacacggtatgttcaagcagagaaaatagcagaatttcctgatggttttcaatggtatcagcatgcttttatggttcgactttaggatctgatgttaaacgcaaggatgtacgcaaatgtttattagtttcttatgcatggaactggtgggttgctggtgttagaggctaatgtggccagaagatggcagtgcacgataaagaaaagctcccaggcgccagccactgttttaattagctaaaaggaagacaggtatgcttttatatagtttttgattttgtaattttcctgagcagccattgagggcagatgttttcatcttttcccccagtttaagtatcataggagagggaatatcaagatgcaatcaattgctggccacggcaaacctcctgaacttaagtcttgcaaacatcatcagcttgtgccatcttagaaattgctgcagtggaaacaggcatggagctatcaattacttctagggctgcaatcccctctgtccttgaaaaggaagccagctgattctgtgagtgagatgaggggacagccactggaatgggaggtggcttctttatcagtgtcttagaagttgatctggagccctagaggaagaaattaaagatcaccttaaattgtgcatgagggcctagccccctgtcgtgaatgaccgttaactggtcagcaaagtaattgaaacaggaaagtttggaggaaaagaaaaattccttaaagcatttcttttttctcttctagttgttacctttgtctttagagtgagtaatccttcatgcaaaaggagctagcatgttctctatacatacgaagtcctaggcatactttatacattttctggctttacttagggtgatcttcaattaatctctttggcaggttgtattagtaacattttacaaaatgggaaaatgggggctcaggaatagtgaggaacttgcctaaggctgcaggatgactgaaaatttacaggtgaaattcaaacctccatccctcatcatttccctatttcctgtccagaaaggaatgctaaataaatacgagctgtcaccttttatattccattccttttctttattcctgctgtacttactaaccaaaaataaagacaggaggtgttgttaatcattacactggcaataaatgacttcacgtaagtgtactaagagagggagagtttttcttttttttttttttttttttgagatggagtctcaccctgttgcccaggccggagtgcagtggctggatctcggctcactgcaacctccgcctcccaggttcaagcaattctcttgcctcagccacctgagtagctgagattacaggcatgtgccactatacccagctaatttttttttttttttttctatttttagtagagacaggattttgccgtgttcgccaggctgctgtcgaactcctcacctccggtgatccgcgttcctcactctcccaaagtgctgggattacaggcatgagccactgtgtctggccaagagtttcattttttggtcacacttaaaccaagtccagacatcatttgctagttacacaaaagtcatccatacttattgtagaacatttaaaaatataaaaaaggagaaaaacaagatggcctcatcactcaagaataccaattttaacaatttggtgtctgcccctatcctttttccctccaagcacctgaaattttaacaaacagccttcactcaatgttgttttcattatgtcatgaaagtgtttcctacaataataaatatttctgtcttaaagccaccattattaatgacttcatgtcctcttccatcatatggacattttctagtatttaaaaagcttttatttttgtacacttaggttgattccaacgtgacaaaaccaagcaggttctgtctagcttttgcaagacagaaaaaatactgcatattgacaaaaatgttatttgaaaatgtcccatatgtttggctgggcccagcgctgtgctcagcactgcattatttcatttcaaccgtgcagcagcagcagtggggactatcatttcttctacatattaagcagagagaatgtgaaggaacaaatcccttcgatgtaatcagacaggtttccacggttcagatgttcttatcactcaggtagaggtctcaaattagatgagacagtggtcagggccattcatagcaatcgaaggcgtctttcttcatgggaacttcacagatttgtgtgggcttagtctgagccctcgcccctcctcctttgctttattgatgcttcaggaagcctgtgggccattcagtttcatgtcgatgacagtacacctaagaactgctatgcgcaggcctccgttgtactcacaacgcagcttgtttttgcataatttaagcactacgtggttgtgtcgtttaagttctgtgaaattggtgttcttccatccatgaaattatatacatcttgggaacatttctcagttgctaaaggggtgaacacattcttcaataggggtgagacagcagtggagttgatagagcttcccccgaaagcacaggtatctctccttgtccttttgagacacaaaggtaagcattttcttctttaatgctaagggaacgcaattgtgagactaaccttcccattatgtttcaggccataactctttccttttctcccaacctcccccattacacacacccaacccagttaacacatcaagaaacccacagattgcacgtcctttttaaacattctctgcattgctgctactgtgttgtattttgagtgcttaagacaatgataatcttccaagaaatgcttttgattaatttgtgtacctgatttgtgtgtgtatatagattctgctcgtaatgatatgatgtgaaaatactcattatatataacaaaccaataatatgtcgtcatggaaaagcatggttaaactcatttcagaaatctttgcagtgttaaaaacaggaacagcaggtatctagttcctgaaagaatcacacttacagatgaagggcttttgttgttattgttattacttggggcatccatagaaatacagattatgagtatcctttgaattcttggttttaacatcaggtagtaaataccgtatgttctgacttagaagtaggagctaagctatgactctgcagaggcacacagagtgatataatcgactttggatactcagaagggggaggttgggaggagaatgtgggggtaataaactgcatattaggtacaatgtacactacttgcgtgacaggtttaccaatatttcagaattcaccactatataattcacccatgtaaccaaaaaccacttgtattacccaaaggctactgaaattaaaaatatgtaaagttaagttaaataattaaacttaaaagtggtgatctctgctagtcaggataagctagtctgtgcttcagtaacaaacatgtcctgatatcttggtgttttatcacttgcaagcttatttcttgccacataaaattaacttcaggtctaatagttctataagaaggttctcttccaaggggaagtgccaggattcaggctgctcctgtttcatctagctgtatttatgtcctgtatggtttttcaaagttgcagcggccggggaggacagaggatggaaggctcacagctactctgttataggtcagcccagagtggtcacatgacactcctcttactccctattggctagaacaagtcacatgggcccaacctaactccaaaggagtctgggaaatgtgtgctcaggaagcacaaaatgaatgatgacacagtgaatgcatgttatttctctccaccgtattttcaaaacaatcatcttgagtgagagcttcagaaatgaaagatgacacatgctaacaaaaccactcttggaaacatcttctatgccaagcactgtgctatgcacctcacctgttgtattagtccattcttgcactgccatagacaaatatttgagactgggtaatttacaaagaaaagagatttcattggctccgggttcagcaggctgtacaggaagcaccacggcttctggggaggtttcagaagactttcagtcatggtggaaaaaaaaaaagagaagcaggcgtgtcttaggtggctagagcaggaggaagagagagatggcaggaggtgctacacaattgtaaacaaccacatctcatgagaactcagtatcatgagacagcactagggagatggtgctaaaccattagaaaccacccccatgattcaatcacctctcatcaggccccaccttcaacagtgaggattacaattgggcatgtgatttgagcagggacacagatgcaaaccgtattacctgcattcttttatttagaccccttggcaacagcagtggggattttcattttctccatataagaagtgaggagagagaggttgagcaaagtaacttcccaagcaccgtagtggggacaataggagtcaaactgaagactaccagaggtgaagcctgtatcactgtccaaccagccatttgacctgcagattggtattctttattttattattattatactttaagttctgggatacatgtgcagcatgtgcaggtttgttacataggtatacacatgccatggtggtttgctgcacacatcaacccatcatctacattaggtatttctcctaatgccatccttccctagcccaccacctcccgacaggccctggtgtgtgatgttctcctccctgtgtccatgtgttctcattgttcaactcccacttatgagggagaacatgcagtacttggttttctgttcctgtgtcagtttcctgagaatgatggtttccagcttcgtccatgtccctgcgaaggatatgaactcatccttttttatggctgcatagtattccatggtttatatgtgctgcattttctttatccagtctattattgatgggcatttgggttggttgcaagtctttgctattatgaacagtgctgcaataaacatacatgtgcatatgtctttatagcagaatgatttataatcctatgggtatatacccagtaatgggattgctgggtcaaatgttatttcttgttagagagcttatcctctaaggctgattatgtctggagtttttgtaggaagtggttgcaggatcctgaggttgaattgtttcttgttttcatatgtgtttataattcacatgaagtgatagaatagactttgaaatataaggaaggtatttctcttaagtcttcacctccacatatattatatatgaaaatctagatttatttgatgtgggcaatagataatacttttttcctaaaaatattatttttatatggtaatttcttctcatgtgttttaaatactcatcttctaaggctgagtaagtgtatttaatgcacaaattttttttatgtttatgcaagagatgtttacacaggacttatctttcctgtaaggtgcctcagcctgtctatgacaatgtctactataaacaatatcaaagggtttctgtattttatatcttcctgaatgtagacatattccttggggacagttgtcatgaaaatcctctggaagtactttggtgacatgtccgtcattcatgttctgtttggttcttccctgaaactcccacaacatggaaataaacagagagcccagctgttttgtttctccgtcttcctacggggagagactcaatgcacagacttcttgagcgagggcagtaagctttgtctcctgcaaagacatttgtctctgaatgtggtttccttttgtttcatgcttgtgagtgtgtgcttgtgtttgtcaattgagaatcagcaacgaagaggtgtaagagttgactgttccccagagtataagggcaagctgatagaaaatcagctttgggtattgatgataaacaagttaatcttctttgggtaatcttttgaaaagaatccttgctttatttatttatttttgctttttttcctgttgggaattatccgtgagtgaaataaaaatgcttagaagatggtcttagatttcagcctctagcttataaggattgaataaatgttttattactcatgagttaaaacataggctaattcaaaaagagtttactttaaagagcatgactctctaagaagatatttgattttatcttattggaatactaggatgtggagaaacaatgataatatgtgtgtttttaagtgtgcttagagtgataacatcacctatgcaatatacgtttctagaaaagataattcacagatccattcgtgacaaaaattcatataaagggccatcacacttttaaaaaaatggagggactatttgaaatgcaaaatgattttgcctactatagtttaacattaaagaaaaaaataaaattaacctatttgtttaaaaaaatagtatataagtaaaaggcaaacaaaacctcaaagatcatcgtttcaaaactatactgagatgcaggatgatcttatgtatcattatttagtaagaccaagcagggattggttgattcgttggctgcttaggaatcataaacctctgcttttagtcgattatagtacagtaggaagtgggttgaatcaaaaacaatatttctaactccaggatatttcaagttcggtttggtttcttttctttctttctttttttttttttttaactttagaagtaccatgagccaagaaaggtagtgtccccaggccatcattttccttcctctaaattcacattactgaatttttccccccttggactctgaaacataatcaggggaattggcaggtttgggttttcattttcacctccggctaaatctgtcaacctgtgatgaggttggctgggcatcatcaggaagcgaactgttttcctatttgtagagtggaaacaagtaccagcgcttgcagcttccagtcattttgttattcatgttacatcatgttccttctgattgttaacatgacgatgtcactgtgtcttgagagatgttgggaaaagtaaaagggaattacagagtcctggaaagaaatctcccaaccatgtcttttgtatcaaaaagtgtctgctattagctgtgggggagctagatgtcactcccatcagaggatggttttctgtccctataaaattattcccgtgtctatacagagcatctcgatgtgtgcgtgctgcagaggtagggggtggcagagctttaagcccgtaataaacataactgtttcttaagaaagcttattttgccatcattcttcactcttctctgtccatttccaccttcccaatccaaacttgtcactttcaacacctattaattctccttcctcagtacctttaccatctattcctttttctttattttttttgtggatgccactcaagtttgggaagtaaaatcattctgagtaaatgcgtttcgcaggtttcccgttatcacattacacgcgttatatgtatcatttgatatcatctttacatcaatcccaggaagaaagaatgtgtgcctccactgtttaagatgaccttggcttacaaacgtaaaatgaccatggcaggtaggataatggtcctccaaactgtccacgtcctaatccccaggaaccatggatatgtcaccgcacatggccaaggaattttgcagatatgattaagttgaggaccttggattgaggaaaattaattatccagataggctcgatgtcatcccaagggtccttgaaagctgagcacttttccttgctctggtcagaggagagaagtgacagtggaagaatggtcagaaagatgctacttttctggttttgaatatggaggaaggggccatgggccatggactgttggtggccttttgaagctggaaaagttagggacatggatttttcccctacagctttcagaggaaacacagccctgcctgttgacaccatcatttcagtccagtaaaagacaagtcagacttttaatatacagaactgcaagataataaacgagtagttattttaagtaagtttaattaagtaagttagtggtaacatattctcctattttacagatgacaaaaccaaggtaactataaagattactttgttacaagtttagcatcaataggaaactaactcagtgacctccctgtaagatcacccagggagtaaacgtgtgtctgagctgtggtttggattcatacctctctaacattaaagagcagatgtcgttttcactaagtgtttcatcttctttatttcttacctagatccttgaagtcatttgatacctggtatctctccctagagttcctctcatttaaatccatcctactcatcactggtacattattcttcctagaacattgaaatgtttaactactttccgtgaccctgtggcctaacaaagaaacaaacagcatgtgtcggcctcctggttcctctctgaattacttccacttaagttgttgattcacctacactctagcaaagctggaaaatttttgttgtcctccttccaccatgcacttttccatccaaacacatttttttttttttactgtttcttccacctgaatgtgtttccctttaaccaacacctagttgaaatgcctactatatactccaagtcagagtaatgtctttatcttctgatctgtttcaacccacctctggtatcaacatcatcatcatgatcattgtcactatcagtactatcactaccatcatcatcaacattatcttcatccactaccatcaccaccatcatcatcaccatcctcatccattactatcaccaccatcattatcagcatcatcttcatagtactaccatcaccaccattattatcaacatcatccccatccactaccatcaccggcatcattatcaccatcgttctcctccactaccatcacaaccatcatcatcaacatcatccccatccactaccatcaccaccatcattatcaccatcatcctcctctactaccatcacaaccatcatcatcatcctcatcctcccccaccatcaccatcatcatcaccatcatcctcctccactagcatcaccaccatcatcatcaccatcatccgcatccgctaccatcaccaccatcatcatcaccgtcatcctcctccactaccatcaccaccatcatcatcatcctcatccactaacatcaccaccgtcattagcaacatcatcttcctccactaccaacaccaccatcatcaccatcatccgtctccactagcatcaccgccatcatcatcaacatcatcctactccactagaatcaccatccccatccactaccatcaccactatcattatcaacatcctccttcactaccatcaccaccatcatcatcaccatcatcctcctccactaccatcaccaccatcatcatcatcctcatccactaacatcaccaccatcattagcaacatcatcttcctccactgccatcaccaccatcatcatcgtcatcatcctccactaccatcaccaccatcatcatcaacacatttttattcactaccatcaccaccacaatcatcatcatcatcctcatctgctaccatcaccaccatcatcatcaccatcatcctcctccactaccatcaccaccatcatcctcatcctcatccactaacatcaccaccatcattagcaacatcatcttcctccgctgccatcaccaccaccatcatcatcatcattctccactaccatcaccaccatcatccttattcagcaattctttagtgttcacagagtgccatatacaatgttggatcctttatgagaatcatctaattgactgtttacccatatgaagtagacactattatttctcctattttacagatgacaaaaccaaggtaactataaagattactttgttacaagtttagttttctattgtaatataggcatgtgtttgtcatatgtcactactcagatgctgaaatgtttgaaacaaatttcaataattcaacacccaggtttggagaagagtttcatcttttgtttaacctcatcatgactctgccaactgttggagttttccttgttcctgctaaataatccctttagggcaacttctattgcatattgtcagtattccacccattgtgcgattctccaattttgttaaattagagaggaggttggtgtgtgagtcaatttttctgtcttatttatcttgacaaacaatttaagagattatctggcatttggagttggcggagattaattatgtagattatatccacagttctcatccaaattccactataaacacaagaagaaaaaactggttggtcttaccatgtgaacatttcattttggatataaagagggaaatgaaaatgttgatgatccaaacctgcctgacccaaggaaattcctaagtgttttagttacatgtccttgaagttgtttctttacacattttgttcactgagggcctctttactggcttgggtgcaggaactcagtctcatgtttgccatcccaaagttctgccttacactgtgttggtcttatcatggccattgtttttccacatggtagcaagatggccaccaggagccaccagctctatcatatcctcccagcaactccattggtaataggtataaaaatgaattccagcattgcctctcatttaactaattcagggcaagggcttttccgtgcatcagtcactgtgacggaacacagtgattggacagacctggtctagagtccagccccggagccctgggaaccacacggcaacacacagaagacagcatgcgtggtaaacaggactaacacttgtcagatctcgggggaaaggatgttgcatagttcagtaccacaggtgtcactgtaggtgaagggaaaaaaatgacacatagacattctaaaagctgcatttcatattaaatcagccaggctttgatgcatatggagaagaacttttagatgaatgctatttcagaaagcccttgtcccagtgaatattactgtgtgtaaaaaggaaaaaaaacaatggccgggcgcagtagctcatgcctgaaatcccagcactttgggaggccaaggcggttgggtcgcctgatgtcaggagtttgagaccagcttggccaacagggtgaaactccgtctctactgaaaataaaaaattagctgggcgtggtggtgagtgcctgtaataggtactcaggaggctgaggcaggagaatcgcttgaacccaacaggtagaggttgcaattacctgagattgcgccgcttcactccagcctgagagtaagagagaaactctgtcaaaaaaaaaaaaaaaaaaaaaaaaggaaaggaagggaaaggaaaggaaaagaaaatgacataattaaatgtatctggtcactgttggattaaacaagtttctttaagatttcttggagcccttaagtggccgacgcgcctattatgaatgtttcaagtatgagatatagaatgatgagcactctcaatatattttcacttggaatcttctttagggagaatatattgtaaaagacgatcatagtgtccggcctattgttagtactccatagatatttgtcaagaaagtgaatgactgtcacttattttggaaaatatagttcaagaatcatgaatcctctctgtacttcttgtagcaaaagtaaataacagttctttgatatcttcattgtcatgtcctgttttgtttgttggttttgttttccctgctggaaatccaggtggctcaggatgaacatctccatatggccgtgaatctatgggaggaaattgcatatggtgaaaatagtggacaactgactgttccttttataaccacattgcaataagcttttaaagagatgtacagacatacacacactgatctgatttctacagcgtatccacttaaactggcaaagacgtttaccttgcttgaggcaattgttgtatctagaaaactgtgaaaattgaattaaattacaggtagaatacactggggagctcattactaaatggatcctatactgcgtgtttttgtagaatgaggaattatttcataaaaggaataatactctctagttgatataataaatatgcttaaattgaggtatacaatatctgtttgtaccactattacaggcacataattgtcatttatttaaacttatctccaaactaagtgaaatatctctgactttttcttagaagttttctttggaaaaaaaaatttagactagcactttctttataatatgcagtgagtcttgttttatattgaaacctcaattcattttcttcctagtgaaaaatgctttttcatcccctctgaaataaatataatctttgaaattggagtcgatgtaaatccagaggtaatgagattcagtttttcattgtagccgaattagatggagaacttcaaatatttatttgaggtttaattcgagtaatttaggaaaacattgagctttctcattcataaatgataattacgtctcttcatcaaatattatactatattcccttctgctatctgtacagtctccttcagatatgaacagttttatatctcaaaggagattttttttttccatgtaacttccttggcttgtttaacttacaaaacctttcgaaatgcagtttgctgtgcctgtgtttggagtgtttagttttgtagaaaaaaagaggtgagaagtagaataacatttacattgattttcttcaaggttgtgctctactgagaaatagtattttgtcttactaaagcacatgtttaagaaatggagattgctgtcttgcaaaacccccaatataaactccagcaggctaaaatgcctgtagcctctagttgattataattctgtaccaaatcaaaagtgactgcatttaaaaacttccataaagaaaagcttagacatttcaaactaatgcttggccaatgcaaaattatttattccttccccttcagaatttcttctggggaaagccaaagaaaaatcatatgaattgcttgaagatattcagggattgactagagaaatagggcctctaccttggtggtgatgatgttatatattataatatgtatatatggtatagtggtcactgtagtggtagctgcagtagtggaccaggtttttaaattttctgcatcttaagtccttttccacccactgtagtcatggtacttgactttggtcactaagcttgccagaggaagtcatattaagtattccaccagccagggatcctttgggtgcaagcaacagaaacccaattcaaactaccttcaacataaaagggaaatatactggctcataggaaacagcccacggtgagactgacttcaggaattaaggaatccaaaaactaaatgatgtacagaatctaatatctccttataaatctgctttccattgtgtgatcacatggtccattctcactggagcagcttgagtcaaaggcttatcctggaactggtttctgtgttggtggatggaatgatgatgtgggagcaccaagccaaggttatttgctcacctctggattaaaaggggaagaaaaccccatggcgaacaaatgaagtttgggatgatccttccccaaagaaacaggctgttgtccaaaaaaggaaggaaaacagatactgagcaaaccagatcaacagaagacccaaccttggtattggaagtccatatctctacatggcccacctttagccttctccagggacaccagatctgcccagacagtagaagaacaattgtaatcaagggtaggatgtggccagaagaccaaaagtctctttttttaaaacatctgttctattaaggaaccaaccagagagttgattggtctatggtatgtacttatgtcttaactgatcaaacttattatcctcctcagtaattaaactaactagaattgtctcttgtcccactgcacactgtctgtgaatttggagttatttcaactgtttggaaatcataaaatatgcattttgttactcatgaattaagagctagaaaccagaaatccacttatatttcttccacctcccttaaaattttactttccctcgtgctccaatttgacaattagatcatgtaaatatcattatgtaaaataatacagcattaagatgtccacagaagatatggggggtaatctatttgtacatctaaaccagtccatttttctaagatatatgaggatgtgggaaagtctgcattgatcttcaagtgcaaatttttaagagaacacaatggatggtttagctacaaaaactagagattcttaagtaagaccattcttgtgaagttctcctgtggccgccataacgcaaatcaatcctgtcattatctcttcctgggctgggccctgtctttccccatgagcgcttaactctttcttttgtctcttcaaatttttgtttgctcttctgaagtcatcatcgtcaattagtatttgccagagccccacagggtctaacatgccacttctccatctgttattcaccgaggcagacgtggtgggaccaccccttttaggttagaatcacattattctatgctattttcagcatctcccacctgctgtcctccaagccgttctcaaatcccacatctttgttctgccctgttttcctcccccacggtttgactttctaagcattatgcaatggtgagaaatgtgaatcccttatagtgatatggaattccatgtcccccaccttctagttaatatgaccttggagggtttttggattctttgtgatattttcccccttattcataaaagaggcatattgaatgtgtccatagcgtacgaagactctagaacaaggggtgatgattgtgaaaatgagcttaaagctagagaatgtggcgttgttcttggtacacattaggtactaaaaatgggtgtttctgttattaccttagggattcaagtaggcaggcaagtgacaatcataaccagcatgcagccatcatcagtataagaaacagcgtcttcaacccatttgaagtgccacccaggcacccctgtcatgtcagtttttaaaccatttttatcagtatgcaaggcagcatatggactactgttctgggaccaccttagccttgaactctcttcacgttcactgttgtgaggctttgccttcatagttatcctccctatgttacttttttttttttttttaaagtgactttcaggatcagtgactaaaataaggttctctgtaacagtcataataagcaggtattttttatgcaaaagtggtgtctttcagagtccagaccatgctgcgtgtctttgaaggagaagcctgcatttaaaagccaagccattttgacaatattaattcagttaatttcagcacattatataatgtgtccagtgacctatcaacgctgactggttgggcactccagtaacaaacaccaaagcgagtgatatgtcataacagacaaatgggctctttaaactgtacgacgggaagagtgtttttgttggcatgaatactcatctgtcaaccagcccctgccctgttctgatgatggacaaggcattgggttaacacagaaggacataaaatgaatgatcaggcatggccgttgccttgaaggagtttatgatcaaggtgggataatgaggcataaggacatgaacacatgcaggcacggtgaagaaaaactcatgatggttgtatgtagataagtgtcaaatgaggggtctgggcactaaggatagctattctgccacaagtccttcaatttgggcccaaaggtaatgttaaatttgtggacaggtacacattgttttgagttattgcatcaaaacataatttgccctggtatgtggatgagctagctgacatacatgttttcagggtatcttttccttctcttacgattggcaagaaaaagcttaaaacctctctctcatcaaatactctcccccactcaccgtagcatccctgaataaaccaggtgggtacctggaaattgtagaggcattcccctaaggtgatgtatttgatcatcagagccagagtcgggggacttactcaatttttcacccagagaggaacgtgagaagtgtaccatgcactgtcctttcctgatctcagggcttcctctcaatagctgaacccaaggcttgttgaaatgaaatgaaaaataacagtataacatgcttacataaatttttaaaacatcagcaccataggcaaggttaaaacaaaaaaaaaaagaattttgaccaggtgtcatgtctcacatctgtaatctcagcactttgggaggccgaagcaggcggatcacctgaggtcaggagttggagaccagcctagccaacatggtgaaaccctgtctctactaaaatacaaaaaatcagctgggtgaggtggtgggtgcctgtaatctcagctattcaggaggctgaggcaagagaattgcttgaacccgggaggcagaggttgcagtgagctgagatcgcaccactgcactccagcctgggcaacaaaaacgaaacttcatctcaaaaaataataataataataattttttaaaaattaccataagtagattcgtgaaaccgagtcacctggtaagacagactttcttgaaactcaaaatttcattactacatttaccatgttatctatggcatatcccagcaagtaattaaaagtagtggttcatgacatatagaatttatctagtaatgaaaacttgcactaggagtgtttttaatgctccaaatatcctctttacccaatttgctagtcacgtcctcggactacttaaccattgttcgaggttgggttcacagataatcagaaggcattgggggtaccagatgcttatgagggatccataccagtaaaagaaaggagtagagagcagagttgggcagaggggggggtgagtcagactatgatgtgagcctggaaagcctcagctgacccattggggagctccagaggtgaagagtttatcagtgtctctgtgtgtgtatgtgtgtgtgtgtgtgtgtgtgtttgtcttgggctgaaatggctgggactttacctcctacctctctcagtcattggatgcaagttgccccaggaagggtgtgatccttgagcaaggaggctctctgcagctgacgcaggccctgaaggggctgacagctgtggctgcctgctgacgtcaccccctgcagctgggtacgggtatttgtgagatgcatctccctgtttaccatcatcttactgactccacaaagtgggaagacatctgcattagtctgttttacattgctgtaaaggaatacctgagattgcataatttttaaagaagaaaggtttatttgactcttagttatgtaggttgtacaagcatggcaccagcatttgctcagcttctggtgaggcctcaggaagcttctatttctggtggaaggtgaagggggagcaggagtgtcacatggtgagagaggaggaggtgccaggctctttataaaaatcacataaaggcgtacgtacacctgtgttcattacccagcactattcataatagcaaagacatggaatcaacctgaatgcccatcagcagtagactggattttaaaaatgtggcacatgtacaccatggaatattatgcagccagaaaaagaatgaaatcgtgtcctttgcagcaacatggatggaactggagtccagtattctaagcaaactaacataggaacagaaaagcaaatactgtgttctcacttataaatgcgatctaaacactgagtacacacggacacaaagggacaacagacaccggggcctgcttgaggatggagggtgggaggagggtgaggctcaaaaactacctgttgggtactatgcttattacctgggtgacaaaataatctgtacaccatacccttgcaacatacaatttacctgtataacaaacctgcacatgtacccctgaatctaaaataaaagtttaaaaaattagacctcgtggtaaatcactcattacagcagggacggaaccaagccgttcataagggatctgctctaccatgatccagacacctcccagtagacccacctccaacactggagatcacatttcaacatgagatatggatgggacaaatatccaaattatcggccagccgtggtggctcatgcctgtaaacccagtactttggaaggccgaggcaggcagattacctgaggtaaggagttcaagaccagactggccaacatggtgaaactccatctctactaaaaatacaaaaatctgcctggcgtgctggcatatgcctgtaatcccagctacttgggaggctgaggcaggagaattgcttgagcccgggaggcagaggctacagtgagccaagattgtgccattgcactccagtctgggtgacagagcgagagtccatctcaaaaaaaaaaaacaaaaatccaaattatatcaacattctattccttcccaaaaagttctgctgaagactaaatgaggtcatacttctaagatacccagcccagtgactggtgagaataattgctcaataaaatcctgtacggcagatactgttctctctctggtttttgttttagtctttagattttttaaattatttttttgttatggtaaaatagacataacataaaatgtaccaccttagccattttaaatgtagagttcagtggcattaaatacattcacattgttgtgcgaccatcaccaccatctgtctccagaactttatcttccaaatggaaactttgtacctatgagacattaactccccattctcatgtcctcccagcctctggccaccagcattctgctttctgtccctatggattcgatgttctaggtacgttatctaagtggaatcatatggcccttgtcctttggtatctggcctatctcacttgcctcaaggtttatgttgtagtgtgttattcttatttccttcgtttttaaggctgaataatatttcattgtgagaatatatcatgttttgttttgttatatcatgttttgttcatttctctgttgatagacatttgggttgtttccacctgttggctactgtaaataatgcttctattaattacttattattatttattattattacagagctgttaatttcatttcatagataagaaagtggctgggagtggtagcttacacctgtgatccagcacttagggaggctgaggcaggaggtttgcttgagcccaggggtttgaggccagcctaggcaacatagtgagaccccatctctacagaaaatataaaaaatattagccaggtatcgtggtacatgcctgtagtcctagatgctggggaggctgagatgggaggattgcttgagctcagcagttcaaggcagcctaggcaacatactgtgaccctgcctctaaaataaaaataaaaaaagcctggtgtggtgttgcacacctgtagttctgacttgggaggctgaggtgggaggatcacttgagcctgagaagttgaggctgcagtgagccatagctgagccactgcactccagcctggatgacacagttagacccagtttcaaaagaaaaaaaagaaaagaaaaaagaaagtggctctgagagttcaaggacaagaccagcaactgaatccacatctgtccaacccagattccaagctgctgactgccatctgggtggcttcccctctctgacaaggatagccagcaactctgaaaagcaacttactctgttacacctgaggctacagcagactcctcctatctcatagaaaagaggcctcagcttcccagcctccagcaaagggaattttctaggtcccagtccccctgctttgattttaaccctctctgtgtctctctcctctgacttctacttccttgctctccatctaattccccctcctcctcgagctctttgaagttgagggagtctatactgccaggcactatccttgctcttctaatttcttaattcatttcaccttcctcctagccccatggggcaggcattgttattatcatccccatgttgtgtgtaaggaaatgggtcatgcaggagttaaaaacctgcctaactttcacgcagctagtaagtggcagaactgcaaattgaacagccagtccctgctccacagagatatgcaatgctacctcttgagctaaaacagaaattcagaccccactttgtagacacaatggctcagatttaggagacgaccctgcagccaaacctagacaaacatgaggtggttctgctgtcctgagcttgctgctcaccgtctctgcccacatggctctagctgggctcaggactttcctcttcacagcaggctgaacagcaaacccagaggccattgcagctgcctcggtattctacaccccccttgggtctggaagttgttggaggcaggcataccagactgtttataatatggatgctttctccttcacctagctggagccaagaggggtgggggaagactgagagagacagagacagggagagagagagagcctgcctaactgcctatttatcccaaatccatatattattttggaacattcagtattgcagaaatacatggagggataaatcatttcttctgccatctggtctcggagaaccttcccaagaactgtagcttcgtttaattttgctgcgttcctttcccaccctctttgtgctttccatcatcttttcttggctgtatttttgggtttgttttgcttcagtttcttgctcttttagctgtttctggatttcaatttttaaaaagaaataacggatcgcacttatccaagtcgtgccagattctttatttgggataatgctacctcatggctattttttaactttaatccggaaccttggagtgacgtgtggatttttttttaatgccccaaccagatgcactaagcagcttgatggtcagtaatgaggcagcaccaggaccctgtggtcctagagtttcttggcagtgccttcatggcaaatgtttcagtgagatgagcgtggcagacccagcccagccattgctctatggttccaaagtccttttaaatgaacaaatgggttggcattcatctagtgggactgcaactccagtgaggttactcaaaacatactgggcaaaggtttctcactgtttgagtgggaggttacaagggaagaagtctagagcgatccatggcatgatggatgggggttggcatcagaatgaatcatgtttagcttaattgggacacagatggttaagtatagaaatacctacagacatacatacatccctgggttactgtacacatagatcttcttgttccgtcagtttagaggtcctggaagccacaaccccccagcagcaatgagcatgcctactacccagatctcagtttctaataccattctccaaaaagggaagaagggctccttggagaagcggctgcttttaggactcagctatgaaatatacaagatgagcctgatagcaaatattttacagtgcaagaaagcgctcacaacaacaacaaagccactgtgatagagtatgtcttataaatgagaaataaagagggataaaattataaattagggcctggcatggtggcttaagcctgtaatcccagcaatttgggagcccgaggcaggcagatcacttgagctcaggagtccaagaccatcctggctaacatggcaaaaccctgtctttactaaaaatacaaacattagctgggcatggtggtgcatgtctctagtcccaactactcaggaggctggtgtgggaggagcacttgagcctgggaggtggaggctacagtgagttaagatggtgccactgaactccagcctgggtgaaagagcaagactctgtcttaaaatatatacatatatagatagatataggttagatggacagaattgtggaccacctttcacgcctattaaaacccggatgcttagccccagtggctggctttgtacaggcattgtaatctttgttgtgtcagggtttgtgttgaaaactttttactgctcccgtgaataggtaagccctaaattcctctccttaggttcacaacagcagtggctttcctggtcgcccatgtcccagttttgatgatagggcaacttgaaactaaaagagtgaaaaataaatcacatttacgaggagaaaatggagtcattgcaactcaattattaatgtgcaaaactgttatgcaatgtagcagcccaattaataggtgtctcttggggaataatcaaggcttaatttggcatgataattagtagcctccccttccagctttggatggggggcccctgtaggacagcctgatggctggtaatgaggcaggatcacttactttgcagccgtgttaattgtatctttctgtgcatggggacaaaacagatttacctgtttctggatgctgggatgtgccattgctctaatagagttgtacttgtttcctggtcttgccaacactggcctttctgaagggcaacactgttacacttttgagacgtctttaattggctgagttgttctaatggctacagctgcagtcttttttttttttttttaatagagtgtgtggcagagttccaatcttacaagacatacggccagagctgacatattcttaggaataacagaaaattgtcctgtttagggtatctgtaataataggtgaccagaagtcatctggtgtaggtatctatctcctctatgtgtctcagagaactcctgttttttgcaatattgctagttgtttgtacaagctgtatagtcacttaaaagaaaaccatgaaaaattacaaacgtgtggtatttttactgacaaatgtggaacagcacagagaagaaaatagtatatcatctctaatgatccatcagccgagggataaccactgtcatcattttggtataatctctttccagacttccatgcacacacacatttctccccatatatatttaatccagatgtgatttctatttgcaaaaaggaaattgtaaggtgcatactattttgttaacatgtcgtttgatcataggaacagattttgaaccagatcaataccagcatttcctaaacggtcctcctccaatatttgggagctgctgatctgtgttctgaaagtgaggctgagacagacgcatttcctctcctcctctaggtaacacacaatgaacattcatatttcaaagtctttgtttacatgttaaaaacatcattttagggaaatcatacgttaacagctcctacaattgtcttccttaaactacatgtgggaaaatgctagtgaatatttagatggcttcccatttttgttttttttttttttttgctgttgtaaacatcactgcagtgaacatccttgtacatgcatcttggggcatttctaagatttccttagaatcaaccccaagaaggattgacagtcaatggacatactgaattgaagatgctggatctccttggatgaactgccgtctccagaaaggaagggcatgtacatttacaagcccaggagagtgataggagagtgcccttcctcccagtttctgctccatagcacatttttaattccagattctgcaactttagtagccgtgtaggagaccaaaagagaaagtttattaaattcttatttatgtgttcaatttgcatccgccttctccttccccaagctcaaagcgccacaaagaaaacattaagcttgtaactcttggatgtgctcctctgtgagagagggacttaggggaagattcagggaatggagttgaggaaatagtgcagaggtagaagcaggatgcattgtaaaagaaaacctagacatcaggtagtgctgtggagggtttcaaaaccttagtttcagaagaaaggcccttttccatcgtctttcccctggcttcccttttgaatggtagtagaagaagccacagtgaacagttggcatcttttgtttactacccacagacacctggcttggggagcgggggatgttgggggttatgacttttccccttgtttcttattaagccccctcctttgttgttgagtcctccctaaatggtcactcttatttattatgttgaaagtcattgtgtgggctaggatagtcccaaagcatttttgaacacacacacacacacactcacactcattcacaaaaatcactgtcttcccaactaccttgagaccatcttctgttttcttactttccatcattttttcctaaatcagacaggagttaagttctaaaattataggattttgtacctgtcatttttgtgaaaagtgttcctttctccacatgctgcccaatgagggtcctttaagatattttcatcacgttcctcttgctcttgtgttggacaatttcgcacaaatatgttttttgcccaatgatttaagatgctcttaattgcttttactgaagggaaatagaacaccttttaagccaacagctgagcgatttgctatgacaaatctgccactatgcattcacttaatttccaattaatcaaacattcaataaatcattagtataattacacctgttcccttcttgccctagcccattagctcaactcaggcgtcccttcgactggctgtggggaaggtgttcatttgtctgccctggctgggtgcacattcttactccctgtgagcttgagaaatgatgagtaagaaattgtaattatttcaggcaccagaagtttgcttggttttcctcttctctgcttcccactccattgcgtccccaacagcttaagccaacatcatagtggcctagtagcggtggctggttaatttcagcaagcttttcttttttttttaatcatttttattccctgactgtgcctctttgctaattacaccatctccccaggtgagcaataattccctcatcaccatatatctcaagcacagattattaaaataatacagcttatgtcatataaatgtaacagaaagtatcttaaagatgctttattgaaagctggtaaattggttcaacagatgaatgttttaaggcctgtttttaaaaggttgcacaagtataaacccactgaattactgctgcagtttcacacgagcggatgcaattattttaagcatctaactgtgcagaagacagatctgaaaggcaaggagctaaattctccgagattaattaaagggtttcattttgctcttgatttaaaaataaatttcaagcatgcatcacttgttattctgtggaagaatttgcattatggggtttaaaaaaatactgagaacgttaagtttcatgagttcttcatacaatatagctgacagctcttaaaaagaggggttgacctactgttgcagcagcattttctcctacatacttctttctacttttacatttgtgaagggtattaatcttcaaactcatttccaatgtaagattgtgcatttacatgaatctcccataagattgctcctgattcgatctatgcttattgatttaatttcttttacctctcagagccagtggtgctgaagggtttattgtaattacagtgttgcgggtttcggtggaacagttccctggtaacttaagtgtgggtttgattccctctaaactcgctcagcccaggagatactgcggcaagtatcttggaggcagagagctttcaggccagatcagaacgctggctggtacacaaccggaaggtatggggaggctggagagggaacggccgggggctactggccagatggatcgctgttctaacggggcccttttgaggtgaatcacttggcaattttgtgagttggcagacggcacagccacctgtgctcaatgtgaaatgagatacaggtaacctactgatctgaaatatgctgctcaccctttgagagatgggacagtgttgcaagaggtgatttgccctatttgtggggtattggggagggaaccacagcaaaaataccatgagttttgggactgaggggagtccaaatccaagccgtgtgtctctagaactgtagtttctaatttggtttaacttctcaaaactgaaatgtttgtcacttattttccttaacttctcaaagccaaattgttcctctgtaatagcattgtctagaagaacatgattaaagctgcatatgtacttttagttttttaatgactgcattttttaacagtaaaaataaacaggtgaaattaatgcattttatttaacccaaatatccaaagcatgatcatttcagcgtgtgatcaatataaaagatattttacattctttttttcatcctaattttttggaatttattgtgcgtttcatgctgacagtgcacctccatttaaactagccacattccaagtactcagaacctcaaaaggtgatggttactttatctaaaggtgcaggtctggctgatccgttaccggaatagtaccatttgcaactgaaagaagcctaattcaaatgagctacagcaagggaagaaaaattgtctcaagtatggctgaatccagaaacacacctgctgcagtttggaaattccccacatcaaggccctgcttgccctcgggtggcccattagatggcaggaaaatggcccttggcaaccccaagccttaggtggcccttaagtttgtgacctcaggaaatgagagatcctcttcccctgtaactgtagcaaaaacaaatttggtgaggaaaaggaggaaagggacaggcttcatttgtgccaagtgtctgagaagactccttctagaagacagggaggggatgatgggcaaatccatgaaggctacatgtaacgggagtgcaattccccaaagaagctctactgagcggaaaaatggcacatacccattgcaagtgaaatgatacaatctgccttaaaggttgtggtaaggattgcttaggccaaaactctggagtctttcttgacacttctgtttctcaaatatcatgcgtctaatccctgctgcaggaaatcatgttggctttagaatttatccagaattgtattgactgccaccatggggaccatcatcctgagcaggttctgtcttttcttgcctggattatcgcatcctcctcctaactctgctttcactgttttgtctccacacgcccctccccccatggcttctgtctcactgagaataaaagaaaaagtccttgaaatttttcacaaggtccccacattctggtccctaccaactttgtcatctggtatcttgtcctatctctcctgatatggtttgactctgtgtccccactcaaatctcatcttgaatggtaatccccacgtgtcaagggagggacctggtaggaggtgactgggtcatgctgttcttgtggtagagagtgagttctcacaacatatgatggtttaaaagtgtttggcagttctgccctcactctctgtctctcctgacaccatgtaagacatgccttacttccccttcgccttccaccatgattgtaagtttctcgaggcttccccatccgtgtggaactgtgaatcagttaaacttactttattaagtctcaggtatgtctctgtagcagtatgagaatggaccgatacactcctcactgagcccatcctgtctcaccactctcattctagacttcgttttctttcaagatctttgcattgtctatttcctctacctggagaaaccttccccaggtacccctaggtcttattcctacccaatttgaggtctttactcaaaaaccactgtttcagtgaggtattttatattgaaaattgccttctcctacatttcttgtctcccattcttcctttgtagctgtagcattttgtatagtatacgttttagtgattttgttatctcgctctctttctctgtctcacatatactatatggtaaagtccatcaggaaagatatttctgtgtggtgttacattcctctacctagaacagacttattagagaggcttaacaaatatttattgaatgaatgaatgatggaatgtagaggtgctcaatgaacagtagccatcatcattatttactatcagaggctgtttcagctatggtcagcaaggttaaaactcaaaatggaactctgctatgaacccttaagtgtcaatgccatcagtctacaaggtgttgcaaccttctgtcatctgggtctgccaaatacccatttgcgcatgtgtgcccgagaccacgttgttgaaatgttacgtctgtcctgggcgtgaactagataatctgcctaatgactgggccacagtaataggattttcagagttttactgtgtaccatcctaacctttcctctcatctcccgaggactattttctcccagttttttccatctcagtggatggtattatcatctttccagtgacacagggcatcatcttctgaaactcaacacccaagcttcagtccaatgtcatccatggcaagataatataatttaatcattcctttattcagaaaatgtttattaggtcctatcatggcgtaggcactctgataggcatggcagccaaaatgtctcctaagtatctctgaaaacatacccacttctccccacctcccctcctatcacctggcagctggactataaaatattccacttaccagttgatatggtttggctgtgtccccacccaaatttcatcttgaattgtagctctcatcaccctcatgtgtcatgggagggacccagtgggaggtaattgaatcatgggggtgtttttttttttttttttttttttttcctgtgctgttctcatgatagtgaataactctcatgggatctgatggttttataaagagcagttcccctgcacatgctctcttgcctgccgccatgtaagacctgcctttgctcctcctttgctttccaccatgattgtgaggcctccccagccatgtgaaaccatgagtctattaaacctcctttcctttataaattacccagtctcaggtatttcttacagcagtgtgtgagaatggactaatatgccaatcttttgttccctcccagtcttgcgtatcttccatccatcttctgcctagagccaggataatcttttccttctcacatgcaactctgaccatatcatacctgggtttttgtttgtttgtgtaataataacagtcccccattgctcacaggatagtctcaaagtctcacgggagtcttgatgaccaagttaatgccaacctccacatccccatctctcaccaaattctgtttaagctctaatctccagtctaagatttctcaaccttggtattgggacatttagagctgaataatgctgtgctgtaggggtctgtcctgtgcattgtaggatgttgaggagcatccctggcctctacccactagatgcaagtaaaaccccctccccagttgagacaaccacaaatctctccagatattttcaagtgtccctttgtgggcaaaaataaaaatccttcctttctccattgggaacaacagcttcaaacaaaattgaagttacagttgcccaaacatcccctgtcctcccttgtttttagacatttgcagaacctctcttcctctctctttccacatctacctccttagttatggctggcaactcctgctcacccttcatgtttcagttttgacaccaccttctggaaaagcttttttagacttctcccaggtagtagggtgatggcaagatccttggtaagacttggggactgatagcatgtggagaatttggacaggaagatatcatccttttctcagctgggttctgccagaagcagacctgaggcaataattcacatgaaagtagttgatacggttaggctttgtgtacccacgtaaatctcatcttgaattgtaatacccatgtgtggaggaagagaagtcattggattgtgggggtggtttcccccatgccattcttgtgatagtaagtgaattttcacaagatctaatggttttatgaatggtagtttttcctgcactctcacgctctctctctcacctgccaccatgtaagccatgcctgcctcaacttctgccaagattgtaggtttcctgaggcctctccagccatgcagaactgtgagtcaattaaacctctttcccatataaatgacccagtctcaggcatttcattatagtattgtgaaatcggaccaaaacagtggtttatttgggaggaaacactagtgttcatggtggtggtggtagaaaatggtgcaggggagaaaaggccacctgcagaatttattttgtgaagccactgaccactatatggaagtgaagctttatcccactacgggatccttggaaccaacgtacacacatagcttagtattatcctacccaagggcagggggcctggggtacttatactgcaagtctcattagtcattggtagaggggttctgcttttcctgctgcacaggtaggaaatgtgatttcagcatcaagaagaaatgcaggtattgaagatgaacatattacagccaggtccatgtgcactgatatcataaaggtgtaggtaaattggtggggccctggagtgcctcacgtggtggcttcaaggtgttgcatctacacagctgggacatgggcagtaccgttttctaaacagtgcaatttgttaggaggagaaactggcttatttctttgaaccacctgtgctacatccataagaggctgcgtttgaggttctgtttgggaggcagaaaaaagtctctagaaggcacctggaaataaggaagctaaaagtggagacagattggagctgaagacttaagttgtagaggcaccttgaaggaattgtggttaagcctcgaagatgggtaaggtggtcacaggagttggaggtctaggaaggaggggtaactgcagagaaatccatatttgggattagttttgttccttctcctaaagtctgtgtgcggcagcagggagtggtgaatacagtcaagatttgccacttgggactaagccacagtgtttccaaataaagactttaagaaaccctcctcactcataatgaatttaagggctaaaccttatcagtcacacacacagaacaatgaatctttccctgaggcaatgcaggataaagttttaaagttttttttttttctttttttaaccctgttctgttgaattatcttcaaaactgccttagattctgggaccagggtgcggagggacagatggggtgagtgattttgaatgctgcagctttatcttgctgcattataaatatgtgatgccatttaacatagcaagccatcaggttagtaaacaaatgattgccaagtttataattggcaaggaaggaggttataatctataaggagctttgtgtcccaaccaatttattctctaacggaactttattgcctccatcgctgaaaactcccgaagagtcttaagagctaagaatccagattggctgagctagttttctcttgtggtctcctttctggcctcatctcctatccggataaagatacttggaaaacccatttcttgaagatgaagcagcccacctggcccagaaatgcctggtttgttgtttatgggtggtttttatccagtgaattggcaagaagtgaattatgtggaagaatccattttaaaccctttcagctacacaaaattggaaaataaaatattgtgtttcttgagatcatgaaccaatactgtctgggtttcttagggtatgaagcccctttggggtcaaggctcagcctgctactattacagcctcataccctgcttctctcttcctagtatgatgattaagtcaaggatacgacgcaattgaccaggtgtgcagtgcccaactctgtggggccattaacttcacagcctacataaagaagccacttacggttttgtgagctcacactgctcagttgtacatgatggccctggtgacaatatgtgtttttggaattagattggcctgaggcaaattctacagaaaaatagagggaacttagataggttgctttatttgtaaaatagagggttataatacctttctaataatgttgtttacaaaaatgatgcaagaaattgcttctcttagtatgtatttcccctttgcctggattacttaccacaaagccatcgttgcttttcataaacaacttccgatcccttctgtggggtattttccatgaccttccctcttgctccctcatctttgctgtctctgaatataggtatctaactggaaggctggaagtgccatttcaaagcggtggaatttttttttcttcatttgttgttttattttgctttattgcattttccatatttttggctaaatctgttattacctgcccatttcagcaactaaaatctgtttgctttcttgtttacctgcatagaacttactcttccatcttcttggaatggaacttgtctcagaatctttcaggcgattgcctgagtccttcttacagacaggactaacactccccttggaccccaggtatctgcccatgactcagtcttgttcattcagcattttccattcctctggccttgatgtttggttcaccagtgggcatgtaacccaattctatccagttatacttgtgttgggaagggattttttttttccctggggttgtgaaagtaacaggatataagtttgggacagctgatggccgtgttgacattatgtgagtgtaataaactgaatgtttgtatccttccaaaatccatacatggaaatcctaactcccaatgtgatggtattaggaggtggggtctttggaaggccattatatcactagagtggagccctcacaaatgggattagtgcccttataagaagagacagaagagcttgctttctctcttttctctcaaccatgtgaggatacagtgagaaggctgccatgtgcaaaccaagagttcccttcccacacaccaatctgtcagtggattgatcctgggattcctagactctagaaccgtgagaaataaatgtgtgtttaagatgcacggtctatggtattgtgttacagcaactcgactaaaatggtggggaaagccagtgtgaatgcaaagcaaactgttaaaaaaaaaagatacccatttctgacattatttgagtgtcagacttgcatctaattgagccgcaagccttgaacttatcagctttgtgataaatctccccttttttgtgtataaggtagttcaagatgtattactcaactgtgcatcttcctacagagtcttttctactacagcataagaaacttgagagcagaatggtggatctgcatgacacgttttggcacttgttacgttaaactcaaaaactccaaacttggaggtttagaagcagagatttaacaaccaaaaattgtgcatagtcaacctgatgaattaagatagcctgtgagcctgagatgctgaagtcttttttttttttttacccagaaatacggtgattttttacatgtcacatcctggatcgactctctgtcagctcagcaagtgtcttcagagctgacaagtgataaaccagttgaaagtgccagtcacattgtttggttattgataatgctgctgtaccagggatgtgtcattagtatgtgtttacgggctgcaattctcaacatggacccagcagaaaatattgggtacttcaggcattcttgttatttacccagatggtgtttcgtgggataccccctgcctagagcagatctggatatgtgtctacactggttccaaggatcctatactgggataaagcttcagttccacatagtggtcagtggcttcacaaaataaattctgtaggtggccttctctcccctgcaccattttctaccaccaccaccgtcatcaccaccatcatcactggtgtttcatcccaaataaacaggtgcatttctttgtctaattttagagccagtggctacttcttacccatctggtgggtattttttacagaagacctgatcactgagttccttgcaaagatgtccccatcttttgcttccattgtctcatcagtagaaactcacaacatgaaataataacagcaattaatgtttatatattggtcttttccatatggtaggtatgttggcactattccacgtgctggggttggagtggtgaatggaacagacgtgcccttgtctttagtaaatacactacaacttgtatattttagtgggagagatagatgataaggaagtaactctagctgaaaaatataattacaagttttgaaaagtggtgtaaggaagtccacaaggtaatgcgagtaagagtaattgatgatggtgataggtgttcacggttggacagagtcttgagaacaattagttccaaagtgaaaccacctttaaggaggcagcattttcgtggagacctgacatggtttggatttgtgtccccgcccaaatctcatgttaagttgtaatccccaatattggaggaggagcctggtgggaggcaattcgatcatgggaacggacttcccccttgctgtttttgtgatagtgagtgaggtctcacaagatctggttgttgaaaagtgtgtaccactcactgaaggtaaccatagtaacagcaaaatcccaaatgagttaaactcacaactaggttgactccagtctccgcataaacacactggcagaagagatgtgcatgtttctttctttttttcttatctttttttttgttgttgttgcttgttttttgagacagagtcttgtactgttgcctaggctggagtgcagtggcatgatctcagcttgctgcagcttcaacctccggggctcaaacaatcctcccacctcagcttcccaagtagcttctgggactacaggtgtatttcaacgtgcctggctaaatttttatattttttgtacagatgagactttgccatgttgcccaggctggtcttgaactcctgggctcaagggatttacttgccttgatctcccaaagtggtgggattataggcatgagccatagtgcctggctgagatgtgtacatatttctatgcaaaaatgctattgacttcagtcttcactactttccttcatagtattcaatattaaatagtatttaaatagaaatactaggattcaatattcaacagaaaaaaagaggaaaaaatagcccacttagacaaagcaatcacatcaattaaactcagaaaagaccccagtgttaaaattatcagggaataaatttaaaataactattactaatagtttaaaagttttaaagcatagtttcctcatcttcaaaataacctgtttttttttttttgagacagagtcttgctctgtcacccaggatggggtgcagtggcatgatcttggctcactgttagctccacctcctgggttcatgccattcttctgcctcagcctctggagtagctgggactacaggtgcccatcaccacgcccggctaattttttttttttgtatttttagtagagatggggtttcaccatgttagctaggatggtcttgatctcctgaccttgtgatccacccaccttggcctcccaaagtgatgggattacaggcgtgagccaccgcacttggccaaaatgatggttttttaaagtgccaaattcttctggttattgtgcatattaaatgacataatggagcccgggcatggctgctcacacctgtaatctcagcactttgggaagcctgggcgggcggatcacctgaggtcaggagttcgagaccagcctggccatcatggtgaaaacccatctctactaaaaatacaagaaattagccgggggtgatggcaggcgtctataatcccagctacctgggaggctgaggcaggagaatcgcttgaacctgggaggcagaggttgcagtgagccaagatcatgccactgcactacaccctgggcgacagtgtgagactccatctgaaaagaataaaataaataaataaataaataacaaaatgttagtaaagtgcatgcttagcaaaatatctgacacagggtaaggatttagtaaatgacagtaattgtagtccttatcaccttggatacttaatgaaatactgctgaatgttcaagaaaaaaaaaagtgtgtacttcttcccccttcactctttttctcctgtttctgctacgtaagacatgccagcttcccttttgccttctgccctaattgaaagtttcctcagtcttcctagccatgctacctttacagactgcagaactgtgaaccatgtaaatctctttctttataaattacccactctcaggtagttctttatagcattgcaagaatggactcatacacgacctatgtgttcaagaggagccagccagggataattcaggaaagggtgttacaggcagcaggaacagcaaaggcagaggccctgagctggaaggagcatggtatgatggagaaacagaagtgagaggggtgctgctggagaatagttggggagaaagagacgtgtcgggagaatagttggtgagaaggagacatgtgtcaggaagagctagagagaccagggtggtgggtcagctgggacacacatgaatgattggaaacatgagcttcatttctgagtgtgccaccttttttattcttcaaataggtgataaagtaggtacttctgaaggattaaggatgttgctgaagtgtatcccacaagtgaatatcagaaccatgattcattccctctctttgcacaatccatccattttaccttaacatgatgctaccatgttattaattggttttgaagctccaggtacattaatactgggacagtattaattcctacttaacataaggatcatgagggctaagatgaggtcacgaatatgcagcttttatgctggtggtcaggcatagtctgttcacaataaacagtagaatattgcctcttctgatagctcagtgtttgctttatgtaaccattttaaaaaatgtaattgtggtaaagtacacgtaacataaaacatatcatgttggccgggcacggtggctcactcctataatcccagtactttggaaggccaaggcaggtggatcacctgaggtcaggattttgagaccagtctggccaacatggtaaaaccctgtctgtactaaaactacaaaaattagctgggcatggtggcgggtgcctgtaatcccaactacttgggaggccaaggcaagggaatcacttgaacccgggaggcggaggttacagtgagccgagatcatgccactgcactccagcctgggggacagagcgagactctgtctcaaaaacaacaacaacaaaaccgtgttaaccatttttaagtgtacagttctgtaatgttaaatgcattcatatttttgtataaccaatctgcagaactttttcatcttgtaagatggaagctttatgtttgttaaataacagctccccattctccttaccctccagctcctggcaaccaccattccactttccctctttgtgaattcctattctagctacctcatacatgagtagaatcacacagcgtttgtctttttgtgactgtcttatttaattcattaatgtatttgtttaattaattaattaattaattttttgacccaggcactggccctgcagctgcttccttttgggcgtggaaattcccactcatttcagggatcacgctcacacgcctattgcaggagtattagtaagcaccccccaccagcccacattatccccccaaaataacgagacctcacctggcctctgcatttccacatccctgctcaaagccaaatccattcctgctccctcgccctgtcctaaggttcatctgtattacagcatgtatcaaaatttccttcctatttaaggttaaatggtatttcctcctatgtatctactgatgaacgcttggattgctttcacctttgggctattatgaataatactggtataagcgcggttgcacagatatctctctgggaccctgctttccattcctgtggtacatacccaaaaatggaattaccagatcatgtgatatttctagttttaagttttgaaggaaccactatcctgttttccaagaggctaaaccgttttgcatttccacccacagtgcctaagagtttccacttctccacagcctcgccaacttttgttattttctgtttttgtttgcttgtttgttttggcggtagcctttctaacaggtgtgaggaggttgctctaagtcatcttggtcatgtccttaggaagtatattatttgcagagcagctggaaacatctcattctcttccatccactcctttctgatgaaagcggcatattccattgatggaatatttaccatgtagataaatacttggcattttgccaagtcattttgtatactcagtaccatgtttgtgtgatattaatgagaacctacagacttctttagaataatcaaggggtccttaagtttctgtcttgtgtacttgaaaatatccaactggaaaccatttaaatatggctaaaattctgtgtctctcttgcagttgcacaacccataattaaatgatttgtagaagcagtctgaattaagggccccgttcatcaatactacatgaattatgtaggcatatcttcatttttacattatttatctcagcggccagatgggtacattggctgcaatattcatcagtaagaaatccaaatgtagctttggcacactgacatctgtgcctggtctggccccccgtggggtagagtgaatatttgtggttggggactagggggccctctgcttctaggcaagtcaggagttctgcaagtgatggtatttgacactttatcagtcacctcctaagtagctcccatcagagataagtggaaaggatctgagagctacccaggctttggggaggggatgggcaatgtcccatgagtggtgatgtggacaccagagttttcacaacgtgtttgtcttggttgctgatgctctgtaaaactcagtagtagctaatatttaggaaggcagtgtaatatagtggataaaagtgtgggcattggggtttacattgtggctttcccactaatactgtgagactttgggcaagcagtttcttcgtgtttcttacctggacaatcatttaatataggcacctactgtatcagagtggtcgtgagaattcaccgagcataggcaggttataacattgagtatagcatgcaactgtggattaaaaagataaagacttaaagataccactatggagttatctcaaagatacattattggtgaacacacaaaagggcataatgttatgtattatagttttgatctgggtagaaaaaataatacaattatagattgtgtttgtatgtgcataacatttctggaaggttctaacacaagtcattggtttactttggagaagtggatggcagtaggggatatcttgagtgagccctgttgtatattgtgatctttgttttaattttacgatttgcatatattagtatttttgaggagcaaatagtctgattttgaaaacaaggaatgagttacagaaagctgcatctgtctcgtgaagattttttttttctttgcagttagacaggaacctggtgatgaggctcccctagacttctggagagtcttccagctacgtactcaagatcttagcttactgacctgtatgttctgcacgaggttctcaccattgtttccagctccacaccctggccagatacagagcactcacccagtcatgatccatcaggaaaataggaagttggaagtgggctccaccttggcccattgctgagggcaagtaggattttcacttaaccgtttgggagaagtggatatttgcctctactatggtctgaatatttgtgtaccctgaacatttatatgaaatatttataccccgggtgatagtattaggaggtgatgaggccatggtggcagggacttcatgaatgggattagtgccattataaaagaggctttacagacctccttgccttgttgtcctgatatgaggacggcgagaaggcatcttccattttttttttttttttttgagttggagtttcactcttgtcacccatgctggtgtgcagtggtgcaatctctgctgactgtaacctctgcctcctggcttcaagcagttctcttgcctcagcctccccagttggtgggattacaggtgcactccagcatgcccagcaaatttttatatttttagtagagacaggtttcaccatgttgccaggctggtctcgaactcctgacctcaggtgatccacccacctcgtcctcccaaagtgctgggattaaaggcattagccaccacacctggctgccatcttctgtggacgaggaagcaggccctcaccagacaccaaatctaccaggatcttgatcttggacttcccggcctccagaactataagaaaataaatttctgttatttagaagccacccagtctgtggaattttgttatagcagcccgaatagactaagactgcctcaaagtcaacatttaagagttcagattagaccatatagggtaacttttttttttaattttaatttttattctaagttctggggtacacttgcagaatgtgcaggtttgttacataagtaaatgtgtaccattgtgatttgcttcacctatcaacccatcacctaggtgtgcattagttatttttcctaatgctctgcctcccccaaagccatatagggtaacttcctgaccttgctgtagcatttgtaaactgtcatggcagtagtgggagtgtcttttggcatgcaaatgcattacaaatagtgtataatgagtaatggggacagccaggagtcacttttgttgccctcttggttttggctagctttttttttttttttcttttttttttgagacaaagtcttgctctgtcgcccttgctggagtgcagtggtgcgatctcggctcactgcaagctctgcgtcccgggttcacgccattctcctgcctcagcctcccgagtaactgggactgcaggcacccgccaccatgcccagctaatttttttgtatttttagtagggacagggtttcaccgtgttagccaggatggtctggatctcctgacctcgtgatccacccacctcggcctcccaaagtgctgggattacaggtttgagccaccgcgcccggccggttttggctagctttttaaggcatctttttaccaacgaggtctttgtgacctgtacctggtgccgaccatctgtcacatcctgtgactcacaatccccaacctaccgtgaatgcagcccagtgggtctcagccttaggggatgaaccctcagttttgggaattgcccacccctttcctggaaaactcacaaataatccaccccctgtttagcatataatcaagagataatcataaaaatatccaaccatcagctcttggggctgctatgcctatggagtagtcattctttattccttttaatttcttaatacatttgcttttacttaaaaagaagagttcagattagttcttctaaaactctatattcagggtagatttccatctgttttctttttctataaatgaaccaaaaatgttgaaaattctatcattttaagccattttctggcgccgtgtgtgctcttcaagcattgggttgtgcaatactgtttgcctttttccagcagtgtttctcatttgatttatcagagatgatacttggtaattcagtttgatattgtcccctgtatctgatgataaacacttgagggaaaccaggaaatctattttttatgttaaataataacactggccctttcattatcctttcagcattgcaaatcaccctttctgtctcggcaaagagagaggaattaagatttgttccgtgttgactcctacgtgattatgttattcagtgttaaatatgagagaactttgttacacagagccaggagggggcagtaaatttccttttttactgttattaaaaatggatcctgcgtttcatgcatagcaagatctcacccgtttgctctagaataccactaattcctaccccctaccccagcaagggaaatttttgaattcattgtgactctggttttatgtaacatttccattaggttttaagtagtgtgctttcaaattactacctgtaaagaggcaaaagcaaatttttgcatttgtaaaaaaataataaataaaaataaaacgctattttttctttttttttttttaactttgcaaaggagataaaatcacgacttgtcttaagatctgctttagctcttcccgttcccaagtaggtgaaggtggaactatcactagataaactgaaatcaaagtacagtgcctggacatgttcaggttcttgtgaacaatgagagaaggcaaggatgcctttaatgtacatagctgctttcctggtcatattctatcagttcagcaaacactatgatttcaaacaggtgtgcatgcccagagaactagcttgctgatcagcgtctggactggacccctgggcttgcctgtgcgttttctcttccttctgctgtggctgctgcttcctaaaacttgtgtctttgaatatcattaacttacgtaattgctatgttccctaccagggtacctaatatatctggctagttttaaggaacaccaagttctctctgtgggatgatttgggggtggcttgggaattattattggctgtgctataaatggctgaggagggaaataaaggacactttcaggacacaattaacactttctaatggcacagcctatgtgctacccagagactgggaggcagtgcagacccagagaaataatgacatacgatgagagcgcctcatgaccttcaggtatttggactgaacacacacacacacagacacagagagagacacacaaaacacacacagacacacataaatatatgtgtgtgtgtgtatatataaaacatgtatatatttgccttcaaaagtcgcaattccatagaaagaagaggtgagactcactatcctgcaattctgacaatccctcaacctgcagactggacatttctggtgacttctaaaaggtaataataggttaatgtaaaattaattgcgttttttgccatttctttcagtagaaaaaaaaacgcaattgcttttgcaccaacctaatagaaactatctaaagaatattttcttaagtatccaggttctcattagtcttcattttacaattgttcctggtttttttttctttttttccttcatattcccccgctgcttccacctacaccagatgaagcacagggcaaaaactggattatacgcaaattgtacactgatttattagcgtgagccaggagtttaatgaggggagagggaaccgtacaaacagctcttggggcctatgcttgagtggagttgtgccgccatactaggtttcagtatgaatttgggatagggtcttctaccccctccttccttaaggtagaaatgaggaatgtgtctacttacaaatgtccctggtacacctatcaaatgggctcacacgtgtgagtctctccatgaagtaccctgctgagttcagtagcatccgtccagtatttgttttgtcaggcatttgaggtctttaatgttttccaggacatttgactttgtttctctgttcctcctcgggcatgttagtggcattaacttacagtccagtatttacctgattccattttgaaatcatacagcctgttttggaaggctagttctactacgtacgcacagagatgaagggaagaaaattattttggtctctttaaattccctatctgtaaattgaagaaattgtagtatttccatcctcacaggtttgttttgagatctaagtaacataatgcagtcaggattttagcatagagctagccaccaagtgaacttcaataaatggttaatattttatcattagttttgacttttgttttcatatccattcattatgctttttggaaaattacttcaagcagtgtcacttcttacggtcattgtatcaccttaagtgaagcttctgcaggactgctatattgtggtatttatgcctttaagcagttttcagcttggggaaatacaaggttgcagtttacttatcaaatagtgaaaaacgtaacttgagcaaatttctctcctgtataaacagttaaatcccaatgtcttgtcgttgtttcttcttctagaagaggttattccttgagcccagttgtattttgtatgtttcataaccttggaaattgttcatctctatgaagtaatcccttttattacataatataaagggaagataaagtttttaattctcaacgcatctgaagtggtgacatgtagcaaacagctcattatcccccacaaaaagcacaattactcaatatagggaagcagtgctttcagaagctgcctcatattggagctgccccacgctggctaatgttggatattgattctgaataattcaaatagcaataaaattgggttttcatgacagtcaatcagaggcattttatatttaatgctcaatagaagaaacacggtgtctccttaccttctgaatttcaaagccattaaactaattgtaggtcattatgtgaaatttatctgcataattggaatagttgatctaattcatgtagcattcaaaacagtggccagagaagaactgatgaatttttagataatgatatatatatagtacatgtatacatatgcatacatacgcacacgtatatttgtatacatacacacacttttagtcaaagtagtgtcactttaccagcattcatttttgttaatacagtcaacaaatcatacggggataactttaaataattcatttgatcctgtttctcacatattcccagtggcctcagaagtgaatagcttctgttgaaatggagatactaaactaaggagttttgttctttatatgattttgctgatattttcttcttagttttcatctgtctttccaaaatagacttacctgggagatatatatgattatatgtatataattggggtcaccagaccccagggattctgatttaatttacttgagattgggacctgacgatcaagatttgtttagaagctcctcagttgattctactgtatagcatagagtgagaatcaaggtaaatctaattcagtcattcactcactcattaataaaatagtttatcaagtaccttttatcttctgcagtcttacaggcgttctgacggctaaaaggtgaggaagatagtattgtaggagccttcccagcaatccattaaaatgttttaaagtgccagtttagacatagaaacaaagaagatgtttatatacagctgcctggaaagcctaatacttctgtctctgggaatattatcaaaaccctagagggaaatgggcttctaaagggttcttggctgtgtgtagaaagtacctcattctcttctaactttagacttgcaacccttaatatatgacctcagattagtttgttggaaggtagagtgacatatgaaagcagaattccaccttacttgggagttgggtcttaaagtcacactctgtgttcacttaagttgagtttgtttctagcatgtgcaaagcagagatatttctcctggtaaatgctgaagtatcgtgggacaaatggagtttggaagaaagctgcttagaaacgagaatggcccaggagatacaacatgtaaaacttgtacaggatgcccgactccgagaagagataatggctgatcaaaaactcagatcctgatgccaacaaatgactatacttgttgaatatttttgtctaggaagtaatttggagagcttggaaataatcatggagataatcttgatgttctttatatattcccaggctgcctgttagaaagacatctctccaccttggcaattcctgcttcctttgacttaagtatttgcttccctaaaagaagccttaaataattataactctttacccataaggagaagaggaggggacataggaacaaagcctgagcaaatatatatggttcatatagggagatggtagaaccgtacaccagtgtacggccctaaggatgggggtagcaatggtgagaatcccttgaatctcattcttgcccaatttagaataagaaatacattatatagtaagcagtaagcatgtggaatctctctctctctgtctctatcatctgtgcatctgtcatctctctatctcatctatatctaatctatcaatttatcaaattatctaatctatccatctatctaattacctaactgtctaatctatctatccatctatctacctgtctacctaatctgtctatcaatctatgtatctatgcatctatgtatctgcctatctacagtcctgaaaaagggattggattcagagatgatagtgatatcattgtttaatgtgaagactggtcattttgtggaaaatcttcaatcatggtgaaataacacctcttagatgaaatgccactgtccaaacgatttttaaggtcactgctaggggcaaacagacaaaaccgattatttagtgggttaggaattctagagttggaagatggcttagatttcatttactaggagtttctcatatgtggctgaggagcagagccgcaaggggactgtactaaagattcccagaccccaccctgcttccttgaattagaattaccaaatatggggtggggagatttctatctttgacaggttccccagctagctccacaatgatcaagaaacagcagtgaggaaacactgcttttgttagtatcattgatgtcagagatcacaaaagagaggttatgtttgcaacccagatcagaagccagattataaattcctacctcaggaatatcctttacctttggaaaactggttatattcctcccttggaaagcctgaattagaagatgaatacagagggactgctgaggacagctagaattatctaagatgcaaaaatacagggaagatacatatcagatcctagaggaactaaatccagatactgaaggctaatgggaaatggtaagatgaggtgggaagtagagttctgcacaactaaaaaggacacaaaaatattgccagaagcacaggcagatactgaccatatatcattgtggatcgttgatgtctagggcacgactatactttagaaacaggggatcagtgacctcacatctcatcttttgtagcatactgctactctctgtccttcatcctgtgggtttgccatctttttgtgctcttgcagaattctagctgcgagtatctgtgtctcagttcttgagagtatttctcaggattatgggaagttgctttgcccatgcacaataggagaccagaattgtgaggcaattaatactccagggaatagcccttaactaatggctcttgggagctggagtgtaaacaccccagctccctcactccatgggtaggataatgctgaggcacacgttttgaaagttttcccacatgactaggctcattgtatatctggcttcttagtccatcctttattacaggatgcttttttcttccctgtgctaatttctccatttctcccttccccactgctgtttcctaccttccaaaatgaacaacgttttctaaaatccttggctcattgtctgcctctaggggaatccaaacaaacaaagtatctgggtcttcctatgttttcttgcacagccagttaaaatctgacatctaggagtaatgtatgaaattagctgagcctactaaaaccaaatttgaatcaaaagggaagattttttttaaaggatctaggtaaattctgggaactgtattggaatgacttaagctatggcttgagatctatccctcttttaacctttccttcatttctctttcagtcttccctttgcatctgattcttctgcatagtttctggtctctttcccctatacatctgatccctccatctttccaaagattgactttccctgcttactcacagttgctgcttctctgcagcctcagctggcatgtaactggattacagtggtgttagatgtggccaagaatccacagtgaaattccagctccagaattcaccgtctcggccccaggctcctgttcagattctcacgagagagtgagtctctgacagatgcagcattccttgctgggaatcagcttccccaaggcaggtgacctctctggcccaagcacctgcactgcacctgcactggggagtttattgaggatggtgaggtcacctgattcattgagtatctcttccagggggatgggcttaggatcgtaatctagaaaacatttagtgtagcaggcaattgcttttcatcctgaataggcagactttccaccacgattaatgcacgtagtaggtctgcaaggcagggaccctctgtgttaatgtaaggacagtgacattggagagaagagcaaggtgaatgcttagcatttacatagtatgttgacgtcctctgttgcctaaagcacataagcctgatttatgccatgggagaactagcacattctgccagtgcctctgtacatgctgcacacctacatttttgaagagtaaataatgaggtggagtttttttgttcatgtttttgttttaccttggacagccattatgtaaacttttcacaacaaatttgcatctgaaagtttgttgatccttgtgttatatttcatgacaaatgatgaaaatgctaatttctgaataaagtaagagctacttttacacatttatttgcagaaggaattataatttctttattggcattttttaaaggttaggtacatagtctttttaaaaattaacttattaagagacgtcaacatctagggctccctcttacataaaaagatgctgaaaacagaaatatatgaatataagcactgttgaatgcaaatatcaaaatgtgaataatgagaacagccaacccctcatctcccataggtcattagaaagtgcttcttcactatttatttattagcaggtgccagagccctggcaaactcccttttttgaaatttggccttcagtgtgatagaaacaaatatgacttgggatgatagaaacagaaatatgacttgggcatatatgtagtccttccatccttccataatccagatatgctgaactgatctgtacacccatgtgtcagagcaaagcctgtgcctgtcagctgaacccactcagtcctacagccttcctgaaaattaaattaaaaaaggttttttggtggcttttataagggcaatagcagaatttgctaggtcaagctagtcaacatttttataatgaaccatttaataattaatatgtagcaaatataaataatggttgtagcctgcagtagttaaaaacctgagatccttacaggaagtagccaggggtggtggtgtgcacctgtagtcccagctactcaggaggctgagatgggcaggtcgcatgagcccagaaggttgaggctgcagtgaactgagatcacaccactgcactccagcccgggcgaaagagcgagaccctgccttaaaaaaaaattctgacctctgaaatctgacaaagctgggttctactaccatctctgtgacttgctgctggaaagcaggagctcactccagagctgacgttcacccagaacgcagggccagtgttggttctgattgtcagcgctatgctgtacagggtttcagttcttagatagtctgaatagcatcgttgtctatctttaagggttgccataaagacaaagtttataggacacagtgttcagtccctgccacatcattacagtttaacacgtgcttatgtttcttgccatggtcattttagagaacttataccccactgcctgggtatgaaattccagtcttattaccagaattgcacagggatccgccagaattatacagggttcaacaggtttatttgacgttttttgtgcttttgatttcagcccacatccgtgcagctctgcaattgtatgatgtctgacccctctgtccaactcccattgaatatctatgaatgccctttgttaagcagtgtgcatgcgagggctggtatagagatatttgctttgttcagaaggcaaaaagactatcctctgggctcagttttgaattcacaagattgctaatcattgatcgtaacagctctaatttactgaacactgacaattatgtagccatttcctttacgtggattatctcatttaatcctcatgataaaggtcatggtattgcctcattacagatgaggacatgggtccaggaagttaaaccacttacttgaattctcccaaagtacaaatggcccaactaggagttcagtccatgtaattaagactgtgctcttaactactctcctaaactcagtgggactaggtctctattcctcagacattcttttctttgtgatagtttctcctctcattctacacatattttatcttatttgtgagggaagagtcagaaagcagcactagacttcagttcctctctcctttcttttcctccttttacccctatccaatcaggacaatataagttgtacttaagatttgtggaaaatattttttacgaaatctagatgcataaagcaaaacaggtgcagcaatgaaaagatgagtcattttcaatagttcttgacgcctagtaaaggttatcagaatgtattaggttgtgttgcctcgcttgagcccaggagtttaagactggcatgggcaacacagtgagactgtgtttctataatttttttttaaagtagcctgttgtggtagcacagtgtatgtctgtgttctcagctacttggaagactgaggtggagggatcacttgagccagggaagtcaaggcttcagcgagccatgattaaacaactgtatacactccagcctgggcagcagagtgagaccctgtctcaacaaaaacaacaacaacatcaacaacaacaacatcaacaacgaaaaccaaactggtggcttattgctagatgcacatgatttaatagaaagggtatggtttgggagttaagtacacttgcctcctacccaactcagccactcaccagtgggttcatgttggtggaattacttaaactctaaacctggttacttagtgccgtcagctagggagcttgtacctactattcagggctttacttttaaggattggaaaattgtaaataggtaaatggatagatatttttctgtcttagtctctgcagtgcctgtcggagactaaatcttcagagtatacatatttcaacagttatttatttggagacgtttgagtggcagctactgttgtgtcttttaactatttctcgtccccatggatgtgacttgtatttgcttatgtcccattgcatggctaaaataacttgaaacagaagttgtgtaacattggatcgatcacaaaatgtttgggtaacaatgctgagactctctcagatccctagggttgcatttcccctagaaactgaatttggttatgaaaagccccagtgcaggagtctaccatgatagttcccaagtggcatgggtggtgatctgtggttcctctccccctgtgaagaacacagacatgaggaaatgaatccttgaggcggagcattggttacataattcacaggccctccttctgagacctctggaaataagcagatggttgaagaatgagggagtttttgtcgccattttttttttgccttttgctttaatttttggaataaataaggtttgcttccctactgggcctgctcaagggtaattaacttcttctttttgaaagggatttagaattttcagcatggttaccccaatatttttctgatctatccagtattacacaatttttgttcaaattattttagccatccaaggagacataaatacaatttatgtccatgttgttaccatggaaaaccagtttattttattttattaattttttaaattttatttttccataagttattggggtacagttggtatttgcatacacgagtaagttctttagtggtgatttgtgagattttggtgcacccatcactgcatcatattgtcttttatccctcacccctctactcttccccccaagtccccaaagtccattgtatcattcttatgcctttgcattctcatagcttagctcccacatatcagtgagaaaatatcatgtttggttttccattcctgagttacatcacttagagtaatagtctctaatctcatccatgtcattgcaaatgctgttaattcattcgtttttatggctaagtagtattgcatcatatatatacatacctcaatttctttattcactcattgagtaatgggcatttggattggttccacgattttgcagttgtgaattgtgccactataaacatgcatgtgcaagtatctttttcaaataatgacatcttttcatctgggtagatacccagtagtgggattgctggatcaaatggtagttctacttttagttccttaatgaatctccacactgggaaaaccagtttagaaggacaggttgtgatttgtagcaggtggtggttctgaccatgtatggaatgctgtattcatacatctgaattccagatgtggataccctggaaagtgggatacctagagtctgaagcaattgatttggagcctaggtatagacttagcagggaggagtgctgtgatggattggtgatgtctgctgtgaagttagcatcgggaagcgacagcctgtgtgccctgtattcgccacttatccctgacacgggaaccgtctgaaaagaggagcctcatttaagcagtattcagtgaacatctaccatgtgtcagatacttcagtgggcagtgaaaaatcagttctgagtaagatagtccctgccttcattgggtttacaatagaggaaacaacagaggcaaagctgtaaagaatattggcaagaatggtagatatttggctataggtcaagcaaaaaataactcaatgtaatttaaataaagggttatgatatttttgcatttccccgtatttcttctgacaaaagttcacttgtgattatccctacccttatatgttatttatagatttcttgtttagaagtataaaaatgcatcagttttatctgttgtttaattatcaggtaaagactagaagaaatattgggccttcatgtaagtgtgcatcacagtattaaaatagaattcaaatatttgaaagttaaaaagaacagacatgttactccttgtccagttcagatggccaaaacagctactacgtggtggctatgaactttctggaagtcattgctgctcaacatcagttttaaatctggactctgcttctaggatgtgttttctcgcccgaggctcatttgatgtgagggcttagcaaataaatacagttgggaagagtgaagagtgttaatcaggttcaatataggctaggctttttcctcaaaatgtcccagagccttaggttggatgaatgtctaggtacacaaatgatatatgggatttaaataatagtccatttattaataagaggaaaggtatcttatatcaagattgtttatatttcatttagttaactccttttatttgggacattgcagacttttcctaaacaaaatgtactataatattttcgagatgggggaagccatgaagcctaagttacatttaaaaatttgttaaataagataatgagtaaacattcccagcacaatgcttgagccagagaaaagtgctaaataaattctaactattgccactgggaataataatgtgtgtctgcaacagaaaacaaaaacacaaaggacttgtctcttttttttttgcggtaattcttaaaaaaaaaaaaaagtcaggcattttcctcttgtcaagatggtgtaatagggaccagatgtaacctctcatcttaaatgactgtatgatgatcaaaacacatggaacaatggtttgcataacactgtacatcaaatagtaatggacagcaatccttgacaggagcaaaggatgtgagtcctttgattgccccagcttactgctttaagagtttccataaggagaggaggggaactgagatgaagcctggagtactccctgtattgaggaagtggaactgagggtccggggagcaaggcacctgtcattctgagtatagagcatcagagtggagagtaggagcccaggagagtatttataggaattctgaatgtgtatgtatcgaataaaagagctgtaaaatctgtgaagcaaaaacatgtagaacataaaaaaacagatatatgaacccacagttataattgtaaacctcaacatccatctcgcaacaatttatagaatgactgtataggacataaggaaggatagagaagaactcaccaccatcaaccaacaagatgtcattgacaattacagaaccctttaccccaaaagagcagaatacacattcttttaaggagcccatagagcatataccttgagagaccatgtcctaggccataaaatagacatcagcaaatgtaaagacagtgaaatcttggggtgtggtctctgacaacagtagaatcaaactagaaattaattcataaagagaacaggaaaaaatcccaaacacttggaagctaaacagtaaacttctcagtaatccatgagttgaaaatgaagtctcataatacattttaaaaatgacattgaacttaatgaaaataaacatacagtgtatcaaaatgtgtgtgtcgcagccaaagcagtcattagagggaaatgtatacccctaaatgctttcaatttaaaaatgacaattctaaaatcaataatgtaagctcctacttcagacaaaaatagggaaagaagagctaaataaacctaaagcaagcagcagagaggaaataataaaaattggagcaaaagtcaatgaaattgaaaacagaaaaacaagagagaaatgctagttctttaaaaatatagaagaaaatggcaaacttctagtagggatgatagaaaaaaaaaaagaagggaataattacccatatcaggagagaaggtgagaatattactatagaccctgcagacattaaaaggataataagagagtactctgaacagctctgcacttactcatttgagagcttaaaccaattctcttgaaaagcacaaactgcaattcacccaatatgcaatagataatttgaatgaccctataactattaaggaaattgaattcataatttaacatcccccctccccccaccccaagggaatctccggtctaaatggtttcactggagaattctacccatatttttaaaacatttaacaccaattcttcaaaatatcttctagaaaatagaaggtgggccaggtggggtggctcatgcctgtaatcccagcactttgggaggccgaggtgggtggatcacatgaggtcacgagttcgagaccagcttggccaacatggtgaaaccccatctctactaaaaatacaaaaattagctgggcgtggtggcaggtgcctgtagtctcggctcctcgggaggctgaggcaggagaattgcttgaacctgggaggcagaggttgcagtgagccaagattgcaccacttcactccagcctgggtgacagagcaagactctgtcttaagaataaaacgtggtggtccacattccactttattttatgaagccattacactctggtcacaaaactggacaaagaaagtaacaaaagaaacaagaaaactgcaaatcaatatccctgataaatatagaattaacactatttaaaacattttcaaatagaatctaacaatatataaaaagacttatgcaccccaacctaatgaggaatagtccagtaatacaatactaattcagtatttgaaaatcaattgatgttattcactataccgataggttcaagaagaaaaatcacatgctcacattagctgatgcaggaaaacatttgacaaaattgatacacaaccagaagtctcagaaaaaaataagaatcgataacagttttcttaactcgataaaggatatgtgcaaaaaacctacatctaatattgtgtataatggtacaaatgaatgatttccccttaaatacaggaacaagacaccactgctattcaacatagtagggaatttctaaacagtgcaataagacaagaaatataaataaaaggcatacagattaaaataaagaaataaaactatccttattagtggattccatggttatagagtaaacaccaaaaatttaaaacccacacacattttgtggactgacaagttagctcaccaaagtcacaggatatgaaatcacattgccaaaaacagtttctaaatttcttacagtaaacagataaaagcaacttaaaatacaatacaattttaatcacccagaaaaaagggaaatatttaggtgtgcatctaacaggacttgtatgctgaaaattatcaaatgctgatgaaaaaggccaacatgtaaatagatggaaaagcacagtgtgttcatggattgaaagactccactttgtaaagatgccatttctgctcaaattgatacacagaggtaatgcaatcatttcaaaatatcagcagagtttttaaaaataaatatagacaagattatctcaaaatttgaatagaaaagcaaagaaactagagttgttaacacaattttgaaaaataagaatcaggtgggacaaaccagtctacctagtttcaagacgttatgtaactccagtcatcatcgctatgtggtatttgcttagatgtagacacctaaatcaatggaagggaagagaagacactgaaatagccccagacaacattgaccagctgatttttgccagtaatgcaaaagcaatttaatgggggaagtataatctttacaacaatggtgctggaacaattggctatttataggcaaaataataataataaataataaatcttgacctaaacttcacatctcataaaaattagctcaaaatggatcgtaggttaaattgaaaacataaaactataaaactttcaggcaatcctataggaaaaatatctttcgaacttagagctcggtgacatgccaccaagggtctataaaagaaaaaaatgataaattagacttcatcaaaatttggctggacggggtggctcatgcctgtaataccagcactttgggaggctgatagcaggtggataacctgaggtcaggagttcgagaccagcctggctaacatggcgaaaccctgtctgtattaaaagtacaaattttagccaggctaactttggtggtgcgcacctgtaatcccagctacttgggaggctgaggtaggagaatcgcttgaactgcggaggtggaggttgcggtgagccgagatcatgccactgcactccagcctgggcgacagagccagactcagtctcaaaaaaaaaaaaaaaattaaggatgtggtctctgaacaatcctgttaagatattggaaagaaaagctataatgtggaagaaaatacttgcaaatttcatatctaataaagaattaatatctataaatttatgaagaagtgaaatggtggttaccagaaactggaagggtaaagggttagagaaatgtttgtcaaagcatacaaagttttagttagataggaggaataagctcaatagatcaattgtacaacatagtgatagactgtagttaataattctgtattatattcttgaaaatcattaacagagtagatttcaaatgttttcaccacaaaaattataagtgtgtgtggttctgcatatgttcattaacttgagttagccattctacagtgtatacatttttcaaaacatcatgttgtacgtgataaatatatacagttattattgtcaattttaaaatgtcaaagagtgaaaaccaatccatttagaaaatctttttaaagtgacttgaagaaatattttaccaaagaggatatatggaggcaatcaagaacatggaaagaattcggcattactagctattagggaaatgcagattaagaatataataacatatcattatacacatgttaaacaggtaaaatttaagatagaaactatcaaatatttacaaggacgcatagaaagtgtgtctctcatatactgatgatggcaatgcaaaatgacacaactcttctggcaaattgtttgtagtttcttaaaataaatagacatttaccaatgagtcaacaatcacatttctggacatttattccacagaaatgaaagttaatgtccacgaaaaaccccagaaagctatacacaattattgtcagcagttttatttctgagtcaaaaactggaaacaaccaaaatatctacagtaggtgaatggttaaagaaactgtgagatacccgtactgtgaactactattcagcaataaaaactgaatgaactatcgatatacacaacacctgtgatgaatctcaagggcacaatgttgaatgaaaattaaaacagtctcaaaaggttatagactatacaatgtcatttatataacactttgaccatgagagaagtataaagatttggacatagttgccagtatggtgggagaaaaaaagatgggtagaactataaaggtacagcatgaaggagaaatctgtggtgaattagttctgtattgtattgtggtggtagttacagaaatctatacgtgtaataaaaggggttaaacttatacaaacacactttatcaatgtcaatatcatatagtacaatatgatattatagttgcataagatgtaacaaatgggttaccaatgtcactagcaggatagggaaacaatacttctctgtagtgtctttacaactgtctgtgtatttgtaatattttcaaaataagttataaagatttgccttttatagtgttactgtaaacccttaagttcccactaaaaagatgaaatgtagagttatagctaataagccagcaaaggaaatagaataataaaaattttcaattattgtgaaacaagacacaaaaaagaggaaaagggaaagttgggacaaatgaaaaaccaataggttataggtttaaacctaattctgtcaatcacattaaatattaatgttctaaatatactcagttcaaaggcagagattgtcagacttaataaaaataagatcaaattataggctgtgttataagaagcacattttaaatataaagacacaaatatgttgataaggatgaatggtagtgcacacctgtagtcccagcactttgggaggccaaggcaggaggatgccttgagcccaggagtttgagaccaacctgagcaacatgacaagaccccaactgtacaaaaaatttaaaaattgaagtgagcatggtggtgcatgtctgtagtcccagctacgtgggaggctgaggtgtcagtatcacttgagcctgggaggctgaggctgcactgggctgtcatcacaccactgtattccagcctgcactccactgcactcagggcaaagcaacaccctgtctcaaaaggaaagaaggaagaaaaataaataaataaataaatgttcattattttttctcatgtgttttgactatttaaaaaatcatgttcatttatttctgattatttgtaacacattttcctatacattaattaaggatattaaccattcatctatgatatatacagtaaatgattttccagtttttcatttgtggtttaattttgtcaatgttatcttttcaatatataaagcaagtggtgtgttcgcatgtttaaataaagtgtatttctttcctttaaaaagtaataaagatacagaatgtgatcactaatctaaagaatactgaagtaactatactgatatcacacaaatagattctagagaaaaatacatcagggataaagaaggtaatttcacaatggaaaaggtgacttaatcaagaagacattaaatatttatgcacctcaactttaaaatacatgaaacaaaactgttggaactggaaggagaaatagccaaatatttcagtgctagtctctcaataactgacagaataaatagctagaaaattattaaatatatagatttgaatagtagtattaattaatttgccttaattaatgactgtagaaccctctatcctaaaatagcaggatacatattgttttcaagtacataaggaaatgttttcaagaaaagagctattctgggctgaactattttttttaatcaataaatttaagagaattgaagttatttctccaatcgcagtggaatcaaactagaaataaatgacagaaatataaaatgaaaatctccaaacacttggagaataagccacactttaataaataacctgtggatcgaagagaaaatctaaatggaagtcaaaataaacagtgacctgaacaaaaatatacataagacatatcagattttgcgtagtgttattaaacaatgcttgaagagaaattcatagcattaaatacccatattaggatagtgaaaaatggtcttaaatcacttactttatcttctgccttagaaaaatagaaaaagaaggtgaactaaattaagtagaagataggaaataaagatcagggttgaaatcaataaaacaggtagtaggccaaaaatggaggaaatctttgaaaccaaaagctggtgttttgagaaaattagtaaaatcaatacacttttagccaggcttagtaaagttaaggagaagatacaaattaccaatatcagtatagaaagaggaggcatcactacagactctataggtattaaaagaaaaataagatcatattatgaacaaccttattttatgatattaagatttaagggtgaaatgggtaaattccttgaaagagatctaagaaagctcactaaagaagaaatagatcatctgaatttcctgatatatatcaaataaattaaatctggagttgaaaatcttccctctaagaaaattccaagcccagatgactttgttaataaactttacaaaacatttctttcagaaaatggaaaaggaagttacatttcccaatccattctatgaggcaacgattactgtaataccaaaaccaggaaaaaattcacaagaaaaaacccccgaaaccacagactagtcttcctcatgaatacctatgtgaaaattctaaaacaacaagcaaatgaaatctattgacacatgaaaaggatactatatcaagaatgagcagattttgttttaggattgaaaagatgccttaacatttgaaaatcaatttatgaaatacaccatattaacaacaaaatgtgaactaacacaattattttaatagatgcagaaaaggcatttgacaaaatccaaaatggattctagttttttaaaaagctcagcaagaatagaagataaattggtcaatatgataaaaggcatctatggaaaatgtatagctaatatcatgcttaatgaggaaatactggtgttgcccccaagattgggaacaaagcaaggatttatgctttcaccacttccctttcgcagtattttagccagtgataatgagcaagaaaaggaggtaaaaggcatctgtttagagaagaaaaaaactgtctttattcataggcagcgtgatcatctgtgcataaaattttatgctctctaaaacagaaagtcactggaacttagaaatgaatttatcaagttgcaggatgcagtatcaatatatgtaattcaattatatttttatatattacacaaattggaaattaaagcttaaaaatatcatttgcaatagcattttgaacagtgaaatacttagaggaacaaatctgatggaagatatgccagtcctatacccttaaaactacagaatagctgagaggagttgaaagagacttaaatatgtgagcatacaggccaatatcgtgtgtaggttgagagacttatcttagtctcccctaattgatctgtagattcaacacaatgccaatcaaaccccagcaggcctttttttcaataaaaactcccaaacatattctaaaattcatatagaagtggaagtcaacttgaatggccaaaatatctttgaaaaaaacaatttgggaagatgaatactgtatgatttgcagacttaatggaaagctacaataatcaagaaagtggtgcgctgggcatggtggctcacacctgtaatctcagcactatgggaagactagacagttggatcacttgagcccaggtgttcaagaccagtctatgcaacatggcaaagcctcatctcaacaaaaaatacaaaaaattgccgggcatgatggcacatgtctgcagtccctagctacctgggaggctgaactggggggatcacctgaacctgggaagttgaggctgcagtgacctgtgattgtgccactgcacttcagcctgagtgacgagtgagacacaggtgtcagggaaaaaaaaaaagtgttgtcttattaatccttaactattattaattaattgaaagtttacatagggcagaaaagtgaaatattgatacatataatcaatacttatatatttataagccaaagtttgctagtgatcccaagtctgttataggaatgtgagattttattaagcataacaactcaaatgttgatgtccagttcatagaaactccatctcctagcagtcttctcagtattttgggagacttcagcaggtgtctcacttgggctcaaactaaaatctcatctctcctgtggagctatactactgtgcagatatcccctcaccacagattattgaggtgttagcctacagaagtcctagcagacctctgcagaacccctcacggtaccatagcaggtccctataccatgccaaatgggagatccttaaattatcttactggtcggccaggcgcagtggctcacgcctataatcccaacactttgggagactgagacggtcagatcacaaggtcaggagttcgagaccagcctgactcacatggtgaaaaccccgtctctactaaaaatatacaaattagcctggcatggtggtgtgtttgaaatcccagctactcaagaggctgaggcaggacaattgcttgaacctaggaggtagagattgtagtgagccaagatggccccattgccctccagactgggcgacagagtgagactcagtctcaaaaagaaaaaaaaaatctatcagtcagtcagtcagttagtctgtctgtctgtctgtctgtctgtctgtttatctatctgtctatctgtcttactggtttacttgttgtcacctgggatatgtaagaagcctgttggggcagtattcacataatctctgttaaaagtgatatttttagtatcttctatgggtcttctctttaaacatctcagatattgtctcttgtataaaaagtaaaagttgctatcccacaccacccctactatgtccttctgattgctgccttttttgcaaaagcagaaatatgtcttctgggcaccatccgcttcatggacagcaacttgtgcaaagagattcctgggagttgtcaatctacatgctcatagatgtctgaattgtgacatatcctcagtccctacccgccatccagagtcatttttctgacataaaactttcataggcaatccataccttatggcttcaccattgtaaaactggtggaaagcacaacacgctatcaacttcagcatcatgaggattggcctttgttttctaaatcctttctcttttgaaatgcacctattatacaagacttaggttgtatgatttgaaggattgttcaccagtagtgacaccgttatttattgaaccattttcctgatactttttttgtgttaactgaacttgtatatgtaattattatctggtaggatcattttttttcctagcgttatttatggcatgatttactagcatctcgttaggcaataaatgcatatttaattggatatccttatgggttcagtaccatgctgtgcataaattccagaagtatacagacccagccttcttttctctttctctctctctctctctacacacacacacgcaaatacatacacacacatatatacgtacacatacacatataactatatacatatgtatgtatgtatgagcacaaattatttggggtgggcactgtggctcacacctataatcccaacactttggaaggccgaggcaggaggattgcataagcccaggagttcaagaccagcctgggcaacataacaagatcccgtctctccaaaaaataaagataaaaaattagctggccatgatggcatgcatttgtagtcccagcttgggaggctgaagtggatctcttgagcccagaagttcgaggctgttgtgagttataattacaccactgcactccagcctgagcaacaaggcaagatcctgtctcaaacaaaacacctaattatttggagtatatagaatttgaacttgttatgcatgtatgaacagaagttatttggagtatatagattttgaagttggcttagatgtatgatgaattctcagaggttatgattaattatctttacctttcattctataagattttattgaataccttctagatgctagaatttcagcaatgagcaagactgataaggtctttgtctaaggaagaacatagaccccataaaattagtgttacagttctttcagaatttgtctagcaacctttctggtttttgctagaaagttctctcctaattgataaaataaaaatatttttgaaagggaagaattaaaaatcatgggattaaatgacaggaggagccaatctgggtattcataaaatgactgatatttctgtccacagttgagtgaaaagtattggaaaccaacattcactgagcaactactaggaaggccggatggcattcgagagaaaaagttatggtctcaggcagatctgagtttggatcctgctctgctgtgcattccaggcaagatcgtgttttggcaagttgtctgtcccatctgagcctgggttcctcattggtacagaaagtcagtaatgacatcaacccaattaaatgagagaacagatgcacacaggacgcattccacacagcgcctggttcaaagtaagtgctcaggacatgagtgccaccatccttcccccaaggaggcatgagatggaccctggttcttgctgttacggtcactcaggcaatttatactcataaccgtccggggaggtaggactcatgttttccccactttccagataaggatactgaggttctggggatttgaactaacctgcctttgacttcatatccagcaggcagccatgccgatttcaaagctccttctcttttcattcattgcaccgtttattgacctcatatacattcttcatctcctggagtgtctctcctaatcagtacatcaggggtaacaaatcttagtgacctcagtaaataataagcccaaagaattgcagtgcacagattcttgcttaagaataacagcgacttggaaagtttttcagtgttaacagagcagccttatgattaaaatcactgaagaatgcgatgtaaaatgtttttatttcgttttgctttctgtttcccttgaaataatagtcagcaggaaacacatttctgaaagacttctccatttctacatcctcagaatacaataagggccaagctgactgtgtcagggtgttcagagttagtaggcacacaaatgaaaagatggtgctctcagagttttatgaatttttctgtctagcagtcttgggttggaaagtcatctttgaaattgatgtagctatcaactaggggctaacattaagatttcagtcgaggtgtatagggttatgatctttctgttactgtcagaactgcagctgttgtatttgcattgagtggcatgctggagagagcaaaatgggatgcaggagaaggaaaaagaaatagcaaaacctattgaattgtgggctctacctgagggcatttgttaaaggtaaattcatcaatagctgttaagtcatttgtattgaatcattctcatagcctcacagcagttcttagttttaataatgggtcatagagaggagcttggtgatagatgccttattatggtatttaggcacttaattgcaactgggcttaaaatagcagcagaagctgaaaccagggtggctcaggagtaaattatgttttcagtctaccaaaacaccctttttaaaattcaagtttaatatttcttgacatatgtttcttgatacgctgttaacagcagtttatcagagatagaagaatgttaaaataaactggtgaccgaactatggtatctaaaggcatgccttgttcatcaccatcagagatattttgaaagaaacattgagacccaagtttaaaacacctgcaattatgctgggacaggggtgttcattgattcattcattcatgcattcattcattattcgtcatttattgctaatgttaaagggatagggcagtgtatgagacagacccttgcctttgtggactaattattcagtggtggaagtgagaaaaacataaatagttaataacaataaacgccaaagggggatgtgtgtgatgatgaaaccaggaagctgaaatagtgagtgatggtagaagatacagtagtgttttcttcagattagtgggctagggaagtgctcttggagaagaacccatttaagcagaggtctgagtgatatgaaggtgccaactggccaaaaagaggaaggatcattagaaacagaaacagcatgttcaagggccctgatgtgggaaagaactaaaaggagatcagggtggcaaagcttagcagagaagtcagtggaggggtaggacataggtttgaatagcagataaaggccaggtcctgtgtggccttttcatttactttacattttattcgaaatacaatgggaaacaatgaagagttttaaggacaagggtattgagctctgatgtatattattaggagattgtttttattgactctagaatggatggggagtaggtggctaaggaggaagttggcagtggtacgggagagaaatgacagtgccctctaccagaaaaatgaatggactgaaaatgtacttagaatgcatgctagtagataaagaggaactagctaggaagttccctaaaggagggtggtctgtattcttggggcatttgtaccctgatgactgaacatcctgacttcctatgtcttagtccatgtacagcaactctttgcctcacttgtaggtgaaatgattttggagtcactagttggataaagaactagaaaggtagaacatacagtgcttcctctgcacatctgatttgggagttttgaagtttacttgtcttagactgcatgaaatgtcaaaggaagccagtaacattgatttatttcttgagtccgttggttatcatcagcttgctgcttacagtatacaagcagatagagccagaagcggcatttccaggaattgaacctgcgttgtttactgcccctgtggtcttatgaagaatgtgtgattatcgtaacccacttgctattattttcataacaaagctgtctctgaccagctacaatcttggacttacataattgaattttagatggagatgcgctgctggtttatatgaattttccaggggtgccagcgtgagtccaggctttaacaaacaatatttttaattgagattttatgtccttgccctcaaatcaagcactttaataggatcccagttggaataggtgactcagtaacaagttaccactgctttcaacttcagaaaggtgttaatttctctaactcctgctgggcgtccatctactccggtgacccactgcctgcatgtaccataaaaacgagtgttttgcattccattagtttcaaagtacagccttagtagtctgcatatttcttgtagcatgtgctggctttgttccatcaggcaacattaagatagaaaagtattaaaaatattgatttgtcatttataacatcgaagtgatagattgaaatgcaatttggatgtactccagacctccaataactttgacattatcagacgaaatacaatgatctcagtctaattaatatgctgtgtccatatgagtaaagtagagagaatgaagcaagaaattggccacaaggaagtgatagctccatgtttcaagtagttgtagaatttagagatggaatatgacatgctctgtcgctggaccttgctatgtgctggaagctgtgttctttccatgtttgttcatctttgaaagcaagttagcgcattcctaaagaatagagtgatactcttcactgaactttgtaaacttctttaagctttttattatggcatcttgccataatgttcttccattcccctgctctggaataccggtaataactctaacacacacacctttctgcgtatcggtttcatgcaacaggtgcacctatcttgatttcaaaactttcctatccccctttcccttactgcttcttcacttccatcctttcctgctggtaatgaaattgtcaaactttattcctactcctatttttttttttttagcagggttctgtgttctctgtcagcctctctgctcacatattgcagttcctctgttctcccagagaatttttatcttcctgttggcaatatgtttatacggtgtgaatatgtaataattgtacttggttgctatggagaagggaaaaatacaaatgtgcaaatttcaaatacacaattgtgcaaatttcaaaatttattgtaactttttcatagtggtcatatagtattattaggaagtaatggcataaaaaaatacaaatattgaacttgagtaaacatcatgtatactgaaacttgtagggggtattttaatgatgtgtgaaatttactttgaaatgcaccaaaaataagatgggttgatggttgcagagagggatggacagatggaaatagctgggataaagcaagtatagtaaaatgccagtagtagaatataggtggtagatatatggatgtttgctgtaaaattctttcagctttgctgttttgagatttgcatactgcagtattggaaaaatatggtacaaaagtgaatagtcatatagtcaacacatagactgagataaaaattgtgtgcctgcattaatatctattcttttatttagggatgctttcaggaccgtagttgcaggaagatcatcttgctataacccagtgtccccctttcatctcctataccatgtctctctgcctgttttcttcttctctttgaatatttgttacatctgtcttaatagagactgtgcaatttcatctcttcatcaactcctgtaagtagaaccagcaacagagcgaaagggagaaaaagaaacgtacttctcgcctgccttccttttctgtctccccgtgagaagcctcgtgccctcctcctgtcttgtgtcttgtgtcagagttagcggagcagcagctctggcctccttggatttatgtgattcgtagtgagagaatgctgccacagctgaggctgttgcctgctctacattgattgagtttcctgggcttgagggatttttgccgagctgagttttatggttgatgtgctctcggtcatttgtcataaaatcattcccaccaagctgtttactgggtttgaatgcttaattactgaaggagaagagaatcactccttatggagctgactgttgacttggatgctttttactgggttgtcttctggtacccaactcttgctgagtagtttatccaatatacatacccactcttcagcataaaaaaataaagacacccataattttacctaagtattttgagcagtgcaaagacatatcatttcacttcatattatgacagcatttttcttttgagtacaaattgattgcaaaactcaacactcaggcagctacagctaggaaagtgtctatgctctggggttcaaatgacaatgttcacctgctttattcagatcaatttccagaaatgcattgctgactctccgccaactcaatatcctcaatccaaattgcataaatggtgttggatataattatctctctgaaaaatttcacctaaattggaattaaatttatttgtaaaagcaaagtcatcttgggaattatatttcaaaacctacggtcgaagattcagtgaatgaagctctttccttttgtttcttccacaatttcagctcctctttttcatgaggaaaattgaagcactcttcgggttcccactgctccctcctctgcactaattcccacatagaatttctctctacaaattggcctccactaattttttgcattggttgtgtcttgttgaatttttcaggagcacacttttatatacggggatgttgttttagaggtgggagaaagagagaattagagagagatgcaggaaatggaatgttgttttttttttattattatagtttaagttttagggtacatgtgcacaatgtgcaggttagttacatatgtatacatgtgccatgctggtgtgctccacccattaactcgtcatttagcattaggtatatctcctaaagctatccctcccctctccccccaccccacaacagtccccagagtgtgatgttccccttgctgtgtccatgtgttctcattgttcagttcccacctatgactgagaatatgcggtgtttggttttttgttcttgggatagtttactgagaatgatgatttccaatttcatccatgtccctacaaagggcatgaactcatcattttttatggctgcatagtattccatggtgtatatgttgcacattttcttaatccagtctatcattgttggacatttgggttggttccaagtctttgctattggggatagtgccgcaataaacatacgtgtgcatgtgtctttatagcagcatgatttatagtcctttgggtgtatacccagtaatgggatggctgggtcaaatggtatttctagttagatccctgagtaatcgccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtctcctgttttaatgccaagataacccgtcagaacacctgaaatatttgctacagttttgatgtttcatttatctcttagtggagcattgtgttgtttcagtgttttatcatgaagaactgtggctcttttaactgtaaggaatgagaactttagtaaaaacaacttttaatcactttgctataaatataatactagagaattcgtttcttggagtatgatttccctgttattcaaaaacaactacttgtcacccccttgtactttggccttcttttttcttctccccttcttttaactgttgcccctatttggagcgattatacttaaagtaatatggattctttcagagctgccaaaaggtgaaattgactttttgagaatgtattgctgaaaactgcagcagatgcactttttccatgtagaaacatcctgtgtgttaagaccgaaagggaccatttacagccagtttcaaattgctagctgaggtcaataagtgcccacttctgcaatcacatcagccccgtttggatgacagtacacaatgaggtgcctcccagggagtgaccacattggcagcaaaaccctttttgcaagttttatttggtcattcatagtagaaacctttaaaaatcttcaacatttaatttcaagcatttaaaaaatatatactgtagtaccatttacctataactggatttatttaaaaattatatggattggggaaaggacaccctcttcaataagtagtgctgggaaaaaaatggatatccgtatgtagaagagtgaaacaagaccctatttcttaccgtatacaaaaatcaactcaaaatgcattaaagattgaaacccaatactataaaactactagaagtaaacataggtaaaatgcattaagacactggcctaggcaaagattttatggctaagacttcaaaggcataggcaacagaaacaaaatatacaaataggactatattagactaaacagctttggcacaacaaaggaaacaatgaatgcagcaaagagaggatctgtagaatgggagcaaatatttgcaagctattcagtcaactcatatccagaatatatgacaaggaacacagtcaactccatagcaataataataataataatcccatttaaaaatgggcaaaggatctgaataaacatttcttaaaagaagatatacaggccgggcctggtggttcacgcctgtaatcccaacactttgggaggctgaggcaggggggtcatgtgaggtcaggagttcgagaccagcctggccaacatggtgaaactccatctctactaaaaatacaacaaaaattagccaggcgtggtggcagacacctgtagtcacagctccttgggaggctgaggcaggagaattgcttgaaccgaggggatggaggttgcagtgagctgagatcgtgccattgcactccagcctgggcaccaagggcgaaactccatctcaaacaaacagacaaacaaacaaacaaacaaacaaacaaaaaacatacaaatggccaacaggtataaaaaaaatgcttattatcactaattatgagggaaatgcagatcaaaacctcaatgacgtataatttcatcccaattagaacgactattatcaaaaagataaaaaataaatgctagcaaggatgtggagaaaagggaacttttatgcactgttggttggaatgaaaattggcacagctaatagggaaaacaatacagaggtttctcaaaaagactaaaaatagaactaccataaaatccagcaaaatcccactgtggatatttacccagaggaaagaaaatcaatatctgaaaggacctgcacacccgtgtttactgcagcattatttacaatagcaaagatataaaatcaacctaagtatccattaagagacgattagattaaaaatgtggtatatatgcacaacagaatactattcagccctgaaaaaggatgaaatgctgtttgttacagcaacatggatggaactggagggaggtcattatgttaactgaaataagctgagcacagaaagacaaatatgacatgttctcattcatatgtgggagctaaaaaagttgatctctggaggatagagagtagaatggtggttaccagaggctgggaagggtagagaaggtgggatgaggggaggctgattaataagtacaaacatatggttagataggagtgagttctagtgttccacagcatagtatggtgatgatggttaaaaacaatttattgtacatttcaaagtaactagaagaaaagatttgaaatgtctccaaccatagaaatgacaaatgtttgaggtgatggatacccccaattaccctgatcataacacattgtgtgcatgtatcaaaatgtcacatgtaccctgtaaatatgtacaattattatgcattagtaaaaaaagattttaaacaattacaacaacatccaggttttgttggttgtttttaatgcggcagaccctgtcctctattacattgaactgtcacacttttaagaagtcagtccaaactactatcttctttataccaataagaaggatcaggacacagaaagttaagtaaatggtccaagtcagtaaatggggattcatgattttgaaactttgtggtcagacttcaggtactgtcctcttaatgtcttgctgtgagatttgagatccaagataacttggcattgttgagatattgggaagctactatcagaatcagtcctctgcttgctttgttggtgtaaactagagataatttagtgtaaaatgtcccaataaaaattttcccccaagcatatgtaaaccacgacataatagatttatcaaagtagcagaatgctattatgttcaagagattaaccagaccaaagctatttgtcatagcaacgggtgctagagttgacaaattacaattgaacccagtttgtagcaaaatgttagacagagccttggcactgattaattgacgtgagagtccagcctagaatacattagagcaatttaaatatcattcaaaacagaatataaccatgctctctaaaacatcccaaactgtaccaagcaactacatttgattgattctataatgcaaatattttatgcctaagacttttaaagcacagactgtgttagtagcaagacacaccaccaatttagtaatttctaattaaaaagaaaatacattttacattaaatgcttatattgattgccaaggaacctgactacaggtcttttaaaacttgcatcatggggttgagagggacaatcatctcttagaaatttcttaaaaagaaactttaactctgggtaatgtgtttaccctaattagataagaaacctcatcctaataaaagtaatggactgaaggtgacatgtgttcagggagtcgggggggaaagagtttagaaagaggaaaagcctttgctttctaagctagaaaaatggatgttgaacttaaatctattcagacaatgatgagctagtcatattgtcacaagaataggttacctctttcttgcatttaaggttcccgttatgaaacagaaaacaagattatattctactgaaaataaagttgaaatggagtagaaaaagtggagtttcatattacttatcaattcttttttttttttcttttgtgagacagagtctcgctctgttgcccaggctggagtgcagtggcataaccttagctcactggaacctccacctcctgggttccagcagttctcctgtttcagcctcccaagtagctgggattacaggtgcatggcaccacagctggctaatttttgtatttttagtagagacagtgtttagtcgtgttggccaggctggtcttgaactcctgacctcaggtgatctgcctgcctcagcctcccatagtgctgggacccaattaattctttagtcaaccaacttcatttcttgatatgtcagttgtctgtgtgtgtgtgtgtgtgtgtgtgtgtgtgtgtgtgtgtgtgtgtgtgtattttcagtttttgtccatctgacagttgctgttgttttcattgttaggatatgagttccagttccagtatttctgtggcagagccttttgttctttagcatgtagggatttatttaggtctattacttgttttcactttctctttgccttttcttaaatttcaactttaataatagcctttaatagaataacagtgcattagctttcattgactacatgtatgctgaagaattcatgctaaagaaataataaggaatgtgtgccaagatgtggctatgaggatgtttattactagattgtttataatagcaagacagtggaaaattacccaaatggcctataacagcgaactgatgaaatcaagtatggtataaggctacagtggaattctcattagtttattaatcatttatcaaatattagttgagaggatattttgtatcagcccttgtggagtctctgaatatgtagccttcaagggcattaatagtgaaatggtggaagaatcgtcaatggcacagcaaaaggtgagcatatggctcggggagtccaaactcagtgtgatcttgttttcattaaaagataaaaggaaggtagaaatatgttttcttaagaaaaaaaaatgtacgtacacaaagataagcatcgctatgtttgactccttggatatttattctctaaatagtttgtaatgaattcctcatgtctttaagcaggaaacaaattgcaaatggtttaaaaaggcaattgctttaaaggattgaggagagcattggcacctatgtttctgttatctatgaaggtggaaggggaatcaagatggtttcagtcttttgtttttaaagcaaatggaattcttcaacatcttaactatcttttaactcttgctcttacaagaagtgatactttaatgtttaagaaaggcatgtattattaagaaaaaataagataaaataccaaggataccagcaatcacagcggactgagtggtatgtgaaaagataaacagtaaatgcttttggaaggaattgttagtcttctcgacagtttagcatttgatcttgttttgcgttggtagactgacttgaagtactagactgaattgggtgagacaaataaaagcatatactggagcagagagatccaatctttccctttctctgcaaggtttgtatttaggttataaaaataagtgtaggagggaagattagggcaaggcacagccttggtgcaagatgcagagatgagcagtcacgtatttcacacagagtaggatcagagattccaactagaaccaacaccaacagtgtgtggccccagggagtggcgctgcctctggtcaatgccacccaccagaattggactctaatggatagatcttcctagcactgcgtctggtcaatgccacccatcaggatcggactgtaatggagagatcttcttagctctctccctaaaagttgactgagccatctttccaattaataagaaaataccaaacagaacattaaagtttatagcttcacatttttgaattaaattacctattgattagtagggggctatcattaaaaattagcacaatcacgactgacaatgccttagaaattttcatcatgatgactttgatcaaattgtaaatgtgaatctgtactttattttagaactaaaggaggcaaatgagcaataaatttgaagcccaggtaattgggggaaaaagtaatcaatttaatccgtccgaagggctaagtgattcagagaactgacacttggatatttggttgaagccttttgtctgaaaatgtcacttgtatatgtttaagaaaatattctataccagacatacatttagtctttgcatctcttatgttgttagttttcagtttttaagcataaactcaaggtaacagttttcctgttagtttttagtttttaaacatacactccaggtaatagttttcctttctcccaatctcctttttttttttttttttttttttttgagacagagtcttgctctgtcacccaggctggagtgcagtggtgcgatctcggttcactgtaacctctgcctcccagattcaagcagttctctgcctcagcctcccaagtggctgggattacaggtgctcgccaccatgcctggctaatatttgtatttttagtagagacgaggtttcacgaacttggccaggctggtcttgaattcctgaccttgtgatccacctgcctcggccccctaaagtgctgggattacaggcatgagccaccacgcctggccctctctctccttgttgctactacgccatccagactccagtcactcaaagcaactacatctctcattccaagcaggtaccttcttcctcactctaatcccacattgtcttcacctctagactgatgatcatttatctctgacattttttgttcaaccacagcccacttatgcctgccttctcacgtgccgctcaagctcgacaactctacaggtgctaagatgaaatatagtgtagatgttaaaaggatttctctggagcctgatctccacatgtggttctatcttctgctagttgagttaccttgggaaattagcttagttttctgctacctctgtcttctcctctgtaaaatgtagtaacagtaacataaaaattccatagggttataattagaattagataaaataactaaataattgcaaataatctattatgtagagagtgataggttatatatgtagtgtctagagtgcagacttctagtgaaaatactgacttttggtcttcagtaaactagtaatatgtcaatgttggctttttcaaagtaatttttagcaacccttactagtgcacttagaaggtaaatattagcaaacagtacttaattgaacataccaccaccgacaatgaaattatggattacctacctgtaagaacaaaagaaaaggtgtgaatttttggattagtttatggctcaccagtgttacccctttacaaggtatacgcccacggtcgttatgttcaaaggttgaaactctagactactatatttaattctcctcaagaatcttagatatgaaaggaacagcaaaagtcattttatcaaaatttagtcctggtagaagaactccattaaacttggcatttggttatttgttttgggccccagtgatttgctaaagaataggttgagttctagagatagaaaaatagtaaggtaaagagccttaccccaaggggatagggggtagtcaggaagacaggcaaggaaacaggcaattgcaaaataaaaaccaggtgttaccagagtcatagtggctctcaaaggaggtacctctccttgccttgggtgggagtaagtgggtacaaagagaatttcagagaaaggtagcatctgagctgaaacctgaagaacaagtaggagttccccaaatgaagatagaggaatacagcaaagaaatttgcccagtgcaaataggaacatgcaagatagagaatgtgacgttcattcatggctgtttattattaaggtcctacaatatatcaggactgtattacgagaacttatgtaaatgtcagaccactgtctcctccacctctaaaatgagttttttcagggcagaaactgcccaatttatctttgctaacctaatgccttcagctcaatgtttatcaagtggaagatgttcaataattatttgttgaaggaatgaattaatcaataaatggtttatcacaatttcctcctgttagtgagaagcaaagtcattggaaaaaccatttaccagtatagggtcaggctagacacttgtaagcccatcaccagtgattactttcctgttggagagccatccattccatcagtattgtttggcacaaccattcaaccagcaaactgtatcttcatgggcctgtacacctgtcttattcatggatatttcacaagcgtaatggcagatgtgtgatttctgacctctcctccaacctggttgacttgggttatagcaacagagaaaatgagttttgcttggggttatttcttaataagctatcattgaccattaatcatcaacaaccacttgcctttccagtgtctcaccaattacgtatttcattctctgttctacctcccagcaaagtatcgggtctgttttaggatttacgtttttattagaatgtttgccccttttagcctgatagcacgtttatcattccaaaaccactggacggattccacacaaacattaaatgtttaaatgtgttcacactgaaacgtgtgggaatagcaaatggtcttttgttgtaacttttgaagatcttctgtaattcctctatttcatttgcatattgaagtgcttgcttatgttcaggaacctgtgcttagcgtttgtatatgtcctatggttcccaatattaatgagtcctggagaaagttgaatctgcaagtttctttacagtggccatcagggaatgaggtagcaggatgttaatgctgtctgcatgctgtgaaggatgataaactgtacttgggtgaccttattaatcactcataacgtgatcttaaaggtatgtgcattttctgtgcctcccagtctttgcgtatggagagggaaagatgggcattccctagtccccttaagctctaggtgccctcaatatctcccacttgagcatctgaacttcatctcagttttatgacagcagctggcatgcaaattggctggacttgaaagcactgaagttcacctcactttgctcaatctgtgcacaaatgatcaagctcagcaattttgaaaatggcccacccttttaaagggaaaacctgaaatattttcagtccttatggtagtcgggccaagcagtgtctggtagcccattcttagttctgttaccagcaggtaatgcaggttagcttgatgagcacaactctttgtcttctctccacctgtctctgtccattcattcatcccacggatgcttattgaatgtccactcaatgttggagcaacaacaggaaataaggacatggtttctgtccccatgggacttacattctacttggatatactagggagaaaaaagagtaaacaaaacaattagagatgataattattaagagtaaatgcatgggctgggtgcagtggctcacgcctgtaatcccagcacttttggaggctgaggcgggtaggtcacttgaggtcaggtgtacgagaccaacctggccaacatggtgaaaccctgtctctaccaaaaatataaaaattagctaggcatggtgacgggtgcctgtaatcctagctactcgggaagctgaggcaggagaatctcttgaacccagaaggtgaaggttgcagtgagccgagattgtgccactgcactccaacctggatgacagagcaagactgtttcagaaaaagaaagaaataaaaaagaaaagagtaaattaatgggatattgtaatggagaatcataatgtgtgtgttggctaaggttttcagaaaaaaaaaaattcatggtgacatgaaatttaagcagaaatctaaagtcctaaagaatgcgagggaatctggggaagcgtgctctaggctgatggaacagcaagtaaaacgacagggaatctgtgaacagtttaccttgcatgaggctctgaatgcagcacgtggtaagggagggggtggactaaaggctggaggaacagaatgaggccagaacacacaggctcctgcaggccaagatctgggtttgattgcaaacacaatatatagctcaagtttactttgtactcaacaaaatccattctgtctaccactggaaataatagcaaatacggcttgttggaaagtccgtgtgtaacttatctcttattattgctgagaggatcaggaaaaataactgttgagtattagactgaatacctgggcaatgaaataatctgtggaacatacccctataactcaagtttatataacaaacctgcacatgtacacctcaacttaaagtttaagaaaaaaagaatgctggtgggaatgtaaatgagtacaacctctatggaaaacagtacagagatttttcaaagaagtaaaagtaggtctaccattcggtacagcaatcactctacccaatactgggtctctacccagaggaaagatgcctgcttgcatatatttatcataacacaattcacaattgcaaagatacagaatcagccttagtgcccagcaaccaataagtagataaggaaaatatggtatattcaccttgaaatactactcagccataaaaaagaatgaaataatgtcttttgcagcaacttggatgaaactggaggtttcttctaagtgaagtaactctgaaatcaaaaagcaaatactgcatttcttcacttgtaagtgggaactaaggtatgaggatgcaaaggtatacagtatgatggacattggagactcagaagatgggagggtagaagggggatgaggagcaaaaaactacctatttagtacaacgtacactactcgggtggcaggtgcactaaaatcctagatttcaacactatgcaattcatccatgtaaccaaaactaacctgtaaccctaaagctattgaaatttttcaaaaaatatttaaaaagaaaaaaaagcaaaattttagatatggagaaaaaaaaagacatgaataagagcccttcagtccaaccagaatttgatttcactttcctctccttgtcattgtttttatacagctctttatctctttccaacagaaaaagtaaagaatttttccttttttatttagttttttaatgttcagagtggaaaagacataacttttcctacttgagcatttgtctgttttttcattgtaaatattattattgtccctgtagcctgggaggcctttcaaaggtcacttggccttttctagtacagtcacatgcccttcttcatttttaaatctttgagggggagaggggaatgagaaaatattccggaatagcactgtccaatagaactttctgcaatgacacccatgttctttatcatcagtgtctaatgaggtacctactagtcacatgggacttgtgagcactcacagtcaagctagtgctaccaaggagctgaattttaaattctatctaattagccacatgtggccaacagctgtcatcttggacaacacaactctagagcctcttctgaatgttatgccagtgaattcactgaaattcacaactggaatttacaccagtgatggtcttcatatgggcttccgttagtgactttggtgaagtttcaggcgagacctaaaggatgggaggggatctggggaagcatgttctaagctgatggaacagcaagtaaaaagatactcagtctgaggacacttgacctggcatgaagctctgaatgcagcccgtggtactagcccttggtaagtcgggggaggctgaaggctgaaggaacaaccttccagctcaattccaggtcatttctggtcatggcgaggtctttttcacaaaataatcattgttttcatctattcagtatccatttcctcatcctgtggtcctataattgcatttttcttaggggaccacctctcttgcatttttcctccatacttccagagagctggctccttaccgagctctagagttgggtatggaacctaaacctagccagctggcataactccaattcccagccacagggactggctcctagatgaccaagtggctcaagtctctccaaggagactcagtctcagaacacttgttaaagctgttagagactgaacacattgagcctgaaattgatggccatttctctgcccccctgagaatgtggccaacctcctagaaagaccacagggctaggactgagttccaattctctgaatgtagccctgctgcaatctataattatcctgaggtttttcacttatgtgaacgaatacatttctttttttgcttaagccaatttgagccagtgttttaatttaaaacctcacccccaaaaaaattctgatgaatacaataatgtcaaatatagcatttgtgacagtataaatctttcaaatcccaaagaactcatccctaagaaattatggagaggctaggtgtggtggcttatgcctgtaatcccaacactttgggaggccaaggtgggcagatcacgagatcaggagttcgagagcagcctggccaatatggtgaaaccccatctctactaaaaatacaaaaattagccaggcatggtgacgggtgcctgtaatcccagctactcaggaggctcaggcaggagaatcgcttgaacccgggaggtggaggttgcagtgagccgagatcgcgccattgcactccagcctgggcaacagagtaaggactctatctcaataataataataataataataataataataataagaagaagaagaagaagaagaagaagaagaagaagaagaaattatggagaaaactggacaaaactgggagtacagaagtggaaaatcacattgtgaaggagctagtgaattttctcccttagttatttagctggaaatatgaatccactgataaaggtggatttgcttggcccccgaggcagaggttgcagtgagcagagattgtaacactgcacttcagcctgggcaatagagctagactccatctcaaaaaacaaaacaagaccgaaaacaaaagaaacaaggacctcactttttactccatatacttttttttcctgtttttgcttttttaaacaataaatgtttgtaatttatatgacaataaagagtcttattaaaaagtatttcaaaaattttttttcttctagggtagatggtgtagttttcttattctttgaaaatacaaatataattgctccaagcaaatcaaacatataagagtgcagagagagagggaaaattcccccccagcccacacaagccttctaaatgtacttcccttcccagagaaaactactatgaatagtatctattttctatacattgacaaaaatatttagagatagtgggtatgtatgagagaaaaagatggatcaataaatacacatctacaaacatatatgatttggtttaaatatcgcctacctgtatatattcattagtatgcgtatgtacaggcatatatatgtaaaatatatatgtacctatatatatatatgtatatatgatattatgatgatattatttttctttttttttttttgagacttgctttgtcgccaggttggagtgcaatggggcgaactcagctcactgcaacctctgtctgcaggtttcaagcgattcttctgcctcagcctcccgagtagctgggactataggcacccaccgtcatgctcggctaatttttgtatttttaggagagatggggtttcaccatgttggccaggctggtctcaaactcctgacctcgtgatctgcctgcctcgggctcccaaagtgttgaggttactggcgtgagccactgcgcccagccaatattacttctttttctgtttaacagttgatattgtttggctgtgtccccacccaaatctcatcttgaattcccacgtgttgtgtgagggactgggtgggagttaattgaataatggaggcaggtcattcccacgctgttctcatgatagtgcataagcctcatgagatccgatggttttataaaggggaatttccctgcacaagttctttctttgcctgctgccatcgatgtaagatgagacttgctcctccttgccttccaccatgactgtgtggcctccatagccatgtggaactgtaagtctattaaaggtctttctcccgtaagttgcctaggcttgagtatgtctttatcagcagcatgaaaacagactaagaatacagcagtacatcaggaatattttccatgagctacatctccactgcaacattctttttagcaacagtgcagcattctgtagtttgtatgtatatccttaatggtttatcacccgccttttaataaacatcaggctgtttcctgtttttgcctattcgtgacaatgctgaaacagcttcattgcgcataagcaagacttctctatggcatctccaaatgatgactgttggctctaatgtataatacgagtgtatcttccatatccctctctgctaatgttccctgctgatgtaggataagcttctgtggcttgatcttggctgataatttgggtacaaatctaacaaaggcatgagatgtgttctaaacttacctctagaaaagtcagggttttttttgcagcaatgatgccacaaaacacattctgaggacaactcaccacgagtttgaagatgatttgtttggagcgatttgaaatcaaagttcagatttatttctcataagtctgttgtttagagggggatttcgtgaactgttcctatctatgtgccttatgcctgcaggctacaggtcctttatgagatggctatttttaaaggaacacctctattctcaggatggttgacaggacttttaatgaggaaagaaattagaaatcagagctggaggcaaagtggtcagcagaaaggaaagaaaaacaaggaacttgtattaagcagaaaggcagcttagtataccctttcaagtgtctgttattgtaaatattcttgtatatatccattagcagtcatgggtgagaactacagaattttttgggttatcatcataggaaagtacttaccacatctccacaggctcctcattttacttaaacttgaccaaatccagtagcaattgaaactgtacaaatcaaataatgtatttaatgcaacagggcaggggttggaaaactgcagcctgtgggccacatttactccacttggattattattatttctgtaataaagttgtattatgtatacccagctgcacctatgcaagcatatatttctgcggcagcttttgggtaccacggcagagctcaatattaggatagccctgcaagtcgaaaatattttctttctgcccctttacggaagatgttcgtcaacctagggaatctcacaatttcaaggtgttccctgttcaatttttttttttaatgtgagaaaagaaatcaatctctactcagaggctgcagagccttcctgggaggagagaagagtccacaaagttctccgtctgcctgggaggcagatgcagatgagaggaagtggcataggctgagctgtacctgctggattcattcttcttgtctccccagttgggaagttaaggaagttactctttatatgacagggaggaaatgagcaatggagagagcccatttctaaatagtagggctgaagtctcccatggataatgcaacacagttgtcagtgacacaaaatgatgtgcttgggtctgagaattacctcttatttggaggccgaattgtgtctccactacccccgattcaaatgctcaaattctcacccacaggacctcagaatgtgagtctgtttggagacaggatccttaggaagttaattcgggtttcatgaggttattaggttgggcccgaatccagtgtgtttggtgtccttataagaagaaaaaatcagaacccagacacacagagagaataccatataaacaacacagagggggaagatggtcgtctgcaagccaaggaaagaggcttcagaagaaaccaacactgcaaacaccttagtcttgaacttctaccctccagaattgtgagaaaataaatttctgttgtttaagccacacagtctacggtgctttgttacggcagccctggcaagctgacacacttctgctcaagtctatgttggtatcttcttagatatgatgcagatagtacacagatctttctgacgcctaagtcagcagccctggcaagctaatacacttctgctcctgtctgcattggtgtcttcttagatatgatccagatagcagagagactttctgatgcctaagtcagcagtcctagcaaaccctagcaagctgaagccaacacacttctgctcaagtctaccttggtgtcttctcagatatgatgcagatagtatagagagctttctgatgcctaactcagcagttctcaactgtggacaattttgctcctcaggagacatttggcaatgtcaggaggcatttttgattgtcataattagtggagcaaggcactataatgctactggcgtctagcgggtggaggccagggatgctgtttaacatctcacaatgcacaggacagccccctatgacaataagttacccagcctaaagtggcaattgtaccaagactgagagttcctgatggggcagaagatgcattactgtcaggctgtgtcttttcccttctccccattagacctttggtgttctttgaaggggccggaagaggttatctcctactctgggcattgtgtagaatagctatataagatcctcaaaataattgaaacggaaagactcccttcggctctttctgccattccagtaaattcctgctaagtatgctctaggaaaactatgaggtgctgtatgatttctgtgacaggaactgtggctttcctgaggaacagtcttcctttcaatgctgttaacttcccccaagtttgtggtctgttggtggttccggtgtgggcaaagaggaatgaatgattgatggactgtgagcctcccaagtagaagtgggctagtggggagtttttttaatatcatattttatatacaactgcaggtcaggccaggctatggatatacagtgcctgaccctagtacagaggaaggatcgattgtgctcaaacagtgagctatccaaataatttatttatgcagcaatgcagctgtctgcttctttggaggtgggcacaggctggaagggttttgtgtgtgcgcacgtgcgtgtgtgtgtgtgtgtgtatgtatgtgtgggcatggggtgcatttgtatgtgtatgtgtgggtatggggtgcgtttgtgtttgtatgtatatgggtgggtatggggcgcatttgtgagtgtatgtgtatgtgtggggtgcatttgtgtgtgtatgtatatgggtgggtatggggtgcatttgtgagtgtatgtgtatgtgtgagtgtggggtgcatttgtgtgtgtgtgtgtgtatgtggactttgagtgcatttgtgtgtgtatatgtgggtgtgggatgcatttgtatgtgtgtgattgtgtatgtgtgggtttggagtgcatttgtgtgtgtgtgcatatgttgggatgtggggtgcatttgtgtgcgtatgtgtgggcctggggtgcatttgtgtgtatgtgagtgtatgtgtgggcatgggatgcatttgtgtgtgtgtgtctgtgtgggcgtggggtgcatttgtgtgtgtgtgtaagtgtgggcttggagtacatttgtgtgtgtgtgtgtatctatatatttgggtgtggggtgcatttgtgtgcgtgtgtgtgggtgtggggtgcatatgtgtgtgtgtgtgtgattgtatttgtgggcatggggtgcatttgtattgggcttggggtgcatttgtgtgtgtatatgtatgtgtgggcgtggggtgcatttgtgcgtgtatgtgtatattggggtgtggggtgcatttgtgtttgtgtatgggtgtggggtgcatttgtgtgtgtgtgtgtgggcatggggtgcatttgtgtgtgagtgtatgtgtgggtgtggggtgcatttgtgtgtgtgtgtgggcatggggtgcatttgtgtgtgtgtaagtgtatgtgtgggtgtggggtgcatttgtgtgtttgggtatggggtgcatttctgtgcatgtgtatgtgtggatatggggtgcatttgtgtgtgtgtgtgtgggcgtggggtatatttgtgtgtatctatgtgtatgtgtgggagttgggtgcatttgtcttggggggcatagggtgcaattgtgtgtgtatgtgtgggtgtggggtatatttgtgtgtgtctatgtgtatgtgtaggagttggttgcatttgtgttggggggcatagggtgcatttgtgtgtgtatgtgtgggtgtggggtgcatttgtgtgtgtgtgtgtgtatgtgcatgtgtgggcatggggtgcatttgtgtgtgtatgtgtgggtgtggggtctatttgtgtgtgtgtgtatgtgtatgtgtatgtgtgggcatggggtgcatttgtgtgtgtgtatgtgtgggtgtggggtgcatttctgtgtgtgtgtatgtgtgggcgtggggtgcatttgtgtgtatctatgtgtatgtgtgggagtttggtgcatttgtgttgtgggggcatggggtgcatttgtgtgtatatatgtgtggatgtagggtgcgtttgtctgtgtgtatttgtgtgggcatggagtgcatttgcgttgcgggggtgtggagtgtgtttgtgtgtgtgcacacgcacatggttctcatggtcctcccgttttcaactgaacctgtaattagctcctcagagaccaggtaatcacagtttgctttttctacctgtaaatgctcattggctttctgatttcccattaatttcctagctttaaattaccaagaattggactttttgtaaaataccaagttatcggaacaaagaccggcactctgggaaggcaaatgaaaaattccagtgtctctgtaactgagattgcctgttattagtaggtttctctgtctgtttggttttgtctacatttgaaaggaagcttttgaggaattcatggagcatgtctactctattccctcccaggtgagatggtgcccctccaggaaagtatcagaatgcagccattagggctggacatttctaactggccaagtctacacaggcataacaaattgagcaattgtggttatgatcacaatttctaaaactgggactctaaataataggttccagaagcaaattaaatatcaacaacccaattaccttttgtctctgctaccaagcatgaattctgatagtcattgtcttacttctctatgttcagagaattatatttaagggaagaagcagctaatgataatttactgattgttacaaacaatctacatgtcagctatatagagtcatctataggaattaattgtatgagctatatatgtcaggaatatatagagtattcttgacagtaaattagcattagcattaaaacgattagtattataattttataatactaattataactattagttaattagttcaactgttgagttgaactttctgcaatggtgggagtgttttatacctgagctttccaatatagtagccatgagccgtatgggcctactgagcatttgaaatgtgattagtgcaactgaggggcttttaaaataattttagttaatataaacttaaccccattgagtagtggctaccatattggacagtatacgtctataggccctaatctcatctcctctttaaaaagaatgaatatgtatctttattaataatctgtgttcatatcttatataacatacctaaaaatgtagacaaggcagggcgcagtggctcacgcctgtaatcccagcactttgggaggccaggtctggcggatcacgaggtcaggagatccagaccatcctggcgaacatggtgaaaccccgtctctactaaaagtacaaaaaaaaaaaaaaaaagttagcctggtgtggttcggacgcctgtagtcccagctactcgggaggcaggagaaaggcgtgaaaccgggaggccgagcttgcagtgagctgagatcgcgccaccgcactccagcctgggcgatacagcgagactctgtctcaaaaaaaaaaaaaaaaaaaaaaagtagacaaaaagcctacaaacagacacacccaactgttaagacctctcaggttgggattagaaaggtatgaagaaaggattttaacatcttgtcttgcctaatcccaaaaagaaaaaaaaataggtgataagattaaaaatgaatcaaataaatcagatgcaaccaattatatcatggaaccagttatgtcagtccatctctttgaattaaaattaaaggaaaaaagatggagggttctgacagttatctctctaatcgagacagccctctccctctctctgtccccttacagagaaagtgaatttgggagcttcggtcaaacatcccttgtctttcgtcaaattagtgcctaatgtcatcattttggtggctttcaaaggtgtgaaccagcaaacgggtgacagtgagaggaaggaacaagcatgtgaacaaatgcgtgaaccacagtcagtctctgaatggaaatccatgtgtcttatgaaaatcagttattgttgaaagccatttgcaaagcttccacgatcctcgcttggctggtgcacggctgtgagtgcttctttccaagtctcctgtgggtgacggggaatggctaaccagggattgtgttcacaggcatatcgattccaagtctgatcacagccacaaatttctttcccaggttagtaagaagaaatcaacactttactttcttggatcatatgtttttaaacattagtactgaggaaataaagaaagggagagaggaagaaaaaagaagtacaagaaagaatacactgggctgggcgtggtggctcatgcctgtaatcccagcactttgggaggccagtgcagacagatcactaggtcgggagatcgagaccatcctggctaacacggtgaaacccagtctctactaaaaatacaaaaaattagccgggcgtggtggcgggtgcctgtagtcccagctactcggggggctgaggcaggag[135 bp omitted]caaggagaagcaacacagtgcaattctttaaagtgcatacaattaaaacacatagaagaggaaccttggctagaattacagagcttgatcaagtctcatccatggttgacactgtttgttggatgatttggacatttggagcctctctatgtggggagagttttctttatccctttcaaatcggtatgccatctctacatacctgaattattataaaggtaacaaggttataagctcccccatgcctgccaggatgcactgctttgctgtgactgagccacactaggtgctaaacttttctgcactaatgcaatcaaattagaagttaaatctgatactgtaacaagttaccacctgggaacagaaatgctttgctgttttattttttcttcgtagcattgtgaaatgaacatggcatgtggcacattttaattacagcaaatattaatttttaatgggaaatgtacacctggctttgtattgttcataaattatctgagaggttgaaatttatttacgtgattttgatgcagttgtaattaaagtgaagaaactaatagccttctgtaattgaaggcacattaatctgaaagctacctgagggcagggattctgtgttaaccgtgttgtatactcaatttagtaaaatacgagtcttgggattagtggtcttgtatgcgatgtgctacacattttccagatatttctagggtattttctgagctttagaaaagtgataatatgatctagtactgtaggtaattatgtgctaagaaaagaggattctatcacattatctggcattgcttttttagttttgtaatggagtaattgattagtactactgcattttagcaaggtattttgctcctatacctagtggatgatgtttaagttaactctatttgtgtgtccctgagaaagagaaccgaggcaggcgctcggggaatggaacagggacaaagaaaccaaccaaataacactaggtatcagttttcagctgcatgtaaactcaacttattttttaatgattttattaggaagctttctacattctattttgtaatgcatttccctgagggaactttagaccttgcaggcctgtttgcaattcctgtcagattaggggggaaagaaagagaacagaatgatggaaatttcacacgttattcagtgttttaaaaatccagtttcttagcctgacagtttcttaaatctgtagaccttgatgttttaatcttatgcattctgatggagcttgatattcataactggtgggcttggtaaatttttaatcaggaagttgaatatgatgagaaaacacaaggggaggtttgtgttttgcaccttgtcatcaagctttccagtttcattttcactttttgcactaagagtattcctcagaggtgtcagagctgcccaaagctgacttccatccatattgaaatgactttttctgagctttccaaaattccaatttcagtgcaggtggtaatatctgaatgtgagcagcagaataaatagcagtttaaaactcatataaatatacatttatgctccatgtgtgaactcataaggtgtgggataaatcttgtcatttcaacataaacggaataacaaatagattgaaagtgggatgcactgttgcgaatacatgatctggatgcgcagtgcgattaaacagtgatggcttcatgagaatcgaatttcaaagatcacacaatcgattaaaacaattcagtctccctggtcatttttgtcagtaaattaaaacattaatttcatcccaagaatgtttttcagtgttttttattgtacaaagtaacaaacacatgcaaaagtagagaatagtaacatgattcctcatgtacccatccccagattcgataattaaaactcatagccaatcatgtttaatctatatccccacttgttttctccacattcctgaattgttttaaagccaaggccagacatcacacattttatccataaatgtttcagtatgtatctctaaatataattacacccaatccttcaacattaacattgattccctaagatgattaatatctgatcgctgttcagattttcccagttatcttacatatttataaagtttccttgaactgaaatccaaacgaggactatagaatgcaattagttaatatggctagagttccttagtctataaagagtaaagaactttccattcatattttactctcttttttcttagaattcttaaattaaagaaactagattgtcttcctgagtcttttgtgaaaaatatgattgtgaattttcttgtttatcgcacacaataaatccaccttataaattattgattgaaccaataaaacctatcaaaacaatttaattgaatacacatacaccacacactctagttttttttttatttttaatttttatggttatggaagagttgtacatatttatggggacatttttataaaagcatacaatgtgtaatgatcaaatcaaggtaattgaagtagcctaactttaaatatttatcattttgttgttttgcaaacattccaaaactactactctagttattttgaaatatacaatgcattattgttaactatagttgtcctattgtgctagtgaatactggatcttatgtcttttatctaattgtatttttgtacctatgaatttacctacttctaactcccccttgctctcaactccccttccttgcatttggtaaacattattctactctgtatctccatgagatcaatttttttagctcccgcatttgtatgagcacatgcaatatttgtctttctgtgcctggcttattttagttggcatcatgtcctccagttgtgtctatgctgtttgaaatgacaggatgtcatgcttttttgtggttgaataatattccattgtatgtatgtaccacattttttcattcggttcatacattggtggacactcaggttgatttcataacttggctgttgtgaagagtactacaataaacatggcagtgcacatatctcttctatacactaactttctttcatttgaatatatacccaacagtgagactgctaaattatgttagtgttagttttagttttttgaagaacctccatactattctccagagtggctgtactaacttacgttcccaccaatagtatacaagggttccctcttctccatatccttaccagcattcattattgcctatctttatttatttatatatatatttatatatatatttatatatttttatatatttttatatatacttttatatatttatatatatatttatatatatttttatatatacttttatatatttatatatatatttatatatatttttatatatttatatatatatttatatatatttatatatttatatatatttatatatatttatatatatttatatatatttatatatttatatatatttatatatatttatatatatttatatatttatatatttatatatatttatatatttatatatttatatatttatatatatttatatatatttatatatttatatatatttatatatatttacatatttatatatatttatatatatttacatatttatatatatttatatatttttatatatttatatatatttatatatatatttatatatttatatatatttatatatatatttatatatttttatatatttatatatatatttatatatttttatatatttatatatatttatatatatatttatatatatttacatatatatttatatatatatttatacatatatatatttatacatatatatatttatacatatatatatttattcatatttatatatatttatacatatttatatacatatttatatacatatttatagatatatttatacatattatatatatttttatatatatttatatatatttatatatatttatagatatatttatatatacatttttatatatatttatatacatttttatatatatttatatacatttttatatatttatatatacatttatatatatttatatatacatttacatatatatttacatatttatatatatttatatatatatttatatatatatttcttttttgttttttgttttttagttgttggtttcttttctttcttttatatatgtatatatctatattgcctgttttttcagagagctattttaactggggtgagatatttcattacaattttgatttgcatttctctaatgattagtgacgttgagcatttttccgcataccttttggtcatttgtatgtcttcttgagaattgtctattcagatgtttgctcatttttatttggattatttgggttggggttttgtaccaagttgtttgagctcctcacatgttctggcagttattctcttgtcaggtgggtagttggcaaatgttttcttccattttgtaggttgtcttatcacttgtttgtggttgcctttgctgtgcagacactttttagcttgatgtgatcccatttgaccatttttgctttggttacctgtgcatttggtggcttactcaaaaagtatttacccacacccatgtctggaagcatttccacagtgttttcttgtaatagcttcattggtccaggtcttacattaaattctttaatccgttttgatttgatttttgtagatggtgaggaatagggacatagtgtttggtcttcattatgttgatatgatatgtcacatttattgatttgtctttgttgaaccatccttttatcgcaggaatgattcccatttgatcatgatgaatgatctttttaatatgttgaatttgattcggtagtattttgttgaggatttttgcattcatgttcatcagatatattagtctgaagttttcttttttcgttgtgtatttgtctagttttggcattaggataatcctgatcctgtagaatgagtttggaagtattgtctactccttgattttttagaatagtttgaatagaattggtattaagtcttccttaaatatttggtagaattcaacagtgaagccatcaagtcctggccttttctctggtgagaatctttttattacttcttttatagcattacttattgatttatccatgtttactattatttcatgtttcaatctttgtagttttttatgtccaggaatttatccatttcttccagattttccaaatcgttggcctatagttgataaaaatactctctaatttacctttgaatttctgtggtatctgttttaatattttcttagctctgatttcatatatttggacattctctcttttttcttagcgtggctaaaggtttgttgatttcgtttttattttccaaaaacaagtttttattttgtattttctctcaatttcatttatttctgctctgatctttagtgtttcttttctttgactagttttgggtttagcctgctcttacttttctagttctttaagatgcagttttaggttttttgttgctgctgttgttgttattgttgttttttatacggagccttgctctgtcactgggctggagtgcagtggtatgttcttggctcactgcaacctccgcctcctgggttcacgtgattctcctgcctcagcctcccgagtagctgggactacgggcatgcaccaccacacccagctaattgttgtattttcagtagatacagggtttcgccatgttggccagggtgatctctgtctcttgacctcgtggtctgcccacctcgggctcccaaagtgttttgttttccttttttgatacaggcatttattgttataaactaccatcttagtactgcttttgctgtatcccataggtttcagtatgctgtgtttctactaaatttccttcttaaattatttaattcatccagtagttattcaggagcatgttatttaatttccatgtatttatatagtttccagagttcctcttattgatctcttcatgttttctattttttcatggttcaatcttggtaggaattttatgtcccgggatttttatgtccaataaatgcttattgatttctagtttcattccattgtggtcagaaaagatacctgctatgatttggatttttctgaatttctgagacttgtgtttcggcctaacatatggtctaccctggagaatattttatgtgcccatgagaagaatgtgtattattcagctatcgaatgaaatgttttgtaaatgtctattgatcaatttgttctgtagcgcacattaagtcagatgtgtctttgttaattttctttctaggttttttgtccaatgctgaaagtggtatgttaacttagcattcccaactatcattgtgctggggtctgtttctctctttatctctaataatatttgctttatatatctgagtgatccagcattaggtttatatatatttacagttcttatatcctgttgctgagttgacttctttatcattatataatgaccttctttgtctctttttacagattttgtcttgaaatatattttatctggtataagtacagctctttatgttcttttttggttttcatttgcatggcatatctttttctgttctttcattttcagtctgtgtgttttcgtaggtaaaaatgagttccttataggcagcatatagttgggtctttttaaaaaaaaatttattcagctagtctgccttttatttggagaatgaagtccgtttacactcattgttattattgataggtgaggacttactaccgccatttagttgttttttgttgttgttgtcattttgttagttctctcttcctttttttttttcttcttgtcttcctttctatataagcaattttctggtaatgttttaatttctgtcttttaatttttttgtgtccctgttaaaggtttttgctttgtagttaccatgaagcttgcaaaaaaaaaaaaaaatcttataaccaattattttaaattgattaaagcttaactctggtcacaaagaaaaaacattaaaaaggagaaaactaaattctacgctttatctccatctcctgcagtctgactttttgctatctctgtcttttttactgtctttcaacaaattgttgtagttattattatttttcataggtttgtcttttagtcttcgtactaaagatatgagggctttacatacaattataatattagaatattctgtatttatttgtgtgcttgcttttaccaaggagctttagaccttcaggtaatttcttgctgcacatttgtacccctgtctttcatattgaagaactcccttcagcattccttataagacagatctagtgttgatgaattacctcaggttttgtttgtctgagaaagtctttacttctccacgtttgaagcataactatgctgaatataatgttctagctttgaaagtctttttgttcagcactttaaatatgtcatcccactccctcatggcctataaggtttctgctgagaagtctgctgacaaacatttggacttctttatattttctttgcttattttctcctgctactcttagggtcctctttttgtccttaacctttgagaatttgattattgtatacctctgggtttcatctgcttggtgttgcttgactttcttgtacctggatattcactgggtttgaaaagttgtctgttatttttttgaataaactttctatcccaatctctttctctacttcttcttcaaggccagtgactcttagatttgccgtttttaggttattttctaaatattacaggcatcttttgttcttttttagcttctttttttctctacagactgtattttcaaatagcctctctttgagctcactgattctttcttctgcttcaccaattttgctgttgagacactctgatgcatttttgtgttgttgattgcattcttcagctctgcaatttctgtttgatttttttgttattataatctctttgctagatttatctgatagaattccaaattcctcttctatgttatctccaagtttgttgagttttctcaagacaaccattttgaattgcctgtctgagaggtcacatatctctgtatctctaggattgatcactgatactttatttagtccatttggtgaggtcgtgttttcctagatgttctccttgcatgagggcatttgttaatgtctgattttttttttttataaaggtgctttattgtgtggatagttgttcaatttggtgttcctgtggtcgggggttgtggggaagtaaatccctggaattttctatttagccatcttgttccacctcatatatttcattgttttaagaaaaatgagtagaagttgaaagagttgtataagagctaagtgaaggtcggctggagttattgtcaccaagcactcttctaagttgcttgaaaaatagcacaagcagtgtttcttaactgctcatataggggatctttcttccttgggtaaactcatggttggcattgacattgatttgttgcacttctgagtgaaaaaaaataggcatttaacataaaagagattactcttaggaaatactggatgtgactttagaaagtggtcatggttccttccaaaaatattcattattaaatatagtgttatatttcatttctgaacaaagagatctacgagatctggtctgctctggagaaaaaaaatgacaaaggagagaatttgagggaatctcccagtccgttcgtaactaacataagagtttatgcaaaacaagaattattctaaacaccatggatggtgggccataagccatctcatttatccagacatctctgtggttcagcaaatttcccagttgccctgtgtatagagcttttagggagtggagttattgttgctaaggagaggtcactgtttttaggctgggcaaaactgcattgatccttaggaagaatctagactagacaattggcaataaaagccatttgcatctgggcaacacctttccatcctaccttccccaaagcacactcagcagtagttcctcttaccacttaaataaaaacttcaacatgtggggacaagttttccattaaataagctatttttcctttgttttcaactgcacaataaccatcagaaacacttacctaatatttatttccacgttccatgtaccatgttccatgtgagcatgttacagccactgtccagtttaatatcatatgaatatgaaataccaattccactattgttatcatcattttccagatgaggataccaaacaaatgcaggaaacaatgagagcatgatgagaacttactttagaatacagagctagaattagactcaaagtccattagactctaaaactgatgctgctcctcaggctccgcttagcatttacaaaaaatggcactgtgactgaggaaccttgtgtacatgcatgtgacttcccaggtggcacttaccaacagaccatccttccaaatagctgctccttaaacaccccatcttgagcttagagacacacacaaatggtagtgtctgcactggggaggatgtacctggggcagaagcctgttcagggcctggagtgggctttgtcactttggcaaaagtctgcatgactttgggtccccctaaatgaatggagttcgggggccaggcgaagattcccatgaccctgttgactcctcattccttggggaggggtatgtcagaagagggtcagaactggaccctcacaagtatgggcctggccaggagacggggctttttggctctgagatctcttaaccacttgttataattcttcccacattacaaaggcccacaatgtacccccacaatgaggagagtccctgttgtcccagacagcattattcttcttgtacctttgggcttcatgcatcatttttcaggaggtagatcaagtggaagaaacatttttacagggaaaaagcagaaaaataacaacaaagagctgtgtagccccttaaaagactgtagctgtgaacatttcagacagagttcagagatcctggaaaggaaacagtaagccaaaaaacctctccaaaaattaataataaggacaaagctggttcccctgatccttatgaaggggatgaggagaatggatggtgctctgtgcgcatttagaggtcaagtaggtcaacaaagttctgttttccctgaatggggaccctagcactacggtgctcccatctagctctttccttaaacagttggaaatgagatacttaaagaaactccacccaatggaagtggacatgaggtcacatcgagggtcatggtcacaattgactaaaagggtagggaattgatttgaggatagcatatttcagaccagaaggaagagaattgcttagccggcaggcttttttacttttaaaaaaaaaaaggcttattgactcttagggaccttatctgaaagtgtcatgaccatgtctccctctgcacaggtcacccatctcactaaaaacttcctgctttggggttcaggttggaatgtcagaaatacattagttgatttgaattttgaatacgtgaaaagaaagcatccctcatagattgtaccttcaccgaaatgcaatgatttcctgccccaattgagtgctctccaagaaacgttgatgaaacatttatcagatgtgtggagtgaaggtcgtatgtggcacgcttggacagaaataagctggataaagcaggcagcattctctatgcagttccctaactgatcggcccgttctaggcagcataatcttaagagcaaaagccaggttggtcctgccatgttcgtgtattcatcaataacagcacataaagaagttctttcaacttaggattttatgcagaaacggtgaaatgattaacatcagaaatagcaacaatgccgtgtgatttccaaaattattttatttttctcctggttatacagttagagtgtgaattggagtctccctgtggttaagttgaagttgtgtgactgtatgctgggcaatagaaattgggtgtaaactgtattaatttgtgccaattccagatttagccgtaaatcacctgtgacacccttcacagtctctgttctccatccactgtgaccttggaggccaggttttgaagacacgttattacaagatgaaagagattgcatccctgagtgattcatgatcgtagcattccattgattactctaaaccaagctgcaaatgagcacagagcttctgctggcttaatccccaaaacctggagttgtaaaggacttagtcttcctccataatacaacttaatccacgtctactgaaatagaagtatatttatattctataaagttaacataagcgtaactcgatactatagagagaagttttaatattaatagccaatctgtcattactaaacagctggtgaaaggccaatgaggccgggcacggtggctcatgtctgtaatcccagcactttgggagtccgaggtggggggaccgcttgaggtcaggagttcgagaccagccagaccaacatggtgaaaccccatctctactaaaaatacaaaatttggcaggtgtggtggcgcatgcctgtaatcctagctactgggaaggctgaggcaggagaaccgcttgaacctgggaggcggatgttggagtgagctgagatcgtgccagtgcactccagcctgcaacaaaagtgaaactccatctaaaataataataataataaaataagccaatgaggtctgctgcatcatacctgttctgatttgaataggatgtcccttttccaaaattccccagcatctgcagagtattttattcaggttcaacacaagctggtgaggcatgtaactaccttgtaactagtttcataataattattatcgtctctctgaaaatagtcagcctgctttggacacaggtgctgcactgattttttttttattattatttatttattttttattttttatttttttgagacagagtctcttgctctgtcgcccacgctggagtgcagtggcgtgatctcggctcactgcaagctctgccttctgggttcacgccattctcctgcctcagcctcccgagtagctggaactacaggtgcctacgaccatgcccagctgattgtttgtatttttagtagagacggggtttcaccgtgttagccaggatggtctctatctcctgatctcgtgatccgcccgcctcggcctcccagagtgctgggattacaggtgtgagcgaccgtgcccggccccccactgatttttctgaggatgcctctgtgatgtcatacgatgtgccaatttccatcttatgtcctaaaatggcatcgcctcacttctgagaaatactgtcactctgtagctaactctctgctctaagaactcagcgtccccaagccaacttcccgagttcctcctagcattctctattctttccgccgcacaatgggacatgtggttttattccctgaaaagtcacttctggatggacccagtctgaagatggttctcctgctgtatagaaacatggatgtcgcgaaattgcctattaaacagggaagctattaaacagcctccctgaatttaccagattaggattttagtgaaaaattaccgcctgcccactgcttgtgggtagagtgttcttcagaagaaacattaaggtttaaagactgtaagtcatgaaatgcacgtgacaagatgaatgtcattgtatcatttcccaagccgcgatccccatggttcaccagaacttaaatacagcagttgatatttatagccagtggtataagaccttgtcttcaaggtggtgagtttccgctttgagatgtattccagaatgttacaatgttaaggggtcctaggtgttaatatcaattttataatttttaagacaaagaaagtgaagcgtgtggaaggcgagagaaacactaatggtgtcaagttggtattttagagagaagcagtcatttcattctcagttattacctatgctggttgtgcaaatttaagcaaattattgcactcaataggcgccattttctgtatccatagacagtggggactgtttgactcagtgctgtgcccatctttgcataaaaggcatttttacatttgtgtgcattggtgtgagttgtctgtttcttttgcccattttcatccttttcttgtttcattttctccatgtcttcgaattttcacagtaatttacacagaagtctgcatagtagtctcttagttttttaaaaaatcttctgtttgaatggtgatcctcttgtaatttctcattttctgtctttgtgctttctcccacctttttcttcattaagtggttagctactttttttcttattttcaaaaaatacccttaaaacatatgatttggtttattaattagatctataattattctcttccctaacttattgatttctggtcttccgtaacttactggtttcttacgtttatgaatcctttcttaagcttttttgtttgtttgaatttactgttatttttctaaatttttgagatggagatttaataaacttatttatatttttctattatattgaaatttttcatgctgtgaattttcttctggttctgatttaaatgtgactcttagattctggattttattttattctattattattattattattattattattattttatgacagactctcgctctgtcagccaggctggaatgcagtggtacaattttagcttagtgcaacctctgcctccagggttccagccattctcctgcctcagcttaccgagtagctggtattacaggcacccgccaccatgcctggctaatttttgtatttttagtagagatggggtttcaccatgtttgcctggctggtcttgaactcctgacctcaggtgatctacccacctcggcctcccaaagtgctgggaatacaggcgtgaggcactgggcatggcgccctccatcgttctttttgttttgtttgcatcatagtttgcaaagtgtggttctcctttcctatttagcctctattcccccaaaccattgttttcccaacactgccttctccaattcagcacatgtttttaagtctctttactgtagttaggactctgagcttcctgttctgtctgtcattattttcacttgtatggtggatgtgatttcagttcagtcttggctctccatccctcctcttcttcttctcctgtgtctctagaccctccttattcttgtcaaaagctcaggatgggaaataggaaaatagttctgctagagggtggtatttattttcaaatcacagttatttaactttatagttttgtgtgtgtcaccaaattatggtaaaggatggtatttgtgtggtttattttttcctgtttatctttttttttttgcaatggggtctgactgtgtcacccaggttggagtgcattggtatgatcttgactcactgcgtcttctggctctcaggttcaggtaatccttccacttcagccttctgagcagatgggaccacaggcatgccaccacaatacctgactaatttttgcattttttgtagggatggggttttgccatcttggctaggctgatctcaaactcctgacctcaagagatcctcccgcctcagcctcccaaagtgctggggttactggtgtgagccaccacacccggcctgttcttgtctatctttatagagttggcagaagatgctaggagattccagctgccattgactcagctgcatggaaattgcttttcttttttaatacattcattatatatgattagttattgattattcattttaaaatactttgcatcaaattatttctctttccaggcaggactggctgtctaataggtgcagccctgtgaaaatgaaagttcagggccccttcctaaaaaattgtaaagaacttcaagatggcgaaagtagagcatcacgccagtcacattggctcacacctgtaatcccagcacttcgggaggccgaggtgggtggatctcttgaggtcaggagttcgaaaccaacctggccaacatggtgaaaccccatctctactaaaaatacaaaaatcagccaggtgtagtggtgcgtgcttgtagtcccagctactcgggaggctgaggcaggagaattgcttgaacctgggaggcagaggttgcagtgagcagagatcgtgccacactgcactgcagcctgggggaaagagtgagagtctgtctcaaaaaaagcatcaaaccaggtgcaggaccctttgagtggcatccctgtgtgtacacagtcatacctccaggaaggtggtactggttcaatacttttatatattaagtaactcttgtttaataactttatatgtgttaagttatctaacacagagagagagagaactagagactggaacttaggagagccgaattctattcccaaatgtgtcttggatttatagtctgactttgaactctggagttctgttttcctacttgaaaaatgaaagattttaccctgaattgcgtttcacgaactatcacatatattactgataatacctaaatacattttaatagtggtattaattatatcacataaatagaaaaaaattgaaacacataaactatgctttttctgtatattttttcttagcaggtagttaaggtgagtaataacaaaacaaggtcaattttaaagcactattggagaattataggtgatatttagattttgtaagaattgtgaagattacataaatacatctaaagtttggaaaacgttgctcaggatgatccctaaggacgctttcaagtcctttcagcattttaggattctataattgcatatctttatgcagaattatgcattttttgatttagcaaataggtagatttaaatatataattaaaggtcaacctgttcataccttccagaaagactggggtgagatgaattccatatttttgtgtcatctaccaccacaaattttatttcaatttcatataaaggttaaaaattgagatgtccccatgtacactcaacgccatgtagtactgtgcctcctactacgaagtcagggttgcaaaaagccttcatgtaacattgctgtctatggtaacttgatgtcatgtctttttcatttctggttttcatgtctgttgtatctgacattctaaagaattcaaaatagattgttcttgaaggggatataaatagaagtgatgggccggcatggtggctcacgcctgtaatcccagcactctgggaggccgaggcagatggatcatgacgtcaggagttcaagaccagcctggacaagatggtgaaaccctgtctctactaaaaatacaaaaaattagctgggtgtgatggcgggcacctgtaatccaagctactagggaggctgaggcagagaattgcttgaacccgtgaggcagaggttgcagtgagctgagactgcatcactgcactgcaggctgggcgacagagtgagactccatctgaaaaaaaaaaaaaaatagaagcgataatgctgtacatctgttagccacttggatgctctctgccagattgcacaaaagttcatggtacgcctgctgtcaccagatttgggtattattttttaagaacccagaaattaaaacagataatatgatcctgttgatcaaacagtataatttttaaaaaggtactgtttgttaattttaagaacattccagtagaccgattggaggagaaatgtggtccccctgttaggcttagattttacataaaatttttaaagtgaaatttgattggagaagttgagttttttttccaaaatatgattttcttccattgagattgattggactctataggttcactgcaggagggtgggacattcttacctgttcgtaatacagaattctctgagagaaatatcccttcatctcagtgtctcagtggacattgttggtattcctgagtgttttgacattttggccatttccaaacatttctaggtctttgttattgacctgcctacatttcaattcttggcccttccctctgttttgaaatgactcattcttcacaagagcaaactgaaagctttactgttaagcaaaaaaagaaatcttgagccaaagtattataacttgctctgtaggaaatgaaaacagtgcattggccatcttttcaccctgttgttagagtatattaaattaaaataacacagcaagaaacattagtttccatgattcattttagatttatgttggtgtgtggatttggttggttgtttctttggttagtagaaggtgatgtattaaagtggaggtctggtatagctgatggaaatgagtttttttaaaaaggttatgaaacatctatctccctcttgagcagtagtccaggggagtgatcacatactgagatgaaaacaagagggtggtaatacagcaagtggtgtatgattcagtaactccaccggattgctttattggttaggtaatgaagcacgctagggaatttctatcaaacaggagtcaacatactgcccaataacatctgaaatgactgaactataagtttagggagcatgggatgaggtgtactgttaaatcgctcctatgctggaaagtgttccctaagttcttcccatcactacctggagaagttgatgcgggattactgggagaaggcttgtgacttttaggtcctctcagagctcttcactttgctccatgttgtgtgttgttttcttgttcgtgatttttttttttttttttttttacaatgaaggcattccaatcgggctaatacaaacatgaggcattctcaaactacaggaaattgctttccttaactacactctttgaaaaaaaatggggtttaattacctgctgcttttctattgctcagattcccttcaggatgcagggggagggatgggagagaagtttcctttgtgatttaatgtaattattcataatgactacatatggtcattttataagttcctaattattttaagtgattggtgcatggtcatttgcataggctgtttagcagaaaactcattcagtgacctacatataaatcatggaatagtttctaggcatgtaaagcgggtgagagaaaccaaacccttccccccatcacttatggttccaatgtatgcatcccagaatgtttaatgtaaatcataatagcagcttggatccagtattcttcatacaaatgtgtggttgatgtagggaaacatgtttaatgttttctttcagtagcagatggtacatggatttttatttgatgcaggcactgctttccaaggtaattgtcaagggcttttttccccctatgaaaaaaatggagggaaggcctctggatcaacccattcatttcacagatgagcaaactgagacctcaaatattgagtaattttccctaaatcaccagtttttaaacagagtgagggctaaaattcacatctcctgacagtcagcttaattctcttttcgtcatactgcacattttctcttgatagttgatgtgatatatgtcactttaaaaaaatgagtttccatttctgggtatattttatctactttcctcctcagaaagccaagttctgttgattcatagtaaggaccagatatttcatagtgctaattccaagctgggtataatttgtgacttctaggttacccacttgtgtccacaaaccacctaaattttttaattgtacacagtcaagtcaccttgatagaaggggccttgagagctcatctaattcagtgatttttccaacactggtttcagggctgctgatgtgctattgcatttcacccgagtccacaacaaaataagaagaaaaaaaatcagctctggggagttttgtcctcaagttaaattaattcccattttttttaagttacgtctttatcaaatgttgatgcttaaagagagacattgttggctgcgcacgttggctcacgtctgtaatcccagcactttgggaggccgaggtgggtgaatcacgaggtcacaagttcaagaccagcctggccaatgtggtgaaaccctgtctctactaaaaatacaaaaattagcctggcatggttgggggtgcctgtaatcccagctacttgggaggctgaggcaggagaatcgcttgaaaccagaaggcagaggttgcagttagccaatgttgcaccactgcactctagcctgggtgacagagtgaaactccatctaaaaataaaaaatgaaaaaaaaaaaaagatagtcatcgttgctttcttttattttcatgagaaaacaagaaatgacacatgtatgtcagctttccacaaaatcaccccctgccttccctttccttttatgttcttatgtttttattgtgtttacctgtcagtgaatccaaacattgagaaacattgggataagggaatgttattttctaggaaaccaaagttttaaaatatcatggttactgtattagtccattttcatgctgctgacaaagacatacctgagattgggcaatttacaaaagaaagaggtttattaggcttacatttccacgtggctggggaggcctcacagtcatggcggaaggtgaaaggtatgtctcacatggtggcggacaagagaagagagcttgtgcagggaaactcccattttttaaaccatcatatctgaagagacttattcactatgaagagaacagtgaaggaaagacccacccccgtaattcagtcaactctcactgggttcctcccatgacacttgggaattgtggcagttacaattcaagacgacatgtgagtgggtacacagccaaaccatatcagttactatagtcattttttggcaaaaccaagaaatagcaaacttgagcccgattccttaaaacagataaagcaccctaaccccccactgccaaatcaacactcttccactatatcattttccattttcaataaataactctttcatccactgtaaataacagaatagatgttgtctatgaattcactgcttaatatttcatttatctacttccttctacccttattcatacctatcctaaacacttttcaaaggaactttctctctgtctcttgttaaaaattttctcttgtaattcttaaatatgtacagatgttaccaattggtaagagattcttttttgatgaactttctctcctgggtacacatttatgatcctaaacgccccatgaagatgggcctacatctgccttccaacttcttctatgtccctcagtcataaatatctacattgtttctttgataaattttgggaatgatagaagacaataagttgcatgatgactgcttgtcttgttctttgttaaatgtacctatgtctccaccccctttcttccacatctcaaattggaaatcattgagtactaggagagagaggaaacagggcattccttagtgggaaaacataagatgccacgggcagtctaaatgtcaagatttggactgctggtctaaaaggtttccactctctgggttgctctagtgaagcaaataaatagagtaacacatcgatcctcccacaggtagaaggctctgctgttcgttgttttactactctgcagataggcagcagcagcagcagaatttgttagcaaggatcagtctgagtcgcctatgtttactaaggaatctgtccaaattggccgtgcctttgatggatattgttattcccccataacgctgtccttaggatcctggtaaatctcagaaatctctatacaaagttaccgtttcagagcaatgaatgtgggcaaaggtgaaaatcattatgaagcagagagtggagattattaacaggtggtcgaaagagagagcgagagaaagggggagagagatagagttgctttgttgcgcaataacatgaagataaaacagttaaacacatatatcctgtttcccccagtacaagcctaatgttgctgatttcaggttcctgtgacatcattcatttactgcacctattatattacaatgggggtaaaagaagcactttccattttcatgacagaagaaatgaaacagcaccagcattaacaatagcatactgggcactgtatctgttctccttggttctggaaaggtcctagagatttatgagtaaattggaccattccaactataggcattaaagttctggtgtttccaaaccacgttggctcttggggtccattatacctggttttatgatgtttaaaaatccaatatcatttggtaagaagtaacacaacattatgtctgcaatcatgagctctagaaccactcgacttgagttgctatcccatttctactaactggtagctagctgacttttggaaaggtacttaaactttctgtgtcagtattttcttgtctttgaaatggagatgatgatgatggtgatcacggtgatggtgatagcggtgatggtgatgatgggaatagggatgatgatgatgatgatggtgatgatgaagttgatagtgataaaacccaacacataggcatgttagaaagactataaatatatgccacacccttaaacagcatctagcacgcatttaataaataggtctcattgtgattagcagaacaaatgaaagcagggcgtttctagtctcttctctggtcgtgtccctaagagaaactggaggtgcctaagaatcactggggatactagtcccagagaagagttcctggatcctgttacatgcttcctgaatctgcatagattgtatctagaaacttgcatttttgataaactctgaaaaaggttaaattttgagaattgatggatttgggcaaacgtgaaagccattctgagacagaagaagtagaggctatcaccaggtggtcctgcttaatagatagggagagacagagagctgctatgttgtttaattcagaatggcagggagctgaaacattgcctaattctgaaccagacccctgatgcttaaataggaagcccagataacacccccaattctaactgcagccatgctaactaagataacagctgtctgtattcaaagacacatatatctgtgctttgttgactagtgcctttcgtttctctggccaaagcaaatgtgcttttttggctttaattttgtgcttttcactaattaagttgtttatatgaactaaaatatttatacacccaagataatgaaaataacccatgataaatggaacaaatggagtaaaagtaaagtagatttagtggcaccatagtttattgagcatctgtgattagattgtgttccctaggatgcttcggggagtgtaattcaatctgcagtttgaactgatgactcttcctttctgtagaggtttagagaaaaaaaatgaattcttgtttttaatatctcaagtttctcttcaaatggctacttgttacatcttggggtaggaggggagtcttttaggaaaaagaagaatgggtatattttgttgccatccaggagggagactgggcagaaaattaggctatatttggtagcttataatctaggatgtgtgaagatggggtacggtgactagctgatgcaggtgaatcccagaactggggctcagcttcgaagagttcttagctttgctcaggaaagaattcaaaagtgtgctgatggaggagagccagtttactaggggaaaccgtgcacagcaatatggctgctccatagacacagcagggccaccccacaggccgagtagcactcctggattgttggctagctgtatttctagctacttatcattatatgctattaggttggtgcaaaagtaatggcagtctttgtagttaaaaaaaggtaaaaactgcattgacttttgcattaacctaataaggcgtgagttattcgcaaactttctggaaaagagggagttcccagagccattcatgatggttaatattaggtgttaacttgattggattgaaggatgcctagagagctggtgaactattgtttctgggtatgtgtgtgaaggtgttgtcagaggagataaacacctgagggagcggcctgggagagaaagacccaccctcaatctgtgttggcaccatccaatcagctgccagtacagctcgtataaagcaggtggaagaaggtgggatgagctagtttgctgagtcttccacctttcgtctttctcctgtgctggatacttcttgcccttgaccatcagcctccaggttctttagcctttggaccgctggacttaacaccagtggtttgctagaggctcttgggactttagccacagactgaaggctgcgctgtcagcttccctgcttttaaggtttcgggactcggagtgagtcattactggcttccttgctcttcagtttgcagatggcttatagtgagacttcgtcttgtgatgatgtgagtcaattctccttaataaacttcctttcatatatattaaacacatatatcctattagttctgtccctctggagaaccctaatacaccatctaagataacttctgggcattgtcatggtgtcagtaaactgtcatggtgctggtaggattgtcttatgcagatgtattatcgttcctagtcctactggtttgggccaatttctttgcgacatccagttttgatcaacagggtattgaaaacaagtcttgctgttttcctgcctcataaccatgtctgtttgcccaagactgtcccagttttagcactcagcattgaaaacccagcaccctggaaacaccttagtcctgggccaaccagacgggctggtagtaccaaaagtcagggctacctatttttgtttttcatgcaataagttaaggaagtggtttcctactctaggatagtgcttctcactctttaacagtgataggcattgcctggggatcttgctaaatgcaaattttggttcaataagtctcgggtggggtcggagcatctgcatttctaataggcttccaggtgattcaaaagccgcccttccgtgcacgctacactttaagtaacaagcttctagagggcccggtaatcacctggccggatggttaaagagcaaattcaggataccaacattttttaattctttgcaattacttttttctctccctaaaatttttgccttttaaatcactggagtaggcccgtggacgttcagtttttcctaaaaagactccttttatcttttagataaagtacaaagtaagggtctctagaaagcagtagatgacaaagtagcttttgaaactaaaatctcatgtgagtgactgtataaatagcatacaaaatggaaggatttttcattttcttctggttgtttttctatgtagttggaagttaattcacttcaagtggaaatctggaaactagtttgctatccgtcttgcccctgtttgagtatctctcaagggtatctgacaacagtgtgggaaatcaataaatgtttgttcaataaatgaaaaagtgagaatcatttaattcaatgatacttaaacttgaacatgcacaaaaatcagacggaggacttgttaaaagtgcggattgccattcagtagatctggggattgacctattaagcatttctgatatgctcctaggtgatgttgatgtcttggaacacactgtgaatggcaagaatcaagattgaacatgcaaaaaaaaaaaaaaaaaagtaacgttacatatcatgtattttgccatgcaattaaaatgctgggaagtgtgatgatgattttgtcctttagaacatataaatgggatctacagttgagagagaaccatacaaggctcttggtaatggtcaggcttatgtatttaaggtgtaattgcatctatctttatactagttcctttcccttgggaactgctcagctgaagataaataagcaaaacgggcacatgtgtagcctaatagcaaatataaagattattgagccagtttatagtgactcaataaaattctgcttgtcatgggtaagcaaaagtcagggcccttgaaatttagggtgcagcaaaaggaagcccataattggggtggaggttggggagatggccaggagactcatgtgtccatcaggagacagctaattgggcaggaaaggtgtttctggaccaaactgagggtcacactgctatttctcgtggtctaataatgaggtgcagatgaactggggaggaagagagtttttatttctgtaaccagttacagggagaaggtctggaaaatattgccagaccgactcaaaattacaaagttttccaaagattatataccttctaagttgtatgtctacatgtaagtgtgcattcatctgaagacctaagtggttcatttattgtcatctgtacctaagatctgagtcctgaggaccttcatctggaccttcagtaaatttaatctaaatgggtctaggtgctggggtgattacccttatcttgtctcgtgctaatcatggaggttgggggagttcttttagaccccgcaataaacttgtttgtggaggcctggggagtttcttcagatcccagtaaaacttgtttaatcctaaacaagtcctgttaagaaatccttcagtatcttgtcaggatttaagccccaggaaaggcctgggcacaattctgggtgggctttggttgcatcccagcctttgtagatgggctctggctgcctcagcttttattatttaacttaaccactcagtcagtgccgaaacagtagttgtggaggcctgtgttagtgagacctgatttgccacacagggtcctgttgtgcttctctgggaatttcattgcttggatgttatttgacatttcccttttaacagttaatgttagaaagtccatgttatggcctggcgcagtggctcatgcctataattccagcactttgggaggccgaggtgggcacatcacctgaggtcaggagtttgagaccagcctgaccaatttggcaaaaccctgtctctacttaaaatacaaaagttactcgggcatggtggtgcacacctgtaatcccagatacttgggagggtgaggcaggagaatcgcttgaacctgggtggccgagattgcagtgagttgagattgtgctactgtactccagcctgggtggcagtgagactccgtctcaattaaaaacaaaaaaagtgcatgttatttgatggtttttatattcctttattcatttcggcaaaagccattcccccacgttgttgtaagaatctgattgttagatgatactcttgaagtaggctgacccaaaatatttttcggagacttggctatgaagaattttataaactaacttaagttgcctttcttttaaggagctgacatagtggaattgtgcaaagaagttattttagtttcccttagggttaaatatttattgaagagggaagatggcttcttccacaacaatttttattttctccttttctaatctgttctaaaagtcttttagctgccttgctactaggaaaagggacttactcatttccattgaactcaaaatgttactttgtgtgtgtgtttaatttccccatcacccactctgcagactcaaaacctctgagctagaccatgccttgattttttttttcttttaaatgccatgagttagacatttaaggacaccaaatgattgaaaatagtcgaaaatgttcacttgaccctcattgcctatgacattgctgttagctttctgcatgaaagtgcaaacttcaattttcaggaaggcccacatcccagaactggcattgtttccttagtcattggaagcagaaaactacagcagaagtgttgcctccagccgtacagagaagaacaatctgcaggcacaatctggaaacctttcccagtgaagggagaaagtgagagtggcgttctggccttggaaaaacaaacatttgttattactttcctagggactgaaatttttagctccccagtgcaatctgtgtataatctagatttccagatttcctaaatggaaaacagataaacaaaaatcagccttcttaaattatgtatggtggtaaaataaagtaactgagaaggaaacaggattcctaaaccgaatggactttagcaaaagaatctttcaccattaataatttctccctgaacaaatatgcagatattttaccagacagagaatagagactttgttttggcttatcttgcttaagagtaattctgagaatctattacttgtgagagaataagattcataaggaatgttcgttagagagttgtactgggagattcacaggctacatttctaattttttcctaaagaactccttttacaataaaaaaccatgctgtaagctgcagagtgttgctgaaatgtaagcttttaccattgttgtagatctggcatcttgtttagaacccatagtttcctaatatttgcacgttataacatatgaagctaaactgtatagtacataaaactcatacaattttttttttttcgagatggagtcttgcactgtcaccctggctagagtgcaatgacatgatctcagctcgctgcaacctctgcctcctgggttcaagtgattctccttgcctcaggcatccaagtagctgggattacaggtgcccgccaccatgcccagctaacttgtttgtatttttagtagagatggggtttcactttgttggccaggctggactcaaactcctgacctcttgatccgcccacctcagcctcccaaagtcctgggattacaggcatgagccacccagccctgccaatacatacaaattttaactccagggtaaattgataagacttcttccttcatggaagttaaattctaataggatccctaatgccccatctagccctgcagtatttcaggtcaacaataactctttgctgactgaagatttgactggatggtacacgccctccaatggaactaacaggctcaacagctctaggtgcataaataatcttcatcctacaaataaagaattctaaattggactctaaatattgtatgtggctactgtggaagctaggaagattgattggattaatatcaagtttcacaatgtgttctttcattaggatgtcagtaatgagaatgaactattcattagaacagccaactttctaaagaataagagtgctgacctcacacatgactggggcagaacagggtactgtttacttcatgagagccctagaatgggacgcagtggattgggggccgttccctactctattgccaagtatgtgcatttgccactctgacttcttataggtaaagtattggcagttatgtcctccatagtcaatttcattcttaaaaaggccatgtgtcccaaacattaactgaaaaacaaaaagcgagattcaaagacttctcatatgctgttggtcggagtgtaaattagttcattgtgaaaagcactgtgaaaggcaattcatcaaagatctgaaaactgaataccatttgacctaccagtcccattactgggtttatatgcagaggaatataaattattctaccataaagacccatgcacgtgaatgttcactgcagcattactcacaatagcaaagatatggaatcaacctaaaggcccagcaataacagattggctaaagaaaatgtggtacatctacaccatggaatactatgcagccataaaaaatgagatcctgtcttttgcaggaacatggatggagcttgaggccattttccttagcaaactatgacaggaacaaaaaaacaaatattgcatgttctcacttacaagtgggaattcagtgatttgaacacatggacacacagaggggaacagcagactttggggtctcctggaggatagagggtaggaggagggagaagagcagaaaaaaataacttgggtacttggcttagtacctgggtggtgaaataatctgtaccatccccataacatgagtttacctatgtaatgaacctgtacatgtacctctgagcctaaaataaaagttaaaaaaattctcacttcagttatcacattgaaaggaatacagatcatcagacaatgaagagcaaatcaaattattcctggtatctcttcgaggatgtttacaaggagggaagtctgttaatgaatgctgaaaacatgtgaaattatccttaccatcttgtccattctgcatgcctcacaatgtaccctcctttcttcaaggtttttccctccactgtaaagtctgaagtgtaacacccaagccatgtggagattttcacatcttcgctgccctgttgtcctcagcatctatctccgcctttctccttacagtcacacttggctctttccaacacgaatcactagcctttactttccctgttgtatcttctttactcattgctttagttctaaaccatagaattccaaaagccaagctggaaaaggaggagttaccttttgtgaggtgagaaggggaaaaactgtgggtattcatactcaaaatatttgctagttgcagctctataagaagtcatccagcagcttggagaagtatatggttcacaaagatgattcatccaagaaccagtttgaatatttagatgatttagagtggaattagttagaatagaaatgagtatagaattgccacaggtcacaatataagagaaaaattagcaaattaattaattggatgttgttctatagccagtatttgttttagagatttttatgaagtacttttccttcctgaaagtcattataaagctttgtagtaacctgataatgttgaatatttactttaatgtcatccaaaaaactatagagttttgaaagatggaatgagaaactggtctgtaataaggaaaaaccagaaagactgtaatacatttgcatctttttcaaattcatatgctaactagagctaacaaatgttaaataatttcagaaagtatctttgctgggcctattctgaccagtaaataaaagcatttgaatgagttcaccatcttacatggatagtctgtggagaagaaatggattttaaagagcctgaactagttcccagcaaatttgatcacatcattggttttttaaaacatgtcttttacctacacgcggtaacagatttgtattatatgcgctaaaatgataatattgatattaatgaggtgatattgtcttacatgtattaccaggggagcatctttctgttttttctccctttctttttctattttttctttgtttctttttctctttccttttcatttatatatataaataaatatataaatatatatatatatatatatttttttttttttttgagagaaagtcttgctctgttacccaggctggagtgcaatagcatgatctcagctcactgcaaactccacctcctgggttcaagtgattctcctgcctcagcctcctaagtagctgagattgcaggcacgtctcaccacgtccagctgatttttgtatttttagcagagatggggtttcagcatgattgccaggctggtcttgaactcctgacctcaagtagtatgcctgcttcagcctcccaaagtgctgggattacaggtgtaagccaccgtgcccagcctctttttttccttttaataaaacactggttacaatgtgagaaacagattggagattggacagggagaccagttaggagtctgttccagtagttcaagtgacagctgatgccctcttaaactaaggtattgagggagatgatgggaactaaacagcagattcaagagttctagggcatacaatgaagagaacttggcaataaattgataatgggaattttgagacaaggatgagtgagtccaagttgatttctgcatttagggttggttgactgaatggtggtgccattcacctggatgggaaatgctggaggaatgttggagtagcacacagggctggggtcctgagttctgcactcactaatgggactttgcttgtcctatgatattaagatgcatactatggcggagtgtggtggctcacacctgtaatcccagcactttgggagcctgaggcaggcagatcacaaggtcacgagattgagaccagcctggcgagcatggtgaaagcccatctccactaaaaataaaaaatttggctgggcatggtggcagacgcctgtaatcggagctactcgggaggctaaggcagaagaatcacttgaatccaggagatggaggttgtagtgagctaagattgtgtcactgtactccagcctggtgacagagcgagactccatctcaaaaaaagatgcttattatatatatagttctattgaatatgtatgttagtatatatatctagttctgttgaatatatattattgtgtgtgtgtgtgtgtgtatatatatatagggtataatatgcatatgtaatatatgcattatatataatatgcgtattgtaccctgtatatatatatgcatagaactatatataatatgcaaattataccttgtgtatatgtatatatactatcctatacaatagaactatatatatataatcatactcaatagaactagatatatataggatgtagcaatatgcatagaactatatataatatgcatattataccttatatatgtgtgtgtgtgtgtgtgtatatatatatatatatatatagttctattgaagtatgcactagcttccagcatgtagcctttatattctactgatgccccatcactttggaattacctcttatctttttctctcctgcctttctaatatcaccccaccactgattcccatctgattatgcctacttcactgaagcacccttgtcactcccttcaatgcctaaagtattgctttcttaagtgctatggaagcagagttccttttcttgcagtgaataaactacatcccaaggatctcaccccttgcttccccagtgaatagctctcagatggaaaataaaacagcaccattactctctgagattaagagggacaggtttgcatactcaacaaacattgtctgatggggaataactgccaaatttatcatctcagggtgttggtagttgttattttaatgtaaattttgaatagataatagattaatatgaatcttattttaccaggcagaaaaatggtatacagtgaagagtaatgcttcctccaacctctgcccccaggtaatactgttcttttctccacagacaaatacctggttatctctgggtctgggtattaactgtatctgtgtcttctcccagtcataacatacaatatctctaattcatagaaaatcactacctcttaccaagggaatacttcctgtaacacctttagcagggaacaatatcggataatcccaaagcaagatgttaacgcaaactaaatatgtcctgagaaggactctgtacttctatatttgagtccttgtggatgaactgtaacctagcttaatagacaagactgaaaacctgacttaggagtatgcacctgtaacaatagttgagtcttggccaatcccagccgccatacttcaaccacccatagactgctaagtgttcaaaaaaggcaaacaccaacctgtcaccagttcagctgtttgtgtacctcactgctgatttctgtaagtcatttccctttttctgtctatgaattttctttcaccaccttggctacgctggagtctctgaatctcatgtgattctgggggctgccttctgaatcgttcattgctcaattaaacttctttaaatttaatttggctgaagtttttctttaaccagagggaagaaataaactaatgtagattgcctctaagtgccagccactgtgccagacactttctaaaggtgcatttttaaagaattattttttaaaatttttgtggatatacacatagatgtattgatttatggggtacctgagatacaaaaatattatcttcctcatctacattgaagagctgtcattcaccccaggaggcagtgtggaataagtttctgtgcacctgagactatatcctattgtatatgaagccttcaaccaaaagtgccataaccttggtacagaattgctaccccatccgaagtccataggaacacagcatagaacaaactgaagtctgagaagttcaggtgagatacgtagagctgcagaagaggagtttttcattgtctctgaattggtctttctcagcgacagagttatttatgagatggggcaatcatagaaagcagtggcttttaaaaaacacttcagctgccaaaaatcttattccaattctctggaagagtgctgtcgtaccaagtgtaattcaccagtccggtgcctttctggaagttatgaaattggagagagttgcttttgtacaaatgaataaacaccaccaagatgagcctacccgcttgtcctgagttgagattgatatgatcagacatctagagcttgttctcctgggtgtctctctgaaaaaattctcttctctctcaccttttttttttttttctgttaataagtagacaatgctctggtctgatggggtctcaggaaggaaactggtatctatcttttcttgtcaacatttaccaacaaatatgcctcttatggacagggatagggattacggatcactctcattgtcttatgtgtgcaacttggagtggattgttagctatccagaaaatgtccatccctctttttcttggagaaattcactttttaccacattttgtgattcaaattggtctgtcactgaaattattctgaaaggttaaatgagacccatgagggccgtacaggaggcttccgtgcattttttcctctccttgtccaagtggtgaagaggtaggcacataaactaagcgtggacaatggtactttttcctgggagaaggatgactaaaaagatggcgacacaaaggtatctaattttccgttcatggcaccgttcatgagtcttgattctgtgaatgtccccatatgcccctccaaaaacctctttttttttccttaagttagccagttataggtttgtattatgagtttcatagtgctataaagagctataaagaacttcctggagactgggtattttataaaggaaagaggtttaattgacgcagttccacatggctgggaagtcctctggaaacgtacaatcacggtggaaggcaaaagggaagcaaataccttcttcacagggcagcaagagaacggagcaagagcagagagaactgcgtcataaaaccatcagatctcgccagaagtcactcactatcaggagaacagtgtgccgggaaaggtcgccatgatccaatcacaagcctccctcaacatgtggggattacggttcaagagctgatttgggtggagacggagccaaatcatatcaaggttcggttgcttccaaccatacacgtaacagatatttcactaaatgctattccagaacggatttacacaatttttggaaatagttacagaacacacacagaaaaactgatgatgataagataccccgaaaaacacacctgggtatttctttctgggatgttgtggctgagataccttgatagaaaagccgattttgctgagtaacttctaaggcctccaattctgaaggaagaattaagtgatatgagagtttggaaaataattgaagagacctgcctttgcaggaaataatataggcaggaaaaatcaagaatgccacaaaattgagtaaaagagaacaaaagaagagaaatagaattacctctcaactttgtaaaatagaattgaacccagtaatactggataagatttaaaaatattatggggtaggatcacttctattaaatgtgattagcttttagctagataacattgaatattttaatgtttcattggctattatacaatatatttttttcctctatgaatattgtaaaattcctgtttgatttaggagtcagggatgtttaagtgattatgtagctagtcctcagaccacagttaaaaaggtacttttgttttgttttctggcgttgggaagattagcaacctgggtgctagcatggaaaaggcacaggaggccagttacggtgcctcaggtctgtaatcctagcactttgggaggctaaggcgggtagatcatctgaagtcaggagtttaagactagcctggccaatatggtgaaatcccatctcttcaaaaatacagaaattagctgggcgtggtagtgcacgcctgtaatcccaactactggggaggctgaggcaggagaatcgcttgaacctgggaggcagaggttacagtgagccgagattgtgccattgcactcgagcctgggcaacacgagtgaaactccatctcaaaatataaataaataaaatacaaaatataaggcacagaaaaaaatactgaaataagttgcagactggaatttcttacagatgttgtttctcctcagcatgaacagaggtggccatgccatttctccagataaatagtgcagtacaagagtgttggttggtttcatgtatcaccatataaagttgtattatcagactccatatgatgaagaagccttcacgagaaactcactaccaaagcaaaatcgttttaaattaatgaatgattttcaagtaaaggccccataggattttttatttgtcctcctgttagaatgaatatctgtgaatattaagctcctcacatttcctgttttgttaagaaatttgttcaaaatgaaagtatctccctttagaccaagctaggacggtctactaacagaaccttagaaaggaaacacaatgcaaagtgccaattagcactgcaaagttttggttcagtttcttattttttattttttttgagacggagtctgggtcttgtcacccaggctggagtgcagtggcccgatctcggctcattgcaacctccacctctagggttcaagtgattctcttgccatagcctactgagtagctgggattacaggcacatgacaccacgcccagctaattttttttgtatttttattagagacagggtttcagcgtgttggccagactggtctcaaactcctgacctcaattgatccacccgcctcagcctaccacagtgctgggattacaggcgtgagctaccacgcctggccttggttcagtttttaatgcctaaatgtggtctaaatcttttaggacaagtgtggcctcatgcaacatggattgttggaggcctcatttgtgctcataagcggcattttccttgtggacctcctgttttactccattaggttttgcatacagcagtaccatagaagatggagcacttagaaatggtgggaagcccctgagtcctttgtccatcatgtcagagtgacgatgtttctagaggtcattgctgtctttctttggagactgggagaatagggaagtaaaggaagatgtttaaattccctacttctctcttttttgttagatttttaaataaaactttatttcacaaaagacctattgtcatggcaaccagtcaaacaatgctgatgtatatgaagaaaaccatgaatatattttcactcccattaaaaaaaaaaagtgcaacctaagttttcaggcctcacctttgtatggttaaatatcaggccacaatgacttcctataacaaaattgtgattatagcaaggatgattggctaattactgaaatttacacttctccggttccccagatagtattccagttctttctggcagtcctcaaaacagccatattccatgaaacaaccctcttcgtttctagcctccagttgaccacattcatgtaactgccttcagaagctgctgcttgttgcaattcccatcttgagaatgctcgtatgggttcccaggtgtcacctctgaatgttctcatggctctagtttggggaccccagctccttcttaggttttcttcagagacagggccaatggctctttccccagccctatgctatgatctgtcacctggtccctaaagtagctttgcttgtgctgaatctcactaagtgtctctttcatcttctgcatccaaacctctctctccacaggtggctcaaaatcaatctgaagaactgagtagggggtggatgcaattccttttcattttgaatttctttatcacctttccaagtcccatactctctcaccctatcaaaatcttctccctctgtccctagttataaaatcaaacctcctgggcatgccaatggcagcaggcacctgcagagatgcggaggattcctgaagaatgagtgaagggaggaggcgctgttgatacccccaacccctctggcttccatctgagctcagccagccccttgttaggtaatgaagggagataatggtccagactggttacatttccttcctcaagttacccagcaaactattaaccagtccttgctactaacactctcatcatggcactggcaatatctgaggaccggttcagtgatctgcacaaagggaaattagattcaaacataacaacttgtcctggagtgaaaagcagatgtataatttctctcatttgtccctactttatttaatagcccacatagggagcttatttaaaactcctagaacaacaacacaccaaacaagccaatattctgagatctcattgcatgatcaacatgatgataataactgttttcttctttcatgtaataacacagagagaaaattgtggtgggggggagggaggaggtctaagagagtcagaaatgtccttttctgatcttcaaactgaaagcaagaaagttgattaagacatagctcctgatcatgtcctaagtgtttccatttctttctgacattgttttccatccattcttacggtaaataatctctgtgtgtcaagcctgacattgggtggtagaagcaggtgggtgaacaaggtagatgtggcttctagcttcatggggcttagagtctagtgggagacaggcattgatcaaattaataatgacaatccttagtatgtgctgtgaagggaagttacactgatgagcatgatagatgcgaatcacagagattctcaagtaaatggcagttaaggacagagctgaatgacaggtaggggacaaagaggctaagggggaagggctcctccaagcacagggagcagcatgtggaaggtcttggaaacctgaggaagtgaagtgaaaagtccttcagtctggaaccctgggggagaggtggggctagagttgaggttggatagaagcagcacatcaaggggtttgggtttatgtcctgtgagtgtttctggaaaggggtcctgatccagacgccaagagagggttcttggaccttgcacagaaaagaatttggggcgagtccatagagtaaaatgaaagcaagttttttaagaaaatacaggaataaaagaatggctgttctacaggcagagcagtggtatgggccgcccagctgctcatccttatcattacttcttgattatatgctaaacaagggatggattattcatagtttttcccggaaagcggtaggcaatgactagaactgagggtttctccccatttccgaccatatagcgtaacttccgggtgttgctacagcatttgtaaactgtcatggcgctggtgagagtgctgttgagcatgcaagtgctttataattagcatatagtgaagagtgaggatgaccagagatcactctcattgccatcttggttttggtgggttttggccgacttctttgccacttgctattttattttctaggtctttgtgccccgtattgtgtgctgaactcctgtctcatcctgtgactaagattgcctaaccttctgggaatgcagcccagtagatctcagccttactttacctaaccccttttcaagatggagtcactctggttcaaacacctctgacattcgcagtggaatccattaaaagatgttaaggagatatgattatatttctaaattgtcactccagcatcccctacgccagacattatgccagtctctatccatacagtatctcatttaatcctcccgtcattaatctcattttaccaatgagtaaacttgaagcaaatgagtgactttctcaaggctacctacttacgccttaccagggccaggattcaaacctagacttgttcagcgacagaacacacacttaaccattacccactcttctctctggtccccagcaaaaagtctatagtttgcagccaaacctcattctctaattccaactacctaatagtttgctcttaatagttactttaagaggaaaagcttaattctcacaacatttgtcaacactcagtctgtttgaatgggtataatttaaaaaataatttacttccactgaaggaaagaaaggactgtcttgagaagtaagaaacttgaagatctttaagagtattaatattaaggttggcaaatcctttgagaagagtttctttctgcctattgtaccatttaaaaataatcggccaggagcaatggctcatgcgtgtcccagcacttttggaggctgaggcaggaggattgcttgagctgaggagttcgagaccagcctgtgcaacatgaggagaccccgtctctacaaaatttttatttttaattaggtaggtgtggtgatgctcacttgtaatcccagctcctttggagactgaggtgaggattgcttcagtactggagttcaagaccgtagtaagctatgatcacactattgcactcgcacttgagccacagggtaagaccttgttgcaatcaatcattcagtcaacaatcattgtgtcatgtctgcctgcctgttgaaaaagccttttagatgaaagtcaatcttcggttttgttgttgccagactggccccttcatgtaattttttttttttttttttaaagaaacagggtcttgttggccgggtgtggtggcttatgcctgtaatctcagtactttgggaagccaaggcggacagatcacaggatcaggagatgaagaccatcctggctaacacagtgaaaccccgtctctactaaaaatacaaaaattagccaggcgtggtggcgggcacctgtagtcccagctgcttgggaggctgaggcaggagaatggcgtgaacccgggaggtggagcttgcagtgagctgagactgcaccactgcactccagcctgggtgacagagcaagactgtctcaaaaaaaaaaaaaaaaggaagaaaagaaacagggtgttgttctgttacccaggttggactgcagtgatgcaatcatatctcactgcagtctcaaactcctgggctcaaacagtcctcccacttcaccctcccaagtagttgggactaaaggtaaataccaccatgcctagctgttttttttgtattttttggagagatggggtcttaactgagttgcccagggtggtctcatactcctgtgctcaagcgatcccactgcctctgcctcccaaagtgctgagatggcaggtgcgagtcaccatgctcagcctctttgacataatttttgcaaatcaatgaattggacttgacatctaggtgactgtggatacagaactgatgtattaacctttgacatggctgcaacctgctgagtaaaggctgatcccttgactggacctgttatacatcactgtccacttgattaggtgcaaggaactttgttgcagagattttaaagtggaatcagacacccaggtaacatacttctgaccaccttaatgtgtcatagcttcaaacacatttaaccaaagcccctctcccatgtacgaggaccctgcttacctgttagctgcgtgtgtcacccttctttagtgtctcatggtagaaataattcagttttaaaattaacttttagctggacgcagtggctcatgcctgtaatcccaacgctttgtgaggcagaggcaggcagattggttgaggtcaagagttcgagaccagcctggccagcatggtgaaaccctttctttgcttaaaaaaaaaaaaaaaaaaaaaaatttaactggatttggtggcgcatgcgtgtaattgcagctactcgggaggctgaggcaagagaatcacttgaacccaggaggaggttgcagtgagctgagattgcaccactgcactccagcctgggcgacagagccaaactctgtctcaaagaaaaaaaaaacaaacaaaaaaaactaccaacagtctacatgaaggttgtgtgtgttaagtacatctgttaaacttctaagtttctgacaaaaaccttattaactataactcaagaattcatgaagtcccctgtgaatgtgactcatatcagacaggagatcccaagcccttcatgaaggcttgcctcataccctgttcctgggccattgcccaaaaatctactgtgtctctctgttgggcttcagaatgagatgatctggttttaaacgcaggcctgccatcctcaagctaaatgagcatgggttagtggctaaactttttgtgtctgctctcctatatctcacatgggcataaaactatcttagatgtcatgatgtaattgcattattgtttcagattttccacccctccctctatggaagcccttttctaggttcctctggtagagtaccaggcatatggcttcctgccacagggatcctgctgttggtcctgtgacagtttggccaacgaaatgttagcagacatgatacaagcagaggctttagaagtaggtgcttgtgtagctggattcacctgtgtgtgcgtctttcattactatgagaatcatggtttctaaatgggtgtgacatacggagctcacctcacccatcccacaagtgggacttaaaccaagtttagaagaaatgaacttcatctgacgtacagatccatgagtggccaaaaagaaaaaaaaaatattattgaatgccagtgagagttttatgagtgagtaaatgccagtgaggtttgttatgtagttactaaagtggcaataatacaagctgttgtaagatttaaactctagttcccttttttcttctaaagttgctatggcactctcatttaacctctagtagggcatgtatcactcagcacctgtgatgaatagctgctattattcatttttccccccttcttctggtaaagccccttagtgtttctctagagaagtcctctcttccaccctcagtctgtgtcatcagatagaaaaagccccaagcttcacaagggggagtgtgatcgaggcctggccactgatgccatttcatcctcctggcctccctgactggtccgtgcctgggcatatcgcccaactcagtccaatgagattaaatctcaggaatttacatggaattctttggaaagagactcgatttcctctgggcatgctgaactgatagaatgaagtcgaaattttggtagccacctctccatgggttgaaaggcacctgtctgagaatcaaacttgacacagaggaaaataaaggtaagtaacagagatggactatcaacggcattgtataagcgacttgaatgagttctgtctgaatccaaacaccacagacttccggtttcaggatccaacaatttccatgtgggctatggcagtttgtatcatatatttgacccctgtgagccttgtacactggagtgtcctaacattctgtttatttccgtatagaaatcgtcttcattcctgtggttggcaatcctgcatcatttaactttgtgtctcccagtggaaatggcatagtcccttgtacatagcaggtgctcacttaggtttgaattattgcttagatgaataaataatattggtctacagtgaacacacacacacatcctttaacatggctgtagagtttaagttgcaaaaggtcatcttcagaaaccaaaaggtaggccgggcatggtggctgaggccagtacttagggaggcccaggcgggcggatcacctgaggtcgggagtttgagaccagcctgaccagcatggagaaaacccatctctactaaaaatacaaaattagccgggcctgttggcgtgtatgcctgtaatcccagctactcgggaggctgaggcaggagaattgcttgaacctgggaagcggaggttgcagtgagccaggatcaaggcattgcattccagcctgggcaacaagagtgaaactctgactcaaaaaaaaaaaaaaaaaaaaaaaaaataacaacaccaaaaggtatatagtataacaggtattaaaatctatttcaaagaaaggaacttgttgattacgacactggtaatttacagaagagcaagcatttgaatccagccctctgattccagtgtaacctacaatgtaagtgctttcctcaagcataccttacagagctctgcacatcagggagactgttcctgcagaggtgatgtcatctggtattttcactcatcctctggctgtgtccccacccaaatcacatcttgaattgtagttcccataatccccatatgtcatgggaggcacccaataggaagtaaaattgaatcgtggggcttgatttttcctttccttttctcataatagtgagtaagtctcatgaaatctgatggttttataaaggacacactgtctcttgcctgccgccatataagacatacctttgcttctccttcaccttccatcgtgattgtgaggcctccccagccatgtgcaactgtgagtcgattaaaccttttcttctttataaattgtccagtctcaggtatttcttcatagcattatgaaaatagactaatacgtcctcttaatcatcaaataatcttttgattccctaatggatagataggattgttcaggtaactgtgataggcccaacacagtggctcctataatcccagcattttgggaggctggggaggaaaaatcagttgaggccaggagttcgacaccagcatgggaaagatagaaaaaccgtctctacagaaaaagtttttaaaaagtaactgggtatggtggcgtgcacctatagtctcagctacttgggatggtgaggcaggaagattttttgagcccgggagttagaggctgctgcaagccatgatcacactactacagtccagcctgagtgacagagcaagaccctgtctccaaaaaaaaaacaagcaaaacaaacaaacaaaaaccgaaaactgcagtgcattctcattcttagaagattttttaagagcctctataggcctcaaatcgatgctaagtcagagacttattactgcaaaaggcctgtgaatgagcacagataaatggaccattggtacttccaaagaagccatgtagaagttaattatttttgacccatagtgttgctgtttttcatcctttgtcatccttagcagtttggaccatacatttcatgcacaatggttgaatgataattaaagctaccagttattgaatttgtattatgtgttatatacagttacttgtaagggagtcttagggttattatcacttaattcttaaccctacaaaacagattcctatatatttccagtgtgagaaacacatctcagaaatgttaaagtatcaagccactacaccattaaaaaacaatagtgatgagattcagtgccaggtttatctgcccatgttcatgatctctttgctggaaggcactcctggatttggctagaagtccagtcatggcctctacccttgtagctgttttaaatatggtgtctctttacatctaaccagggctatcacctgggtctgtggtgctttcctctcttccctattactaagttttgctacctgacatgttttgtccccaaattggaaaactagtctagtctttgatactgttttattttaaaaaatttcattgaggtgtattccacataactgatatcaattatttttaagtgaacaattcagtggcacatagtgcattaatgttgtgcaactaccacctttatctagttccaaaacattttcattatcccaaaaagaaatcccatgcctattaatcagatgcttttcatttctctctccccccaaccgctggtaaccactggtcggtctgtcacaatggatgtgtccgtttatgatatcttacataaatcgtacaacacgtggcctttttcatctgacttctttcagcataatgtttgcaagattaattcacatgatagcctgtatcagtgcttcatcaatttttatggctgaataatattccactgtagaaatgaaccaattttttcattgatagacatttgggttgtttccattttctagctgttgtgaatgatgctgttatgaacatgaaggtgcaggcacttgtctgttttcaatttttgtgggtatatacctaggcatgaaattgctaggtcatatggtttaaccctttgaggaaactctgtttttcacagctctagtttctgatgtgattgcctctactgtttggggatggatgatacttcgctgacataccttctacatgaccaaatagggagcatggttgtatagacttgacaagtgatcatcatactgagactactgccagtgaaatggttgcgtgtgatttttctgcagctactgggggagacagactgagaaaggatacagggaagcaaaacgggagctcgtgtgccaagtcgaggcattgtaagaggggagaatgatggatggttggatgacagtcagtttgaaatgctggtatggcagatttcccttgagtatcaatgctcagtagtcccactttctgccttttccattctatcaccattattctttgttggacatgcacattcttcaatgcctgttgactctcagccattctgtggtctgttactgtcacttgcaagaatttggctgtcaggggagatgccagcaagtcttttaaaagccactgcaaactttcattgctaacttgtaacttggaggaactttcagagaaagggttataaataaaacacatgcatcaatctgagtttcacaacaggaatgcaattccacttcgtggctagagataaaacatgtcttgccgtgcacagtgagctcttcgccgtgcttgcattttatttcccatcacaatctaagttatggcagatgaagctgctcataaggtatgaggttagacaaccccatgctaattcacttttacacgctatggtgtgtttttaaagatccaagctctgctttcttcagcaactcaggcttgaaggaagggagaggggtggaaaagaacccagaagaacctatgggacaagcgcgagtatggtctgactctccaaccaggttaagccttttgagagcaatagctgaatcttagatctctttgtgccttaaaatgcctggaacagtgattcacataaagggcatgcattaatattaacaagtgcgtgctgctgcagcagaggatagttctgataaccattagagttcatggacaaaaaacgatgatccctaacagcttctcaacgtgtagatactttgcttagtactgtatgtgcattattctgatgtcatgtttgttattggcatgtgtgttgaatacaattatttccattttacagatgggagactgagcatcagagggtcatagccattttatgaagcctgtatttgatagaagccaggaccatctcagccccaaagtgattagggagcctgtgttccttcttaagcattaagcattctacttcactgacctcttggcccatctgaaattgttttgttttcttttttttttttcttttttttccccagaaagagtcttgctctgtcaccgtggctggagtgcaatggcatgatcttgactcactgcaacctccacctcttggattcaagtgattctcctgcctcagcctcccaagtagctagtattatatatgtgcgccaccacacctggctaatttttgtatttttaatagagatggggttttgccatgttggccacgctagtctcaaactactggtctcaggtcatctgtatgcctcagtctcccaaagtgctggtattacaggagggagccactgtgtctggccaccacatgaaattcttataagggagtatattatcttcttccttccttgaatattccaccagttttcctcccttgattttgaatctccctattcttgatttcttagggtcagtggaaatcattcttcttccctttttcattcatttgttcattcattcattcaatatttaccaccaattgaaattttgaatgttaaatatcagccactgttctagttgttgcagataggaaaactaataataggagattcctacctctggggacctagccaggtaatcagagaaatagagggctctgtgctgtgggctggggttgaggggattacagattgctgcaaaaaggagcatgctggagttacacgtaagaaatcagtgtaagaaacggtgtcctggaagaggtggcatctggtccaaatcttgaaggatgggtatgagctggccccatgaatgaaagtgtggagaaagtgtagagttctccattatctggatttccatatctttgtctacaccttgtattttgtagtaatggaatggtgaagaggagtttccagaatgtaaatagttatttggctaggcgctgttgctggcgcctgtaatcccagcactttgggaggccagggcgggtggatcacctgaggtcaggagttcgagaccagtctggccaacatggcgaaactccatctccactaaaaatacaaaaattagccagatgtggtggttggtacctgtaatcccggctactcatggaggctgcggtaggagagtcacttgaaccagagaggcacaggttgcattgagctgagatcatgctacagcatgctccaatctgggcaacagagcgagattccatgtcaaagactgtaaacagttatcttactgtcaaggcaactcaagatgttctattgctttaaatagaaaatggtagtggtgttttgtagtaaattctatatttcattttttaaaaattaacatgttgagtatatctcctatttttcttaataataatcataataaatactaatacaagtctgtaagttaaaggtgtgctgttttgtcaacagattactctgaagagaaaatccattccttatcaaaagaggttcttggattcatcactcactaccttgaaataataatgtttttcttgtatatactctctgttttacttttctttgaaaaagtccaaaagctttctttaaaaacttttctggaagaaaacatttaaaaggaattaaatatatttttaaatttgtaataacatgtcaaagataatacatgtggattggaaagaaacactattaacatttcaaaagtgaaataattgaaagtggtattgttgggttcctgccatcttccctagaggcaaccattggtacatgattaagtgcatccttctacactgaggatttcttttttctttctttcttggtttttttttttttttttttttttttttttttgagacggcgtctggctctgtcacccaggctggaatgcagtggcatgatctttgctcactgcaacccctgtcaccctggttcaaacaattctcctgcctcagcctcccaagtagctaggattaacaacctcactcagcacccttggcgttgctggtcagatgatcctttcttgtgggggggctgacgtgttttgggaggctgcttagcaattaacctcactgccctctagctactagataccaatgccacaccccttccctactctagatgccaaaaatgtctgtagatattgcccatgttcccctggggacaaaaatggctggtgttgagaatcagtcttctagatatttttaaatacacacttaaaattcacgaattaacggaaaagccagagattattcagcaaggcagggatgatttgaaaagggaaaggaaaaataacgacaggaaaagggagttgtgtgtttagaacaaacaagctgagaacacaaaatgaatctcactttttgaacagtcttttgatattgaaggtccaggtacctacgcacgtgtgaagcatttttgagttccattttctcttccttttagaaactgcaacatcctctccctgggagtgggtatttattcaccgcttcactgcagaaagcaggagtcttggataggtaacacaaggaaagaacctagtagcagatgaagaggaaagggagggaggcagggcagtcgatgccagggacacgtgtaacggggtcctgaagacacgcagctaatgaaaggtaagggtggagacagaggcagcgatcctgcacaggaacttgcatcttccatccggaaggaggaatgaatatccttggggagccttctgatgtaggtggcagcaagactttaggaatcgtgtgactttaaattcaaatcctggttgtaccgcagggtgctcatcctttaacgatacgagtttccatgtctgcaaaaatgttgaaccttctttacattttgggtaggccgaccacatcgtggtgatgtgcagaggtggtccacgttcattgcccaggtcccccacgttcattgcccaggtctcccgctagctgtttatttcatcttggtcatgccgtctcacttctccctaccccagttttctcatctggagaagacaggactcatcgtcgccacgtaggttgtatgtattgagtcagtcgacgcatgtaagagcttagaacagactgagtgtggtgccttgtacctgtaatcccagcactttggggaggccgaagcgagaaaatcgtttgagtccaggagttcaagaccagcctaggcaacatggggagacccccttcttatttacagaaaaagggaggggtgcttagaacactgcctggtacatagtaaatactccagagttgctcgctgggatcattagcactcaagtaattcccatgggttgttaagaggcttagagatgagaaaataacctagaacagtgcctggtatacaataagcgttccataagtggcagtgtgggcacagtcttccgggcatacgtgcttgcgggcatgcgtgctctcacgtgctctattcctcctctctttggtccctctccctcttgacattttcctttcttttttttaaaaaccttcctttttttctttgtttgctaccagcctaagagctcaggagagaggactaaccctaagaccaggtgatttatttttctcacgctcatttctctttaataattatcatattgactctgaatttattatactacaagaatgactttatgtgaaatctcatgaatttaaacattaatgtaagataaattaattttaaattgaaatcctcaaacgcagttggatgtgtttccgtatgatgaataagaaattttccgaataaaatctgaatctctgatgttccattttttgtgcaaatggaagaaataggtgaggatatttgacaaggttaaaatatgattgcactgcaatagataggccatgctgtaaactaactttttagtctggggagaaagcagtttgggggcaggctttggtggataaaaagtgaagatttctttgcacatacttaccgagtctcttagtgtcctttaatctaacaccagtgaatataagatataccatcctaaagaggacactattttttacatttttaaaaataaatccattgtattagaggtgtgtttttttttttcttcaactactttaatctcattttctcctaaagttcttctcttcaatatgatctgcaaagggttgaaagtgctgtcctccaaaccaggcgtaagaaagtggttacagataaagcaagtaaatccattaaagaagaaatgggaagatgtgttgtgtgccttatctgacccagcattatcgctggaggggaagtgcttatagggaaggaagagaagtttggtcaattgatgcagtctcagtatgatgacagctggtgacttcctgagggttattcatcacacttcagcagggtgatgttttcaaagcctgagtgtgaccatgtcactcctctgttctccagcgctttcaaaataaaactgaaatccgtctcagagggccagtctcagagtatcccctgccagccccatccttcactgctcagcagtcacctccttccccctcctcacccttttgaggtctcttctgatccttcaggggccagcttctctccgtcccatggttgtttgcccatgctgatcccctacatggatctccggtcacctccatcactcttacctggttagtctttccctggcctttatcccaggtcagcttcgcttctgcaggaatgcctgccttgaaacctcaggtccttctgttccccctcttagagcactgggctattctcctgggaggcagtaattccagtagtaatttgcatacatttgtaagcagttttgattaatgcctgttgtttccactagactctatgctctgtaggggacaaatcttgtctgctttttgctcatcaatttttccccagcacagagctcaatactggcactggtaaacccttgagaaaatgattaaaagcctctaagatgcatgcagttatgaagaaccaacagaaggtacaggtggcatgggacagcagtcaggaagcaatttggcttaaggaggaaggccagtgactcacagatggagtctcagcacttcccttgcccgtagaagtgagaaacaatacaggtagtcacagcatagtaaaaatttcaggccaggcacagtggctcacagctgtaatcccagcactttgggaggctgatgtgggtgggtcacaaggtgaagagatcaggagcatcgtggccaacatgatgaaaccccatctctactcaaaatacaaaaattaactgggcatggtgacacaggcctttagacccagctactcaggagactgaggcaggagaatcacttgaacccaggaggaagaggttgcagtcagtcgacatcacgccattgcactccagcctggcaacagagcgagacgtgtctttaaaaaaaaaaaaaatcagatagcagtttcatatgactagaggctgtgggctgatcagatcctgaaaaaccgggcatggaccaagctggctaagaccaagtggacccaacatggtgctgaatttgacctaggattcacctaggacctcatgatgtgtttgttaacatcctaagtcactgtgacttgggatgttaatgagtgacttaccatgttaatgagcatatcacgaggtcctaggtgaccagcaccatgaattccgagaatacctacgtttggtgtaaaaatggatggcatcacaattctaagaaatttccaccctttcccaggaattttcataagtattccaccccttggctaaagaaacacataaaggtagcagccccaaatccccttaggcatggtgctctcttgagtccgcctacactccccctttcttgagtgtgtacttttcccgttgttataaatctctgtacttccactgttgcctgactcatccttgaattccttcttgagacggtgtcaagagcctggacacctgccgggatcagggtcccaccagcatttggggacctccccaagcccactagtatcagtagagtccctataggtaattgtctaataagtggaaggtgggtgtagaagtttcaagaaaccaaagaaatgtcagatgtgtcatttgacccaaaagaaaagcattttaaaggaagttaatgaaatgcagtcagaaaaaaaaaaaaaatagcataaaaggagaaatctgagaagttctacttttaggaatttaatctacataaatacatatataaggaggcaagaatatgtgaggaagtaaattcaatgtgtacacacacatacatacacagacacacatagatatatagaacgattgtaaaaggctatttgtagatttcttgggtaagttttgggtctgtccatgcaatgaaataccactcaaccattaaaaaaaaaaaaaacaaaaaaacgttaacttataggtacttagtatgacaaaataagtaccattagttaaacaaaaacaggtatttgcataatcatgtgagtaatatgaatgtattttcttttttcttttgtttttttaagacggagtctcgctctgtcacccatacggcagtgcaggggcgtgatcttggctcactacaacctccgtctcctgggttcaagagattcttctgtctcagcctcctgagtagctggaattacaggcacctgccacaacacccagctaatttttgcatttgtagtagaaataggatttcgccacgttggccaggctggtatcgaattcttgaccttaggagatctgcctgccttggcctcccaaagtgctgggattacaggtgtaaaccaccatgcccagccctttatttttattttattttttttatttttttgagatggagttttgctcttgttgcccaggctggagtgcagtggtgcagtctcagctctctgccacctccgccttctgggttcaagtgattctcatgcctcagcctcccaagtaactaggattacaggcacacaccaccaagcctggctaatttttgtatttttaatggagacaaggttttaccatgttggccaggctggtcttgaattcctgacctcaggtgatctgcccacctaagcctcccaaagtgctgggattacaggtgtgagccaccatgcctggctgaatgtattttcttaatgtgtgtgaagacatcagtatctaagaaaagattgtgcattctgatatacacaacagggaaagtctaaaataatacagaactattattcctggttagttcctaacattgtttcataagaaaatattccactttttttttccagtttatctttgaattttactaacgggaagtaataatagatcaatgaagaaaaatgtcacagggaccgtaagaggaagaccttagaaaaataagcaggataaaagcatcctctatgccaggagttctcaactgagactgttttgttcccccaggggacagctggcaatatctggaggcattctggtttgtcagaatggggtggggaaattgatgttgacatctagttggtagaggccaagggttctgctaaacataccacagtatatagaacagctcttacacaaagacttccccaagccaaaatagcaacagtgtcttggttaagaaacgttgctctatcatggttaaaatatggttctctactctttgcattctggtaattttaggaggatgacgtcctctgttgagatggtaaggggtcgagagagtcatccagataaaatcggtgttgactttacaatatctgaatcactcataaaattattcaagatagtaactctcccacctcctggtcaggttgacatttcagcaaccaggtagaattggtcatatagcctgttgtgaatccatggatattttatttaattgcgatatgtaaagttctccaaatgtggatgccatagaaccttcggatttaccatctaagccttttcccaattgatctcactctttttgctctaatcaaatgtacctcaacctccatctaaagtaaagctggatagattcatactactccattatcactaaggttcattttatttgcaagcggttttgctcattataatttcattagcatatttggaggtggggaatgagagaggagacaacacagcttagtcttaccttaaaccttggcttgacttggtcgaattttaactctattcttggctcacccaggtcttatagtccaagatgtaaatttacagaaacaacttcttggactctcctgttttttccaatgtcttattagatgatacgtattttctagattttactgagttaacatattttagttgtgttacctatgcaaaaaacaggaatactctgaaacatatttaaccacataattatacctcagcaaaccctccaaccaaatgcccattatatatcatttacttagcctaatatatttccctttttgaatataagagatttcacctctgaacattacatctaaagatgggcaactgtttaattatttgagtaactcaaaaatattttcaacaagagccagggctgtgggaagtgtcctcaaatggaagggttttaagcattttttttaatacaaagatgataacttgcaaccagttctattatttttaactctttgccccttcctccatctcttgggtttgagaagagctggatctttgggcaattatttattccatttccacatctttgggaaggagggacagtgggaagaacaagacccagcacttggggaatttttatgattatctccagctgtgaatgctagggagcatcatttatgcagtgaaagaagtaggaaaagcaatgtcttacttctgacgaagaacttacagttctctctaaaggggtggaataaaattgctattgcaaaaacgggaagatgttgctaatgggaatataccgaatggtatcactaattaaataaagtactttggaattcattgacagcctgcacttaagaatataattgcatattaatcaaccatttgtagacaaaactgaatgctatttattatgttaggataaaactttttcctgatatttcaaagcctgcgattcaactttgttcctaaattcatcttcagaaatgaatacactgtatttgtatgtgaggagcccaagtgaataaataagcaggagtttctgaagggaacaacacagtgggatttatcttgaaaagagcaattgctgacatatgtcacatgtcattaccagagagttggagacagtgttactcattatgtggttacagagtgttctaaattagagaaatggattattggtagtggatgatttccccagattgctacttaatagtgactgaggggtctgcattactcatatttgcgatgaaaatggtgccaaaacccagcagtggttgactgaaatgaaatgtaacacctattgggtattatcttgagatgctgcctaattgtatgcctcttgcttagtatgaatgtcttggggtctcaggggctgggtgcttgcagcagccgcagacggaaagtgaaggtttctaagttatttacctttttgttgcttcctgcctccttgctgccatgcctgtgcacttcagtaattactttacccactcaaaataagtttctccacttgccctttttccattactgggaagggtctatctttgcagctctctgtaactgtccctacctgtttgagctgccaggcttgtgctcctaggtgagcagcccagctactgttttcattcatttattgattaaatagttaagaatcccaactacgtatcaaagcctgtgctagaccttggttctggattgacaggcgaactagtgtatctgcatttctgcagctttcaatctctggggagacagatattaaaaatacagtcacacaaattgatatgtaactcctgctcctcatttaccactaatgttctaactcagcactagtcctacaggcctcttttctcttattcaaatatttcaggctcttttccacctcatggtctttgaactcactcctctttctggaaggctttttctgtggcactttccttttttttcaagtcttgtattttattttattttattttatttttatttatttatttactgagacggggtctttttctgtcacccagggtggagtgcagtggtaaaatctcggctcattacaacctccgcctcccagattgaagagattctcctgcctcagcctcctgagtacctgcgactataggctcccaacaccatgcctggctaattttttgtatttttagtagagacagggtttcaccatgttggttccgctgttctcaaactcctgacctcaggtgatcaacctgcctcggcttcccaaagtgttggggttacaggtgtgaaccactgctcccagcctcaagctttattttagctcccaccttctcagggagaccctccttgacttcccagactggaatgccagcctggccagctactctctgacagtctgaccgatcatttcctccactgcacttatacacctgttagtatgttgttaaagttacatgtcacagggcagagattttgtcttcctcatgtcttcccattggcacctagaattgactggatgccaaatagacatttgttgtgaccagagaaagactctagatgctatggaatattaaaacaaaaagaattaatttggatgggaaggttcattgaaggtctctgtgaaggactagcattgaggttgatgggtaggtaggaattagataggaagagagatggaaaggagtggtgcagactgaggagacagcgtgggcacagcttgaggaggagaggaacctggcaaggttgatcaatccacagatgagtgtgtccagagtgatgtgacaaggggctagagacatcagccttggaggcacagtagggtttggactgggttgtgagtacactgggaagccattggaggaatttaaaggttgggggtacctgatccaataaatatttttttttctatttttatttttttgaggcggagtctccctctttcgcccgggctggtgtgcagtggtgtgatctcatcccactcggctcaccacaacctccgcctccccagttcaagtgattgtcctgcctcagcctcccaggtagctgggattacaggtgcccgctagcacgccccattagtttttatattttttagtagagatgggggtttcaccacgttggccaggctggtctcaaactcccaaccttaagtgatccacccacctcggcctcccaaatttgctgggattgcaggcatgaggcaccacgcctggccctgatccaaaaaatattttaataagatctcttgggctattgggagaacacttgtttgggaggggaagcgtcaatggatgcctatagccttgcctggtacagagaaagtactcagtaactgtttattgatgaatgaatgaatgaatgaatgaatcagttaattaattaacaggagatatcagtaagtgatttgttcttaaaaagaaaccttgcagaaacttgaaggtgtttgtttgggatgactaagcaagggtagacagattgttgttactcataaatgtcaaaataagaattataaaatttagaataatattgttgtcatgctaagtgatatctggagttaagcgtcctctctgacctgcgactgctcgtgagacagttgcatttactcaggtaactgtggctctcagagtcattcttaaatgttttctttttctccccaatgtgtttgtgactttgtccatctggaagtcaagttcattttggccaattaacttcaaaggcctgacttctctatttttttttttttttttttgagatggtgtctcgctctgttgcccaggctggagtgcagtggcgcgatcttggttcactgtaagcttcatctcccaggttcacgccattctcctgcctcagcctcctgagtagctgggactgtaggcgcccaacaccatgccccggctaattttttatattttttagtagagacgggttagccaggatgttagtgttagccaggatggtctcaatctcctgaccctgtgatctgcccacctcggcctcccacagtgttgggatcacaggcgtgagccaccacgcccgaccggcctgacttctcttgtgaagatggctccgttagtgagcgctgtggactaagatccacaaacacagctgctatgcgggttccctttctgcatctttgtgagtttcagtgtcctaagctagccctcatataggcatagactccttgatattttactctgcataatcaggacaggaaaagatataggacctgtattaaagggacacaagattcagaatcacattaacttccaaatctcagtgccttaacacaatttaagtttctatcttcttggccgggtgtggtggtcacgcctgcaatcccagcactttgggagtccaaggtgggaagatcacttgaggccaggagtttgagaccagcctggtcaacatggtaaaaccccatctctaccaaaaataaaaaaaagtagctgggcatggtggtgcacgactgtagtcccagctactgggagaggctgaggcatgagaatagcttgaacctcagaggtagaggttgcagtgaaccaagattgagtcattgcactccagcctgggtgatagagtaagactctgcttaaaaaaaaaaaaaaaaaaaaaaaaaaaaagtttgtatcatgtgtagctctaaatcggtgtcctgatggatggacagttctactccataatgtgatacagggacccaggctccttccctaggtggctccacctttatggttgccaaagaaagagaggatcatatgtgctgagcctaaaatgataaagagcagcacctccattcccattccatctgccaaaagtgtcatctggtcacatctaactgcagaagaagctcagaaatacagtctctgtccttggaggagaaaagaaacctactgttcaatagctagctcagctctgctacaaaacgcctgctatagaaatgggagacaatcatgcattccttttctacaatttatggtatttcatgggtgaaccattaatacgtcaccgggtaacgcattattgaatatgttagtcattttcttttctcatcgtttcttgaaaaagaagttgtctaacagtcctaacttcccatctggcttcttaaaatctgttttacaagcaatgagatagttaaggattttcagctctgtggttgaattactccaaagaaagaaaactgcttttgaagttagaaactgaaacacacagcaacagaagcaaccagaaaccccatagggttttaaccttgttttgtcatatttctcaacaaactccttatttgtttggggattctgcttagctctgtgcagaggtatcttgctttctgtatcacttcaaaccttccttctacgtgagttagccttagggtatgaccacgaatgacaccttcaaatgggaaccttttgtgcctagagaaatcaaatcatctttcaagacttggctcaaggggtgtatcttctgtgaaggtcttacggactttcaccccgcttcgggggtgacagttcctttcttatgcccctaatttatcctgtgtggactatgatagctcccttgctacaataacatagttctttgcatttattttcttaaagtataacaccagttcattacagaaatttctaatttctgtaattagaaagtacagatgttttttaaaaaatcaagtaaatattatgtgtgagtccatgatgcagaatacttactgctgaaccacagggcctgtatggttaatcattgaatcagcgttgccaagcaaagagtgtgacacacattacttccatatcagtagaagggtggaaggatggctggatgggtggatggatgaatgactcacatagcttctcacggatgaacacacctatttactcggcttttacagtaagcccaggacagggtaaggatgagttggaaatgatatatattggttaacaatagccagagcagtactgagagttcccttgtttgcaaacagtacagttttaagttattcaggaaagctggttttctgagtttaaataactaaaatcaggttaggttgtactaggtaacatacaaactgtggatctccgtgttttaacacttgcatattgctctctcatctgagcgtgctgctagtctgttccacgaggtggctcaagacccaggctgcttccattttgtagatgtgccacctggctgactctgataaggaagtggagtcagagttcttgggttctccgcaatggtagtgacttccaatcacggtccaccagctagagctgatcacccagcctcacccaacagcaagagtattttgagccactcagaaggtgatgagaactagacatggatgaacataaccatgtcctatgcagtaccgggtaattgggaagactataataaaaatggtttagcatgtgagtactgggctcagactggttttgagcctctactgggaacaatttgtgcaatcttgggcaagtcgctcaatctctctaagcctcactccctcattgaaaattgaggataataatagttttaattaaataatgtgctaatcactgtgggcattgtgcaagttcagataaacattagttatctttaaatgtccatgaatacttaaaataattgtcattattacaatcttgttatcattggtagaagtggtagtaatgaggtagcacttgggactccacttcagaccacattgaagactggcggaaactgagaagaggcactgaaagcatgcccaacagcaacaatgacagtttactgtcaccatggcaacagcaggaagttaccacctctttccatggcaacacctggaagttaccacccctttccatggcaatactgggaagttaccacccctttttttttttttccattttactttaagttccgggatgcatgtgcagaacatgcaggtttgttacaaaggtatacatgtgttgtggtggtttgctgcacctatcaacctgttgtctaggtttaaagccccacatgcattaagtatttgtcctaatgctctacctccccttgccccctagcccccgacaggccccagtgtgtattgttcccttccctgtgtccatgtgttatcattgttcatctgccacttaagagtgagaagatgtggtgtttggttttctgttcctgtgatggtttgctgagaatgatggcttccagcttcacccatgtccctgcaaagaccattaactcattcttttttatggctgcataatattccctggtgcatatgtgccacattttctttatccagtctattattgatgggcatttgggttgactagcccttttctagaaatgtctgaataacctgccccttaatttgcatgcaattaaaagtgggtataaatgcaactgcaaaactgcttctgagctgctactctgcacacactgcctatgaggtagtcctcttctgctgcccctctgctgctgctgtgcactgccacttaagtaaaagttgctgtctaacaccactggtttgtcctagaattctttattgggcaaagccgataaccttcccatgctaatccccagtctgggggcttgcccgtcctgcatcggtaatacatttgcttagcatcctccaggggtctcaattagtgtcatacaaatgtacatgcctcaaaaggatatatcagaatactccattctcagctttctcaggtgcttccccgtcatactctgaaggaaaatcacactgagaatctcacccacagaaaaaggattcttcattattaaataccattcaagactgtgcactggtttttgatttttttttttaagaaaaaataaggggaggagtgtatccatcattttcttttttttctttatttttgtgaccgagtcttgctctgtcgacgaggctggagtgcagtgctgtgatcttggctccctgtaacctctgcctcctgggttcaagtgattctcccgcctcagcctcccaagtaggtgagattacaggcacacaccaccacacccagctaatttttgtatttcttgtagagacagggtttcaccatgttggccaggctgttctcgaattcctgacctcaagtgatccacccgcctcagccccccaaagtgctgggattacaggcaagagccactgtgcccggcacatcattttcaacatagctgcctcagtctgaaaacgataactcctcactctactattaaccccactgactccatctgggcagaaaggctgaggttaggttgtcagctgcgtcactgctgtggaaacatcgacagactcaataaacaccctgaaatttaacatgcttctgctatctgctgaacagctctgggcacaaataggtttcttttattatggacagaaaggccaagtgaaattttaatcagacagacaaggagggtatctgagaacactgaaatgccagccctgctggtatttccacaatattgaacttgtctttcggggaccttggtaggtatttcaattagctgtgagacacacagcctgtgtttttgcaaactctcctatttttaattaagatgctgttcactgggatattagaaggcacacgattcttcttgtaatatgcaaactatagaagagaaaattaagcagttgaaacatttggatgtagaaagtggattgtagtcatagctaaaatcatagcacttcgtgtactcatagctataatcatacctctgttcttacgtgatatttggggtatcttttcccctcccatcccattctctcgatttcttaactttcaattgcattattatgtatatttgctttaacgtatgatgagcctgttttcctgttttctttttaaaataacgaaatatttggtataaacaaaataatatctgtagcaactatggaccctgggaaggataataaaacaaaaatccgtgagtttactactcaacttaaaaattaaaatgctgatcagtactactgaattgacttgcttgcttcttggtgagtttattttttcatggagataatcaggcaccgttttgccagttaaggtgcctaaaagcaccataaatcactggaaattctagactaaaaagaggtctttctttctttaaagctttgtccatcttttagtcacacggaacacactgaaagaccttccgaaaaatgaaaaggcaactttagggtgtaaggggctgcagggccgcctctaacattcattcgttcattcattggtccctgtatttcaggattcctgcgttggttcctccattccttcattaaatgttgagtatgatcacagtcttctttcaactataattagtagaattaactgctattggctgaatgttcatgtccccctaaatttgtgtgttgaaattctaatcccaaggtgatagtattagaaaatgggatctttgggaggtgatggggccatagagcatagccctcatgaatgggattagtgccttcataaaaaggcttgagtctggtcacagtggctcatacccataaccccagcactttgggaggccgaggctggtggatcatgaggtcaacagatcgagaccatcctggccaacatggtgaaaccccgtctctactacaaatacaaaaattagatcagtgtggtggtgtgcacctgtagtcccagctactcgggaggctgaggcaggagaattgcttgatcctgggaggtggaggttgtggtgagctgagatcgtcccattgtactctagcctgggcgacgaaagtgagactctgtctcaaaaaaaaaaaaaaaaacgaaaaaaggtttgagagacccctcaccgctttaatcatgtgaagttagagttaagggtatctaccaggaggtggacactcaccagacactgaatctgccagcaccttgggcttagcctccagaattgggagaaataaacttgttttgtgcaagccacctgtttgtttgtttttaatttttagcacctttttttttcaattttcttgtgcatttgcttaagttccttgtacactctggatattagcctatggcattttgctagaagcctgaacagactaagacaatgattatgaaaagatttagttataaacattataataatggtcagttatcctgcccattatactcaggttcttttgagaattccttgcgaggtttgataaggacattagattttgtttacatgtttgtggttttagacagcaaacatgcattgaagaatgttagacaggaataaagttgaaatagcctcactcacactaaagagcccagagtgttaattgacatcctgttttccataatttttttcttttgtttgcttgtcaataaaaccctcatgcaacctgagtggaaggggagagtcattaatgcggtagatctggatgattttctgaacaacctaacctcacgctaatgaggcgagtattaccacaggccctttctcctacgagctgtccacccacagttgaagagctaattttactctcaaaactctcacgaatgcttttggttcctgccggctcttgagtagtaacagagtgctttagccctctgtggaaaatgatggaggcattgtcagggcacatgaaccctctaagaagtggatgtggtcccacctctacttaaacctggaccatgcagcttaagggttccattctcaagccagtgaacatcactgtcttcatgtgaatgttcttcaggtagaattttttagcataaaaaattccaacaggccgggcgcggtggctcacgcctgtaatcctagcactttgggaggtcgaggcgggtggatcacgaggtcaggagatcgagaccatcctggctaatacggtgaaaccccgtctctattaaaaaaaaaatacaaaaaattagccgggcgtggtggcgggcgcctgtagtcccagctacacgggaggctgagggaggagaatggcgtgaacccgggaggcggaacttgcagtgagcggagatcgcgccactgcactccagcctgggtgacagagcaagactgtctcagaaaaaaaaataaaaaataaataaataaataaataaataaataaataaattggaactgagtgttagctatttgagtagtctcagctgaataatacctctgacatggtatcattctgtggcatatatttttctgtaaggaaataaaaacaactttcttaattatttttttctgatcagagaaacaacacatacacatctttggaaagacaaatactttgtgcacatatagagaagaaatgttctccttatttaatccaactacttggagattattcactgtttgggcaactttgctgaccttgctctatatttatatacaaatatgaatgtgtgtgtttgtttagaaaaaccaaattgaatcatatatttttatcctgcccttttcagcttgatgaatatctgtatcaactttttaatggctctgcagtgttccattgtatagacatacttaatttatgtatccagtttcctgctgacagacatttagactgttttttttaaatctatttgctttttttttttttaattttacttcaagttctgggatacatgtgtagaatgtgcaggtttgttacataggtatacatgtgccatggtggtttgctgcacctgtcaacccgtcatctaggttttaagcccggcatgcattaggtatttgtcctaatgctctccctccatgttcccccaaccccctgacaggccccggtgtgtgatgttcccctccctgtgtccatgtgttctcattgttcaactccgacttatgagtgagaacatgcagtgtttggttttctgttcctgtgttagtttgctgagaacgatggtttccaggttcatccatgtccttgcaaaggatatgatctcattcttttttatggctgcctagtattccatggtgtgtatgtgccacgtgttctttatccttgatgggcatttgggttggttccaagatttactattgtaaataggttgtttcttattgttgttgttttcaaaacataacacattttaagcatatgattctctgagcaaagttttctattagagtggatgtctcttgggtttaaagaatgggtgaaaatctctttatttctgtgaaccttttgcaaagttggacagcagtatcaagttagccaaggaaggatgtcacacagagtggccatggtggtcttctggagcaaatagagaaaacacatattccagggaggaaaaaaaaaaattccttactttttgtatagcccaatcttattttcagttaataaagctttggccagacatggtggcttacacctgtaatcccagtactttgggaggctgaggcgggcagatcacgaggtcaggagatcgagaccatcctggctaacactgtgaaaccccgtctgtactaaaaataaaaaaaaattatctaggcatggtggcgggcacctgtagtcccagctactcaggacgttgaggcaggagaatggcatgaacccaggaggtggagcttgcagtgagccgacatcgcgccaccgcactccagcctgggtgacagagcgagactccatctcaaaataaataagtaaaattataaaaaagctttacaggtagttccttttcacatataaattaagttagtagatttaggaacgtatccttcactattctgttccatgccaaaagaaataacaaaaacaagatttgacccttaggttgaagttctcctgaactgactgttccctcaatatcttcatatcccctggattgtccttcagtatctaagaatatgggggggaaattaccagaattctccactgtctcatggaaatcacaaggcttgcttggatcgtaatgtgtacaattcactattaacaaaggatatggcattttctgtctgaaccttttcccaacaatccattttctttctctctctctttctctgtctctctctccccacccccaaatccctctctgtctctaagccaccatcacatcttccctgcatggcttttctctctctccatcattacccctacaggccagtccccttatagcttctggaggaatcttctttttttttttccttcatgttttaagttcaggggtacatgtgcaggatgtacagatttgttacataggtaaataggtaccatggcagtttgctgcacaggtcatcccatcacctaggtattaaatctggtgttcattaggtattctttctgatgctctctttccttcccctcagcagatccccacgcccattgttctctcccatgtgcccatgtgttctcatcattcacctactacttataagtaagaacatgtggtgtttggttttctgttcctgcgttagttatcttccaactccatctatgtctctgcagaagatatgaccttattcttttttatggctgcatagtattccatggtgtatatgtacgacttttttttttatccagtctttgtcattgatgggcatttaggttgagtccttgtctttgctatcgtgaatagtgctgcaattaacttacatgtgcacatacctttataaaagaatgatttctgttcctttgggtatatagccagtaattggattgttgggtcaaatggtatttctgcatctaggtctttgaggaattgttagaccatcttctgcaatggttgaactaatttacactgcctccaacagtgtaaaaatgttgctttttctccataaccttgccagcacctgttttttaatatttttattagtaaccattctgactggtgtgagatggtatctcattgtggttttgatttgaatttctctaatgatcagtgatactaagcttttttcctatgtttgttggccgcatgtatgtcttcttttgagaattgtctgtttatgtcctttgcccactttttcatggggttatgtttttcttgcacatttgcttgagttccttgtacactctggatattagacctttgtcagatggatagattgcgaacattgtctgccattctgtgggttgtctgttcactctggtagtttctttttctgcacagaagctctttagtttaattagatcccatttatcaattttcgcttttgcagcaattgcttttggcattttcgttatgaatccttgcccgtacctgtgtcctgaatggtattgcctaggttttttttttctagtgtttttagagttttgggttttacatttaactctttaatctttcttgagttaatttttgtgtattgtgtaaggaagaggtccagtttcaattttctgtgtatggccagacagttgtcccagcaccatttattaaatagagaatcctttccccattgcttgtttttgtcaggtttgtcaaagatcagatggatgggggtgtgcagtcttatttctgagttctgtgttctgttccgttggtcgttgtgtctgtttttgcaccagtgccatgctgttttggttattgtagccttgtaggtaatcttcttaaatcatacattttatcaggacactatcacttacgacccttcattggtttctcattctacaaagagaaaatttcagagatctcaccagaacgttccaggccttgcttctctgacacagacccatgtacctccttcctgacccccatacacaactcacactggtcttttatcagatcctcaaacaagtaaggctctttcatattttagagactttgtacctcttccttacccctcttgggataatctcagtcccacttgtgtatggctattccttctgattctttatatctcactttaaatgtcattatcttaaaaaggcaaatctcaacctgccatggacagcagatgcttcttccttaggtgttactgataaaataatgcatcaatgcatctctgtaaaatgaacctgtgcatctgcttcaggccatatttctgtccctcaacaagcacatcacagttgtaatctgtgtccattcatatttctgtaccactaaaatataggtatagtctttgtttttcattcgtatatcagacttgttgcctagcccagagctgcttacacggtggcccatccaataaatatttgttgaagactgaggacttgggaagggtgtgtgcatgttttcagtctgtgtgatagcttcacctcctattacgtgaattggcccgaagatccccaattccgtgtcatcaagaaacatggacacatcacagactcactcaacatggacacatcaagactcacttaacgcagggtggcttcccaacagcaagctgtattgctgaaaagcaggccttttccagtaagaacatggacaaggacaaacaagagactgcactgtgttctataagaagacacctgggtcataatgagggagagaaaaataagaccacagcaaatgaaacaaaatgtgtaacataccagacaggggaggaatcaagggagctgttcggggagctgctgcaatgcgagattggagctacaaatgtggaaacgcacgaagacctttgcccctatgaatcatgtattgggaaaacagttgagcatctacagacgtcaaataaccaataaaatttcatgaatggtaacgttcgccagtatccgggagaataaggctgagctctcaacatgatctgctaacaaaattaggtcatttgtctttgataggagatggccactttcttattttttatttattcatttgtaagcagctgctttaataagcctacaggatcttggatggcatgctcataagttctagtaaagcctggaagaaaattacaaagggaaagactgcctctaaattaccctaggaaacaaaaaaaaaaagaggtgatggctacagttttaccatgtctttgggggcaaagtgatttccttctttctgtgttcttgttggggaaaaggggaaggtgttaaatcccacagctgcaaaatagattcatttctgcctctcttgtaaagtgaagcatctttccttcccagagaactttatcttgcctcagtcaaccctgctcagagatggttcatccactcctgtcttgcggccattaaacatagcaactcaagccctcacttccagggacttaatattggtcatttaatactgcataacaacatttcatgatatacaacatgtatctctcatgcctttctaggctggctggggtttggctggcccagactgtgctcatttggacagctctgcttcatgctatgggtccagccagacctgtgtcctcacaactgcaagggggtcttcaatctgccctatgtgtgcacattctggggccgggtctaggggaagcagccgtctagactgcttggtgctctgtcatcatcttcacagcaatggggagccacagggggtgggctggaatccttaccactgtggcccacgttttattggccaaagcatgatacgcaactgatggcacagtcaaggtgtagggaagtgtggtccatggtcagtcgctgaaaagttgcatggcaaagggagtgaatacaagggacgtgaagaatggaagaattgctgccagtaattcagtcgaccacagcataactacaagaggctgatacggttatttgacagtgatcgtcaggattagagcacccatcaacctgtgaatgcttacacatttttattctgttttaaaacagtcacgtgtggcttagaaattaaataaaatctggtaattttactatgaaaaaaattattcccaccaagacttccttttggtggtggttgttgttgaaatggagtcttggtctgtcagtcaggctggagagtactggcacaatcttggctcactgcaacctctgtatcaagcaattatcctgcctcagcctcccaaatagctaagactataggcacctgccaccatgcccggctaatttttttatttttaatagagacacggggtcttaccatgttggccaggctggtctccaactcctgacctcaagtgatccacccaccttggcctcacaaagtgctgggatttgcaggtgtgagtcattgtgcccgatccaagactgtctaatgctgtgttaccccacaaggaggctgatcacagcctccttgtggggtgatacagcaagtggcgacaccatggtgagctcgggcccatgaccattcaaagggagtcacttcacagctgcagctgattgtgaccatgtgggaaggtgggcatagtatggccaggctttctcatttctccagagaagtttggcatctgcattttttatgagtgaaatttatagtttttgaatgttagtcactaatacaaagttttatgaaaatgctttgcatgccaaacaaacacttctgttgaccacacatggccagcaggcacccgattgccagcccaccttagactgaaggcactatttgctattttcgacattattggtcaaatctaaatagctagatggatatatagaaaaagaaaagaagagatagaaaaaaaggtgatagaaccaaagaaagaatgaaagagaagatgtatgtgtatgtgtgtagagagagatgatggaaggaaggaaaggagggagggaaaaaagcaacctaggtagatagctgggcagatggatggaatgagagataatagatggataatctttaacgttcagtaacatatgacaagtcacattgccaagtagaagaaactcagcaggcagcatttaaagagaaagtttcacactcatggaggagcaggccagtgattagtgtcagggataatgacccaaattcactgattgtatttcctcaggtgtcaaagaggaacagaaaacgatagtgttgcaaagaaaaagaccagagaatgtctcaccctgggtaattctaccttgcttcatgcacgcttaactagcaacttgcctgtcctgattccaaagcacgtttaggtagtcccaccattggccaggcttacgtgtccctgaacctgcagatttaggaaaaagtaaacagctgtcctcaagagtgcatgagacgctccacatttctcctttgtgatttatatataatcatccccagagagtgaaacaaaggaaccaagtaacttgctgaacactcttgaatgtagaggaaaaattatccacctatcagagagtgtgttgacagtagtgagcttttaatactgaggaagtctttccgtggcacctaaaagttagctcctgcaatattctgctcattggcaaaaatcgtgttcatttttaagagaaatagattatgacaaaagtagaaaaaatatagtcttatactttagatagaactgaaaggcctggctgggtgtggtggctcacacctgtaatactaacacttgggaggctgaggctggtagatcacttgaggccaggggttcgagaccagcctcgccaatatggcaaaaccctatctctactaaacaatacaaaaattagctgggtatggtggtgcatgcctgtagtcccagctactccacaggctgagacaggagaattgcttgaatgcaggaggcggaggtttcagtgagctgagattgtaccactgtactgcagcctgggcaagaaagcaagactccatctcaaaaaaacaaaacaaaataaaacaaaaaaaactgaaaagtccatctgccatgactgtctacatcgcctacatcccacatatccctaagacccagtacaaatgccatctcctccaagaagccaccttgatttctacccactgaaaatcctctctccctcttttctttgtccgttgtgccttatttttcttcctaccctgccacttaactctccctgatttataattatttgtgtgtgtatatctcccagttgactaggaagatgacttggattagaaagctggagactttgtctttgaatcttgcaatactgttgattttggtagatgaacaaaagtgacaagtgacatcttttttctcaaagaaatacaccatgtactcctttgtgcatagataccttcttaaccgagtcgattgacatggactcttaagtatttagcttcttggattctaaagtaaacttacaagttcctgcaccctagggttcctttccctttatcatttagtccttcattcagtgaattcagttgttcctcaaatgaagcagaaatgattcctcttttggggcgtaaagtgtagtgtgaagctttaaaaaataaaagtaaataaataattgcatacttacaaatattgacaggtacgatgaaagaataaactacgttgttctacaaaataaaattaaggtgagtgtagttgggagagaaccctacttaggtaggttggtcctggagggcttctctgaggaggtgatgttcaagctgaggggtaaaggatgacaaatgaggtttgagttgagagcttatcaggagactgattgcctaaggtacaataagagaagagatgggagaggaagttggaggaagaaacaaggccagatctgtacccacacagctaagattatatccctactggccttaacaaattaaagcacttcttcccatgccttccacagatgactcctaatgtcattcttttgcaatatttctaccttctttcattttaacttccgttacatatagctatgcagaaaaaaaatcaatttgttggctaaaataaagaatagtgacaataccaaatgctgtcaaagatcactcaaatattgctggtgggaatgtcaaatgacttaatcactttggaaaatcatctctcattttcttgtagaactaagcatgcacctcccatataattgagcaattgcacacttgggcatttatcccagtaaaatgaaaacacatccacaaaacaacctgtatgcaaatgttcactgcagctttatttgtaataatagctaaagactgtaaatagcccgtatgttttcagtgcatgaatggttacactgtgataatccacactgtggaatactatgtagcaataaaaaagaacaaattattgatgatagacacacaacaactaggatgaaactccagggtgagtttcactcccttgtggtgagtggaaaaaaagcccatttctaaatcattttgtccagtctcagcaatcatttttatgtatctaaaggttacatacaaaatgataccgtgtatgtagcattcttgagtttaaaattctagatatagagaatcaatgcgtggttgccggggtcaggagtgagaggtgtggagtgacagtagggtgtggtcatagaaggcgtctttttgtctgtggactattttttgtcctggctgtgatatttatagttttgtcagatgttacccctggagcaataagagtagaggtcatgggctctctgtatattacttattaaattacatgtgaatctacagttatctcaaaaagtttaatttttaaaattccttcatataacaacttagagtttgaaagatattcacaacatattttacatattaaatttttatttaaatatttgtgttctcctctgccaaattgtaagagctttcccctaagagatcttgtcttaattatctttacatgcctcctctcaagcctcctgttgtcagggaaagaacaaggctctagggtcgagaagacatgggtgagataacaatttcaatgccaggcaaaggactttggcaaattcagagcatgatttgataaagactggaactcacaggcagaaggactggcaggtggcacccggacccttaactccttcctctgggcatcaaggcgcagacatggatgatgccctgtgtgcttgcattctagaacagggacaccactatcctttagctgtattttttggggggttggagagtacggtgtattagtttccattgggttttttttttttttctttttttgagatggaggttcgtcgcccaggctggagtccagtggtgtgatctcggctcactgcaagctccatctcccgggttcatgccattctcctgactcagtctcttgagtagctgagactacaggcacctgccaccacgtaactaccacagatgtggtggcttaaaatgatataaatttattatctaacagttttggtgatctgatgtctgaaatcagtgtcactggcctgcaaccaaggttttgatagggctctgctttctctggagtctattcttctagcttgtagtggctacatgactgcagtctctgcctctgtgttcttgctgtcttccgttctgtgtgtgcctctgcgtctttcttttaaggatgcttgaggttgcgtgtagggccctctggataatccaggttgatcacccattttgtgagcatcagttcagtcacatcagcaaggaaactatttccttacaaagtttataagtttcagggatttttgacctgagatatctgagtggctattatctggcttattagggtaagtgtgagaacagtcttacaagtagggaacaattccttgtgtctcagaaattaactttggcgagatacatggtggcaactagctgtccaggaaaggtgcatgttggaaactagctgtccagatgagatgcatgctgggaactagctgtctgggagaggtacatgctgggaactagctgtccaggtaaggtgcttgcctaggtgaggtgcatgccaggaaatagctgtgccagcgaggcgtgggctgggaactagctgtctaggtgagatgcatgctgggaactagctgtctgggagaggtacatgctgggaactagctgtccaggtgagatgcatactggaaactgctttccaggtgaggtgcatgctgggaactgctgtccaggtgaggtgcatgctgggaactagctgtccacacaaggtgcatgctgggaactagctgtccatgcaaggaggatgctgggactgtgttgatgacatcaagagaccatgtgagcccagcaccctatggatggacaatctcactggcagaattggaacagctggtcccagctggcttattgccaggcaacccagagacagcctctggtgttacccttcacacagttctatccctccctccatatatactacctaatgattgtgcgaacttgggaaagctgcttaacttctctgagcctgagtttcctcctttgtaaaaggagactaatactggtgtttacccttagggcttttgtgagcattaatgatagtatgtataaggtttgtagtaagtgccatataaatgttggctgtaattattatattcttgtttttgatattgtttctatgaggatggtggtggtagtggtggtggcatacctctgtgcattgtagcataccctaagggttggctgcataacgttgaattttagttcgcagagttactgatagtgcctgcccccagccattgggcttcctggtttaaaaggcaaatcatcctgatggaggatggtgcctacagtgtggtgctcgaggacaatccctgtctgcttgggactctgacagtggtagatgctttcagaatttgggttatgagtgattgagggaggttagcaaacggattcctacctccttgtactgtatgaagcagtttgatgggattaatttgcatggcccatagtaaatgctctcagcctgtatggaggctaatttgtgaacctgtagcaatttatcaccctggttggattcgtttaccagtagacaatgtgattgggataatgcgcctcactgtgcgtggagaggagctgcactctgacctcacttgaagaaaccaccgaggggtaatttcctccccaacggatgactgacattacagtgtggtgacaaatgatgagtatggtaaatggttaatatagccagggccaggatctatatgatttatgcaaataattagctcttcctgggtagtagcctgcatgtctaggtaacttttattttttcagacagtcatctccgtaatgagctattagtctgcaggccagaaagaaagaaaggtagaaggaaggacagacctcaggcagttaagtctttgttccttccagaaatcctatttatttaaagctgagtgtgataatgttttcttttacaaaactccattgctctgtattgtaaaagcaactcaaaatatgagtgtctgacgtttattagtttcaataacggtttctggggtttagacagagcttgcattcatcttcactgagttccattaacacggagggacatataccattagcaccatttcctagttagagaatgtaaggaaagatggaggatcaatatgactgtattaggaaggagtctttgggtacaaattatggaacctatgaagaggaaagggcttaaggggttaattattaaaaagcttatctaaggaatattttatataaatataggatgatctgggaagctaaattgatggaaattcaatggcatgttacaccttgagggctgccagaaataggaagtttagcgaagttgggactttctctcaggttacctgttttgcctggccaacgacatcttctgaacctcacgcattacctccctgccaactaggagaggtgaatttttttttttttttttttttttttgagactgagtctcgctgttttgcccaggctggagtgcagtggcgctatctgggctcactgcaagctccgcctcctgggttcaagtcgttctcctgcgtcagcctcccgagtagctggaactacaggcgcctgccattgcgcccggctaattttttgtatttttagtagagacggggtttcaccatgttagccaggatggtctgcatctcctgacctcgtgatccgcctgcctcggcctcccaaagtgctgggattacaggcgtgagccaccgcgcccagccgaggtgaataatttttttattctggtttctatatgacagaggagaactttgatcaccgagattagaatcccttgttaatgcttggactaatctttggtggcaaaggagtcagtgccacctaaggacaatgtttcactgttgggaggtgggtgggaggagtaggtcctgagaggagagagtgatgatcccaacagaagagaaggatgctatgtagggagttgacagattccagcactatactgtaaattccgtgagtgtgtagctatacgtgttctggtgagcatgatatccccagtacccaatatagtacctggcaaaatgataagcatgcagtgaacatatgcatgaggaagggagggagggagagggggaaggagggcagtcagcattctagtatacaggtctgagatagccaagaaaaagcaagcaaaattttcagcaggtagtcacacaaaacagaaataagaagagatcttggccgggcgcagtggctcacgcctgtaatcccagcactttgggagggtgaggcgggcggatcatgaggtcaggagatcgagaccatcctggctaacacagtgaaaccccgtctctactaaaaatacagaaaaaattagctgggggcgatggcaggtgcctgtagtcccagctactggggaggctgaggcaggagaatggcgtgaacccgagaggtggagcttgcagtgagcctggatcgcaccacttcactccagcctgggcaacagagtgagactccatctcaaaaaaaaaaaaaaaagatcttttaactctggagagttatctcagcgatcgaaaccttgattgcacttcctagatttattggattcatttaattgcgcagcccttggaagttttatcctctacctttagaggatttgagtgataaatttccttcttcccttccttcctccttccctccctccttccctccctctttccctcccttcctttcttccctgctttcttccctccttgtctccctccttacctcccttctttccttctttctttactcatgcacatattcacttcatgggctctgtcatttgtacccaaagactcctgcctaatacaggcctattgatcctccatcttcccttatattctctaactagggaatggtgctcatggtatatgtctctctgggttaatggacctcagtgaagatgaaatgaagacccttcccttcccttccctttcttccctttccttcccttccctttaccttcccttccctttaccttccttgcttcctttccttcccttcttcaaatgtgtattgagaaccagatactgtgccagccacgagaaacatctgaatcatcaaggcagcctccatctgctcagatctttttagtaggtgttttattgttgagtatgatgatgtaggagttctattcccaattcatattgttttgaagccacgtctgaattctgagtaactaggatgatgagtagactatgtctccttggagtccctgtttgaggctaggatttaggtgagcaatcctgatcccactcaggagacagcaggaccacctgagccactgacctttaaacccaggatataaaggttatcattgccctctagaaatatcaaattggtaagaaaggaaaatgctccctcatgaatgttcatcaaagagtgtttcccatcaggtgatattctgtcccttcaggccaccgtggaattcattaaagatgagaagacagtgataaaccacctcttgtgcaggaatatttatatattcctgtattcttcaagatgttacaaattccatttaataagtaaagtggttatctcaatcacaaactaccatgaggcaataatgatgatccatttgtcaaaaaccgccactcaagcactaaggagatgtgtgtaacagttggcattttaagcattgcgattgtcaaaccactgattgacagatcccttaattgtcaattcagataataataattctgctgcaaaatgttagagacagagaaagggaaaagaaagaaagagaaagagaaggaaagaaaacgaacggagggacatgagaagaaagggagggacaaagagaaggaggacttgagataaatattagacatgctttggagtttttcaatggcttactgcaaatcgtgttcaaccccacatcattgctggctggttgtctttcttatttgttgtgaagtgattgcttcaaaaaccctgacacaaatctctgtagagtgattttttgtgtggtcaagaattttgtgattttaaaaagactttcaggttcctgctgatttgggactttggctctctctacgctgatatataaatcatattacacaatattgataactccccaatctctaaataaatcgcaaacttattaggaagaatcccaaagaagaagtcaacacctttactgaagaactatttaaaaagatgtatgggtagcatctaagtgctcacgttattcttagtgaatcagaggtctccatcctacgaagcatgggagaggtcaaatcccatgtacgccagctgaaagagttaagccatttttctatttacatggtttatttcacaagggtctgactcattgggcataaccagcacagttaaatttcaaaattactatttggtcctttttttattgactacaattcaaggctgcttcaagcctcccaaatttaatcgccgtagctctttgccaagaacattatgttttattttcagtgttaaactgtgtaagatgcccctaaggctacatggaaacttactctctgtgatagcagctaacggagtgtatcagttgttcatgatttcccattctcctgtaaattgggagaggcagggagagcagtggaatgcgaattttgttctgtcagcactttcttgccccagctttagcccaagcagtgcctgttttggtaattaattatagtgtgtttgtagctcttcatgctcagttaccatttagcaacctgtcaaatcctgagctaatgagcctatcccacagaagtcattgcatttactttattttatttttaagcatcaagacaatactggtttttcgtaggtcagatgaagttgagagggagattctaaaccagcatatggaaaaggcaaggcttttctcttctactcacaaatgttcatcccaagaatggccttgcttaaagtttttcattgatgtttctctaactagaaattggagttattaaatacagttattaaaatacagttattaacgtgactgtaatttaatatttgaaggaagaaatagctcactcataagtgtccttttcaaagtgttgttggtaaacgaaggttgaatggttttgagatttatctcaaatgatgaactacactttgtagggaatgtttcagaggtcttccctctctgtgttgagagactagattaggatatctagcttaggattttcatctaaaatacaggaaaaagcagagcagattcgtgatactttcctctccttgttggttttgtgttgttctttcttctttaattgtggacttgaaggagttccacaatctcgttatgggaaggacttaggcatagcactttggtttccgggcagaggtagaacatactccttgaagctgcttttgtatcacgcttgcttgttttacttagaatcgtacggttacagctcaattaaaatagcagagttttctgagaatgatttcattctctttatgtgagactcagacgatttcatttagtttatatgagacatatcactaatctctactaaaaaatagaaacaataattttatggaattacatatcagaatatgagtgttcagctcagcctctttatggaacagtgtataccaaaaacacatctttattcttagttgaaagttttagaaaacccagaaattagagcagtggcattcgcctctgctggttagaagtataatcttcaattcaacatgcaaaactcagactcgtagctatttctgaagctcagctataactacagtatcatgtggtcagtaagttctgcatttctaaaggaagatattattttcactgtcaatcaaaggtaggtaaaaacacatgtacacattttagcttagctgaccaggtcacagggatgtgtacctgtttatgtataagtgccaggactgaggctggaaggaggaattaagttatgctcccttaataccatcagtgttgtattgtcctaaaaaaagtgtatatatatatatatatacatatatatacgtatatatatatgtatatatatacgtatatatatgtatatatatgtatatatatatgtatatatatatatacaaaaattagttcctcaatccaataagaacatgattctgactctttataaaaatgactcctcttgaatattatttgttcccatctcattcgttgataatatctattatatttttataagaaagagtcaaaaattctatgcaaaattctctgttctcctcaaacagatgacgcttttgcccatacttggctctaatatcataattgattttacttgtcagctctctgttcatcagagaacttgataagcagaagaacagttgctcactcttgttcaagtctactgccctaatgcccatggacctgcaaatttcccaaatgtgagtggtttttatgctgcctgtggaaatctgaatttagatgagccacactttgtagaaaatgcttcagagatcttcctgccgcctctctgtgtcgataacctccatggaactgtgtttgtgagatactcaataatggaaccatttaattcaaattttttaatcgactacggtatcagcaaaatgagaaatgtctttcacccttgatctttgacaatagcagacatgttaatatgaagttactgctaaggctccaaaaggcattgatacaagtatattttttctgccattcttgtttctttatagaatcacacttttgagtattcagagcttgcttttcctttgagttagaggaatgcattggagagaagtgttattgatgagggctgattaagcaaattaatgaattgagacagctgaatagtaagtgagaagaatttgaggagtggaattggtttttgctcattgactgtaaagtgtaggagttaacaccacaagggtacctgatggaacgagctataataccgaggtaagtgaagagagagcatttggaattgtgtactatttttcctcttccaatgaatagctgtgcgctagctgttcactgctttcctggcatatgtttttcttgcttcattttctgagtcatctgcaatagcggaaatgaattcattcaacaatatatattgaatgcccgttatgttccagacacaatgttaggcacttaatggtacttgtggaaatacattatttaatgtctgatgactaaatgttctcagttctgatggagtcaagtgtttttggctgggggtggtaatatttgggaagcatcttggaaagcatttgttatttcaaactcttcaaatctgcaagtcttacaaaacactacacgttggctaagacgcgggggcagcgggcgctctaccgtgctgctgatggaagagtatattgatgcacctgctttggcgctcactttagtaacatcatgggacattcaagatgcatgtagttttgagatatttcatccctaaatgcacacatgaaggagacacatagaagattcattgtggcatccaagcaaaacattaggaagacaacaatcaaccagacattaattgtccaccaatagggaaatagaagataaattgtagcaaaagtcatgtctggtgtgtcatgttaaaataaataaattagatctctgtgtgccagtgtggataaatctgaaaaccataatgttgaacaacaacaaaaagtaatttgcagcaggagacatacagtatgacatcatttatgtacagtttttggacacagtaaaatgttttcaaaaatatataaatgtattcaaaaatagatattccaaaatatacatttatatgtatttatatatgaatgtgcccaaaaatatatattctcttggggtctatgcatatatggtaaaacgagatagagctatgtgggaatgatacacagtaagttcagcagtatgcccaccactgttagggagtaggggagcggttgtaatctgcgagagtgactgacaaggattccattatatttgttatattttatgttgcaagctgcggggtggacatacggcatttgctccagcatcttccgtattttttatatgtctcatgtattgcataagaaaaaagagtgcatctgaacagctacagttaccgctgtgtctgtgtgtatttgcatgctgagttttttgagcaccacactctaaccatagtctttgcaaaagggttttatacaaaaacaaggtccctttcgagtgcattgtcttggtaagattgttaagggcagatgagtaaagagatgcagtaccctcaatctacaagacaaaagatggaccagtcaagcagttccctaatgtctttgatcaatgtaaactgctaattgcaaggcctgactctcttttccaaaaggaatgattcccctcccaaccccctccccccccgactcaattacaagaataattgcttcaactctcaatgttcctttaactgggcacgttcagtgttagcatcttaggctctcatttcatatgaaagtactaagttgttccagtaaacagcctctacattgggtctttatgttgcaatattacagacttggcatgcaacctcctctatttttcactgtgtataatgaggtcaaattcgttttggaaggcccggaagtcttcaggatttacagctatttgaaaaccctattgataataagtatttggccaaagtgtttccacgttcatacactccccctctttcctagccagcgtcccttggtttttttttttttttttttttggttttttttttggtctagcttgcactttctccctgcccagaaatgtcgttaacattaacaagagctctctctggcactggcagggggtctgcaaacagaactggtttggaatatgcaatgggaggcttgaatcaaagaaaagctgtgatacagactgtggagtgtgtaagacaaactcgataagctccagtcaatactgtcaggaaaaatcacagcaaaactgatttcgatgagaagatgtcattgggctgtgagggatacttggaaaggatgcttcagcaacaataacaacaaaagagtttttcatttagattgtgaagggcttgctgtgtgtgtcatgtttagggacataaataagtactgacccttactctagagagttattgcacataagaaacccagagtcctaggccacctccagagattttaattctgtaggtctggagtggagactgtttgccttgtgaacaagctcacaggcgatgctgatcgtgcaggttcctggaagcacattttgaacaccaaggccccagagcaggttcaatgaaatggaggaagagagtcaaataaaaatcctttcattcggtgctatggggatgcaatggcagagttattagcaatattacagttacctaggaaaaggagcaaacagctctgccttgcccaggcaaccagcagaatggaggtgatacttaaccagcatcttgaagagtgaagagatttccaggaagaaaagagagttcatgttacaggcagaggaagtgacatgaatgaagtacaggacacaaatggaaaatgaaagtggttttgtatgaacagagctggaggtagaattggaatcatcacagatgctgtttaagaattgtctgtggctcacacctgtaatcccggcgctttgtaaggccgaggctggtggatcacctgaggtcaggagttgaagatcagcctggccaaaatggtgaaacctcgtctctactaaaaatacaaaaattagccagtcatggtggccggcacctgtaatcccagctactcaggaggttgaggcaggagaatcacttgaacccaggaggcagaggttgcagtgagctgagatcacggcactgcactccagcctgggcgacagagggagactctgtctaaaaaaaaaaaaaggaagacaggccgcagctgatttttgaaggaatttgcagagtccttctaaggtgtttggtacattattctatgatgtatggtggagaacagtggaaggatttttacagattattggtgggagagtggatgaagagaaattaataagcaggggatcaaaagtctaggtgaaaaaacaggagggcttgcctgaattactttttggaatagagaaggacatggcacaaaacattccaacctaaaggcaagaccctcaaggttggagacgaagtatcttctggatgcagactgggaaaagtgattagcagcaaatggtcaagatgaatgggtagagacaaaacgtggctcaccaggagggtggtgactcactaatcttcaagaatgtatggctaaagattcaaagctccttactaaaatttagaaaaggcccataatggaaggaactaagcaagttttgccttctgctacctctgaattcattatgttgcctgtacaagtagaacacatagcaggaactgtgttttaatactaattacaattattttctggttacatagataaatgtaaataacattaaagatgtgatctgttcctggacgccatttttatcttctttgtcagaaggagggagagagaatggcatcaaaataccaaggttctgtttttttttttccttaaaaaaaaaaaaagaaaaaaagaaatgaccggaagcacaaattggatgcctgcgctttttttttttttttttttttttttttaccaaaaccaaatacaaccttacagaggtaataaaccttgtgatacagtctcaggaggatgtgctatgaaaggagccaaatcaggtaaccagaaacaaataccaagttctttactggtattttgaatgtttattaaacagttaccaatccattgccatttgtttccttcacactttgtgctccctccttcttccttctcttgcaaaatcctcacaacttcttctgtctttatgttcctttttttttttttttgttgagattatgccttgcaaaacctctaattaacctgcctagcaaaagctgaaccttcttcagactacagggagagtagcagaaaaaataaaagtgacaaagaagaaagcgaaggagtctctttagcaggaagaaggaggggtcatttcagggaaattattttaataattcttgtcccattacataaataattcacttttttcttctatgtcactgtattcctagggttcttctcaaagcataactcttccacatttagacacgttcaaaaataagaaattagagaacacacttcattctttccttatcctatccagttatttcaagacaaacatttgaaaaacaataataatttcagactgcaataaaggaaggctatttgttttacttttgcaggcacagaaattttgtgaaatcaccaacaattcagaaaagaaatgacatcatcatgcccgaaaaagtataaatgacataatctcaaattaacacataaaaacgttaattaaaaatttagttttaaacccccctattctctccttcctcttttttttttttttttaatcatggcctaatacatcaaaacaggctggatgtgtcaacggcaggatatttgagaatcaaggatctgattcaaatgttttatttgttcttgatggaaaattccaaactggcttttaaagcctttcaataatgcatggaatcctgaagaaaaagttgcttcctagaagatgttgctctgttcaacctgtatttttaagtgtctttttcctctaatgtgggtttaaaaacaataaggagagacatatgctacttgggtattttgttgaggccatttccctttttttatctgaggtcatgtgaatggatactcatcaaaacaagaggggcgtttttggtttctctttttgctgataaatcgaaaacacaaaggtcaaaaataagccctgttcctcaatcccagtgccaatgttggagtgggtttttctttttcttttttttttttttttttttttttgagatcgaattttgctcttgtcacccaggctggagtgcagtggcgcgatcttggctcactgcaacctccgcctcctgggttcaagcaattctccacccttagcctcccaagtagctgggattacaggtgcccaccaccactcctgggtaatttttgtacttttagtagagatggggttttgccatgttggccaggctggtctcgaactcctgacctcaggtgatccacccgccttggcctcccacagtactgggattacagacgtgagccaccgtgcccgacctggagtgggttttttaagtacttataataattacttgaataatatgtgttcattgtagataacatgaaaaatgcagaaaaacacaaagaagaaaaatcatttctaattttaccagtgtttatcattagtgtgtgccatggggatatttcctttctagccccacacacccaggcaccttcttgttttttaacatttatttaacacatggttaatgacttgctactatgctgcaggaattgtatcaggtggtagaaatacaatttgtattaattgtagataatattttgtgatacattattttttaatttaataagatactatggactgagatgtattcttcatgacgtgtgatgacaacgtagtaatccctaattcctttagttaataagttcattttaccttctcattttgcctctcatttgctattttatcacctttcacaaataggtttatttgttgttattttttcctgctttatttgtaagcagtattagataacagttgcacacggagaattttcaggtacaattaacttctctcttttttgcgtgtaggcttatttcttcctgacaagtcttttgccttctaagtaacttagtgttgaaacattacatgaaaaagccacctcatttggttcttgcacagtaatgtctaaatcacataagaaatgcattgaaaaaaacaatcggggaaaaaagagggagtaatattggctagcacatctttgaatgcatctggaaagaaaagagtaaatcaggattgaaatagaagccaaaagatgatatttttatggaaaataattcccctctccttttctttccccagctctttttctatctaatatgcatttttctttatattataaaacagctttgctcaccttatctctggtagttctttattacttcagtgtcttctcatcattttttaaggttctggaaatgtaaactactttcctaccacttttcatttttgtggatagggtggctgatgggctttaagtttcaagctatgatgaaacaaggaaatagatcacttcttacagtgtaataatggaactctgttgatgggtctaataaagaagaaaaaaaatcaaaccttatccatcatctccatgacttctagtgtctttcccatctgcatcttcatgttaagcaaaaaatatataatgcaaaaagtgtgtttcacaaaggactttttttaaaaaaaaaaataaggttagggctttctttccttctattttttttttttttttttgagttggagtctcgctctgtcccccaggctggagtgcagtggtgcgatctcggctcactgcaagctccgcctccccggttcacgccattctcctgcctcagccttccgagtagctgggactacaggcgcctgccaccacgcctggctgatttttttgtatttttagtagagaaggggtttcaccgtgttagccaggatggtctcgatctcctgacctcgtgatctgcctgccttggcctcccaaactgctgggattacaggcaggagccaccgcgcccagctaaaggttagggttttctaaggttgtaacttttgcatgtgtattacttgccacacaaagcatcaagataaggaaaccagcccttatgggtccttagcttcatgacaatatctaaaggtcatactgttttaagcatacagaaaaccctctagtcagagtctgtgttagctgttctttaaaaaaaaaaaaaaaaacttccatgtcttgctattattatgagtttgtatttaaaaatttcattctaaccagcaagaacacttccagtgggaatttctgataaagcagtcaggttttagcttggagatgtactaagtgcagaagttttgtgagttttcttcttggtcttgcaaagaaaagcatgaagctatataagtctttctgtaggggaaaaaaaaatactttttttcttccttttttttcctttctgatgagcatggatggaggagagatccatccatattctggatcattattggctctgatgatggttttgtacaaggaataacctctcttggggtagtgattctttttaatgacctttataaaccagaatttttgttcatctgagaaactaatgaggattaagggaagaaagggggccgggtgtgggggctcactcatgtaattccagcactttggggggccgagacaggcggatcacttgaggtcaggagttcgagatcagcctggccaacatggcaaaacctcatctctactaaaaatacaaaaattagccaggcgtggtggtaccggcctgtaatcccagctacttgggaggctcaggcagcaggatcgcttgaacccgggaggcagaggttgcagtgagtgccgagattgcctgggtgacagagcacaagactctgtctcagaaggacaaaaagaaagggatccaacagatatttatcagttaatgtgtgaattacccatggcatcattacctttaggtttgctcagaacaagtcctgtttatcccttgatcctggtgtaattattgacatccccctttctgctgacaggtgtcccagtttcaacgatgtattatatagtcattccatactcttaaacaagagagtaatcaaatatagaagccaagcgtccagaactatggctcagacaaattggcagttgaattttgatttctgtacttgattttttctgagaagctgaaactactatacttcagttaacttatttgcgaaatataggtattatagtaatgtttttgccgtatgggtgttgagaaaattaatatgtgaaattttgatcaaagtacctgataaatagtaaatactcatttgaaattagcaaataattattcctatattttttttcattgaagtctttcagtgctacatgttacagcctccaagtcatttaatttatagaaacagaaatacttcgtggtctgcagcagtggacacaggaagtggcttataagaagatggacacagaaagtggtttgctgaagtaagaggatggtaaaacagagtggattcatctatgataagtgtctataaagggattatggatctagagaaatttctgtaagttttcttttgggttagtgttcaaattggtaaagttgccagggcgaggtaggaaagtcacattcaagccagtgtttcatatttattggtttatgatttttttttgagacagtctcactctgtcacccaggctggagtgcggtagtatgataacggctcactgcaacctctgcttcctgggttcaagcaattctcctgctttagcgtcctgagtagctgggattataggcacacaccaccacgcccagctaatttttgtatttttcctagagatagggtttcaccatgttggccaggctggtcagaacttctgatctcaggtgacccacttgctttggcctctgaaagtgctgagattataggcatgagccattgcacccggccagtatttcttaaagataggtaataaggttgcatctttttgctcctcgaaagatgggctttgccatatgacttactttgactaatgaaatatgcagggaggtgatgtgactttctcataggtggatgcttgaagtgacattttgtgagttaccacattttctagcccttgccttagagattttggatacatgaggtgagagaaaccgtctgtcagctcatgtccctgagtgactacaaaaaacaaaagttccagccaacctgtattgagcacatggtacgaatgagaaataaacttccattgctataagccactaacttcaggggctgtttattacagcagcattgtgttgcccatactggcttatgcatcttgcctcttgcttacctgtcatatcttctgctgctttgcacgctcatctcttccttcccccacttgccattatcagcaacacttgctgaccacctatatgtgcaaagtgcttggtgtcaatatgtttctcataagaaccttatcaagtaaatacttattatatcttgccactgccagatgaagaaatgggctcagagggtcactgttcacaaatcccatagttgtaggtagagaaagagtcaaacatgggtctttcaagctccaaattctgttattaaccactgtggtatctgtcttgtattaggaaggagttcccttactgtcttttgaggttttttttttttaatgtaaatgccctgagtttttcaacacatataaaagggttttatgaatcctttttgttcataaaaggagattaacattaatttctgtgcagagtaggatgaaatagagaaagaaagaacaggaaaaatataattggaatctgttttcaactctgacgtgttagaactaggatttttacccttctcaaaacaaattctaggacacacattcatgcagttggcaaagccatgtgactctagagaaccgtgttgactgattggaaatgggtaaaattctaaacagcatcagcttgatgtggaatttccaattacttaattctggttggttttgaagacacatgagctgactgcttcacgggaatcaggaatgaaggggaatctgttcagaacgtatatgtctccccgcagtaaaagcaattcaaagccataaattacttatatcatctcagcgtcttggggactgcttactaatcttaggacctataaaataagggatcaaaggtaacattttctacgttgatgctgtgagatctatgcatatctatctctcagctggccctacgagtttaaaaattgttaaactgacaatttactaatccttctttttggatgatgataataatgatgattttttgcataaggctcttggaccacctagttttcacaggatggtgatgaatgagtttagggtttggcccgaaaaccttatttcatctagaattttgcaggcagagccaagagagttagcagcctggggtggggcaatggagagagcattccctttggtcgcttgaaaaaatccgtgcctttttgtttgtcagcactactgaaattcagcactgctaggaaacagaaatctgatattccaagatgctcctattggattttcacatatctcatttgcatttggattgtttcagcaagtcttacctcacttctgatacctataaatatctaaggttttagttgacacacgtctggctagcttcacaacaaggatttaagagcttcatgatattatttgccatgaataattgctagtggaacatactggatcaccttgtataacttttgcaggctggttttaatttcaggtttgactgttacattgtagctttgcaaagcaataacaaatcataatgtagatgagcagaaacaaaacaaacgatgatgggaatattaccataaccataattttacagcacagtttaattatttggttcagtaatgttgaataattatttcaccaccaaaactcctccccaccccagcccctcaacaaactaaacaactgtttcactactagcaactaatttatgaggcaatttcagattcttatgacttcttgtcgctctgagatttacagtcactaataaaaggccctaactttgagagacttgaattaaaactcatttataaagagaataaaaaatcagactttttccatttctatccgtaagtgtccatattcctgtagacctggatgtaagtggatgaagcccactatccagtgaataacagatgctcattaaatattggaaagcaaatgaagtcataaatgcgtataaagtaggcagagtcttaggaatggacaagatgacttatctttcttcttacattctttaggatggaatttgatgaaggttcctttcttttgtttttgaataaaccaactgaagtttaattccatgtttcagaaaatcacccctgctttttttggagatggagtgttgctctgtcccccaggctggagtgcattggcatgatctcggctcactctaacctccccctcctgggttaaagtgattttcctgcatcaacttcctgagtagctgggattacaggcatgtgccatcacgcctggctaatttttgtatttttagtagacatagggtttcagtatgttggccaggctggtctcaaactcctgaggtcaaatgatctgctcacctcagcctcccaaattgctgggattacaggtgtgagccaccgtgcccggcctcaaaatcactcttgactctttcctctcccttatccctcatgcccagagatcaactccagtggtttatcccctcttaattactgactgaaactttttgcttctctccattctccttctattctcctggccaaagccactcttccctcctgcctggagtgctgtcaacacttctaaactggcctttcttcctccactcttgtccccattaatctattctccatataccagaaagagtgattttctgttacatgatcgccatcattcttgctgaaatttctactctaccttccgctgattttaggatcaagtctggaaatgttgtcagtggccctcaaagtgcagttgctgcttagcctatcgtgtcctaaatccgcatctgatggcactttgtcacaatccaggctctttgagagagggagagagtctgtgtgtgtgtgtgtgtgtgtgtgtgtgtgtgtgtgtgtgtgtgtgtgtgtttccctcggtagagtatggggatctctgaaaccctttgtatactcaatcctattgttcattatgattgtgtgtaggtatcgtttctggaaagcctctcagttacatacccttctttgtcttttcacagcataattgtaatggtacctgttatgttttaatatgatacgctttcttttccaccaaatggaaaactgtgagagcagtactacgtctgtcttagtcaccaacttgtgctcagcacctagcatggagaccagcacatagtagagatttaataattgttgtgtaaatgaataaaacacatctatccagttggataacttggggtagtttgcttctctgcagtctgtctccctctcttccttcctcccttctctctgtttctctctttttctctttctcgtagtaataatagctttactatgaccatagctctttttttaatcgatcaccttttaacactttaagaactatttctaaaaactcaacttaggaaacagctgaattagccccttgctttaggtttcaggcttccctgaattccctatgattttcttatttgaaagtctggttcctgtttatattggaaacattctttaaaaaaagataagaacgtttggaacggcaacaaaacacccaattaatgtgcaactactttgaatattcctgcagtggcaacggttaaagtagaatgattggacactgtcactgctagcaaaattataatccagggtaagctagatttagagttgtgtctcaaaacctgtgttttttgtccttcaggagttaaaagtgcaaaaaaataaaataactgagataagagttgaattgatgccttcgaacaaaatggttaaattctgtttgggtctttaaaagagttaacagaatataacaattcaaagactccatgttccataaaaattgtgctattaggaagaaagccatacttctcagtaacctccctgacacttgctctgttttacttccccggccgcagctggtcttgagtataatgccattgattttgagagatcttataaagataattagatatactgcagtgtgttctatattctcagcatttctgaggctatgcaaagccacccaaacttctgaaatatgtaccttgtatttcttacttgagaaacttttagtttctatgcattggaaaaaaaaaaaaaagctctatagcagactttcctcctgaagcgtgaagaaggaataaacgaggagtagagatttttgcctcctttttcatttatgtaaataaacgtatgaaatggatttttaatttatacattagttatcttggtcccaaagcataactcttttaacaccttgagcttccttatgttggagggggaaaaagagtgcaaaatcattagagacatgattatgctttaatttaggtctttgagttatgtaagcagaatgcaattaaagaagaagtgctcactatgactacctatttcaaataggctttcaatttttcagttttatgtgtatcttctgcaattgcataaaacttcctcaaggctatgacagtggattatggctgtgttcttgtaattattttcagcttaaaaaaaagaacaactttgctgcataaactattgagttaaacatattacacgtctagtttttactgggattgtgtaagattttacaccagccatgagattctctgcattcataggtttagaaggaaaatgtgagtatttatggcatcatgattgtcactgtcactatcatcctctcattgtcgtcatcaccatgaaaatcagatccacaagtgttatcttgcttaattattgcagcaactctgtgatctttattattgccattttccagataaggaaaccgagactttgaaacattaagtaacttgcataaagtcagacagctaggaagcatagtatctgaaataggaaaccattgctcactttggcagcacatatactaacattggaatgatacagagaagattagcgtgacccctgcacaacgatgacatgggaatttgtgaagcgtttcatatttttagtaaaagtagaaatacctgttgatccattatctaccaaaaggaaaagaagtcattatatgaaaaagacacttgcacatgcatgtttatagcagcacaattcacaatttcagaaatatggaaccagccgaaatgcccatcagtgaataagtggataaagaaactatggtgtgtgcatacacacacaaacacatgctactcagccataaaaaggaatgaaataggtcaggcaaagtggttcacacttgtaatcccagcacttcgggaggctgaggcaggtggataatctgaggtcaggagttttgagaccagcctggccaacatgatgaaactgcatctccactaaaaatacaaaattagccaggcatattggcaggtgcctgtagtcccagctacttaggaggctgaggcaggagaactgcttgaatccaggagatggaggttgcagttagtggaagatcatgccactgcactccaggctgggcgacagagcaagactccatctaaaaaaaaaaaaaaaaaaaaaaaaaaaaatgaaataatggcattcgcaacaacctggatggagtgagaggccgttattgtaagtgaagtaactcaggaatggaaaccaaacatctcatggcttatctcccacttacaatggttttccattcccgagttccttaacattgtgttaatatactaacatattctcgcttataagtgggagctaagctataaggacacaaaagcataaaaaatgacataatgtactcttgggacttgaggggaagggtgggaggtgggtgagggataaaagactacatactgattgggtgatgggtgcatcaaaatctcagaaatgacacccaatgaacttacccatgtaaggaacattacctgttcccacaaaactattgaaataataataaaagaaaaacattgttgaaaagataaaattagaaaccaagaagcttggcttcataacccatgttactaatcttaaaaatgattccaagttgggcagaaaatggggagaagttgtgagtgggagcaagtgtggtcaagaacagggcgaaaaaaatgtaaggactcaaaatgtaggttgtaatcttatcaattgactgtgttaccctaagttgcttataccatttaatcatataatgcctacagtgcttgtgcacataatcatcttctttgtattattatagtgctacggttgatgatgatgatattatcactattgtaattcaggaaatttcagtatctctgaagactcttcggttgtctaaacaatacaactcgttatggtgggggtgcgttttttagagaaacatttatattttaatctgtcctttatacacagctttgacctctcctgtccaatatgacctacttctctgaagctggtagtggtttttgaggtttcatttgcaatgtgtggcttcttcccaggactcacacaagattcgctgagagtcttcgaattttttgaatcacccttaagtgcagtatacatcaattcagtgctctggcaaagactatgaattatgtttatgtctgaagcaaggccgtggttaaggaaaatagtagatgtgttaagaccttgtttatttcagcagagaaggttagagttgatccacatctggataaaaataattttaacctaggagaagttatattttctttataccataagctccccttctctggtagcctaaatgaatcagcgccacatctgggcatggtggcccatgcctgtaacagcagcactttgggaggccatgacagcaggattatttgaggccaggagttcaagaccagtctggggaacatggtgaaacctcatctctacaaaaaaattagccagtcatggtggtccatgcgtggaatccaggctacttgaagggctgaggtgggaggatcacttgagccggggaggtggaggttgcagtgagctgcaattatgtcactgcacttcagcctgggcaacacagtggaacttgtctcaaaaaataataattccatttaaaaaaaataagcaggcatagtaacacacgtctatagtcctagcatctcggggggctgaggtaggagggtcacttgatccagaaggaaccccggagattgaggctgcagtgagccatgattgcaccattgcactccagcctgggcaacagagggtgaaggaccctctcaaaaaaaacaaagcaaagcaaaacaaaaagcatcagcaacacaatccatcttagattcctgacatccagtctttctattcttgggaattgtcctagaatcacccagttgcttcctggtcagcatattcaatggacaatgaatgacttgttgactattccaccatcaaagaaaaataatattaataccatccaacccctgaaatgagcctatgttctatgaagtaaattagctgaaacaaagtcactcttaaaaatgaagtgatatcaaaaatcaccaccttggtttttgtcactattttatcttcatcacatagcgctgtacctagcacacagtaggcatttaatatttgtttgcaaaaaattaagtcacttctataaaaattaatagtgtgagaaaccttggactttatgatgcaccatactagagtaaaagacttgtatctattttttttttctaagagtacatttctcacctagggttctatttcttaatcttggctggaaccaaagaagttgttatctgccgtctgatcaagagagaacccatagtccctgcattgtaatttgtgtgctttttcttatttatatttgcattacaagaaaacatgaaataactgtatctgctaaaactgaccgaaagatggatttcagatgtgagcaatggaagtgggattggcattcatcatagtgtaaatgcaaaagtgcttttagcccaccaagtactgggtacactattctgaccttttttcaagtttctcagtatttatggaagaataatttgtagaataatgaatatagttttccagtggagcaacaaatgcatactatatttctgctattgtttcttattaaatattcatatgtatattttgtgtttgcttcataactggccatttactggtgcttaacaagcataggcagtcccgctgaagagaaataacaccaaacaacagtaaacaaaaaagcagacgaatgaaaaaagatatcttatttctgcagccgttacatttaaaaagtgcatttaacatttttaatacagtccatatttcataaatcccacatgttgacatgtcctagagaaagatggatgggttgacttggaggtatgcttctatctagttttatgtgtgcatctggcagagctaatctttacttccctttagcagaacacaaaaatgtaattctctaataactgacataactgcatcattttccaatatggactgcattattaaatcacagagacaagcaaaaccagagtagtggggaagcttgacttctgcttgatatcagaccataaaatgcctacttactgtggccgaaaggaaaaagagcatcgactctcagtgcttggaattcggaacaacttctgaattcacagccccagagtcttgtgtgtgtgcaacaataaccgtgtctttgcatttgcatattgctttagagttcacaaagcatttttacggacaagcccatactgagaatcagagcaaggattgctattctctgtgtatagtgagaaaatagaggctcaaagaagtttccaatatagtaagaattatttctgtaggacttttaaattgtataaattgctttaacgcatgcagttacattttgcttgtgtaactaggagaataagtcatctaacagtcttcttcctatccccaaaatacccattcaaagagaatagggaaaggattgcttccagactaagaacttaggatcttgcgaatggtagttgcaaaacatacacagagtcttggattagcaaaaagtaggggataagggtttcagagagccgagtcattgtgcttaagcatataggaggaatttaaggatgttgttgcctctaagagggatggagctgaaagacacacaagggtaggacagatagaagagagaatggctgagatatatggtggcgtgtatgcaaggacttctaagagaagtgatagctaatgtttgtgttgctacaatgtaaatacttccacttccccaagcaatatattgtatggtcaccatgcaggctcatcaacaaagattccgtttcttccctgctgagcactgcttgaagttcttgtgatttgagtgaggccatgagagcagttctggctaatgaactataaatgaaagtgacaggtgctggaacattttattgctgatgcaagagtttctagaaatttcttatctctctgatatggtggctagaaatatttcagatgatggattttccttcatccaagattgctgagagtctttgagaagcaacaccaccctgtctcttaccaccaaatccatgatggacatgtgatatgagcaagaaataaacttttgttattcctggaccttttagattttggagtcatttgttgccacagcatcacatggcgcatcctgactgacacatgcagtgtcctcatgtgaacattttgtttgtgtgttgtcaaggaaagtcactgtggttcgtgttagcgtcagtttaattcaaaggtaactcaacagcaagaaacagaaagtaacagaaattcagcaagggcaagaaatggaaacctgatatatcccatgagagtttaaggaccctgacaatctgcagaaattttaaaaagtgctttgggcttttcacaaagtatagaaaggggttttggaaaaacctatttgaagttttaaggatcagagagaaattaacagctaatctttgatagttctcccagtaccatcttcaagttaaagaaaagggtaggattttttttcccctatgttaggggaggaaattaaaactgagataaataaaatgacttgtataaggtcatgcaaatgctaataagcaaagcccagattactaaaccatttgaccacacgtgtagtagtgtttcagcccactcttttaagaagttttcagaaagccaatgagctaatagcttgaatatattacagtttgaccttcatttcagcaggacagacaaatcattgacaaaacggctgcaagaatatcagcccttttaataagttgtccagtaatatgatatttttatgattattcaatgaattgatttttatggaattggctttcagtgaatttatttatcagccagttttctgaagggcagcccaacactatatgccataaattttctttgctataattaacttcagacactctgtctcctatctttcctaatttcatctctctctctgccctgtttatatttattggatgctctggtatgtaattattagaattttccctttactttaaaaactgttctttcatctttgtgtgtatcattgattgatgaccccatcatgaccttaattgcaatttacaaacttacttgctacaaagttaggttaatgagattattcactatacaggtagattcaacataagtttccattatcatttttaaagccagtatcatccactaaacatcaatatgtcatgcgatgttttaggagcttcaagtaaggtccagttgtgttatttcagttaactatgttgtacgtctctgtttaattgtaatattcttttctgtggaagtaaattctacctctggatcctacttaacagtgttcctggctgttactaacccttcctctgatttgacattggaatggaagcatttttgatgttctatttatgatgttaaatttacaaagaggtttgagacattttgaattatctcataaatgtgcaatcttgcctcacagttaaatctgatcatttcttttaaaatattatttaaattttcattgcatcatttcttctatctgttcagtggcatttctacttctttatttgttaatcttctgaaatagtcttaatctttcatacttgaagcgcctctgtttcctccatccatgcaagtaaattttcctccagattcaactcctttctccttagggatgttcctgagagtcccctgacctttcgagttacttcttgtcagtggctggtgttagatgcacagttctctaatcatgggatattccacctcaatctgtgtactcctttaaggtataaaagagcaaaattttccaccggggggtagcaacatgacaagaagggaaagagcagagttaaccttggggaaaaaaatgagacataaggttggctgggtagacgaggcagccagagagacagcctctgttgttcctgaccactgccttggtttttagtattatactttccacttcagtcactgcaacccaccgccctgttgcaggaatgaacatgtgacccaggtgcagccaatcagggtttgctcttcccctgtgttggtcattggtccaaggtggacaaatgatgcaaaagctgggccaggtagagagatttcctggaaccttgctagtcaggttagacagcttcagacacgtgaactcggagaaggccagaatctgtttttctttctggactgtctgaaatgtgaactggaagaggcagggtggggaaaaaatcaacccaaataaaattagcagtaaagaaatctagataaaaagagcactgagctgtatgatgttccagagtcagtttgacttcttggacgatgattattttatgattgtatttgattgcgttgtattaaaattattgttatatttttattacagtatttcttatattattgaaagaataaatcaatatataaatgtgttggaattgctggacagcaaactatatacattttatgtggttgacagaaataagctacttgaagctgttgagcttgagcagagtgacaaaaagatgtaaatgctacattaggagattcaatctaataacagtttttcaagatgaatacacagtgagagcctaggcagggctgaaaaatacgtggcccataccctccaccttcccctcctatgcctgtggcagacattgctaatcaatcatggcacttttacccactgagtctgagctggtcttaccatgcttctcagtgaagcgctccaggcagtgactatagatgatcagagctggcacacaaaatgaaacccatttgctctcccaagctcacaggcaaggagaatagccaggagtctgagcatgaattagatataaggttcccaagattggacctaggtggggagagagcaaaggaaggggtaaaacctatcgttgacaatattagtttgcttggactgccataacacagtgccacaggttgggtggctaaaacaacaaacagttactctcacagttctgcagactagaagtccagaatgaaggtgttggcaagattggttccttctgagggctgtgagcaaagggtctgctgcaggcctatccgtggcttgtagagggtcagctacatagagagcctgtgtatctttacatcatcttccgtctatgcatgtctgtgtccaaacatgcatactcctcttcctgtaaacactccagtcatactggcttacagcccactctgaggacctgactttaacttgattccctctgcaaatattccatcttcaaataaagtcacattcttagatgttggcagttaagacttcaacgtcttaacgttgaatttgcggggacaatttaacacatcacactgggtgcctaccatgagccaggcatgagcttatataccattatccactggagcctcaatgcaacctacatactgggtacttttattctccctattttacagagcaggaaactgaggctgaaaaatcttaagaactgtagtaaaagtttcacagctggagttgctgtatagcaggatttagatgtaggctcctgctggctaattgacatagtgtaaaaagaagggaacttggttatgggttagacataaaggagaaatttttttaaaaaaactaaaatcaccaaagactctagacttcatttctggaaaaatggtgatgtcagtcttcctgcttaatatttcagtggccccctattccctgcaggttaagatgtaaattatttagcaggaaagtcaaggctgctgatggtcttagatgcctcattaattctgtctctagcttctctcttcctggcccctttggtccagcaacactgggcaatttatttgcagtctccaccttagagagatggagagggagaaggcttggagagaacagaggatgatggggaggaacaacctgtgcactgggtctcatccttgttgtttgcaattctggctacttttagcagtgagcagtataattacagtttagtcacctaacctctctgattctctctcttcccagcctggccaacatgatgaaaccccatcttcactaaaaatacaaaattatctgggcatggtggtacgtgcttgtaatcccagctactccggagggtgaggcaggagaatcacctgaacttaggaggcagggaggttgcagtgagctgagatcgcaccactgcactgcagcctcggtggcagagttaaactctgaaaataaataaatataaataaataaataagatcatgtttgcagagtcctcagtgcagtgtctagcacttggcaggtacccattggctgtatggataacaaccattcagtttgggatatttggagtctgacataaccaacggcaaccaaagagacgagttccttaccaagccagaaacgcaagaccaggatgcaagtggcattcctggggggtatcaattctctgtttctttgccccttttcagaggctttatgttcacccccaggagtgaacaaccatcttcctgctctgttcctattttccattatacttaccaggagttatgaattgaatcaggatgtcttaggcggcttcccctcctgctttagcaatcaataaattgccatttctaaaggtgagattgtgaattgttaagtccaatctgcagatattctagataacccatatgtctcctgacattgctgtattcatagatggcttctcaaaccattattaatgatgtaattagtatgaatggctacagtatatatcaagcagatcattaaggcagaggtggggaggtagccatttatattaaagatacgtttaatgttctgaacctaagcaatagaaagaaagtacttagcttagaaatctcgctttgctacactatgggttttcttttttaaagttgtcctagaccttctttttgcttgcttaatgctactttttgttggagcccctgggaatttgaatgagttaataaggcagatctgtttgtaaaagagtataatcaagtaaatcacagcctttaaaatcacagatttcaaaatccaatcaacttaattaatgtgttggttcatagacattgtacaagattttatttgattgcactagccgctttctcttagacacccatctgcaagaatatttacttataacttgttgtgtaaagggatcttcctaaacggcacactgccatatgtaactgctcagcttacctttaagagaaaatattgaagtaacaccctcaagctgttctactctgtgttcagaacttttcaaagctagatttctatctttgtagtaagtattgaaaccttgcctcccacatccaggctgttcaaatatgagataaaatagtttctaagaatgatagagtccaaaagttttctacagttcttatagatgttgtgagctgaaaatacatgggttagtgaagaggtttttttttttcttttctctattattatctcttttttccccctaggaattaatgtcctttgtagtagccaaaatgttaaatgtttttaataaaagctgagacttaagttagaggggaacatctttaccccaggtacaaatgacgttgctacttgccacggtccaaagcgcagaggagatggggagattgtgaaaactggggagtcacacacaaggagggggtgttttttgttcttctgacaaactgatcctgttaagcatccactgcagagcggtggctgctgtgttatgcaagcacctgcgatgcgctgcagaagaagagaggcatctgatgctcgaccgagcagagctactgcagacagaagctgcttccgaggccccttctgctcacagggcatgcttcctggctcatgtgcagtcagccatgctgcagaggccagggacccagggagcgtggcaataagtatgtgtccagctttccaaactctgggtactgtgaagcaactgcagctctgagccttgcttaaccagggctggggacctggcagcttcttccaaagtcacttgacaacagttgctctgccctcagtcaatgcaagcaaccacttgtctacaaaaggagtgaggacagtaaagtctctgccttcaaggatcgtactgtattcttattattagtggctacaaactgttaagtacctaccatttgcaaggaactgtgttgatgacatgttacatgtacatcatctgttacattatcataagacctcaaatatgttttattacccccattttgaagagattaaaaaacaaaaaaaactaaattggccaggtgtggtggctcacacctgtaatcccagcactaggggaggctgaggtggtggatcacttgaggccaggggttccagaccagcttgggcaacatgacgaaaccccatctgtactaaaaatacaaaaattagctaggtgtgatggcacatacctgcagtcccagctacttgggaggctgaggcaggagaatctcttgaactcaggaggtggaggtggcagtcagcccagagtgctccactgcactccagcctgcatggcagagcaaggctctctttcaaacaaacaaacaaaacaaaaaaaccctgcaaatattaagtgttaaatcgtaaaactgagaccgcaacccagatctatcttattctaaagctttggttgttttcatttcaataattactgtcatgttttagaaaagcagcaaaacgtttatttaatatgaaatctcctgcagaaactgatacagagacagatcaaaccaggactgctctgactgaaacggaaggaggaaagtctcaagctctgactggaccgcctcctccttccctaattcccaggtagtaattcccaatgactgagccatcacttcagaaaactagaactgtggtttttcagatgtggtctccagtccagcagcgtcagcatcacctggaaacttgctacagacgcgtgttctctatcctcgctgcaggcaaactgagtcagaagctctagggtttgggtgtctctgatttaaacaagccttcggggggttgccgaagcatgctcatgagtcaaaaccaagaatttacaaaacccattttaataacagctgagttctatagtacctttcagtattcgtaacagtgattcctggagactttcttgacaaagtccaggatggtgcattaaatctacttctgcattttatttttttattttttttattttttttgaaatggagtcttgctctgtcatccaggctggagtgtaatggcacagtctcggctcactgccacctctgcctcctgagttcaagtgattatcctgccttagcctccctagtagctgggattacaggcccctgccaccacactcagctaatttttctatctttagtagagactgggtttcaccaggttggacaggctggtctcgaactcatgcctcaggtgattcacctgccttggcctcccaaaatgctgggattacgggcatgaatcactgcacccggccttagtcatgcaatttttattttagagaaattctagaaatggatactgtttactcaatgcagcattggagaatgaacgttgactttattaacccaataataaaataaaatgatttctcttgatttgtttgctgtcaagaatcacaaaccacatggacttgagaaaagtgaaagttattaacgagatttcatgcatcaaggatactgttgactgtccagtgaaagtattttttttttcttttttttttttttgagacggagtctcgctctgtcaccaggctggagtgcagtgacgtgatctcggctcactgcatcctccgcccccagggttcaagtgactctcctgcctcagcctcctgagtagctgggattacaggcgtgtgctaccacgcttagctaatttttgtatttttagtagagacgaggtctcaccatgttggccaggatagtctcgatctcttgacctcacgtgatctgcccacctcgacctcccaaagtgctgggattactggcgtgagtcactgcgcccggcccagtgaagcaccttacgtgtgtgtcaccattgagaagaaaggttaccaaataaattttgtcccgctattgattgcaaaggcattccaatttccaagatatgaaaatgtaggcccagcgcggtggctcacacctgtaatcccagcactttgagaggccaaggcaggtagatcacctgagttcaggagtttgagactagcctggtctacatggtgaaaccatgtctctactaaaaatagaaaaaaattagctgggcgtggtggtgctcacctgtaatcctagctgctcaggaggctgaggcacaagaatcgcttgaacccagcaggcagaggttgcactaaactgagatcgcaccaccgcactccagcgtgggcaagcaagtgagactctatctgaaaaaaacaaaaacaaaacaaaacaaaacaaaaaaaaaaccagaaaaaaaaagaatgaaaatgtgaagaaacgtttgctttagaatcagtgaaatatggcaaaaataaaagagatgcttccgaaattttgttgcattaggtcacttagccaatgaggtcaggtgtctgtggaagcaaaaccgtgtctttgtaatcaatttaaaataacacaaaatgaaaaaaaatgctcttgttcatgataattttttccactttctggtttgattatcttccatatactggtgagtctccatacttggttgtattgtccaagttggattttccctgcagcttcaaaatcatcatgtccctcaccaaactcatgaagttcctttacattgttattgttgactctgctgttcttcttgttattgttggtatactctttagcacttcttcctcctctatctctaattctagtacttggaaggagactatagagtagtgattacctgtattttgagaactgtgttatctgcgaagatgtttcaaagtgtggtggggttataaagggctttgatggtgggacaggatggcattgagtaaagtaagttgagaagttgacagttctccctggccttatgggttcattgtgatttcaagaagccgaaaggatatggttgtatcatctgtgggctccatgaaaactaatgatcattttctaaacttcgcatcatgttttctggctttttctatccctggaatcattaatcatgtatattaggtgatttccctatatctgtttatagacacaaaaacacatatacttttttttttcctttcgaattctgccatatcaccatagaggtcttcaggaagttagtaaccctagttttagaagggtttggttgtttttgctgtctttccatagtcatttttttttttttgaggcagagtctcactctgtcacccaggttggagtgccctggtgcaatcttggcttactgcaacctctgcctcccaggttcaagtgattctccagcctcagcctcctgagtagctgggtttacaggcactcgtcaccacacctggctaatttttatatttttagtagaggtggggtttgccatgttggccaggctggtctcgaactccagacttcaagtgatccacccgtcatggcctcccaaagtgctgggattataggtgtgagccaccacgcctgtcccatcctcatcatttttattactgcatcttattctgtttggggtttttgtttgggtgattgatttgaggtgtttgcttgtgtgtctgatttggggaagacgttcccaggtaattagtgtaaaatttttaataagcctcataagctttacaattatttccctggaggacaggttttatttaggatttaagaacagtaggcagtagttgtgacattttgaacattttatttctttacccaaaaaataactaacttttgtaaaaccaatgaaaagaaatgaaaagaaaatgaaggaccacaatgctttatgggtttgtgtttctgacagcttaagtcctgctcttgaaagtagttacacagttggcaatatacaatgaatcactgaagctgtttgaaaactttttcgtttttttgtgaaaatccaaacttggaggagaaagagcttactgatgtcaacacttagaaagcagtgttctctttatatagtcacttactgtcttgggtttcattttcggttcagggggaaattaaattcccttgcaattgcactctctgtctaccgagaaattttatctccacattgtttttacttgctgtttgtcctctgggtaaaatattgtgtccgtagggttagaagtgcattttagaggtcttttggttcatcaggctgttccttgcaggtcagtatttatactatttctgacccagatgtctcctgtattctaagatcctagtaaaaaagctgggggaagggagaccattgtaagtacacagcagccttactttgtgagctcatgccttagttaaaagattaaccgaagaattttatttcaccctattgtgttaccaaacattagatcttattgcttctaactatatttttatgtcctttattcatccctctttatcccctcctccccaaaaaagaattattttagcatctgaattcattctcctgccaagcagatagaaacctttaatcacttacttactgtaggtatgggcagacacagcttttctgtttcttaagcctgtccttccacttagattgcaaataagtcttcagggaattgcatgtgttctcaaatttgattgtattttttcccttatagacacgggttggttagagggatatcacagtggacaagaattccaaaaaacctggcttcaaatctccaatctattactgtaacattcagtagatcccattgttactgaaaatactgagttcattgtgagccacccctgtctttgagcctttccatgaaagtgagtcttctcccaccccattcttgcccccgttagccccatggcttgctttgaccagtgaactgtgagcataggtgatggatgtcactttcaagtggaaaatttacgagtatgcatgtgcctcattttgctctcttttccctctgcagtaaggccagtgatatcttacatatgacggctctgtcaacttggatttccagaaaaaggagaacgtggaacagataactttgagaaatgggcttttagcaagtgggaaaataggcatgtattttgagctgtgtgttgggttcttcgtgactgcagtgttactcaccctgtcttgaatgatgatggttagtatttgcaacatatacatgtcgaattcccgactagtttgtggaggaagggaagagtgccaatccatatccgtaagcccatcctcaatccaccagcttccaccatgtagtccagcacctaatggttgtttaataaattcttgaagagctatattgaaattggtttgtgtaatcttggaatagacccttcagtggtaaaaaccagcatttttccaaaggttgggtgagattttaggagttctataagtttcttttaggtggttcacagacacagcaggaaacaagattgaatcatagggtggagaaagttttcctttttgagttttcttttaacacattgtatagcattcaaaacaaaatttctcatagccacgtatttcagtggttacctgtgataactagaattccaggagaccaatgtgtttatatttgtacagttgcttaccatttatggttaataatagtagtgtcccacttatactagaagttgattttatagattttcttttaaagtaaaatgtgtttagcacaaagagtacaataaaggaaaataaataatataggtggtaaggtgaaaatgtgaaagcctaaaggtatggtatatgattgaagttgggagaaacactgctgtaagccttttggtaccctaaaatattgttatgaaaacctaaggagggtgggcatggtagctcatgcctgtaatcctggcactttgggaggccgaggcaggtggattgcttgaggtcaggagttcaagaccagcctggcctacaaggtgaaaccccgtctctactaaaaatacgaaaattagctgggcgtggtggtgggcacctgtagtcccagccacttggaaggctgaggctggaggatcacttaaacccagatggcagagatttcggtgaactgagatagcaccatggcactccagcctgggcaacagagcgagactccatctcaaaacaaacaaacaaaaccaaacccaaagaatgtttgaatgggttgtgaggatggtaaagtgatagatttaaggaatcattgctttggttatcgtttattgtgttggtgtttgtaacagtctttccttcctatctagggatttatctccatcttgtctgtccccagtttcctgggatttccgtatgaatagcatattccaagtggagaagaaggagagtgcctaaattcactgtcaccttctgatttaagcttttttaacctacgtacccactctctgttctgtgtgaaaagtaactggaaccatttgtgtaggtgaaaatagcacttagcagactcagtagaactctaaataaaagggatgaagtcaggggtatgaagtgagcatgaagtgagaaacttgaacagactcttgcttgcttgtgactgtaagtgttccctagaattcgtgtggagtcacctggttctttgtgtctcagacccttcaacactgtgaacgttttgaggacaggagttacgtctgattccccttcatgttccccgtcccttcacaattgtttgttgacaccaggcgttcttccaatatccatccattcattcattagtgactttcagttaaagcctactcatgtcttccattacaggtgccaatgcatccatttttattatcagtagtggctacaataatatttgtagcagctacaaattatagaatatgaatcatgaatcctgctagcactttataagaacaactgcttgaagcaacttagcaaggtggcagtattatctctaaagaggaaaatgaaacttagagtagttaatctacttgcccatcgatataagatacagacactaaatttgggtctacccagttctgaaaacccagaaacccgtttgccttttctacctaatagtaccttgttgatgaagacacatacacacacacactagagagagagagagagagaggagaggagaggggaagatatatcagctacataaacttcccagtcctgccttatttattagtctgtgatggttagttttttccagtgctccaggcatagcattcctcagcaccattgttccaaatcactgaagctggcagcattcctttccttgcttaatctctgcaagtttcaacaaattgttaatgtaatgttttccttgaacatacttaacatttacttttattcatctgaacgtggaacgcagcactccatgaaggtgcaatctgtcttcaatccaatgtctcatcaaattcctgctgcccaaaatagagcaaaggttgagccagcctaatgtagggttggcatatgataccattatagctacttagtggacagcaaggccagcactgcttttaaaacaatccctgctcattcttttcttccctttctttccagcaagtcggttttctgagaaggagctgtggctggttgtattaacatttgcattttgatcctgcttactgatgcactgcaaaaaagaatcttctgtgttgcctacttagaattttctgttgtagtcgtgtgaagttgccaggtggatgacatagatcccatttcttagtttcctttacagcacgttgactcttacccaagtccccaaaccccctggttggtgattgcagaccctctttgcaccccttcccttggcgattttatgcaaagttaatgccctttggccaagcagaacttccccagagctccttcaattcttcacatttttgacagtaacactttgtaacgaatgtattttagacaagactcttcgaccgtaaagtactggatctctctaaaaataactcatttgaaaagggggttattttaaggagactcagaaaatatcttaaaatatccaaagtctgagaccaggcatggtggctcacacctataattccagcactttaggaggccgaagtgggtggatcccttgaggtcagacgtttgagaccagcctggccaacacggtgaaaccctgattctactaaaaatacaaaaattagctgcgcatggtggcacacacctgtaatctctgctactcaggagcctgaggcagaaggatcacttgaacctgggaaatggaagttgcagtaaggcaagattgcaccactgtactccagcctgggcaacagagcagggctgtctcgaaacaaacaaacaaaaaagcctgagagtgaagtacagtgctatttgtaggggtttgttaggaagcagaagtatcagaaatgcatattctcaaagcctccctgtctccctctctctctctctctctctctctctctctctctctctctctctctctctctattctgcttcagggtgttctgtgcccccctcccctgtctgatttctgtctctgctcatttctcaccactcactctcagtctttgctcctcagctattcttgcgtgtgtggcgctggctcctgctctgcttttgccttgatctagttttacttttaattgcaaaaactacaattacttttcattgcaaacactgcagttacctttgcaccaaccgaatacatgatctttctcttcagaacttgtaaaagactgcccacctcacctgaccctcctagattccattcacaggagctcactgtctgcagaatgaattgccattgaaacagctctttcacctcattttgcaggcagtggagtgagtttacaggaaatggacaagctcacagggaagcagagactgtggagggaacacagcttctcccagaagaacaccgtgggaagtttggtttcttgtcttagattactgggagtcgggaaagaaagcccctagagatcaaactcatataggtcatctaaaaatacacgatcaagtcacaaaagcacaagataaaaagaaggctttctttatccctgtaccatgcctttacagaaactacctcattcatcaaaagatctttcttttaaacctgaactctagtagctgtgcgatagagaggtcccttgtcagtatcaacagctggggctctatgctgagctcagaaagtggagttctgaatcaaaccaagtccatgagccccaaagtaaatttagaccacaaagaatctcctctccagtttttatataaggagaaaaggagaacaaaagccctgttcctccaatagagcattggccagagaagcccagaactgtactttatcaatgtggaaactaaaatatcttttcagtgtaatttgtgatgaattttcatttgcatttatcatgaagaccaaaacacatgtatcatctggtgagaagtattctttcaaggtatctaaaacttataatcactaataaaaatatgcttaatacttcagggccaatggaatgaattgtatggggaatagtttaggttgtctgatagggtcagctgtcacacatagagggagcaagctgacctggagaatgaacatagagagaacatgataattaaccaagtgctatgatgtcttctaatatcccaaagacagtgctatgatgtcttctaatatcccaaagacagctctttatatgggttttcttcctttgcataatactggatcaatagatagatactggatcgattgatagatagacgaacagatacaaacatacatagattatggacagagatagaatgatctataattgctacctatctcttgtctgtctgtctgtcctttttattcaaagtaagcttcacttccatcacttctgcattttctgtcacagatggcattggtcattggtcatttcagcacagtttcataatatgtctctatttccaaggggtggtctgttgtgcgtttgaaatcccccagatagctctgtgttctgtgtgactttgacagtcagtctcatggatgggtgaaatgaagttttctcttttgttccattcagcccaagtggcagcacttctctaattctgtgagaatgccttcccgaatttgtgcctttattatcttttggttggactcctgggaatctgtctcatgtttctgttcacacctgctctccatcccaactagaggtactcccaaagtgtacccccaaaacaagaagtatttctgaaaacacttgccccatttggggttctcagtgcaatttcgtgacagttttaaactgacactttctctcactttataacagcaggctagagaaaaataagaaactgatagcctcgacctcactaaaacattcatgaattaaaattttgtaaaaaggttaccaacagattgtatcagtttagttcatttttttctattatcttaaaaagccattttccctgtgtttgtaattgtattttatcattttaggtagtagtccagaataagacatgttgggtttaattctctgccacagttctcaaatggatgtttcataagtagcatgtggctttctcagctaaaattaaatgtctcactgtctccaaatgttttctatctagaatttgcaacatacacccttccagaactaacagagactctgaaaattaccactaaacaacgtcagtctagttcatccttcttaccagcttcaaatgctggctgtagataaatacatctttaataaataatctaatgacttaaagaaataaagtctggtcctcttttccatagaagttcagttcagagaagcaccaaatcaaaaaagatgatctatattaacaaaatcctctagttttgtgatgttctaggaattaaagaacaagtccaaacctcagagaccaaatgtatatcccaaatgtatatccccagtggttcctgattcccagaatcccctggatagctctaaaaaatatataaaactggttccattcatgatgatttactaaatatggaatggaactaagcagataggagaactaactggtttaccctcttcgtctgcctcagccactagttgttagtaatatatgtgtgtgtgtgtgtgtgtgtgtgtgtgtgtatatatatatatatatatatatatatatatatatatatttattcccctattggataacaagctgtcgattcctctcatgacctctacaaggcagctgcacatgattgatgagaggaaggatctatgttcagaaaatttttttaaaggaggaagtggaggagaagaaaaaaatggagagtcatagatccttgacaatgccaatgttttgtggaaaggaggcaaaagtacctgatggaagaaataaaggaagagtaaaggatactcatgtgattgcacaaaagtggactacatctcaacagtgaggaatgagccctaagacaggttgaaatcccagctctgccacttcccgaatgtgagacttgagcaatttgtttaaacctcttgggatcagtgttaccatgtgtaaaatgaagatcatcatagtactcatcctcttatgtcatctttttgtaaaatgtttttttaattatggtgggtacatagtaggtatatatatatatttgtggggtaccaaagatgttttgatacaggcatgctgtgtgaaataatcaaatcatgaagaatgggatatccattgggttgggaggccgaggtgggcagatcatctgagcttaggagtttgggaccaacctggccaacatggtgaaaccccatctctattaaaactacaaatattagctggcattggtggtgggtgtctgtaatcccagctactcaggaggctgaggcaggagaatcacttgaacctggcaggcgaaggttgtagtgagcagagatcatgccactgcactgtgcagtttgagactgtctcaaaacaaaacataaaacagtttatcctttttggtactaacaatccaagtacactcttttagttatttttaaatataaaattactactgagtatagtaatcaaataatatgtatgtctttttctttctttttttctttaaactcatcaaccatccctactttcccctctttcagccctggtaactatccttctactgtctatgtacatgagttcaattgttttgacttttagatcccactaataagtgagaatatatgatgtctgtttttctgtgcctgggtaatttcagttaacataataatctccagttccatctttgtcattgcaaatgagaggatctcatcctctgctatgtaatctgcggacggtatttcaaacgcacttagaacagtgcttgggcatcatcaacgccatataagtgctgctgtggtcattgtgttagaaaagtgcccggtaaattatgctctatgaatgcgaggtctgtggattgctcccaagagcgtgaagacccacaaatgtacatgagaggtgggagcatttgagatcatagatgagtttataggatagaaagaagattgcaggtaatataaaaatcagtggaagagtggtgagaaatgattagggaatttaggtgacatttttaaaaaaaatgcatttggtgaaagaaagcaaagaaactctgccacaactcagaatgcagctgacaggccgtctaaggaaatgtcgtggctaacagcagcaggggacgcacctgtgcagagctccctgtgcccagacctgagctctccacaccttcctgaatgctggcagcacctgaggaagggagcaatggatggggctatttatatttggcacataagaaaaccattgctgacaaataacttgcccaagctgacacagcggctgtagagtagagatttaaacacaggttgttttccagaaccctacttcataacttctaagatagagtagaaaatatttgcattccccgtctttactaaaaatacaaaaattagcttgtaagcccagctactcaggaggctgaggagggagaatcgcttgaacccaggaggcagaggttgcagtgagccgaggtcgtgccattgcactccagccggggtgacagagcgagactccgtcacacacacacaaaaggaaacatttgcattgactggggcatgtcctgacacagattaaaacgtgatgtggcttcccactgtatttaagaaaatggtcaagtccagaagtccaggttgggtgcagtggctcacgcctgtaatcccaacactttgggagtccaaggcgggcggatcacttgaggtcaggagtttgaccagtctggccaacatggtgaaaccccatctctattaaaacaaaaaaaaattagctgggcttggtggcacgtgtctgtaatcacagccagttgggagcctgaggcaggacagttgcttgaacccgggaggcagaggttgcagtgtgctgagatcatgctgttacactccagccttggatgacagagcgagattccgtctcaaaaaataaaaaaaggctaagtccttaacatggattacagagccctgcagtttctgagcttatcatccatctgtcccttcataccctatatccccaattccctggagctctttctgtgtctcagacacgagctaccctctgtgtctcaccaggtcggatccctgtgttataggtaacttaaggtctgtaactctgctaaactacaggctccacatggacaagagaccaggtcaggtttttccttttcctcggtgtttatataatgcctgatacttggcagttatttcaaagaaatgaggtgaaccgagtaaattccacaccatattcaggaccaatctctattttgccaaatcatgcatcataattgaggtcgtagccaacggcattaagaatgcttacagtccattgtggagtttgcacccatggccgcccctttggcatcaagctctgactccagctgtgatcacctgccatcctcaagctgccatctgacccctgcccctccacgacctctcagagcatagcttccccttggatggaggggggtgaggagagcagtcagaggtgaaggctaaagaatgtggagggtattgagtgcaccccagcccctgacatttcagcttgttatgtggctgtggtagtaagcatttggaatcagctctatcaattatttaagtctcataattcagtccatagtaaagatttattgcaacaaactgaaaaacaaagtacagacgcaaaggaaacagaacatggattctgctgtgttacacggtacataaacttctcatgtccgtgggagtaacataaaaggaagtaggttatttttaaaatactggagtgtttctgaaagagataattcagctctgagtttctgtgtgtgtacatgtgtatatacgtgtgtatgtgtctataatatatgtgtgtatgtgtatgatacatgtgtatgtgtccatatatataatacgtgtatgcacatgcatctgtgtgtatgcatgtgcgtgtctgtataacgtgcatgtgtataatacatgtgtgtatgtgtgtgcatgtgtatgtgtaatatattacacacatgtacacgtgtataatacgtgtgtgcatctcgtatgtgtttgtgcatatgtgtatatgtgtgtatgtgtgtatatgtgtataatacattgtgtatgtgtatgatgtgtgtatgtgtgcatatatataatgcgtgtatgcatgcgcgtctctgtgtgtgtgtataatgtgtgtatgcatgtgtatgtataatacatgtattacacacatgtacacgtgtataatgtgtgtacatctgtgtatacgtgtttatgcatatgtgtatatgtgtgtatggacacacgtgtatgtaacatgtgtatgtgtgtgtataatatgtgtgtgagtgcatatgtgtgtatatgtgtgtgtatgtgtggatgcgtgtccatgtgtatgtttgcgtgcatgtgtgtataacgtgtgcatgtatgtgtgtataatacatatgtgtatgcatgtgtatgtttcagggtttccttgcattccattttctatttagcatcaggcattttcttcttccctaggcattaaggccctcttggctcaaaattttcatgaagcatggatacattacaatttttacatttttagttggttgtttacggccattggttggtctgtcaagagcaccgagtcatctgcttactataccatcttgagtggaaaggaatgagtttatatttagagacacctggatgtagattacaactccatctctcaccatctgtgagattttgagcacagctccagaatgctgtcagccttagttttctcatctttgaaatgggaagaataaacgtccatacctcctcaagcaagtgtcaattggaattatctctacagattttctcgcccatggaggcttcatgcatgatggtttcatcttgtgctgtccctcaacatttacatgaatgaagtacatcatacttacatatttgaagtatggacaccttttcattgcaagaggaaagcaaaagcaggcaggagcatttcgttagtaaataatagtagggccatgtccaggtgtgaagttaacaatgagagagatttttttgcccatgttctgaccataaccatttgaactatgtttagtcttaatagctgggtggccttggacaaggttaatttgcctttctgtgcttctgtttccttatttataacaggaggatgctcatagcatcaacttctagggttgtcgggaggattaaatgagttaatactcataaaatgcttagaacagttcctggcacatgaaacaaaggtttatttgagtttttctttagttattgctggtggtggtggtggtggtattgttcatgttcttatgctgagcctgtgtggtgaattggaatgtatctgtgaataattcacttgctatttaagcacgttcaaacatcccatcataatattcaaagtcaatatgtgtatttctctgtagttcatccacgaatatcctgttccaagttgccatcatctccccctggagctaccacaaaatcctttagggatccttctgtaacctctatccatgctcccatcaaggaaaaagattttgaaacatctaatcatgctaccactatctgctctcccacttaaaactgtttattgatttcccgttgctcttaggatgaaagcaaacacgattgcatggccttggatggtctggccctgcccttctctcaacactcatctgcttctccccttactcattatttcagagcctttttagtcttttccagttttagcaatgtgctgagtgtcacagcagatgctattccctctgcctggaattctacccttcttgacctcgtcccaccaacatcactattcattcttctggtctcagaatctgtattgctttctccatgatgccgttcctatctttcgtctaaactgggatcttctgtctacgtgtaagaccctctcctcttccttcacagcacacaatgccattcctaatattccacttaacatgttatggttgttgagtgtttgtctttgtgtgagctccatgaatgcagggagctacatatgtcttgtgaactgctagatccccagcattttgcacatggtaaatgctaatgaaaacatttgtagaaggtgtgaatgccatttaagatgttcccataacgttcattagaactagaaagacttcctgatatccctcccattcaccgacattatgtataccgggtgctgtgttcacagcttggccactggatacttctcagttgtgcctctcaccctgtattgtaaatttcctatcgacaggctttgtgtttcctgttagactgtctctttcatgtctcccatcctagtgtctaacataggtattcaataaatatatacagaaggaagataagaagaaagagaggaaagatcagacttcattccagtgaggacagaattgcttgttcatctcttctgtctaagcccatccctctccgtgggctcattttagcaacacggcaagtcaacagaagtttcaacctggaaatgtcccacctagcaaggccaggggtgcaaaatcaaagtgaacaggacgttcctactacctttggggaagacaataacacagagtccaagaggtcaaagggtgcctggcctatgtctgcccctacgactcttccttagcccatgactctcgacctggaatgacagcaagttcatgtctagttaagcaaatccagagaagatttttgtttatgtagtggaatgttcaactcctcaattatgctgtgagaggctgagggggaaaaatagacatttttgcaaaatctgtttctggtaaccttcaacaaactaaaacagttgagcatacagaattttctgttgtttctgcagagataatttgttacatggaagctcatttgcttatttgaagtaaatactgcttcagacccagtagagattaacactcatagatgagatggattgagaaggaagagacataatacttcactgttatatttactgtgttaaatataaagtgggaattgatgaaaaatgttctggagttccccatgtgagcctaagtgatgaactggggtttatttgccatctggcttttaagcagggattttttttcatgtcagaaaaatggcaccttcagaaatattgcgttacagacatctgtttatcagaactttgcctgaatgaattattcagaatgtgcttaaggttgcactttacctgacatatggaaatataaagttgcatacttgatgtcggcatatatttgtctacataaaatcaggtgtcttacttgaaaccaggagtgctggaacttggtaggtggtgcttttcgtacctgggatattcattgttctacctcatgtggttcttgatgtcttcattttttggaaatcattgtgtggaattacatgtaactcacagtttctgtattgaagccccgtttttgtttccactgtgttccttacaactgaaatggaaagctactcttacttgatatgggtttcatggcaaaactctgttagtaatttcaagttggtgaaacaagtgaatatctggagctatcaagaggaaagtcttccaggccatactcagaagacccaagaggaaaaggtggttttgccaggtgcaaaaccatgcttgtaatcctagcactttgagaggcagggtggggagaatcacttgagggcaggagttcaagaccagcctaaccaacatggtaatgccctgtcactactaaaaatacaaaaattggccaagtatggtggcacacacctgtaatcccagctattcaggaggctcagaaaggagaattgcttgaacccaggaggcagaggctgtagtgagctgagattgtgccactgcactccggtcagggtgacaagtcaagactccatgtagagaacaggaagaagtggtttccatacacatcaagttttaaaggaacccttcaactcatcatgtcatcagaaccaaataaagctttaacattatccatgattgtacactgttttccatctgttcatttatttatttatagattgtttcatcagacattgactaagctcctactttaggccaagtattgaagatgtagattctactctttacttgttcggggcttacaagggagcagagaagatggacataaacaaaatagttacacatcagtcaccatgattgatgtgtaacttcaaatgagatgactgctcctgtgaagtgaaacaaggttttgtgagcatctgttggagcaacctgactcaggacttcaagggaaacttcttggaggacgcgattctgaagccatcataagtgacttcacttgttgaagaaggggaggagcctttcagatggcaggacagccatatacaaagatctgggggctagagagctcatgcagcattgcacaagctatttagaggccattgtagctgccgccaggggagctcatatggccaggagggctgaccgttcctagagaggtcagcagcccttacagcctggagtaaggaaggcggtgcttataaagcaagaatgatgggaaaccattgcacagattctaacatagaggccagttctgcgctccaattaaaattgacgaaagatccgtgaagtctgccatcattgcttatctgtctttgaattctctagtgtctagtgttcagcaagtgctggtaaaataaatacatgatgtgggggaagcacttcaataggatgtgagctcggagtgagttccagaaaggtgccccgcaatcacttatcccagaaactggtggggaggtttcagtcaacctgtataaatgctcctggggactgtcctttggataagcaggtgttctctttacctaaaaagagatgcctttcagaaagtctttaagggcagcagagcaagcactgggagggactaataggacctcaaaagaaagaggtgagaggcagagggctgagggcctttcggagctgccgctgcttagccagaggagggaagcaattgcatccccaacaggcgggctgtaaagggaatgcacgtcattacttggaaagggtggtgaagctgggagcaaacagcttctagatcaagctgccagggaggatgtttagtaattaaaggaggctggcaccatttggaggtacaaatctgcaaatccaaggttcacatcccagggagtgaccacgtggtcacaaaacacagcctacaaatgcccccacctgaggtcatacagagataagctacccccatgggggctgtgcgggtacagcaagtcggatgctcttattcaccacccctatacctaatagtgcagttcgttctcagatcatttttaaaggagaaatgaaagctctgtgtctgtgtgtgtatgtaaacaccatcttaacacattgcatgcacttttgatgcacatgtgtgttctaaactgtcatttgcagggacttctgttgttgaacctgttctctgtgaggcacgagtggtaggcttatgaaacccatccatctttaggccaggtgggctggctcatgcctgtaatcccagcaccttggaaggcccaggtgggaggataagttgaggtcaggagtttgagaccagtctggccaacatggtgaatcctcctgtccactgaaagtacaaaaatgagctaggtgtggtggtgggtgcctgtaatcccagctactcgggaggccgaggcaggaga[132 bp omitted]aaattcatacatcttgtacctgaggactgtttggggaagcagctgctttttcccgtcagtttctccttggttttctctactcacagggaccctcgccttgcacctgctgggaaggccagttcacctgcccgggctacttgtgttacacaaagctggaggagaatgaagtcaaagtggctgattttgttagagaagaattgttttgttctgcgttgggtgaagtttctctctattacacttttctacaaattcccctgttcccaattccctcagacaacaaaactacaatttgctgggtaaacaaaagcagtggggatgaagcctccctggcagccagtctgtcagaggtgctgtgcttgttagcatggtaaaagagttagaggaatttttcaagttgtacaaaattgaattacttaataaacttcgtttaactttcttccctgggagtcagtgttgttaaaaaatccaaaaagactgttttgcagcattagcattttacagttggtcagggttttcaaatcctttattctttatccattttttttctcaataacacttgttccttagccctttcttcctagctaacagtctctgtaactgtttaaaaaaaaaattaaaaaaaagaatggctggcctcagtaggtcattcctgtaatcctagaactttgggaggcagaggcaggtggatcccctgaggttgggagttcgagactcccaggccaacaaggcaaaaccccacctctactaaaaatacaaaaattaactgagcatggtggcacactcctataatcccagctacttgggagtctgaggcaggagaatggcttgaacccgggaggcataggttgcagtgagccaagctgatgccactgcactctagcctaggggacagagttagactccatctcaaaaaaaaaaaaaagtgtagatgtttggttaccccttcaaatcatctagctagtaggttggactttgtgtttattccaattttccccgtttagcaacattgcccccaccatcaccaccaaaaggggaaaaaaagacagtgggttaatcatccctgttagaaagaatttctctccaatgcctgaggcaagtttgcatgccatggatggaaatggtattttcaagagacagactgagccggtcctgcctaggaaacctgctgccttggcacggtggtattagtggctgagggctgtatgtttattccctggccctctgctgatccctggaagcaaagtgagtgtccacaggctttctctgtagtgacattgacttccttctgcccttgtgtttccaaggtgagctttgttaggtgccaggctgcagggtccttctgcagcattctgaagaaatcctctgccttcctctggttgggcagaatgcccagtagaatcaggaacagtgagctcatctccacctgatactttgtcttcgatggaacgctttgctttatcattaaaaaaaaattataatgcctcacttagggctgcaaacagtgttgatgtattcaatagcgcattagagaaaacgtcgaagcagatttgtagaaggtgcccatcctatgggcaaccccaaaaagcaatttattacccccccccaaaatatacattgtcatgtggagcggaaggattaaatatttatgtctgttggctggggtaataaaattgtattcaattgtgtctcaggcactacctaatgattgttgaaaactcggtaataacaccgaaactcataaaaaatacaggataaacaatgctggaagaaaattatgggaaaatagcctctggcctgtggaaatgcgactttattttgaaataatttgaaataagagtgtatgcattaaaaaaaagtgagtttatataaccgcaatctaatctctagaaacttttctttatggttttgttctttgtcaagttaaaaacaaggggtacatcagtagtgtttccagtaaatcctgataggtttggatttccttgaggacaggaacagcgttttcttcatctctgaactcttgggacttaaaaagagcctagttcagagcagactgggtgctccataaatatttgcagaactattttttttttttttttgagacagagtcttgctctgttgctgaggctggagtacagtggtgaaatttcagctcactgcaacctctacctcctgggttcaagcaattctcctgcctcagcctcctgagtagctgagattacaggcacctgccaccccacctggttaattttttgtatttttagtagagatggggtttcaccatgttggccaggctggtcttgaactcctgaccttaagtgatcagcccacctcagcttcccaaagtgctaggattacaggcatgagccaccgcacccagcttgcagaactaaatttaaaacataataattgtttatgatctccatgtcatctccgtattccaaggattctcaaccagagtgatttttgttccccagtaggcatttcacaatatctgtagacatttctgtgttttacaacttggcaggggagtatgtcctcctggcatctgtagggcaggggccagggatgttgttaaatatcctacagtgcgcaggatggcccccgaagcaaagcgtttgtagtgctgacagtgagagtcatctttaccgatgtgcctccttcagtattcccagtgcccagagcttcactcagagaaacagtgtatcgagctgtccttgagagaatggcggtatccatgtattggttttctagggcttctttaagaaagaactaaagacttggtggtttcaataacaggaattgatcgtcttgtgttctgaaggctagaagtgtgagatcaagatgccagcaggggtggttccttctgaaaactgggagagagaatcggtcctatgcctctctcttagcttctgtttttgtttgtatgtttgtttgtttctgtttttgatggagtctcactctggttgcccaggctggattgcagtggcacgatcttggctcactgcagcctctgcctcctgggttcaagcaattctcctggctcagcctcctgagtagctgggattacaggcatgcaccaccatgcttggcttatttttttgcattttttagtagagatagggtttcaccattttggccaggctggtctcaaactcctgacctcaggtgaaccacccgcctcggcctcccaaagtgctgggattacaggcatgagcccccatgcccggccagcttctgtggttggctggcagtcatgggtgctccttgcttgtagatatgtcacctgaatctccacctgcatgtttacatagagttctccccgtgagcatggatgtctctgtgtctctattttcccttttagtgaggacatggtcatattggattagggcctatccaaatcatctttacttgatcttctgcagagaccccatttccaataaggtcacattcacagctactgggggttaggacatccacatgttttggagggaaacaattcagctcctaacaatctacttctctgcatccctacatccgtgcagttcagattattacctctgctcagcattgtgttgcctgagatctggcatttcatcttctctcctccagcctttcgggtgtcctctcctgcggctctgggcaggcctgcacccccagcctctgaccatggcttgggcctgtcttgttcatccaagttactctgcctttgcacccttctaaccccgatgtgtgtctgtctgcctgccttctctttcctcccaggaacctttgacttttccactgatacctctggcctctggtgtgacctcttctagactttctccccagcatgcccaatcctctaggaaggtatttccgggttatagctgacaactcacttatcaggttcacctcccaaactacttttcagagtgccaagcatgtcttatccatgtgcctggcacagtgctgaacccccgtgatttaggtggaaatggttaatgaatcctatcctatttcttccagaatatggccctctaattatccatgcagggtccagttgggatgacgagggcaggctccagggtcagaatgccttgtcctcaatccttgttcacctcattgactcactgtgcaatctgggaccaagtgcttactgtctctctgcccagttacctcattgataaatggaggtgaggttgtgccagcctcacaaggctattgtggggactaaattagtttatataataattttgaacaatgctaggcacatcctaagcattcatgactgcagctgctaggataatttggcataatctgtgcttccccccaacacgctctctctgggggctccgttcttctgcttctgaacatgcttagacttccatttctgtaggaggttcttattgttgctataactaaatgatcaccaatttaggtgtaatttaaaacaacacaaatgtattttcttgcagttctggaggtcagaagtccaaaatgggtcttgctggagtaaaatcaaacgtcaacagtgttgcatttcttctggaggttctttgggagaatgtagtttcctccctttgccggtttctagaggccacccagattacatggctcatggcccttttcatcttcaaagccagcattgtggccttcagactccagccctggcttccagcatcacatacctccttctctggtcttcctcttgtaaggaactttgtgattactttgggtccacctggataatcctggcaactcttccatttcaagatcctttattacatctgccaaggttcttttgccaggcaaggtgacgtattcacacctttcagagattacgatgcaggcatctttggcatgagacaagattctgtctatcacactctctaaaggcgttccacctgtgtgatggctttatctccagcaaacatgcattcatattcaggctcagctacctagaagcgagggacatgtaatctccccaagcctgttctctcttttacaaaatcagacaaagaaattatcaagtgaggatagagaagtcggaatcctatgtgcctaacacgtggtacatgcatgctaagtcgtggcagtcacaatgactgttgttggtttcactttttttggtgttattttctcccgagtgtggttcttcccttattacctgcagccatcggtcttctgttgatctaaagcaaggtgtgcagttgggggtgtctgctcggaccaccctcgtgtgactgaatttgcctgcatatcggttcctttgctaattctgttcgggcaggatttgcttttttttgcttagcaaacttcatgagccatttctgatttccaatattgctcctcaggcagatctctcttgaaaggtgttgtttgtttggtttgtttacctcttgttcattactcttacctctacaggctacaagtctcctaggaagggatattgtgcctgtacgtcccaccctggaccacggaaaaccttggtagcgtgcaaagagattgggcattctagcggggctttgatggaactctaggaagtagaaaaagcagactcaagcagaaaatgggaaaagagaaatcctaagaggagtctcatgagatgattacttcacatttgcagttcaggcattttctccatacttccagaatcgtgtagggagttgggcacagagaatctttttaggggcaaagaaagtgagtgtcttttccactccccgtctccacacccatcttcctatttcccttccacacacacaaagaggagagctttaactttatctcaggaattctgtccccaggttcaatgctggagtaaaatcaaggacttggctctgtgcctgagtgggtgattccccacttgtgttaatcactcaaacaacctacatgcttttccttgtagttctggaggtcagaagtccaaaacggcccctattggggtaaaatcaaagcctcagcagggctgcatttcttccggaggttttatgggagaaggcagtttcccatctttgtcagtttctagaggccacctggattacgaggctcgtggcccttctcagcttcaaagccagcagtgtgactctaaagcaacatcatttcctaaagtagcggagaggaggcctgggaagattacacagcaaaaccatcagatcctacgtctgagaatgagaaggttgtttccttttcagttgactggtatatctaagcttatatccagaagaatgcctccatttcatgctggtctttatacctttgccttccttgctaatctctgttagtaaagaggaaggagggtcaggtgcagaggctcacacctgtaatcccagcactttgggaggccgagacaggcggatcacttgaggtcaggagtttgagataagcctggtcaacgtggtgaaaccccgtctctaccaaaaatacaaaaattagccgagcgtggtggcaggcacctgtaatcccagctactcgggaggctgaggcaggacaatcgctggaacctgggaagtggaagttggagtgagccgataatcgcaccattgcactccaacctgggcaacaagagtaaaattgtgtctcaaaaaaaaaaaaaaaagcaaactgaagacttgaaccttgggtagtgcgttagtttcccaggactgctataacaaagttccacaaactaggaggcttcggcaacagaaatgttttgccttacacttgtggaggccagaagtccaagatcaaggtgtcaggagggttggtttcttctaagggctgggaggaggaatctgttccatgcccctccctgtggttgctggcaacgcatggtgctgcttgggttttaactctgtcagtgtgatctctgccttcacctgcatgtgttctccccataagcatgtctgtctccctgtccaaatttcccctttttatgatgacatcagtcatattgaactatgacccataatgacttaattttgttacctctgtaaagaccctgcttccaaatcacgtctcacagatcctaaggggttgggcttcaacatcttttggtgggaacaaagttcaatccatagcagacaggcaattctttttacctgctatttaataacacttttatttgtattgtgtttattttaccatgcatacctacagcaaataattttgtttccacttatagaagagatctattttttcttctttttcagtaaatgaatttactttttaaaaatctcagtaaagtgattttaagaaaagacgttaactatatcatagtacaggtggtcttcagatgtggccaaatatagaagacacagtgtaagatttgggcaatacttggttcaccaatcctttgaggcttgggagtagaaagaacaagaataaagatgttaagtagagtaagatgcattcttcaaagattcctttttgtggaccatttctttgagagagaagttttcttcctgtgaataaatatgctgttgctttttttagctctatcatttatacttactagtatttcagaactttacgtttgagttctattttcatgccataaagaatgaggtaaataatctgaaacttaaattcccacgtggagtaatttctctaatgtggagtttctcaaacttgagggtacgtcagaagcacctgctggcattgttaaaatgaaggttgctgtgctcagccccagattttctgactgaatagctctggggtggagctctgtaatttacacttctagcaagttcccaggtgatgtggatctcggagtggggacggtacattttgcgaaccacggggctactgaaatgaggtgtctgttctctgtgagtaaagatttttcaggatcctttccagccctgcggctcagatagatcagattgaagtattctgggtgggctaagataactaaactaaagaccttctgagatttaggtttaaattcttttctctttgtttcttttactttttctttcttgctttcttgctttcttttcttgtgtgtgtgtgttattactattttttttttttgcaaggtctcactgtgtcatccaggctggagtacagtggcatgatcatagctcactgtagcgccccaacctcctgggctcaagcaagcctactacctcagcctactgagtagctgggactataggcacatgccaccacacgtgcccgcctaatttttttttttaagacagactttgtcccactgtgttgcccaggctagactcaaactcctgagctcaagtgatcctcttgccttgacctcccaaagtgctgggattacaggcatgagccaccaagcccagcctagagctccttgtttttggtcctcaggggatcttgggcaatatctcacctcatctggctgttacccaacactgtgctttatattctacttcctatttctgctgggtgaggatgggcttctgatgggtggaaaagaacttggaaagggccccaggcaggaaaaccattatggaagcaacgtctgtccacccaccaggccgctgggaggctgaagaagacacgtttttttgttttgttttgtttttttgtttttcctgtgggttacttgaaaaacatttttttaaatgcaaaaacagggtatcggaaattattatctgtccacctatttaactgttataaagtagcacttttaattcatttccataattacagcctgtgtcatgctgttcaaaagattcaactggggataaggagaatggtcccattttaacccccttatgagcgtgttagctcaggccaagagcagctgctgtctcttccggcaagccacggcattgtttgagaacatctttcctctcatatcccccaccagaccctgagcatgttgccatcggccttcttcacacccccacaaccctcggccccatcatctgcagtgcccgatgcccagcactgagcccagtgcctggtgttcagggtgtcttttgaaggagaagttataagtcggtagcatccccaagcttttcccagagcaactcaagccctgaggccaccagattgtttgggcagcaagttggtctcctagaagcccttggtagacctggctccttgcctagctgggccaggctctgtcctcccctgcgtaccctcctagccaagcgtctgggcagccagcggttaagtccactgtgggaagctattgagtctgaaacacacagtgacagcaggcatgctaaactacttcccagccctgcatgtggcgtaattgtattttcagggagggccaatctattagcaaggtgccagtctcaactgtgtaacttttataaagcaaacactaaaggcctcttggggtgaaggatattataattatggatgatttatactccccacctcatgtatacattgcacttgatgagaatgttctacttgacgtagccagaaacattaagcaaaaaatagtgttgcattctgggttagaaacccatcttttgttttatgtctaatctatccagtgctaaaacatttggaatgatacctctgcatgctgctgtgaaggaaatacgaacataatgagtgcatttctgatttcagaccagatcatcatttccttctaaaatacctcactgagtttagcatatttattccttggtggaatgtttgctgtgtattgcagtacgaaagcaaaagaaaataatcattataattataatttccgggctaggagggaccttagtgatatatctagtccggggtgtctgggcttaaattacagggtcggctgataagtattctacttttcatgattcagaatctacaagttaaaagaggaagagagaagagaaaagacagtagtaaaggaggtacttttgcattaataagaacacagacctaggtgtctcacctccacctcctacctgagccacctttgataagtgagaatctctctggacatcagttttcagctccagaagaaaacaaaaataaaaaaaaaaacccaaaacagggatcaaggccaggagcagtggctcacgcctctaatcgcagcactttgggaggctgaggcaggaggattgcttgaggccacgagttcaagatcagcctggccaacatagcaagatcccatctgtaccaataagctgaaaattaacctggcatggtggtgtgcacctgtagtcccagctactttgaaggctgaagcaaggaggcagaaacaacaagatcgctgaagcccaggagttcaaggctgcactgagccaagatcgcaacattgtgttccaagctgggcaacagagcaagaccctctcaaaaacaaaacacagatggataggtttgagacagccctcactcacataacttttagagaagtaaatcggatagtgcctgcgtactattattattacagcactattgccaggcagcaagcaggcccagggtggtgtaagtcggctttgctcatccgtagatgaaggatgcagaacattcctcagttgactaatgtgtgaactgcacactgagaactggcctgcggtcctccagctaatcagtggcggagccatgctctccagactcggggtcaaggcactggggctgagctgctgctttccccaggctcccggagacccactcccttgttctcctagcagctggatgaagcctgtggtcctcagcatttctactaattccctccaagaagggcctgggattgtttccattctctgtgttgcggactagggagctaactgcggttcctttctgcagggaggaagcttgctctacagattagaaaggaaacacgcagcttcccaagcatgtcacttctgaactgtttaataaatccacgtagcccgttttcttatttccttgataacttttcaaaaattattccttaaacaaatgacttcctactatagcctaaatctaaaatctaaacaataactattttttctaagtcctcacccccacaccccccttttttttttttttttttgacacagtgtcttgctctgtcacccaggctggagtgcagtgccatgatctcaggtcactgcaacctctgcctctcgggttcaagtgatcctcctgcctcagccttcagagtagctgtgagtacaggtgcgcaccaccatgcctgactaaatttttctactttttgtagagacagggttttgccatgttgcccatgctgccctcaagcacctgtactcaggtgatctgcctgccctggcctcgcaaagtcctgtaattagaggtgtgagccgctatgcccagccttcattcctttttatagttgaataattctcctgaagtggacatgttccgtgaaagggccgtatttgcaaagtggtccccaaatgctgaagttgctgagaaaccaaagtacaaggcagaaaaatccagtttgacattaaaagctgttttactgggaaaacttaaagacagctgtcttgactggcaggaagacagagctccacactgctactccccagacccagggcttatataccttagggaaagggcataagcgctgtgtacaagacaactgaaggcaaccctccaggagaggcaagaatgatcaaagttgacacgttgttatgctaaggactggaaataaagtaggaatcaggaggcattcacggagctgggactgatcagaagtcaatatggcagattagcatccaagatggagtcactgttgtttccacaggataccatagtttgttcatccgttgatggacagttgggttgtttttacctttttgctattatggctaatgctgctttggacctctgtgcatggggtttggatgtaggttttcatttctcttgaatatatccctaggtgtggaattgctgggtaatgtggtctaatacacctttggttaacgaaataaatagcattttagttgtttttttttttttaattgtcattctacgaccatctccaggaccattagtggcacagataccacagtttaagaaatcccataaatcatcgtgacctacacacttgtaaggccttccatcttgcaacgctattggccgttctggcttgtgtttttctggatggtcatcacgaccttcccaggtcgtccttttacctctcattggccgcagttatgcccattcctacttaaaaactcttgcataagctcggattacttccagcttttttctaccacccacttaaacttttcccatctttgaaggctgagttcaaacttcgaagtttgaatttgtaccttgatcttgtttttttatttgtttgtttttgtttttttgtgtgtataagatggagtctctctctgttgcccaggctagagtgcagtgacataatctcggctcactgcaacctccaccttccaggttcaagcggttttcctgcctcagcctcccaagtaggtaggattacacatgcatgccatcacatcaggctaattttgtatttttagtagagatgggtttcaccatgttgttggacaggctagtcctgaactcatgatctgaggttatccacctgccttggcctcccagagtgctggggttacaggtgtgagccactgtacccagcctgcaaatgattttgtccacagagcagactgagtttctgttcttaatttgtatttaaaatagaaaatctcagtggccaccttggtccccgctctcactgcaaagagtctgtcccagctactgttagggactcatttgtaaccaaacactgaacagaggatgtcacagttagtgactaatcccatctggtgaaatcagtatatgggattgcacatgaaatgaagagtttctgaacttgagtgtagctctatatcttataaagaaatctacaagtgcttttgtccttgatgtgtttcatttggggaatacatccatttctgtctccgccttctttaaacctgaaaggaagagagttggtagaaacactctgtccaaaggaagatcaatgctaacaatgttcatttttctaagtgtctccttcttctgaaataaaagttaggaagctctgacaccggctcccttcctgccttctacaccgaagtgggagttaagatgttccagataccatttgctgttttgaaggagggtctgtgtgctgtgtgatgagtagactcttcccctttgcttcgatgggaacctcggcattccaagtggacatatttcatatcctcagggcttgttctcctcctctgtggatctcagtagcagaccttcagctgcctcttagagaacagggccctgggggagacatcatcctttgtcagaaatcctggaaaaataccaagaaactgacacaagtcgaaagagggacaatggagacctgggtattatccctttagggtgttcttactcaacctaagtctcagggtagcctacaggagagccacttacgaatttgttaaaaatgtacatttgtggccaggtacattagctcacgcctgtaatcccagcactttgggaggtcgaggcgggtggatcgcttgaggtcaggagttcgagaccagcctggacaacatggtgaaacccctgtctctactaaaaatgcagaaattagctgggtatgctagcctgtagtcccagctactagagaagctgaggcaggagaatcacttgaacctgggaggtggaggttgcagtgagctgagattgtaccattgcaatccagcctgggtgacagagcaagactccatctcaaaaaaaaaaaaaaaggaaacacacatttggggactccaccccaggcctaccgaatcagaccactgggcttggtgccattgtttatgaatttttaacaagctacccgggtgattctggggcccactaatatttttgaactgtagctataggaagacttcatacatgcagagtaaaaccatcttaaatccaatcaaattaattgttaattaaattaatgtctgcctgggccctaattcataactttcatgttgcaattccctcctgatatccagaggcatcatttaaagaataagtaaccagggacataaaaatgaattatttatcttacccaaatctcatacccttctcagtgaaaatgtggttgcttgtcactgagtgtcctacccaatgggcatatctctggtcgtttcagagaaagaaatcattctctgccttccgaatgcagacaacatgaagcggcagtctcacgttgatattatggttaattaatcttgggcataggagtatgcaggagcattgagcagaagcgcactcgttaataaacaagtattttcagtgcaacacattgcaggcttggcccttacctgatgtaacagatggaggagaaagtgggggtggggaggaaagtggctgtgatctagttacgcagggtcctatttcaaacaccatttctccatttaataacaacagctaatgatttttgtttgtttgtttttgaggcagagtgttgctcattcatccaggctggagtgcacaggtaggatctcagctcactgcaacctccgttcttgggtttaagccattctcctgtctcagcctactgagtagctgggattacaggcacctgccatcgtgcctggctagttttttgtattgtttttttggagatggggtttcaccatgttggccaggctggtcttgaactcctgacctcaggtgatccgcccgcctcagcttcccaaagtgctgggctgggattacaggtgtgagccatggcgcctggcccaagaggtaatgtttcttgaccaattcctatttatcctgtttacatgtattaatttctccaaattaattcctcacaacagcccagcagtttaggttctcttattagctccattttatagaccaaaaaataaaataaagctcccccaaactggaacatagagggtttttttttttaagtaaacttctcagcatcacacactaataaagagtagacctgggatttgaaccatgaaatcccaagagagatccagaacctactctcttagacatttctccacttcctatggcttgaaatttgttttaaaggaaaccctggtatcttcgaacaagtatctggaaattccgtcctttttgttgatggagagataaaaatccagattgaatccagatccataagacattgtcatcagcactgatatattgtatgttatagataaggagaaaaatttccaggaggctgagtgacctggctaagatcattctttttttttttttttttcattattattatttcaatagttctgggagaacaagtggtttttgttaaatggttaagttgctgagtggtgatttctgagattttggtgcacccatcacctgagcagtgtacactgtacccagtgtgtcatcttttatcctttaccccctcccacttttcccctctgagtccccaaagtccattacatcattcttgcccctttgcatcctcaaagcttagctctcccttataagacggaaaatatgatatttgtttttccgttcctgagttacttcacttagaataatggcatccaactccatccaagttgctgcataggccattattttgttccattttatggctgagtcatattctatggtgtaggtgtattttctttatccactcattggttgatgggcattgagtttggttccttatttttgcaattgcaaattgtgctgctataaacatgggtatgcacatgtgtttttttatatgacttctttcctttggtagatatccagtagtgggattgctggatcaaacggtagttctgctcttaatgaagttcactcctgatattgtcatgatacaatctctctcttctgcatgaaaccagagtcctttctactgtttctcttgcttcctcagcttataaatggcttgtttaagttgatacgaaaaagttagatgtgtcctagacattaagggagcaccgagtccacagaggctcttgtaattgccaagggctaccataacaaatgaccagctagtggcaggcttgaaacaacagaaatttattccattactgtttggggaattagaagtctgaaatcaagatgtggagatattagctccttctggaagctttgagggagaatacatttcatacctcttccctagtttcttttggttccaagcaatcattggcaccccttggcttgtggctgcatcactccagtctttacttcatctgcagtgggctttccctctgtctctgtgtgtgtcttctcctcctcttaggagaacatccaccctgaatccaggatgattccatcttgagatccttaacttagttacaccacctgcaaaagctttatttccaaatagggtcacattcactgatatcagggattaggacttggacataggtttttgcaggacactatctggctagtctgtaatgactatcagagaatggattctatagttactggataagtttgcccttgtttgactggaacacagtatctcaagtggttgtggtgaagcccacagactatggggctcagcaggtgttggtttgagctcctgcaccattcgttagctttgtgaccattgataagtttcctaaactcccccaggctgccatctcttcatttaggaaatggtgatattcatcttaactaaatgcatgagttttctattctgtgttacaaattacccacacacatttagcaatttaaaacagcacacatttgttttctcacaatgtctatgggttaaaattttgatacaatttagctgtgtcctttgttcatgctctcacatgactccagtgaacctgtcaggtgggttgtgttcacatttggaggctcaaatggggatggatatgcttcgaagatcacccaggttgttggcacaatttatttcctgtgaccgtaagtctgagattggtggattcttgctgactgttggccataaaccatgtttaccttccagaggctgcattcagctttctgaggtcacccatagttccttcctacatggcctttgccataggtcctctcataacatggcagcttgcttcttcaagcagtggagaaagaataatttatgtatatacataaattactgtatatatatatatatatatatttttttttttcttagggttgctttcaatcaatagacagtatggcaggcagaggtgatggaaagttataccgtgataatgttcatatatatgagcatatgtatgtgtgtgtgtatatatatgaagatgtatgttgtatatgcacacacacatgaacataatcaccatgtaactttccatcacttctgctgcattctgttggttggaagcaagtcccaggtctacccataatgaagaggaggagattatgcaagggtgagaacacaggaagtcagggatcattggcagtcaccttagcttctgcacaccactgaaatattgtatgaattagaatatacacagaactagcacaatgcctaacaccttgtggctatttaatgtatataactgctgttaccaactggcagctggtattactattcaggttaatcactgcccagattttagcatctacaactttcttcacacaggctgttccctgtgcaacttcaggagcaccttacacacaggggaggatgtgaaatggatcctggggggtaggtgcaattcagtggttcttgctacaatggagaggtctgaggcattggcatcgatctcagaaagacctgagcatcctacattgatataaactgtaacttattcagatattggaaagcactggttttcagttccgagtgtccggtggtaatggcaagtttcgcatgctgcagccccttgcaagcccactaaagaacatctgccacccggcacagcagtggctgctggtttttgctctctgcagtgagcacttccaggctgtcttgcctcttcctgaatttgtgggtggttgctaatcttttagctcattttctttgctgtgtttttccacatttaaaatcttttattttcctgcgtctgtgttttcatttccaggagacagttggcttttttcgtgtgtgtggaataaatgaacatgtgattcttttacttgctgactgttgaatgtgaaatgtgcagccacctgtaagccaggtgagggtggagtaaacttaggccatgttttgggcctcactgcatccaccactccaaaaactggaaagccttctgagattttaaacattttccagtaatttccttattgtatggtgactgtgagtaataaatcaggaggtcagcgttcatcacaggtgggattgtgtgatgatggtgtcacagagcacatcatagtgagcatttccatttctaggtgtaccttgggaagtcttaaacaagggggtctatatgtctgtatttccttttggccatttttgataatgaccaaccagaacatatccaaatcagatgatgtaaggtgcctttaatacacaaactacttataaatctataggcagtgtataagcaaaccatagacagtgcagtaccgtcggctgtttatacaagagctgttattacccctaagcccagaaggcaatgagagaaagtgatttgtagaattccaaaggagataggaaagcagctggtccagtgtgagtctgagaataaataccctggtccctgctcctggtcttcagttgcctgcctgagctctccatcagcccagccccacaggctgctagatgtggtatcctggccaggtgtggtggctcatgcctataatcccagaactttgggatgccaaggcgggaggatcatgtgaggtcaggagttcaagaccagcctggccaacatggtgaaaccccatctctactaacaatacacaaattagcaggcatggtggggaacacttgtaattccagctacttggaaggctgaggaaggagagttgctggaaaccgggaggtggaggaggcagtgagccaatatcacaacactgcactccagcctggatgatggagaaagactccatctcaaaaataaataaataaaaagatgtggtattctgttaatcatggctgaccattttccagggcagagagcagggtggaatgggatggagagtgaatcagcaggggagcatggaagatgcatcagatatacccacacaccctttactctttaccccttgactgccattttctagcctttaaagcagtagaaggccagcaaagtggtcaggaacacagatatcaaagcttaattaatagttagtctattttggagtccaataaaggatttgccaccttctagccatgaaacttcaggcaagtgactgaacctctttgagtgtattagtccatgctgcattgctataaagaaatacctgaaggtcagttgtggtggctgacacctgtaatcccagcactttggaggctgagtcaggcagatcacctgaagttaggagtttgagaccatcctggccaacatggtgaaaccctgtctctactaaaaatacaaacattagtcaggtatggtggtacgtacctgtagtcccagcttctcgggagactgaggcatgagagtcgcttgaacccggaggtggaggttgcagtgagctgagattgtaccactgcactccagcctgggtgacaggaagactctgtctcaaaaataataataataataataataatagcaataatgccacctgaaactgggtaatttataaagaaaagaggtttatttgactcacagttctgctggctgtgcagttatggctccagcatctgctctgcttctggtgaggcctcagggaggttccactcatcatgggaggcatgttgggcagggaagaggaacacgcaagagagaggggaggaggtgccagcctcctttaaacaaccagatctcgtgtgaactaacagagtgagtgctcactcatcactaaggggatggcaggcaccaagccattcttgaggaagccacccccataactcaaatatttccctccaggcccacctccaacattggggatcacatttcaacatgagatttagagaggacacatatccaaactgtatcaccgagcctccatttcttcacctgcaaaataatgaggtgcaagtacctacctcttgtccttactgtgataaaatatttctacctttattcttttttttttaattttattattattatactttaagttttagggtacatgtgcacaacgtgcaggtttgttacatatttatacatgtgccatgttggtgtgctgcacccattaacttgtcatttagcattaggtatatctcctaatgctatccctcccccctccccctccccctaccccacaacagtccctggtgtgtgatgttccccttcctgtgtccatgtgttctcattgttcaattcctacctatgagtgagaacatgcggtgtttggttttttgcccttgcgatagtttgctgagaatgatggtttccagtttcatccatgtccgtacaaaggacatgaactcatcattttttatggctgcataatattccatggtgtatatgtgccacattttcttaatccagtctatcgttgttggacatctaggttgttggttttttttttttttttttttttttttttttttttttttttttgagatggagttttgctctcttgcctagactggagtgcagtggtatgatctcagctcactgaagcctctgcctcccgggctcaagcaattgtcgtacctcagtctcccaagtagctgggattacaggtgcaaatcaccatgcccatttaacttttgtagagatagggtttcgtcctgttggccaggctggtcttgaactcctgacctcaggcgatctacctgccttggtctccgaacgtgccgggattataggagtgagccactgcacccagcctatcctttttaatgcgactaatggactccacatttatttatttatttatttatttattgtcctatccaccctattccactgtgaatgtaaatttccgggggggcagggattttgatctattttattcactgacatagctctagcattaagactagttggtggcatagaggaggcaatccataaatatttgggggcatcagtaaataagatagtggctacaaagggcttagggtagggcctggaatgcgttaacagcttgatatttgagcaagtatttggtagtaaatacatcaaagttgattttaaacacccaaacacagacaagcaaagaacgggaaatcccccaggtagggatgatatttagaaataggaataaaataagcctggcgaaattacctttggtgagttccttgcaaggttatgtgatttaaaaaaaaaatctgtaattacatttctctatgtaattttgttttatcatctatttatttatttacttttgcaattaatttattttagtaacctaaactcatcgttaagtctgtagtcctggaaaccatgtcaaccgtcagatctctgtctatgctcaaaaacctcaacttgctggctgggcttggtggctcgtgttagtcccagcactttgggaggccgaggtgggttgatcacttgaggtcaggagttcaagaccagcctggccaacatgatgaaaccctgtctctactaaaaatacaaaaaactagctgggcatggtggtgtgcatctgtaatctcagctaatccagaggctgaggcaggagactcccttgaacctgggagggggaggttgcagtgagctgagatcacaccactgcgctacagcctgggcaacagagcaagactccatctcaaagaaaaaacaaaaacaaaaacccttatttggcagtgactgggtacacagagttgtgcaacaggagacccgcctgcagaaagtacccactgggatcctcaccacacagcaggcctcagaatttcccctgcctcctgatcggtgttcagatgtagatagtaggttcagtgggttgattaagttaatgacatttgtagcggtgttataggctgcaggccagggagaggctttctggaaaattgcagggagaaatcctgcaggctctgcctttgaaagataatgctagttgcatgctggggctgtctcctccctttgtcttgaaggtgtagaagacacagctttgcgggctgagtaaacatatgtgcatggttaaggtaaaaatgctacttagctcttcttcccgttaattcgttcaagaactggtgaaagagagcacacttcttggagactgaacttttaaatgcttctgctgggtctcttgagttcttaaaattatcgttttgatctttctgtcccgtgcagatacaaaatacataaacatccacgtgactctttttatttttcacttagaacctgcgcattgtcctagcaggtactccctcagggcctgggttttgttgtcactgctggaatgcagttgctcctccttgccttactcaggcctctgccagcttctcagacagctttgtcaagcaattgctactcaaccagcgattactattaacccttcgttacctaaatccacccaccatttttcttttcctataccgatgggcctcaagcttgagtttgcattagcttcccccagagggtttgatcccctagagacttagagggtccccaccctcagaagttctgaattgttaggtctgggtggggctcagggatttcattttttaacgaaaccctaggtcctgctgaagctgccagttcccatctctactaaaaatagagaaatttgccaggtgtggtgacacacacctgtagtatcagctacttgggaggttgaggcacgagaatcgctggaacccgggaggcagaggttgcagtgagctgagatcgcaccgctccactccagcctgggcaacagagtgagacgctttctcacaaaaaaaaaaaaaaaaaaaaaaaaatccgaacgtctcgtgttaacaggctgatcattattttcaaaaatgtttcctctctttctttccacatggaagctccatgtgagcagatatttctttgttttgttttgttttgtttttcgtttttgcatcattcactgctgtgtcctgtgtgcctggaaaagtacctgacatttagcaggggcttaatagacatctgctgcatgttgaataatagtgaggatgtcagcatcacctgctgccctttgggggagcagattttagggcactgtagcaaggctgattataagtcagtgccctatgtaaggcctggaacctaaaatctccaatcattgtttttgttctgttgaattaagccaccaccctaaagagccagaagcctaacactgaaggaaatagaaaatgtggatctcacaacacatcatttcaagtgtgtacatatactaatagcatacgctaaacatcatctaaacactaaatataatgatataatggcattggtcataatcttgaaggtagttgcatctccgtaaagtttcccattgagctgctgttccgctgctgctggcttccacccccagcacccacccctctagatttataatttccccaacttgggttgaagccccagatgactgggagctgcttctttactttggttcccttcagtcccttcggcagatggcacaattcttagtgtgtgtgattggggttttcagcattggctgtgcattggcattgcatggggagtgttagaaaagattgatgtctgggtactgcccccgaagattctgatttaattggtctgaggatccctgggcatccagatttttaaaagcttacagccaaggttgtgaaccatcagatcagggacaaaggcgatctggaggaagacggggcggggaaagaaaagaggaaaagagaatcctgatttctggagccaacaaagggccctgtgggagcagaggttgttgtaggataatgaaggggtgagctggcagccaagagctcaggacatgcttgaggaaagaacgttcaactcagaaataagactgctttcatgcgttaattatgcacctcttgtcttctctaatcgttttatccagggtaaccttgttggcccaaggaaattataaattccttgggatcagcaatgtgtcttacagttaccctgtagctcccaaggtctctagcagccttgcattcatgtgggattcttcaaaagtagccctcaaattactgaagaactgtgaggtcagagtggtaagtaaaagattaaaatgtctgccaatcaatcacggttgcatatgtgtgtgtttcatcatttcacattgtttgatttctttccgctatgaaaagacatatgcacacagaaaaagaacagtaacacacacaaaaaaatcagccagttaaaaccaccaccaccaccatcatcaccacagaaacttagaaatggagcccagtagagcatcagttgtcagatatgggggcttcaagtccccaaagcagatgtcatctcatgtcattgggaagtaaagatgttcacggtgcaagcgtcattcacagacacgcatgcttgagttccaagggagcagatgtgagccagttaggaagacgccaggaaaacaccatgcttgccccactccccagtctagtgtttaattcacaggcccacattgcaactcttcaatactttattaaacacatctcttctcctggataccctactaccttcagagcaaacacattctactctttgaaggcaagtgtgttcttaactgcttggatcctaccctttatgacagagaagaagaagatattgctaagggttggattagaggtaggaaactggggaagctctggtaaatggaagaggggtttaccttgttttttcattcataatgtgaatataggcaaggttagaatcccggtgcacgtcaccattgtcaaaatgacatccacaagcagtattgatgcctccaccaggtaaacagcagttccctggtatatatcagaagcgtgcttttctgtattctaagcagtttttgacacagtgctttgctttattgcaagccacaatattttcagaaggcttaaaaatccagttatgactgtagctgtgagggaagaggtctgcatggggccggggaaatttaatttttagcttaaaaaaagtcccaccaaattcaatttttctcacctttagggattctcagagttatatccagcttgcataactagtgtgttagagaatgtgttactacggggttattttttttaacacatttattatttatgaaatgcagaggaaaatagaaatgatcgtttcagggaatatcctgtagctttttttattgtattcaaagaagttgctcatgctgttttaattcaaatattaaaagttaaatctcttttcatcctgacctacatttaaaaaacactgctttagcccttatggaggacagaaaatgtgtggaaggaaaacatccactatgcattccttaccccatagttcgtcaggaatcagaatgactggcaaacctgtccaggaagtaataggaaaaacagagcgagatctctctcttctctccacatccttgcttatcccctctctcccatagcaaaccagccctgctggttatgctggtttactcggcctgctcttgaatgttgagaagctccatgtgagcccctcaatctgtgctagggaaataaagagaagagagatattatcccatctttgataagggattaatattgagaatatattgagaactcctaaaactcaacaacagaaaagcaaacaagctgactcaaaaccgagcagaggatttgaatagacgtgtctccaaaagatatatacaaatggccaatatgcacataagaagatacctaacatcactaatctctagagaaatgcaaatcaaagtcacaatgagataccacctcacacccatcaggatggctatttttgttattgttgttattgttgagaaacagtctcactctgtcacccaggctggagcgcagtggtgtgatctcggctcactacaacctctgccttctgggttcaggtgattctcctgcctcagcctcccaagcagttgggattacaggtaccccccaccatgcctggctaattttggtacttttagtagagatggagttttaccatgttggccaggctggtcttgagctcctcaccttaggtgatccgcctgccttggcctcccaagttgctgggattacaggtgttagcccctgtgcctggcctaattccccgtttttaaaatgggtttaacatctttttatatgtttattggccacttgatcctccctcagagagctatacagttttctcactttattcagtctatgagcaaatgtcatcttgtaagagaatgttctggatcaatcttaactgtaatagcatgttcctatccaatacccctgccccctcaccatagccgagtcttctgtgtatttgtatgtatattcatatatatatatatagtatcccacccccctacacacatacatatgtacttatttcctatcttctcctttctggattgtaaattttttggatgtagaaatcaggttttgttggtttgtttttcattgctgtatgcctaacatttagaatagcagatattgaataaatacttattgatttatattataaaggttgtagttttaagaaaaattcagaacacattgacctttctttactagtaatgcgctgtgtagatatggcataatatttttaacctcttctctctactgatgggaattaaggggttgtttgctctttggtgctaccaaaaaaaaaaaatctatctatctgtctgtctgtctgtctatctatctatctatctatctatctatctatctatctatctctacacacacacacacacacacacatacatacacatatatacatacatatatgtgtatgtttatgtgtgcatgaaccactaaaggcataataaacgtctgctgccttggaccagcatctctgcagggtataatcccagaagtagaacctactacatcaatgagaacactcattttaaggctggggacatcttgccaatttgttcacccaagggctttgtcaattcacactcttgccaccctacaatggacaacatatcccaccccacaaccaccacaatgctttgtctttgccagcttctatccctatttgagagatgagaaaactaatgaaaggctcacagactcaaagtcagacagtttctagttggtgggtctaaccctccctgttgcttgtgcagatctctttgttgtgatctgtttcctgtggtctgccacaaactgggtaatttataaagaaaaataagtttactcagttatgattttggaggtcggaaagtccaagagcatggcactggtatctgacgagggcgtggtataaggcatcacatggcaagagcgcatgtgagagggaggaggcgaggagtaagcaagagaaccagggggctgaagtcatccttttaatcaggaatcaactcccaagataactaacccactccagtgaaaactaactgacacctgcagtagctaacctcctgcaacaatccattcttgagggcagagccttcatgacctgatcatcttggtttttgttgttgttgttttttgttgctgtttttgttttttcagatggcatcccatctgtcacccagcctggagtgcagtggcatgatcttggctcactgcaacctccacctcctgtgcttgagtgatttccctgcctcggcctcccaagtagctgggattacaggcatgcaccaccacacctggctaattttttttgaattttcagtagagacggggtttcaccctgttggccaagctggtctcaaactcctgacctcaggtgatccacctgcctcaggctccctaagtgctgggattacatgcatgagccaccatgcccagcccagatcatctcctaaaggtctcacctcacaataccattacattggcagttacatttcaaccttggaggaaacattaaaaccatagcccttcttgatggattacatccttaggaggatctgcttccaagtgtctcacctatatggtaggtgagttagtgctggctgtaggtcgtaggcctcacttcctcatcccacgggcctgtccacaggctgcccaaacatctagccccaggcatctttcatggagagttgcaccagattctgaagtgctcaaacacatgtctctactttcactaatctctttctgttaaatttgtttttgagttgtgtgaaataaatacaatgtaaaatttaccattttaactttttattgcacagtttggaggcattaaatatagtcacactgttgtgtaaccatggccactgtacatctctagaacattattcatcttgtaaaactgaaactctatatccattaaacattaactcccattatgtcttcccccagcccctggcaactactattctcctttctgtctttatgaacttgactgctctagtatctcatgtaagtggaatcattcagtatttgtctttttgttactggtttatttcacttagcataatatccttaaggttcatctgtgtcatcacatttgacaagatttcttccctgtctaaggatgaattacattccattgtatgtgtaaaccacatttctcttatccctccattcatctgtagacgcttgggttccttccacacttgagttactgtgaatgatgctatgaacgggagtgtacaatacctttcagagtccctgctttcagttgtcttgggtgtatagctgcaagtgaaattgatgaatcatagagtaatttatttatttattttttagtaaccgacatactcttttccgtagcactgcatcattttgcatttccgtcagcagtgcacaagggttccaatctgtccacatcattgccaacacttatattcaattttcagaaataatggccatcctggccaggtgcagtggctcatgcctgtaatcccggctctttgggaagccaaggcaggcagatcacctgaggtcaggagttccagaccagcctgaccagcatggtgaaatctcttctctactaaaaatgcaaaaattatccaggtgtggtggcaagcacctgtcatcccagctactccggaggctgaagcagaagaattacttgaacctgggagggagaggttgcagtgagtcaagatcgtatgactgcacactccagcctgggggacagcacgagactgcgtctcattaaaacaaaaacaaattggaagaatttaaaagggagtggggaagaagtatggtcagaacattttccaaactagtgttcattttctatatccaaaattttcatgcagtgtttacctctctttatcttaagaaatcaataattgggatttcattattttgttttgtcaaaacaaagttattgaacaacaaaataccagtgtttgagtgattaaaaaacaacaacatggtattgaaaaatcaaagtacttatcactaaagttaatgctcatcctctcagcccaccagccaggggtcagggaggggacacgattgcacactgggctagagctgctgtccgagaggccttgagggtaggcgtacgacagcagcatttcagaggtagttggcaatgctcctctgccacccatagtgagacagggaacttcctgggcttctggtacagagttttcctaacagtatgtgcatacctagctgcagttcctggtctagggattcttgctatagaactacagagcggtaacttgagtcactgtgaaagcagctcttcagtctggactgaagttgctgcgcttgggattttctttttcatgatgttttcctttatttcttttatcaatacagaatacgtatttatgtaataaatatgtgagtatttttttacatgcagagaatatgtcatgatcagtatttgaaagggagacctgcctttacatgtttattgcagcactacttaaaatagccaagacatggaatcaacctaactgtccatcagtgggctaatggacaaagaacatgtggtatatgtatgcagtggagtactatttggacataaaaagaaggaattttttaaaaagataacaaagtcatgtcatttgcagcagcacagatggaactggaggtcattgtgttgtgaaattactcaagcacagaaagacaagtaccatattctcactcatatgtgggagttaaaaaatatgatctcgagatttttttctttaaaggaaaaagctgtgaggccctttgcttagtttggaggatctcagagggaaaggggccacgctttgtgtatcacttgaatggtcaatttaagccaggtgcggtggctcctgcaggtaatcccagcactttggaaggccgaggctggcagatgacttgagctcaggagtttgagactagcctaggcaacatggtgaaaccctgtctctaccaaaaatagaaaaaaattagcttggcctggtggcatttgcctgtggttccagcaagtcgggaggctgagataggaggactgcttgagcccaggaggcaggggttgttgcagtgagacaagatcgttccactgcactccagcctgcgtgacagtgagacccccatctcggaaaaaaaaaagaaaaagaaaaaacagcttatttaacctattcgagtgaccttgagctatatgcctatctggcctaattttcccatcatcgaagtgagataataatacatagctcagagtgtatggtcagaattaggggaggcagcagaagtaatgtgtttagtgtggttcctggcatgtagcagatgttcagagtggtagtttcagacgatctctccaagtctttgatagtttcccttcataaagtagagcctcatctccctccccatgaatagaatagaatgtagcagacacaataccatgtgacttccaacagtagatcataaaaaggaaatctttttctctctcttcttgtcaattttcttttgcaataatgaatgattactgttgtcttaagccattacatttcagggtaatttgtctcatggcaatagataactcacactttcagtagtatttgcagccaagatctgttatccttgaatattcaaaaatctgtgacctatccccattgtgcatgtacacacaagcacacgctcccctacatactttgctgacatcttattcttaaatgtaatgtgccttattcaaagggtgattaggaggtttgagaatcagtgtggcagctaagcgagacatcttccttgttttaatcagaagaatggaaagtgctttgtagaggcgaggtggactgtcaagcacagagcatgcatgtctctaaggcatgccacagagtttatccggggccaggatacctgtggtctagatcctagaaaggagggatgctagcctgcacatcggttgctaatggaacccttgggtttgtgtgactggggaccaatctgtgccgatgtgtgaatatgtctgctttgcttacactcaggcagtgattgcatatctgggggctaatgagctaagtttggataatggcaagagggtttcttctcaatgcgcaagagtattttgcctgcgtcaggctgactgcgggcatttccttagatctgaggttcactttttgctccgggggttcagcttctgtacacttgatggatgctggtcttaatttggtgtgttgcagtcattgcgagttgtgcaaggatattaccttaaggatattcttttgaatattaaattagaataaattaagggatgctggatattaagcctaaatcagagatgagtaattgccttccgttttatgccgttaagtttgttggaaatgcaagatatttgttttaattaccaagttgttgaaccaactctcaatgagcataggcacaaacagaaacaaataaaaacttcttggtgagtttgtgaaatgtagataacacctaattggatgcattttgttagtgcctgtcctattatcattactttcttccttcatccaacattgagtaattgactcccgactatgtatccagaaacgtaaaatgctctggggaggatattaagggctacatttttttcattgcttaattgtttcctgtatatgccagcctaagcacttgacatccctataaaatattcacagaagcactataaggtaattatgactatgaccgctatttcacagatacaaaactaaggctgagagaggatagcattagattaatattaaaacaaaaactcatacagctagaggtagggtaattccatactgtattggtaattcaaagcagataaaattgttgcctcttgaaagcctgtgcccaaaacgctttaaagaggttctttccgaatgctcaaaaacagtgtattttaaaagctgctctctgaaatttttaagatccatcagccagagtgtgatgttccccttcctgtgtccatgtgatctcattgggactgttgtggggtggggggaggggggagggatagcattgggagatatacctaatgctagatgacgagttagtgggggtagcacaccagcattgcacatgtatacgtatgtaactaacctgcacaatgtgcacatgtaccctaaaacttaaagtatgataataaaaaaataaataaaaaaagatccatcagccagtaattttacctttaaaatgttatcaaaaatgatatttttttccaaatttttattctggaaaattcaactatgtctgtaagaaatcaaaatagtataatgaatccctgggtactcagatacccagattcaacaattgccaactcacgaccaacactgtttcctttttaccttcattcccacatcccccgaacaaccaccccacatgcacaatgtatcttttgaagtagatacttttctttgttggtattttaggaaagtcttattaatgtagactttttttttatagttttctatgtgttggccattcagatgtcaatgaaaagagtcaaactctgtaaaacggtgaagatatttattctgagtgacataggagtgacacagacatcaggagatcctgagaacacacacccatagtggtcaaggcacagcctagtttcacacattttagggagatgtgaggcattaatcaaatacatgtgagatttacattggttcggtctggaaaggtgggacaactggaagcaagggtatggtgcgatgggcttccacgttattggcaattggttaaaagagttattatcgatagaaaagaatgtctgggttaggataaggggttgtggagaccaaagttttatcgtgtggatgtagcctccaggtagcaggctgtggagagattagattgcaaatgtttcttttcagacttaaggtctgtgttgatgaaatgctggctggcttttcctgaattccaaaagggagatgggtatcatgaggcattcctatcatggtctgaatcagtttttcagctcaactttggaatgccctggctgagaggagaggtccatttagatgggtgggggtggggggtgggcttacaattttatttttggtttacgcaagtctgtagaaatgggagctaattgtgatatggatatccctcagtttctgcttgctttttagaagaaactgcaatcacataccttaaaaaaggaatctacatatagaaattttgaactattcaagttcattgtttaaaaacaaatttctggatttactttcctagtgtagaatataatctgtcattgtccagattagatcattgtcctataaatatcaggtaggttgcagatacaataatgctgcgcagatctttagcctttgtattttttggtatcgtcacaaggaaagtaaaaatagtaattgaaaccgaagcctattgttggcaagaaggttaagttagcacagcacatagagcattacctggaaaatagtaagggtcggaaaaatgtaactgttacactgttgctgttgttatttttgttgttcttgccatcacttttcttgtctgagaaatttctaagtctcatccataatattaataaggattaaataaggtaaatgcctaacattctagcattaccagacactgaattactgtattttttctcttcatttttttttcctctggctatgtgtggtggatttagttggactgtttataggaggacaatctaggttaaagggcagaaaattgtatttttggtagaattggggctttgccatgttggccaggctggtctcgaatcacttgagatcagaagtttgaaaccagtttggctgtcagggtgaaaccctgtctgtactaaaaatccaaaaattagctgggtgtggtgggttgtgcctgtaatcccagctactcggtaggctgaggcaggagaatcacttgaacctgagaggcagaggtagcagtgagccgagattgcaccactgcactccagcctgggtgacatagtgagagtccatctcaaaaaagaaagtaaaataaaaaatggagaatggagattttgcccaggaatgcactgtaactgttcttgtagtcactttccttagagatctgccttgacatgtgacgaactctggaatatcaatgctaccatggggtttgttcttttcctgtcattttactcttgaagaaacagtggcccagaaaaatttagcaacctgccaaggtcacaccactaactaatggcatagctggaattagaactcaggccaatgaagagaaaaataatttattaggttttgaaatttgatatataaaaaccataaaggtttccccacttctcaaatattgcagacatgagtgtaatatgagtcattattttgggccaattttgcttgaaataacaataaattacctagagtcacaaataatatataaattggtccaaagttttaggtagctttatatatgtgtatgtgtgtgtgtgtgtgtgtatatatatatatgtagctatatatagtagacatctgtttttatctgggttaatgaatgtgctctgctttgcacagaatttaaatagtttcagaatttttctttctttttttttttttcttttttttgagatggtgtcttgttctgtcatgcaggctggagttcagtgggagtgatttcagctcactgcaacctctccctcccaagttcacttgattctcatgcctcaaccacctgagtagctgcgattacagccgtgtgctaccatacccagctaatttttgtatctttggtagagttgaggcttcactatgttggccgggctggtctcagactcctggcctcaaatgatcagcctgccttggcctaccatagtgctgggattacagatgtcagccatcatgctggaccagaatttttcactaagagggtatcatatagctggtggaagatacatgtcaaggctctttgtaatttactgcatattattcaatttcactccataaatgcataatttaatcacaactctggtttaaatgatatagcaggaatgacatgggtggaatttaaagtttgtataatttatatcatccatagcactttgaaaaggcacaggtcagcctggcctacagggcaaaaccctgtctctactgaaaatacaaaaaatagtaatcccagttacttgggaggctgaggcaggagaatcacttgaacccaggaggcggaggttgcagtgagccaagatcacgctgctccactccagtctgggcaacagagtgagactccatctcaaaaataaaaataaataaataaataaataggtacaggtaggttacctctggctatcagaggggcttgggcatgagtccttgttgctgcccatataggaaggggctgctgtgagttgctctgaccaagctaggttttgggagatgcttaaaagcaaaagctcaaactacattgctcacttcccatccgacaattccaggaacttaacaattcaggagcagctaaagctcctttaatcttctctctgtccacacagcaaaaactgacgagtgagtgatgacaatgataatttaggtaaatattgatgaagggaagaataattctctatactttgaatgaaattcctctaaatctaattcatcctcttggagagaagcaaaaaattgggtattcaggggtcttatttgtacacttcttttcttttttgaggcggagtcttactctgtcacccaggctggagtggagcgacgcgatctcagctcactgcaagctccgcctcccgggttcacgccattctcctgcctcagcctcccgagtagctgggactacaggcgcccgccaccatgtcccgctagtgtgtgtgtgtgtgtgtgtgtgtgtgtgtgtgtgtgtgtgtgtgtgtagctgggagtacaggcgcctgccaccatgtccggctagtctgtgtgtgtgtgtgtgtgtgtgtgtgtgtgtgtgtgtgttagagatggggtttcactgctttagccaggatggtttcgatctcctgacctcgtgatccatccgtcttggcctctcaaagtgctgggattacaggcatgagccaccacacccggccccccttatcgtatacttctatatgtgtatggacgcctatgtgcgtgtacgtaagtgtggagggagaaatggaggtgggtagttaaacaggaaagagtcttagttggaatttcatttcaagtctactgggatatggaggcaagaatcctcaggaaatccatcagcagactctcattccatgcatacatatatatatattcccttccttccctcccattacctccctccctccatcccctcccattccctccctcccatttcctctctccctcccttccctccttccctccctccctccttccttccttccttccttccttccttccttccttccttccttccttccttccttctctatggcttccagcaagtagattagccgtgtggaaactcagttttctcatttggaatattaggaaatccctaatttaaaataaacaccaaagtcctctaacatactgtaaaagtgccgtaaacttttgatctattctttcttcccagtaaggggaccctgctggtgggtttcctgaaggttctcacacctgtccaccaagagacttgaaattccaacagggaatctcctctacctactaaattatgcccctcctctgcccttcatacctgttgaatattataagaatgggtttatctataaagcaggtcagtcatagtaatagagctgatggttaggaaaggtggatagacagagagagattggatttggcttctgagaatgtggtaactataccaagcaagaggtagaaggcaggtgaactcatactcaccctattggaggacctaacaaataagaatgagctgcttttttttccccctaactctttcccatctggagtgcagtaagtgcaatcataactcactgtagcttcaaatgcctgtgctcaagcagtcctcccgcttcagtctcccaagtagctgggaaaggatgggcacaatggctcacacctgtaatcccagcactttaccaggcggaggtgggcagataatttgaaattaggagtttgagagcagcctggccaaaatggtgaaaccccatctttactaaaaataataataataataaaaattagccacgtgcagtggtgcacacctgtaatcccagctacttgggaggctgaggcaggagaattgcttgaacttgggagatggaggttgcagtgagccaagatggcaccactgtgctccaacctgggtgacagtgaaccaggatcccaccactgcacttcagcctgactgaccgagtgagactccatctcacaaacaaaaaacaagttgctgagaccactggcacacaccaccacgctcagctaattttttgatttttttttgtgacattttgttgcccaggctgatctcgaacccttgggttcaaaccaccctctccgtcagcctcccaaaatgctgggattacagttttgagccattgtgcccagccaggatgagctttaagaatgttgacaacatctccatctcctgggagatgaagcttcctagtgagactatcagttagagcattttcctgtggaagcatcaagaagacaagagtagactaaggcaagtgattgggtgatcaagacagagtggacttttcagtgcaggagacggtgctaggcagagttgagtggacagcgagaaggataagatggtgtctgacttggatgtgaacttgacactggggcatctctttggacaagtgaccatttagagactctcttgagagacagactcacaagcaggtaaaaaataagggcaaatggtttttatatattgtctccaagtcattctcagaaaagatggctgaccctgaacaggttttgaggaggacagtccttctacatgggtgtagtgtgatgctcgcagtttgcagtatacaaagtacacagttgtggtaccgacagggctcgcattggagattcgacatcaccatgtgcttttgtgacttgtttcgtggttgaaaaaagcaaaatggatcccccaaggctcttcctacccagacccaaatgggcaagcggggagaaagctccctgaatgcctttacgttagatgctgttgggattcagagcaggtccccaggagggagccaatctgggtattcattccttagctgctgtaatactggcttgctaatggctaccagctctccactctccacagacctgagcttggccaaatgggaactgctttgcctataaggttatagagccctcaagagaaagccagcagtcaatgactgatcaaggtgcaaaaagaatagcccatttgtcttaaagagggtgttaaagcaaaccaaatatggcttgaaaaggactgcatacttctatatttgagttcttgtggatgagctgtcagctagcttaatagacagacaagactgaaaatctaacttaagagtatgggcctgtgggccgggcgtggtggctcacacctgtaatctcagtactttgggagtctgaggcaggcggatcacaaggtcaggagattgagaccatcctgactaacatggtgaaaccccatctctactaaaaatacaaaaaattagccaggcgcggtggcgggtgcctgtagtcccagctacttgggaggctgaggcaggagaatggcgtgaacccgggaggcggagcttgcagtgagccaagattgcgtcactgcactccagcctgggcgagagagtgagactctgtctttaaaaaaaaaaaaaaaaaaagtattcgcctgtaacaatagctgagtcttggccaatcccagcagctgaacttcaaccactcatagactgttaagtgttcaaaaactgtgttcaaataaggcaaacgctgagctgtaaccattctagctttttctgtacctcactgctgatttctatacatcacttcccttttttcgtctataaatttgttctgaccatgacatatccctggagtctctctgaatctgctgggattctgggggctgcccaactcacgaactgttcattgctcaaactcctttaagtttaatttggctgaagtttttattttaacagggacaaccaacactgcaaagcctgaaacctgtggctcaggcccaggctagactctacttaagaccacaccctggccaggcacagtggctcttgcctgtaatcccagcattttgggaggctgaggtgggtggattatgaggtcaggagttcaagatcagcctgcccaacacagtgaaaccctttctctactaaaaatacaaaaataagccaggcatggtggtgggcgcctgtaatcccagctagtcaggaggctgaggcaggagaatcgcttgaaccgaagaggcggaggttgcagtgtgccaagattgcgccgttgtactccagcctggcaacagagcaagactccatctcagagaaaaaaaaaaaaaaaaaagaaagaaaagaaaaaagaagaccacacccttgcttggccacttccctgccttacatgacttatctccacataggtgacagtgactttggatcagagtgatagtaaccagaagtggtcacgatctggtatattttgtagacctcttaggaaatgtgtacattaagagactgggtctcgtagatctcaggtggaatcttcagcctctgtctagtttttgtgggggtctggccatgcatcacagcctagaaagtgcaggaacctgggctgatttcatggttcagtacatggtttcctgggcaacctttctgccccttgacatacatggataaagtcctgttgccatagtaccctcatatgggtgtatctcatctatgccaactagagaataacctgaggactggagggctttgggtatgatttgtcagaatccaattagcaactccaattgattgatgatggctgattcgtgggtagctatgaatttgcagctcttagctattctgtctgtaaggatgaagacagtctgaaaagtggctgactgctgtatggagtactctttgctcctcctgggtgaaaagggtcgtgacttttagcagctcttcttcttatcttaacattctgaatcccgtgttctaatgcattattgagggtttgtgaagacagagcaggggccagctctgcacccaacgtccctttgctagggtcacgcagaggtaggggcacagtacatagggatgagagtatggggaaaaaagggctgtgacctcagactgcttaggaaagcaaattggcagcaaagttccagctcagccacttaatcttcacgtgtccttgggcaagtcatgtgacctctgttagcgtgttatgatggtgagaatgtgtacactaggggtctcaaacgcagatgcttacctagggccagacagttaatgttatcagtcaaacatggcccattgctggtctgaacaacctgtgccatttctagatggccatgcaggaatgtagatccaatggtgccagattttatcgttttaaagaaaatatggatattttgatttttttttttgtaaaatgggaaatctaattctcatttttggaaaacactacctgaccatgtaaagccacatctgtgactcatgggcaaccagtttgcatctttgatgtttatttttgtatcagaatccgctggtgctggctaggctcggtggctcacgcctgtaatcccagcactttgggaggacgaggtgggtggattacctgaggtcaggagttcaagaccagcctggccaacatggtgaaaacccgtctctactaaaaatatacaaattagctgagggtggtggcaggcacctgtaatcccagctacttcggaggccgagacgggagaatcgcctgaacccaggaggcggaggttgcagtgtgctgagatcaaatcactgcactccccactgggtgacagagcaagactctcgtcccccacaaaaaaggaatctgctggtgctaaccctaagcccccaggggcgtttaccatttcaaggcattctgcctcaatttccacaagtgtcttttggcctgaggtctttctggagcctctggagccccctttgcctacacagatgcttcactggaaatgtgagggaattaaagcaccctttccccagcaaccttcaatgggtaactcaggatttgctttataaataacccagttttccttgcttctcaagtgggataactcatgattaggggttggcaagtgtttacagtaaaggaccagatacagagaatattttaggatttgggtgccatatggtttctgtgataactgctccactacatccttgtagtacaacaatagccatagacaataacatatgggtgtggctgtgttccaataaaactttatttacaaaaatagtcagtgggccaggtctggccagctggccctgtactgggcctatattgcttatctgtgccataaagcaagctctacgcttattgcctgagttctgtgatgaaaataagctgttacccactatggtaactggcttggtaatgggctttctgcatagcctgttttctcctccttgttttacatctcccatccctactgtgttttctaagaaccttctttcataaaagcttcttgcatttaaaacctgttctccaagaacctttttttcatttttttgagggggaaggtagtaggggttagggtctggttcagtcacccaggctggagtgcggtagtgagatcacagttcactgcaatctcaaactcctgggctcaagtgatcctcttgcctgagtctcccaaatagctgggactacagactcactccactctgcccaactaattatttttaaaattttttgcagagacagggtctcactgtattgcccaaggctggtctccagtttctgaatctcaagcaatcctcctgccttggcctccccaagtgctgggattataggtatgagtcaccacatccagcccagaaacctttcaaacgttgttatttggctttatgtttgggagccatttgaatgtgtatttgaatcccagcctgaccagtttcctagccctgttgggttgagcaagtcccttcacctctctcctggcctcaggctcctcatctgtaattgagagaaggtctgtgctttctcagagaatagttaagaggatttaatgggataagatctgttaaactcttagcacataacctggcccatgttcaaggtccaataaatcactggctgtgatttcaactctttatgtgaaggatgcagtttatggctgtcttttaggaattggccaaaatgatgagtcagaagctcttcttattttcctgtttttcaccttgattttggagtaaggtcacccttcccacaggtagggtgtgatttaacagtctttaagagataacattatgaagacacctgggtgcctgagccttttgcatcttaatcgctctccctggtttcctaagagaaggaacagatgggagaatggagactggcttcaactggccgtatttcatccggctgagaacatatgttcttgggaaggatgtaggaacaccctgaaatagagcgaaaaagagatgtgagatgagagaaatcctcctgaaacatgaatggacttgagttcctgttgcccttccttgcagcttgctgcctcctgccttgcgtagaaggaaaactgttcctggttccagacagaatggatttaagttctgttctatcgttatctccttgggaaagctatatgacttctctgagcctcagtttgctgaaatctatttataaacgtttacttaggtggctttcttttttagctattcatctgattacattttctcttgctctttttcattttttggagatggagtcttgctctgtcgctcaagctgcagtgcagtcgtgcaatcttggctcactgcaaagtccacctcatgggttcaagcgtttctcctgcctcagccccccaagtagctgggattacaggctcaacccaccatgcccagctaatttttgtattttttaaatagagacaggctcttatcacgtttgccaggttggtctcaaactcctgacctaaagcagtccagctgccttcacctcccaaaatgttgggattacaagcatcagccaccatggcctggcctacatattctcattttcttctgcggtttgagaaggagtagaaaacaatacaaaatagaaacatgcctttcagccaggcatggtggctcatacctgtaatcccagcactttgggaggctgaggtgagaggatggcttgagctgaggcattcaagaccagcctgggcaatattatgagaccatatctgaaagaaaaacataaaataaaaattttaatttaaaacaaacaaaataaagccaggtaatggaaacaaactctgacatctttctgctacatgtccttttctttctccctttctttttttttttttttttttttttttttttgaggctgagttttactctgttgcccaggctggagtgcagtttatctcggctcactacaacctttgcctccttggttcaagcgattctcctgcctcagcctcccaagtagcttggactagaggcgcccaccaccatgcccagctaatttttgatttttagtagagacagggtttcaccatgttggccagactggtcttgaactgctgacttcaaatgatctgctcgccttggcctcccaaagtgctgggattacaagcgtgagccaccacgcctggcgttgtgtcagtcttatcagaaactccctcctccatcatttgactatgttttgaaatgttcactactccattcaacaaaaaatgcccatacaatccagaagaggaagcgtcttttctgataattttagcctaaatcctagagagatgatttgatttgtgtcatcagtcttctgtccgtctataaaccgattacagtgaccagagggacagcatcctctgactgtcaatgaggaagggagagtgggttataccatcctacgttgtgtggacgagttgggttgctgtagaatgggatagtttgagacagtttctcaaaggaagggattctcgattaagaaaagaaattcgactctatggagtgtgattcgtaaaagggagagtaaggacaaagctattgtcaaggtttctttatcctctgaaatgtaattattgactttttttaaaacatggatagggatatgtaactgatgccttcccccacccccctgaaaagtctaaggtctagaataaaagctacaaaagctaaattccaggatatagaaacaagcctataaaaagcaccttcatcaacaagaaacaggctcaatttcacaaaacaaacccataaagggagaagaaagacatgtaccagttagttttcaatcttcgctcaccttttgttccttcccttcagtgaaacaggccttgctgatgggttttactcattccatggtgtattagctggctaggggcaccataacaaaataccacaggctgggttgcgtaagcaacacagatttgttttcttacccttctggaggctggaaatctaaagccagagcattggcagggtctgtttcttcttgggcctctctccctggtttactgatgacgatcttcggggtgtgtcctcacttggcctttttttttgtgcctacgtgcatcttggatatctctttctctttttctaaaaatggcagtcaaattggattaaatccccaaccttatgacctcctttgaccttaattacctccttctaggtcctacctccacatatagtcacgttaggagttaagacttcaactaggaattttgaagggacacaattcggttctgggaattgttcattttcttctgaattttttttttctgtgtgtgtatgagcagaacatctcttcacccggacagaatgcaattccaagcccctctgttgctgaactgttctccctttaaaactgtcttcatcctcagcgtaggtagctccttccctgagtacgtttttttgttgttgttgttgttgttttttggtacagagtcttgctctgttgcccaggctggagtgcagtggtgtgttctcggctcgctgcaacgtctgcctcctgggttcaagtgattgtcctgcctcagcctcccgagtagctaggattataggcatgcgccactacgcagaggtaatttttttttttttttttttttttaagtagccatggggtttcaccatgttggccaggctggtctcaaactcctgacctcaagtgatccacctgcctcagcctcccaaagcgccgggattacaggcatgagccaccatgtccggccagcacattctttgtctttgcagaaccatgctcccctctgcatctcacagcctcatgtacacacccattgctttatcccatagaatcacagttacttgtgtggatctctgtccctctgtccacccaccacccactacccactacaccagcatgcactgagaacagggtaatgattcagcagtttggtatcctagtgcctggcacagagtagatgtttgataaatgtttgatgacctgaattggattgaagctgaacaaatagaaattgcatttggccattatttccaggcttagaaatgaatgtgtgttaggagacttatttccatagcattaagataatacaatatatatgcaggtgctgtgtgccttatgtagaagctctaaatctctctcaaggatgcagaaagaggtgaggttcaggttgagttgaagaatgaaaaaagagttgcttaggagaacaatgctgggaaagggaggagatttgcggccatgtaatatgggtaggtgaatttcacttaatattgtggcagaatgctctatcacaacagatgctaaaggactacatttccttcctcagctctttcttttttctttctttctctgtttttgtctctctttctctctttctgtttcttttcactctttctttctttctctctttttttttgacataggatcttgctctgtttctcaggctggagtgcagtggcatgatcacagctcattgcagcctcaaacttctaggctccagcgatcctcccacctctgcctctcgagtaggtgggactacaggcacgtatcaccatgcccagcaattttatcttattttttgtagagacagggactccctatgttgcccaggctggtcttaaactcctggactcaacaaatcctccagcatcagcttcccaaagtgttgggattataggtgtgagccaacaggccctgcctaacttttttttcttaaccagttaagaaaaggcatgtgagtgaaagaaacgtaatagagtcacccatcttctgaggggtcagtttcagctgtctgtaggctggatactggagtcattgtcattattgtctgagggtattctggctaactctttctaccaaataaatcaccctagtataatggcttaaaacaataacgtacatttattttacttaagaatctcataatggagtcagctcacttaatcaggagcttttatatagttacatagtggctgagtctggggtggttttttactcataagtctggcctgggaagactcatagagtaggagcaggaatattggggactactaagatctctctttctctccttgtaccttgttctcatctctccatgtggttttttctcatggtgatttcagggtagtcagccttcgtaagtatagtatcacttttgcctcatggattcagtgagtcacacacaaatgtccacccagattcaaggagagactccacacttctctcttttttctctctctcttttgagatggagtctcgctctttcgcccagactggagtgcagtggcataatccaggctcactgcaacctccgcctcctgggttcaagcgattctcctgcctcagcctactgagtagctgggattacaggcatatgcaccaccatgcccagctaatttttgtatatttagtagagatggggtttcaccatgttggtcaggctggtctcgaacacctgatctcttgatgggggcatggcaacattaccaaaaagcatattaacaggaaagataattgtggccactgttgaaaaaagtggtttctcatacgtggttgatcagatacatgtacctttatctttctgaaaacgattgctttgttccttcatttaatatttccccacaagtgcttcgcagagcacatagtcgttgtgaaggctctatgtggcactctgagagaaggaatccttcactgctatcactgagatgaaagaaaaagagtaggacctttccctgctacgtttctgtagatttctggttctaaaagaacaaacttaaaggtaaagctcttgtgtgtgcaaaaaagtagaactccagttttgacaaagtagttaacttagacctgttagaaagtaaacttgttgggcatggtggttcacacctgtaatcccagcactttgtgaggccaaggcaggaggattgcttgagcccaggagtttgagaccagcctgggccacgtattaagaccctgtctctacaaaaaattagcaggtgtggtcatgcacacctgtagtcccacctacctgggaggctgaggtaggagaatcacttaggcctgggagatcaaggctgcagtgagccatgatcatgccactggactacagcctgggcaacagagcaagactctgtctccctcctccctccaaaaaaaagaaaagaaaaagaaatgaaaaaaaattatccttggtagggccgggcacggtggctcatgcctgtcagctcagcactttgggaatctgaagcgggcggatcacgaggtcaggagtttgacaccagcctggccaacatggtgaaaccccatctctactaaaatacaaaaattagctgggtatggtggtgcatgcctgtaatcccagctattggggaggctgaggcaggagaagggcttgaacccaggtggtggaggttgcagtgagcctattgccccattgcactccagcctgggggacagagcaaaattctgtctcataaagaaaaaaaaattgtcattgtttgaactatacatctttacctcacctggcaatgtatattaagcattattatttctatattgcaggtggcgaaaccaagccacaaatacaaaaacaaagaaggcttgaaggtctgcgactgagtagaacttaggtgtatgtatgcctctttccactgaaggaaaaataaccatgatcattcccttatattttgctaagctgggtatgtgtccggtgctctcagacctgttacctatggtactctttaatcaaataaaaccttaagttcaaacatatacaccgaaataaggcagaactactctgaaacagaagatttatggagtctctttcaccagcaacttaataacatagagatcacaatgtttcccatatacatgattttttttgttgttgttattgtttttttttgagatagagtcttgctttgtcgccaatgctgggtacagtggtgcagtctcagctcaccgcaacctccacctcctgggttcaagcgattcttctgcttcagcctcccgagtagctgggattacgggggtgtgtcaccacacctggctaatgtgttgtatctttagtagagatggggttttgccatgttggccagcgtggtctgaaactgctgacttgaagtgatccactcatctcggcctcccaaagcgctgggattatgggcatgagccacagtgcccagcctcacacgcacacgatatttacacatacatacatataaatatacatattttatatacataatgggtgttggtgcatttcataggcttgtctttgaatatcaagatttcaaactggtttgcaactgatagaaccgagaaaaataactcttggatacctgacttgaatctctctttgcccattggcggccaaagccagttgttgacgtaaagttttttttggttgttgttgctaattgcatctctttcctgacagaggagtaacctcttatttacaaaagtgtttacagttttacatacccgataggtcttacgcacatgtcaagacaaggtattgagccaggcgcatatacccctaatatggcaagagagagaacttctctgtcaacaaggcggtaataaagtgtaacagacaacacttaaggtgtcagtcacctttgcaggcgtattggaagttacaggttagatctagtggttttgatttattttgatgtcaaaaagttactcacatatttatgtaaaaagagagtggcaaatcaacggggtgttgattttgaaggtgctatgtaataaatcagggtagcgattctggtcatctcgccaattttgacagtgagacttgcttatttatggcgttttaaggtctgaggagttgatttatagttacaataacggtcttccatccattagtagttccggcatgcatagatgtgtccctcgtttgcatttaatgattggcatttttaaaattacacgactataaattgtcaagcaggaacaaaactcagtttaaaacgtaattttgttgaaacatttgttttaataaaaagggggtagttgggataaaatacatgccaactgtcctcacctgttgtccaccccaatgctatattaattatgatcctatatcctcctcattatgtagatggagaaactgaggcaaaaagaggcatgatttttctagggcagttctccaatatcaggtcattgcatttaggggctctcttaagtgcaggtgcccaagtctagccataggtgaggagatgagccccagagaacatgccctccagaggatcttaaatcatcacctgacttgagcacccagtttgaaggcaggtagaagggttcgaacctcatttctgtggattagcaactttataaccttgggcaagttgccttttttctatcaattcatgtgtcctcaaataaagaaaggtaattatcctaaacttattaggctattttaggcatcaaatttaatatgaaggctgggtgtggtggctcgtgcccataatctgagtactttgggagactgaggcaggaggattgcttgagcccgggagttcaagacaagcctgggcaacactgggaaaccccatctctacaaaaaaaaaaaaacacacaaaaaattagctgggcatggtggattatgcctgtagtcccagctacttgggaggttgaggcaggaggatcagttgagcctgggactgagatgtttcagtgaactgagatggcaccactgtactccagcctgcgcaacagagtgagaccttgtctgggaagaaaaaaagaaaaaaagaaatttaatctagaactccctagcgtacgattaagtaagttatcaataatttttttctctttcacctttaagccttccccacatatgcacacacacacacacacacacacacgtgcacatacacacactcaaaacccctgtgttctggacttactgattaattttatgagaacgttgttctgtgttccactggttagaagtacttaaaatgatcacattcaggcaagatatgaatctcacggaattaaattagctcattgcttgcttttttcaaagggcagttttactcttctctgtgaacatcttagtgtaatattggttttatatgctggtgcattgtattgcccatgtgacagcaatatgagagaaaattaatagtatttttcatcttttgctacaccaccactttatttatttaggtatgtatgtatttatttatttatttatttatttatttttgagagggagtttcactcttgttccccaagctggagtgcagtgccgctatcttggggctcactgcaacctccatttccctggttcaagtgattctcctgcctcagcctcctgagttgctgggattatagatgcatgccaccatgctcagctaaattttgtaattttagtagagatggggtttcaccatgttggtcaggctggtctcaaactcctgtccgcaggtgatccaaccaccttggcctcccgaagtgctgggattacagatgtgagccaccagacccggcctccatcactttttgtaatgagggtgaggacacatttttgattaagtgagttatcttccctttagtgagttaccttccctttgttttgcttatctgagtgagggccacagaggctggagttgtaaatgggacctggacagattgctaagtctgggaaaagatggaatgaggaaggatgagaatggagatgggagtaccacacaggagatcgtgcagagaggcagaggagaaggactttgctttgaagagtcaggcacaaagagctgggtgaagagagtttttagagagtcttgctaaggaatccccattcgtcatctcccacattaattattccccaaagtattttgctgctggagttcttcagtgtcaagactggactcaaggggaatgagcaggctccgctgtcttccagtgaatacttgaatttgtcaagagtaagctacatgctgggctttgtcatcgtcttctcaaagagatggtattgaagattttaatttcagagtaaacctggagtggggaaggagaattgaaacctaagggccagtgggggcagttgtacctcttgcctctggtcaggtgtgggagacagaggagtgagtggttcaaatccacagcccgtcttcccttcttgtgcctgctatttgtggctgatgttgctccagttatctattgcatcatatcaaaggcatttgctctgcttaatgcctttagaaaacaatttaatatcatcttcgatggtcttgtggtttgaccaggcacagatgggtagataccgcttggggtatctcatgtggttgcagacagagagcagctggggctggagctatccaaggatttggatgggctgggtattcaaggtgacttctttcctcatttgtctggcatctgggctagttgtgttaccaggaaggggtccagatccagaccccaagtgagagtttttggatttcacacaagaaagaattcagggcaagtctgcagagtaaagtgaaagcaagtttattaagaaaggaaagaaataaaagaataggcatattccatcggcagagcagcccaagggctgctggttgcccatgttttttggttatttattttatttttttatttttatttttatttatttatttatttatttatttatttttgagatggagtcttgctctgtcacccaggctgcagtgcagtggtgtgatctcggctcactgcaagctccgcctcccgggttcacgccattctcctgcctcagcctcccgagtagctgggactacaggtgcccaccactgcgccaggctaattttttgtatttttagtacagacggggtttcaccatgttagccaggatggtctcgatctcctgacttcgtgatctgcctcccaatgtgctgcgactcacgctcagccggttatttcttcatgatatgctaaacaaggggtggattattcatgcctccgcttgttagaccatatagggtaacttcctgacgttgccatggcatttataaactttcaccgtgctggggggagtgtagcagtggggacgatcagaggtgactctcatcaccatcttggttttggtgggttatggcatctttactgcaacctgttttatcagcaaggtctttatgacccgtatcttgtgccgacatcctgtctcatcttgtgacttagaatgccttaacctcaggggaaagtagcccagcaggtctcagcgtcattttacccagcccctattgaagatggagttgctctggttcaaacatctgtgactgttgggctgggataccttagggaaagccaggcatctctcttttcacacagcctctttgtgtagttagcctggacttcctcctagcgtgacagttgcagattagtcagagcccttaaatggcccctcccttttccatgcaggacatctgtgacctagcccgagaagtcacacagcatcacttccagcatattctcttggttacacaggaccagctcctgcatagggtgggaagggactactcaggggtgagaataccaggaggcatggttcatcgaggggccatctttggagactagctctcatggatgttaaaggcagcggcttgtgagctgcagaaatgggtgaccggattttgcacgttttttgagaagcaaggggaggggaaagttaacttaatatgggagggctgcaaaagttgaggcacagcattttttccagtaagcttggccgtctttgctgagccctgcacgatgcagccgttagcaggctgggcaatgctttgctttatgaggcaattattccaacacactctattcaaaatacacattagaacttaaccttctgaatcctcaagtagcatttttatcacccaccattagaaaagagatggagtcagcatatttccccccctttttatgatcgggtatcattaataaagcattgggcaaggaccttctcgcaattcctcgggataatttgtgacacaaaaggcgttctgtgatacaatggtctgttgacttattcaataacagaggaaacacatggattgttttaaaaaataaagccaaggaattaaacaaccaaacggaatatttcctttcaacaatgggaacgcacgctcagagtagggatgtgatgctattggctatgcataactagaaatgggaagttaatatggaatttctaattggggtcacatgctaatgaactccctcttcatgttagttttatgccgcttcagaaatcttttatcatatgcttaaaaatttatgggcagaaacattaatgaaaatgaggcgtgaattggaaatcgtgtcattatggagatgagggtggcccggcattgctgattttcaaggaggtatcttttattacctttttttgagaactgagaaatgatacaggtaaaattaatgacaaggcgtattctccatcctgacataggcagcatggttctatgtaaagttataaaagtttgattttaataagattttgaattaattataaggagaatattaatcataatggacagtcatttttcagaataaaacttcaccatctaagtaatattatagttcttaagtgcataaagataggcattttcttttttctatcggctttgtcttttcagaaattaaaatccactttttcagactacgatggattggaaagcctgggccttttcatctgtgaaatactcgctcgatttcagattgtacttaaaaagtacctctctttgctaagctcaggggacaggcagattttgtgaggccatgtttatgtggagggagccagtacagtcatattaaactttttctgtttttaatctctcagaaactattgttttcaatacatctgataaccgtcacatttgaatggattttcagaaagtcgttttgtggggtttctaagagttgtacttcacgcttatcacagcagggatgaaggcagaagttggaataaaatcttgtttctaggcctgatctcaagggagtatctttttttattttttattttttaccctctctcattctgtgtgcatttggacccaggtctcagtgagtctgtggcaaagcaggtctccctcaaggctgaacaggcaggcctctgtaacaactgttccagcactgactgagtggttacgttaaatattaaaagctgaggctgggcgtaatggctcacatctgtaatctctaaacttggggaggctgaggtaggcggatcacctgaggtcaggagttcgagaccagcctggccaacatggtgaaaccccgtttctaccaaaagtacaaaaattagccgggtgtgttggcaggcacctgtaattccagctactcgggaggctgaggcaggagaatcgcttgaacctaggaggcggacatgtagtgagctgagattgtgccattgcactctagcctgggcgacaagagcgaaactccatctcataaataaataaattaataaatgccaagaaagccagtgcccttaaacaaaggctgaaatgtaacaaaaaccccccaagagttttgcctaggcctttcctaggccttgaaacatgacaagataataaaggaattcttaacaggacccatttaggattaaacaagtgtattgggggtctgaagaaactccccaggtcttgagaaataagttttttgggtttctaaaggaactccccacacctccatgatttagcaggagacaagagaaggataatcatcccagcacctggacccatttagattaagtaaatttactgaggctgcagaggaaggtcttcaggcctcagatcttatagatgagaagttaatcacttacgtctttagacgaatgcacacttacaggtagacatatagcttagaagctgtataagctctggaaaactttctaattttaagttggtctggtgatatttcccaggccttctccctgtacccggttacaggaataaactcccttgtctcccagttctcgtgtatgttgttattgggccacgagaataagcagcctgaccctcagtttggtctgggaacaactcttcaggagtcacctctttcttgtatctgttcccctgtgcccttcttacctccttccaaactctgcagaggaggcccccgcctgccttttttcctgccttctctccttccttcctctgttctggagacaggacatactcttgcaggaccagcatctcctgtctctgacgggcccactctctgtactgtctctacctgtcaccactgcaagagggtacagaactcagactttgagctcttcaatcatcatatccctgactgtagggattggcccagggttgggtacctgacccaaacaaagtcaaagagattaaatgcctcaggtccgggtgcagtggctcacatctgtaatcccagcactttggaaggccaaggtgggcggatcacttgaggtcaggagaccagcctggccaacgtgatgaaactccatctctactgaaaatacaaaaaaaaaaaaaaaaaaaaattagctgggcatggtggccagcaactatagtccagctactcaggaggctgaggcaggagaatcacttgaatccgggaggcgggagttgcagtgagccgagatcatgccactgcattccagcctgggcaatagagactccatcacacacacccacacagacacacacacgcaaaagaaagaaagaaaaaagaaaagaaagattaaatgcatgggatagtaagctgataggatgtccctgagctgctgatggccattttctcagaacctggggagaccccaccagaggagaggagagctaagcaatgcagacagtcctggccatgcaagtggagcccctgggtccctgcgtccactccagaccgtgttcaaactgtagtaatttcccagcgctgctatagcaaatagccatgaacttggtgacttaaaacaacaaagattgttgcttttgttatcagaaaggggtcccgatcaagatcccaaaggagggttcttggaaattgcagaagaaagaatcagagcgagtccgtaaagtcaaagcaagtttattagacgagcgaagaaacaaacgaatggctactccataggcagagcagctctgagggctgctgattggctactattatggttatttcttgattatatgctaaacaaggggtgaattatgagttttctgggaaaggggtggggacttcctctggaggtgaggttccttcctcacctttagaccatatagggtagcttgtgattgtttcacggcgtttttaaattgtcatggcactagtgagagtgtcctttagcatgctaatgcgttataattaatgtataatgagcagtgagagcaaaccagaagtcactttccttgccatcctggtttgggtgggttttagctggcttcttcaccacatcctgttttatcagcagggtctttatgagctgtgtcttgtgcagaccttctgtctcatcctgtgactaagaatgtctaacctcatgggaatacagctcagtagctctcagcctcattttacccagcccctattcaagatggagttgctgtggttagaaggcctctgacactttcatgattctgaaggtcagaaatccaaaaatcaggctgtatccaggaccatatttcctctgaagtcttgataggagaatccctcctttctacttccaaatgctccttggtttatggcagaatgactccaactctgcttgtttgcacatggccttctttcctaggtgtgtgtcagacctccctctcctttctcttacaaaaagactagtcattggcccaccctaaattcaggacaatctcatcttgagatccttagcttaatgacatctgcaaagatcctacacattcataggtagcaagggttaggacttcgacttatctttttaggagataaattcaacctgctacaacctgtgcaactttttctgttacatatatgacatttcccctgataaagcagcctggtttaatatagccgcagtgtgtccctggcatcctttcttcttacttcagaagctcagaggtcaaaagcaccttaaagttcattcaattcaacctgttaacatgaggcttggagccaggagctcatgcctacctataatcccagggctttgggaggccgaggccggtagattggttgaactcaggagttcaagaccagcctgagcaacacagtgaaagtcagcctctacaaatagtaaaaaattagtcaggagcagtagcatgtgtgtgtagccccagctaccttagaaggctgaggtgaaaagatcacttgagcccaggagatggaggctgcagtgagctgtgatcatgccactgcactccagcctgggcggcagaatgagaccctgtctcatggaaaaagggaaaaaaagaaaagaaagtgagccttgggatggggtgatttgggtgggctggggtggggttgttggatcttgctttgatcgctcagcagtttgcatggcaaaggagaaaaagaatgctgactcccagccaagaatcagctctgtaaaccttggatttgaaacacagtcactgtgtgaactgcccaagtcaaatgctccaggcccaccttccctctcctttactgaggaagtccgagattcacctctgggtgcaggactctttggggttctggctggtagttgccacccaagcctagcactgctattttttttcggagtccgtcatgccataattttctgtaaagaggtagcatcaaaagcagcatttgtgttggcaaaaagctagcccatcttagggtctttcaacagtgacttttttttttgttgctcttgttgttttaaaataagtggggttctcagctttgagataatgggaatgaaatcgaacctctatttttagaattaaaacacacacacacacttgaaataaaaatgtgttgttggacttctaccaaatggttggtgacaacataagttatctcatgctgtctgaaccactggtcagtaatgagatacatgttagaggatctgatttgtttgcaaaggagtgaatgactcacttgcaatgtaaaatgtacattttggctgtgttctgtaggatttcaactataggccatcctagaaaagcaaaactgtggggatagtaaaaagatccaggggtgccagagattatgtgggagggagggatgaagaggcagagcatagaggatttatttatttattttattattattatttttttgagatggagtcttgctctgttgcccaggctggagtgcattggcgcgatctcggctcactgcaagctccacctcccgggttcatgccattctcctgcctcagcctctcgagtagctggggctacaggcgcacaccaccacgcctggctaattttttgtatttttagtagagatgggatttcactgtgttagccaagacggtgtcgatctcctgacatcatgatccacccgcctcggcctcccaaagtgctgggattacaggcgtgagccactgcgcccagccccggatttatttatttacctatttttattttcttttttcaacatgaagtcttgctctgtcacccaggctggagtgcagtggtgcattctcggctcactgcaacctccgcctcccgaatcaagcgattctcctgcctcagcctcccaagtaggtgagattacaggcatgtgccaacatgcctggctaatttttgtattttttagtagagatggggtttcaccttgttggccaggctggtctcgaactgctgatctcaagtgatgcacccccctcgacctcccaaagtggtgggattataggcatgagctgttgtgcctggcagcatagaggatttttagggcagtgaaaatactctatgtgacactgtaatggtggatctgtgtcgttatatattggtctcaacccacacaatatacaacatcaactgtgaactttaatggaaactctgctctttgggtgattgtgatgtgtcagtgtatatggttatcaactgtaacaaattgcacctctggtagggggttttgttaagggtgaagctatgcctgtgtggggccagtgagggtatatggggaatctctttatacttgctgaattttctgtgaacctaatactcctctaaaaaataacgttagtttgaagaaaataaaaatacattttgacaaactcattccttcccaggatttgcaaaagctgatatcacaaagggtgtctctgatgaggtaaggtccggaagcacttgtccctgcaattcctgttggagagcctttaagaacttctcagcagggctgtttgaaaagcttaaagctaagaaaggcctttgtctaaaagagcctggttgaaatccctgctcccagctccttgctgtgtgaccctgggcaagtcactccttaacctcctccctgacttaagccaggctaatccccatctctgcggattaaaggagataacagacgccaggcacttagcagcgagtgtggcctatcctacgtgcttcataaatgatggtggaaatgattatgattgttgctttattatctctaggttctcctccttccctggagtctgggggtggcagtgttatgtagcttcttcctaggtcatgaggtgggtttatctagactctgcctccatggttctcggggccaagggcaactgtactgctgcagattgctgtggtggtagattctgggagaggtgggtggtgtaaatcactaatgaaaaggaaagcattgctttgcactcatttgggtgtaaaaaatggagaattcaggactagaatgaccaaacataaacaaatccaatttcctttttcttttgttgtgtgtgtgtgtgtgtgtgtgtgtgtgtgtgtgtgtgtgtgtgtatgatggagtcttggtctgtttcccaggctgtagtgcagtggcgtgatctcagcttactgcagcctcccgggttcaattgattcttctgcctaaacctccccagtagctgggattacaggcgtgcgccaccatgcctggctaatttttgtatttttagtagaggcagggtttcaccatgttggccaggctggtgtcaaactccggacctcaagtgatctccccaacttggcttcccaaagtgctgagatgacaggcatgagccactgcgcctggctgacaaatccagttttcactgagttctggaaaatgtgagtccagtgactatattatctgaacttaaaaagtagatgtgattggctccaaatgggaatgataataatcatgtttattatcctggggtgctttctccatagcaagtactcacttaggtcctgttcattagtcagtcttttaatctgtactgaaataggtgctgtcgcatccatggggataaggaaactgaggcatggggggattaagttgtttgcccaaggaaatgccgggaaatagtagcagagttggcatttagcatcgggggatccagtgccaggtttttaatggattcacttagggctttggaatggggagtaaatgctcaaaatggagcgtatcatagaaaatcggagatacgttttcttatcttagaaataagaacctggactttgaaggtagtgatttttactctatcacggggttctcaaccatagactgggggcctaaaaagcacataaggcatggttccactaaaaggagacatttacgctcttgccagaggcttcctatctctctgagccagctgccttcccctctctgtcccagcttctcacatagggccacatccagggccaaggagggtaaaatgagcctcccgttgactgggcactcctgcaggcactgaggataaaatgggagtgaagggagagcaagttttggctctcagagcacacacagtctagtttgaaagaaataataagtcatggcaggacagccaggaggaaggggtacatgaccctggggggtcttccagaggtccctgggcgaggtggaggggtgagctcattctgccatccacggagcatgatcacagtagcttattaggtggcgagaggggcggacgggggaagactgagagagatggatcgagttatgcaatgtctttgagaaagaatggaagatacgttagttaaaaataaggccaatggactggagaacatggggtcacagagcaagaggcaaggtggaatgatgttgctgttaggcatgagatagtgcaagctgggctgaagtgaagcgaaattgatctaaattacacctgtgatgagaagtcactgtaactctgcctgcctctatctgtctgtctgtctatctatctatctatctatctatctatctgtctgtctgtctgtctgtctgtctgtctatctatctgtctatctatctatccatccatctatccacacatccatctatccatgtatccatctattcatctctccatccatccatccatccatccatccatccatccatccatccattggcctacctattatctatttgcctatatagacattcatccatcatctacttatacatccctcttttatttctgtatgtacctatctacttatctgtacgtgcatccaccctccatctatccatatatctatacattcatccacccatcattctatttgtctatacactcattcatccattacttatctatttaaacattcatccattcatcatctatccatgtgtttgtacattcacacatccattttctatctatacattgatccatctctccatccatcatccatttgtttatacattcatctaccatctgtctgtctgtacactcatcatttcatcatccattatccatccattatttatgtatggatctgtctatacatccatccatctaccagcagtggggttggctctcatgttccttgagcagggaagagattagagggagctgaagcctcatgggaaggccagttgaagccagttccaaaaagtaatgacatttggagctaggattaggatgggggcagtggataggataggagcagtggatagacgttatttcagaagaaaaacaggaaccctttcatttgctgaatagactgacttgcttatgtgtttctcctacacctctttacatgtcatcagcttctctagttcaccctgcccctcagtactcagtacacttcgctgttgaacagcgaagtgtgtgttcagtaattatattgctcttctaagggcctggttcaagacattgaacacggtaggtccttggtcaaatgggtcttctttaattgtttgtgcccatctgcccgtgcagctgtgggaccctggggaatgtgtgggaggcagcaggtgaccaagccctgaaactaagaatgtaaggggacagggtttagaagcaaccagacatacttcctgaagaattgggttgtcagtctgaaaaaagatgccccaaatcactgctccaattcctcccaccaactgttcagctgccccgggtgccagaaggataaaaacgctcggggagagaggttggcagttctgctgatgacagcgggaaggtgctgcctctgctcttgtaaggaagccatgtgggctcacagtgctgggaggtgcttgggtctgaccctcggatgcatgagagagccactggaatggatctgtggctctgaacttgcaaccccgcacagacaccaccgctagactcggcctcagggtgggaaccccctctccgtgggtgtcctttagctctcttttcagttcagagtgactgacaggcttttctctggttggtgcctttaactcagcaaagacccccaggcaagctgtcacttggagagaggatatttgaaaagcagcctggtgaaattagcagcgatggaaacaatgcaaacatttcatttcttttccttcttttttcttcacttatttttcctccttcatcaggcattttaatactgtctttttttcctggtctcatctcacgcagctgaaataaaagcatgctgcctgacgctatccggaccgaaaaactgaggcttctccctgctttggctgaagttctcccatagccgtttcctgagagcagtcttaaagatttagaagaggaagtctggcagggaaagtctcagaatgatgtgaaggtgtagatgatggattcctcccatcctgtcagtttcagtttgcatttacacaacgtgccaccatcccacaggactcgaggaagcccacaaggtgctggcctcccatcgagtacacatactaactcctgttctcatggcagctggcctcatctccctcctctccctcctctttgcctagtaccttgtaaagtagctgattaccttcattagctcagaatgtattaatccaggtttttttgtttttttttttttaaagaaaacctgcaggtcttctggcagctgaaggctactcttgactcttggctctgtgtcaggattcacataataagctcattagaggaaagttcccagtcccacagtgaccagattagtgggtgctcaggatgtgtactttgagggaaggaagatatctgagcaaagtcagaatgttagaatctcccactttttttctcctgtagttaatacagttcccatccgagaggtgtcaagagcacttacaggagagaccttctcctaatgcattggttaagagtactgcgtgtgaacttattcagtccacttttagctgtctgtccccaaaataggtaacttaacttctcttaactcctcactacattcccagtccttcacctgttatgtgagaatgataatgaagttcttgggaagaccttggagattatggattttaaaaatgcttaggcagttactcaacgaatcctatttagtgcggggtcaggattagggtgcattgagggaggcagtgtcatgcagtgattccatatttaacttaaaaatttggatattttgttcatgatgcatatttcacaatgaataattgtgattttgtacaacattacattcaaataaggtggccgggtgtggtggctcatgcctgtaatcccagcacttcaggaggccaacgtaggtggatcgattgagctcgggagtttgagaccacactgggcaacaaaatgagacctcgtctctacaaaaaataaaaataaaaaaaaaattagttgggcattatggtgcatgcctgtagtctcagctactcgggaggctgaggtgggaggatggcttgagtctgggaggcggaggttgcagtgagctgaaatagtgccacctcactccagcctgggtgacagagccagaccctgtctcaaataaataaaaataaggtaacgtatcttaattgctgagctctctggtgcccccttcagttgtgttgcctcatcctcgttctggccctaattctgagtgtcagccatgtgtgaaccattgtactaattgatgggtatgcaatgttgtgtcacttgagactctttcagtagtctgtcatagatttcccacatacagaaatgtcacacaataaggacacgtgttattttatgtaatataaagtccttacaagcctgggcagcatagcaagaccccatttaaaaaaaattagatgggcatggtggcatacacctgtagttccagctacttgggaggctgaggcaggaagatgatttgagcctaggggttcaagactgaagcgagctatgatggtgtcactgcattccagcctgggcaacagaacaagactctggggggaaaaaaataaaaaagaaagaaacaaaaaaccccaaaatcaaaaacccatgaaaaaccaaaaaaaaagtcttaacagaataagaaggcagggtactttcaatgacccaacaacatcatcacctagactatttctgtcctttcattttctcagtatagtggtttgacacttaggtttgtcttttctcagttgcaagacaggtagtgcagttcccttaatgtttcactgacttagtctgctcaggctgctacatcaagataccttagcctgggtaatgtatcaacaatgggagtacattgctcacagttctggaagctgggcattctaagatcagagacatcagtagattcagtgtccggtgagggctgagtctctgccttataactggtgccctggcgttgtgtcttcacatggtggaagggaaaaagcactccctcctgcctcttttggaagggcactaatcccatttgtgagggctatgacctcatgacgtaatcaccttctaaaaatcctagctcttaatactatcatgttggatattagatttcaccatatgaatttgtggggacatatacattcagaccatagccccctttaacctgaattgggtcttatgccctgtctacaaaggagactggcaaaagtgactacttggaatattcagcatcaatagaagaaagaaggctgtgctagtaagagacaactgcagtaaggctcaaagacctttgtgctgtgctgttccatttgtctgaaacacatgcacacaggtgcacgtgcatacctacccatttcctcctgcccttatttgatcatagaatgtttaacagtttccttcaacagatatttcttgagaaccatactatctaatctgtccaagacataatgatgaaaaggacacatgcgtttcctgattggatggtagttataatctagcggaggaagacagacatttgacaattgagtgggtctactaatacataggaaggaaattattgggaaaaagtatccgctatacagagattttaaaatatagaaagaggtgtgctaaaaggcagctgaattgttatggggatgggattcttctggaacaccttggggattcatatgtaagctgagataggaaagcgaggacatgtcagccacagaaacatccatggaagagcaatccaggcagcaggaacagatgactcagcctaaagtggggagtgtgtttgcttgtttggggagcagaaagggaagggtggtgtaagatgggtttggaggggttggcaggggtcccgcagtgcagagcttttcagattgcaatatgaagagagagagagagagagagttggtgtgtgtgtgtgtgtgtaccactggagaattttgagcaaaagaaatgtgttcccagtttacattattaaaagatcaccagctgttacatggaatatggtgtactgattgggggcggagaatggagtcaaacattccaattaggaagccattgcaatagtcctggatagagatgactgttgttggggttagggtgttgttagcagacctgtgggagtgtggacggattggggacatcgtggagatgtcacttaagtggagtgtccacagtcctgcttctgttgggtgtggagggcgagggaaataggattcaaggctaagagcagagaagtgtctgatggaagagtctaattccctgcagtgatccgctggtaccctttacatcagcagcctcagtggggtggtgagatgggaactggaccgacttgagatgcgggagaatgtgaatgagcatggagtccgtgccacaggcaatccctgcacgcaagttttactgtgaagtgatatagaaagaagaggggaacagagagggtcaaagacttttgtttccttaacaaagagatatattacagcatttttttcccattgtgctaaaaagcacacaacatctaaccatcttaaccatttgtaagaatatagttcagtagtgttcagtatattcacgttgttgtgatagagatcacgaaagctttttcatcctctaaatctgaaactctgtatctattaactctgtaactcccctttctccctctccccagcccctggtaactgtcattctactttttgtctctatgattgggctacgtttgctaccttgtatcggtggaattatacagcgtttctcctttcgtgactggcttatatcacttagcataatgtcctcagggttcatccatggtgtaggatgtttcttcgtttttcaaggctaagtaatattcccttatgtggaatggatacattgtatttatccattcatctgtcagtggacatttgggttgccgccacttgttggtgtctgaatagtgctgctttgaacatggggatacaaatatattgcagcagatttttatactgattggaatgttctgggagaagtggagacattgatgatgcaggagaacaagcagaaaatttcaagagcaaatgctttggggacagacaacctgagtggagggctggccttgatagagatggaggcagaggtggtctcatgcgaaagtataagtgggagactccaggggaaacacaagggaggctgggtagatttgatgtcgagtgggtaagaaaatttctgttcaaattcatatttttttcaataaaaccagagacaaggggccggatgcagtggttcatgcctgttatcacaacactttgggaggctgaagtgggtggatcacttgaggtcaggagttcgaggccaacttggccaacatggtgaaaccccatctcaactaaaaatacaaataaaaatagttagcccagcacggtggtaggcacctgtaatcccagctacttgggaggctgaggaagtagaatcagttgaacctgggaggtggaggctgcagtgagctgagattgcactactgcactccagcctgggtgacggagcaagactccattgtctaaataaattaaaaatttaaaaatagagacaaggccatcagctttgagagagtgtgtgtgtggtggtggggggcggggttggaggatatcaggggttcttccccattaatagcataaatgattaacagtaagtacttggaatcaagttgatgcattttcttatgtgccatgcagacaaaataaagctcagctttgttgtcagacaaaagcagcacttattacaatggttggcatttcagagataattcaactataagagataataacacatcagtcaatcaggaagcattcttcccagtgatatcaacagaattacatgcaagtaatagactgttgtggacccaactaggaattttcttttgctgaaatgctcctatttctaggagaagctcaacgttgatttttcagcttctgtttggagagtctgtttatttctttcttcccgaggggattgtaaatggtgaggactttttattgtttttgacagttatcaaagaaacattttttttaaagctggaccattgactgaaaaataaacccatttgggatttttcgagtaaagtgtgttgaatcatgtttgtgatactcacttttaagttttggcgagcataactgcactgtgttacccattaaccggtagtttttaatttttatttttttaagttccagggtacatgtgcaggatgtgtaggtttgttaaacaggtaaacgtgtgccatggtggtttactgtgcctgtcaagctgtcatcaacgtattaagcccagcatacattagcttttatccctaatgctcgtcccctccatctcccagcagaccccagtgtgtggtgttcccctccctgtgtccatgtgttctcattgttcagctctcacttttaagtaagaacatatagtatttggttttctgttcctgtgttagtttgctgaggataatggcttccagctgcatccatgtccctgcaaaggacatgatctcattcctttttatggctgcatagaattccgtggtgtatatgtaccacatttttttattaatccagtctatcattgctgagcatttgttttgattccatgtctttgcttaatgggggatagttgtaacccctatgaatgcagagaggcatgtggtacagtttgagttggtgtcattttagtaaataacagtccagtttgtggtgatataaatcacatttttttctttttcttttttttttttttttttttttttttgcgatagagtcttgctttgttgcccaggctggagtgcaatggtacaatctcagttcactgcaactttcgcctcccaggttcaaggaattatcctgcctcagcctcccaagtagctgagataacaggtgcgtgccaccacgcccagctaattgttgaatttttagtagagatgaggtttcatcatattggccaggctggtcttgatctcctgacctcaggtgatctgcccacctcggcctcccaaagtgctgggattacaggcgtgagtcactgcacctggcccataaatcatattctttatttgcatttctggaagaccatcaggagggtagtaacatttattaaatgtccctttccatatttttcttatctcttaactgaaactcaccagaggcaggcaccagaaaaccccctgtgtttgcaaaccttgatgaagtttgccagtcactcccttggcttgtagtccttttacttccattttactcgcattcagtgctccctggaaggtgtttctttctgcaaatagctgcgtgagaaatccagcatgtcctggaccctccctcttttaaaacacttttttaaaaggattgttctaaaagaatcttcctctgcttctgcttctaattctggaagaaagggtggagctaggtgtgttcacatggtagtactttttcttttgatccaattgtttaaaaatatatggcagaataaagaggacgggaaaacctcaacaacacctcaggagtcagagagcagaggaaggtgtttcactctgtgcagatcctggactagctctgtgggttcctgtgatggtactgaggtaaagagagtgaagcatctgcccgacgcacagaatttaagaggccaccacaatactcaaccaagaagaaatcatgtcctttttttattatttttttttttgagacagggtctcattctgtcacccaggctggagtgcagtggcacaatatcagctcactgcaatctccgactcctgggttcaagcgattctcctgcctcagcctcccaagtagctggcgttacaggcacataccaccatacccagttaatttctgtattttttagtggagatggggtttcaccatcttggccaagctggtctcaaactcctgacctcaagtgatctgcctaccttggcctcccaaagtgctgggattacaggcgtgagccactgcacctggccgcaagtgcccatatgttgatagcacctgggagaaaattgatcaggtgtgtttttcccacttgacagatgaaaagactgagccacatgatcagaatttcagcccaagttcataaatatcttcccttggaacatcaatttatgattagcactgctcatatgctcataggctgaaagttttctactcctatgacccctaaagtgtacttggtgggtaattaggagcttgctgagtgaataaagataatggtaatggtaataatagtaataaaaataaaactagctgggtatggtggtgcacacctgtaatcgcagcactttgggaggctgaggtaggtggtcacttgaggtcaggagttccagatcatgctggccaacatggtgaaaccccatctgtactaaaaaatacaaaaattagccaggcatggtggtgggcgcctgtaatctcagctatttgagaggctgagggaagtgaattgcttgaacccagtaggtggaggtttcaatgagccaagatcgtcccactgcagttcagcctgggcgacagagtgagactccgtctcaaaaaggaaaaagaaacaaacaaaaaaactagcattaactggtgctttgctatgatttctacaggagttacaagagttcttatatgagcattctaattattacataggggaaactgaggcacggggcagttaagaaactcacctgtactgagaacaagaatttgaacacaggcattctggctttagaggccacactctaaatttctcctctatccttgttctagcattcagtcctatccatgaatacatgaagcaaatatcattttcagaatccagtttccagaggcgagcatgttttatacatctgtggctattggttttgttccaggaaaggggtcctgatttagaacccaagagggggtttttagatctcacaccagaaagaatttggggtgagtccacggtgcaaactaaaaaagcaagtttattaggaaaggcaagtggtgaaagaacagctacttcatagacagagtagggcgttcccgaaagtaagaggaagaacgcatccaccctaggtacaatgtttatatatatatgatatatatatcatatatatcatacctatagcatacatatcatatagcatacatatcatatatatcatgtatcatacatatatatcatgtcatacatatatatcgtatgacatatcaatatattatatatatgatatatgagatataaatgatctagatcatatataatgtacctatcatatgatgtatatcacatatatatcacatatgtcatatccatatcacatatatggtgtatatcatatatatcacatatattgtatattatatatatcatatactatatatcatatatattaaatatcctatatcacatatcatatatatcacatgccatatattgtatatcatatgtatcatgtatcatatatatcatatatatcatatatcatgtatgagatatactttatcatatatgatctatattttatatatatatcatatatatgatctatattatcatatatatgatatatattatatatatcatatatatcatatattatcatatatagatcatatatatcacatatatatgttttatcatatatattatcatataatcatatatgatttaaaaagatcttgggcagatttgctctgctacaagggtttgtgataaaggattaattttcttaattattgtgttttgcaagaattgatattatgatctttgaagcaaaattaggaatgcctttgttctctagataccgggatatctggacactcgcaagtctggttctgtttagcaaacattatttacttgttcccttaaccatacacatctagaggccaggaatgcctgacttcctgagaatgcagcccagcaagtcccagcctcattttccagccctcactcaaaatggagtcactgtagttcgaagacctctgacaattggacacacgtctgtggttcctaactcaggacagatggatttctgtggactccaagcttccaaacggcaggcccccggctggtcatctctttagctctggcactaaccgagtgccaagcacattagcacttggtgaatattgattgaaatgaattgaaattgtgggtggaggaaggctgaataaaggccatttctctgaagaaaagaaagaaaaagaaagtcatcttatcccgtagtcagtgtggattgcaggcacctttggcttatttgcagtatcttgaaaagctgcttcccaatctggtctgagagaaacacgtgagctgaggggactctctagggagatcccaagaggaaactgcctcttccagcctccccagggaaaaaaaaaaaaaaggcaaacctcctttcccaatgtggctgaatgtgtctttgcaagacactcagcattcttgtgtgtttattttctgggtcccccaagccccgccctccctctaacctgccccgtaccccgccccccttcatgtgggtgtcaattacagctgactttgcaggctccagccctgaacacaacagccgggcatgatgccctgggccccatggcatacggcagtggaggtaattagccagccttgactgggccctcggttgcagttcgaaatgcttcttgaaaaacaagtttctagccttggagagcgtggctttgtacttgatagatgttctgaatgtctttattgtggtactatgcaagaaattgggattcttttatcccggtgctctattttgggctggtctttataattagatctaattactcatacagacgtcatgaggacaatgacagctacctcaccgaacacatgatatctggaagaatagttataagcccttggtgcatatttacttattacgttttcattacaggtaggttgtattattatctccattttacagaaagggaagctgaggttcatagaagttaaagtaactcactacagtcatagagcccctttctcctttctatattctgggtattaccaggttgggtgccttccacatattttctcttgtaatcgttttaatgtcctcatgatgattttgttgtccctttcttaccgacttggaagctgaggttttgccaatgtaatcaggatgtgataaatctcagagtaagtttggaagaaggattcgaaccccagatttgaaccccagtggcctgattctggagttcatgctctgtggctacaatacattgcctatatcgggtaacaaatgccttcaatccccttcgcgcagagctgcttcattgcatttttgccctgatgatgctttcggatgctgcagagtgcattggaagggcacagaggcctggggaccacacccatcttggtggagagccccaggctgccacctgtgctaaggcaggcaaactgttgactctttctgacatccagatacaacttctgaggagaggagataatacaaaagttattatgaaagctagagagaatctgtataaaatagcaccaatatgttcaacatgatgattatgggctcagataaaattgtaccaaaaatcagacctgaattcaaatcttagttctagtgttgatagtattcaggaagttgaaaggttatttaaatccccaagtctcagttttcccacctgtaagaggtgaataagagaaaaatacagttaaatagtaaaaaccttagaggattctatggggtcctgtctgattaaacacgcaggatataatagcattcagttgagggtagctattagctatcagtgtaattatgaaaacattagttgaacctgagcactttccattgtgcgatagacccactaaattaaagttgaagaaagtcctttgaacagaagaaattacagtgatttacagcatctgttcttcccccagtacctttctattgattgaagggctgtatgttgtagttaattaaaatgaatatcttcaattggatacagcaatgcttttgcaaaagaagagatagcaggattgcagcacagtacaggggtgtgactctttcattcacagtttggggagctcagaactttcttttgggttgcagaaataagttatgtttcaatagaattcaaataaataaacatgtgaggcgttattatgcttataaatttgaaggctgtgatcattcctcctaaacagtggatgaagattttctaaaaatgcaaaaatcatctcagtgggtattccacccttttctcctgcctacagaaatgccagatgcactcaggctggtgttgggctctgtgatgtgtttgctttgtgagcctcctgggcatctaggtgtggccacaggacaagatcttgtcaaagagatggaactgccagtttctgagaggtctctggggaagctttcattttcctgttggagtgggtaccttctaacaccgtttctccttcccagccttaatggtgtcattatagtgttaacggtggggctacagaactggatatataaccgcatggcaccttgaccctggtgttagagtgtagtagaacagtcacagcacaggctggacgtatgtcacctgagaaccttaatccctcttcaattaagcctccgcagttaggatttctattatttgcatccaaaagcaattctagctgatataacttgaaaaattaccgcaaaattttatttcctatacaaatgtgctgtgtcaggtgtgagtgtgtgcgtttatgatatgaacaatagttcttccgttaaatattacctattcgttttttgttccagatgaggactaacatgtaaccatttcttttgttttctaatcttatctttttccttcatgagagtttacttgccattttcaaacacagaaagatatgtttacaaaagcaaaaaacttgtcttcttatgttgaaatttttctggtgtttgtttgcattcctaggcccactggttatccatgaacagaaaagtgttttccaagctaacatttgacatgagaatcaaaagcgagtattgaaaaacagctttaataaaatggaggtggcaggttttagctgaaaaactccaattatcagaaggtgttggtatttctcaaggaagaacacaatacagctaaatttctgactctcccggagataatttggagggagcaatgtcatcaaaggagggcagattatatgtgggaagaaaatgttcaggaatggagcaggtacagtagctcatgcctgtaatcccagcactttgggaggccaaggcaggcggatcacttcaggtcaggagttcaaaaccagtctggctaacatgttgaaaccccatctgtactaaaaatacaaaaattagctgggcatggtggtgtgtgcttgtaatcccaattaatcgggagtctgaggcatgagaatcccttgaacctgggaagtggaggttgcagtctgccgagatcacgccactgcactccagcctgggtggcagagcaagtctcagtctcaaaaaaaaaaaaaaaaacactaaaaaattcaggagtggtgagatccagtacttttccaattaagtaaactctttttttatttttttaattttaaatttacaggtacacttgcaggtttgttgcacagataagcttgtgtgatgggggtttgtggtacagattatttcatcacccaggtattaagcctagtactcattcattgttttttgtgattctcccctcctcccaccattcaccctccaaaaggcccctgtgttttgtccccctctatgtgtccatgtgttctcattatttagctcctactttacttttctgtttctgtgttaatttgctaaggataatggcctcgaggtccatccatgtccctgcaaaggacatcatcttattcttacttttggatgcatagtattccatggtgtgtataaaccacagattctttatccagtgtattagtctgttctcatgctgctaataaagacgtacctgagactgggtaatttataaaggaagaagattaaattgactgacagttccacgtggctggggaggcctcacagtcatgatgggaggcaaaggaggagagaagtcacatcttacatagtggcaagccagagaatttgtgtagaggaactcccttttataaaaccatcttgtcacatgagagtcagtatcctgagaacagcacatgaaagaccagccctcatgattcaattatttcccgcctggttcccccaggacatgtgggaattgtcagagctaccagtcaagatgagattggggtggggacacagccaagccatatcatccagtctacactgatgacatttaagttgattccacatcttggctattgtgaatagtgctgcagtgagtatacgcatgcatgggtctttgtattacaatagaactttttattggcacatgaaaatacaaataagcctccaaatagtgtgtaatacaatttctttgaaccctcgtgttttaccttacaaatttatgtaaaattttcgtagtttttcatgatatactcatgttggtttatataacaagaatgtggcccccgcaccaatgactaaaccaaattagtgatacgaagagttatccatgtttatggtattggattgtgtattctctggcatccaatttgagaaacctgagaatggtcctgtggttggctatcaggtacccggggagaaatgtagctgctttcaatttgaaaacccttttccaggtaacaaagattgacctacattattccattttgatctttacagaaacccattcccattgttggccagcatgtcattttgacttttgttggttttattagtgagaacactgaatatcattccagagtcagggctctgatcctggagcatcagtcatgtctacttaagtcctttcattgcagcgagctccttctcattcgttcatgagagtcgttgacgaggtggatcctggagtagtctcagacggcctcgccctctgttcatcatccttttgatggaatctccctgttagtagttccaaatcatagttaccatgagttgaacagttgtttgtaccaggagctgagcaaagccctttcttgcacattgtcacattgagtattcacagtaaatgtaagaggtagatttactgttatctcattttgaaagatgtggaactggccaggtgcagtggctcatgcctgtaatcccaacactttgggaggtcgaggcaggtggatcacctgaggtcaggagttcaagaccagcctggccaacatggcggagccctgtctctactaaaaatacaaaaattagctgggcatggtggcggatgcctgtaatccaagatacttgggaggctgaggcagggagaacaacttgaacccaggaggtggaggttgcagtgagataacatcatgccattgtgctccagcctgggtgacaagagtgagactctgtctaaaaaaaaaaaaaaaaaaaaaaaaggaaaggtgtcgaactgaggctcgagcattttggtaagttatctaacatcacattactggggagtggccatgctgagacatgagttacagttttccagataccaaaactcttagctgttccattgacagcttcctagcagggatagcacaccaagcctctaccctttccttgggtagtactcatcctctgactctgtcacccgctttatcctcttggtgatggcagagctacttggaatcactagtaactgcattagaatgatgtgcagttgtctatccaatgagttttgtccattatttctttagccgtaaataaatgaggaaagtacagaattattggtggggggtggtctttgaaaaagctagggtgggagaatatcgagaatgatataattatctatttgctgcttctggtccgccgacttgctggctttttttttttttaataggattatggaagatgaaaaggaagcgcttacttcagcttataagagcaatgtaagcaattttgcattgcactcactccccaggggtggtgtgaacatgtttctagtaaattaaagtatcataaaagcattggcaacatggcaacttttatattaatttcttaatttttcgcaggcttaattataaatctcttgggagaagaggcaaggcctgtcggttcctgggaaaacagtgttgcatctctaggcttgaaggtctgctcttctgctcagaagtatgtgtgctgtgatgtaggctgggtggctgctgtaggttgcatgcactacttgtgcctagtgatggtagtgatgccctgtggacaagacattaggctgggaggcccatgcatgcagccaagtggagagagtgctcttggacaaggtgttgtgtgactcttagcatgtagtaatgtgtcataagagcacagtctctgcagtttactaagtgtaaaatcctggatctggcctggagtggtggctgaaccctgtaattccagcactttgggaggccaaggtgggcagatcacctgaggtcaggagttcaagacctgtctgatcaacatggagaaaccctgtctctactaaaaatacgaaattagccgagtatgatggcaggcgcttgtaatctcagcaacttgggaggctgaggcaggacaattgcttgaaccctggaggcagaggttgcggtgagccgagatagtgccattgcactccagcctacgcaacaagagtaaaactccatcttaaacataaaataaaataatcctggatcctcctgtactacctgtgtgacctagagaaatttgaccagccctttgatctgtgaaatatgatggtatcaatgtcacctgggatatgcatgaaaaagcctacatcctacagcactactgagcatcctcaccagcctaggggtatctccagtgagacgaaccatcaggaaaacaatatatatccctatggatgaagccactgttaggcaggttttgttacttgcagcctaaagtctcctcacctttagtagtcactaaattagaatggtgcagcagcccattgagttccggattcactgaatgatggcatatttatgctggacagaatcttagctctgcccagtgagtttaccacatgccttctttacttaatatttttattattattttgagatggagtctctgttgaccaggctggagtgcagtggtgtgatctcttctcactgcaacctctgcctcccaggttcatgaaattctcctgcctcagcctcctgagtagctaagattagaggtgcatgccaccacacctggctaatttttgtatttttagcagagatggggtttcaccatattggtcaggctggtcttgaactcctgacctcagctgatccacctgcctcagcctcccaaagtgctaggattacaggtatgagacattgcacccggtaccttctttacttacaaatctactgtaaggaaagtgaaaaatcaggagggagggctccttgaaaaacccagggggaaatatcctggctttgctggccagatcccaatgagttagttcctctggatttcatttctcaagattctggaatttcctctcccctctccttccttcccctaccctaccctaccctaccctaccctcttctttcctctgcccttctgtagcatagtatggtttaaaatgtgatcacattctattttaatcatggaaagatttttttctctggcctcttgtcttttctgggctacatgccacatattggtagggaatatatcttatgtttttacatgtccttcaattaattttgaaatattaattttatgataggttaacttatgctgcacacacatacatacacaaaagatatatggtcttataaataggtatggctggacaaggtgactcaggaggcttaggcaggaagatcacttcagcccatgtgttctcagtctagcctgggcaaaatagctagtccacatctcttaaaaaattaattaactaaagaacactatgtgtggaaaatactggattagaaagattagacagggctgggagcagtggctcacgcctgtaatcccagcactttgggaggccaaggtgggtggatcatttgaggtcaggagttagagaacagtctgaccagcgtggcaaaaccccatctctacaaaaaatacaaaaaagaaaattagccaggcatggtgtcaggtgcctataatctcagctactcaagaggctgaggcataagaattgcttgaacccaggaggcagaggttgcaatgagcttagttggtgctactgcactccggcctgggccacagagcgtgagttcatgtaaaaaaaaaaaaaaacagaatttttttttcttttttctttttcttttctttttttgcaggacttctttgtatctttaatctgcaaatgaatgtgaattgtaaatctccatggagtgatatagaataaggcactttccaaacttaccggacgagagaaattttttttcataaaacatcttgcagaaactcactttagagaacctgcatatctccaatttttaaatttcatttgtctttttaaaaatgtgcaatattttttcaactttttattttgaaaaattctaaacatgaaaaaatgtaagacttgtacaataacccttatatacgtctaccagaatcaccaatttctatttttatttatttatttatttatttatttattttctgagacagagtcttggtctgtcacccaggctggagtgcaatggcatgatcttggctcactgcaacctgtgcctcccgggttcaagcgactcttgcctcagcctcccgagtagctgggattgcaggcgtctgccaccatgtctggctaattttcctgtttctagtagagacggggtttcaccatgttggccaggctggtctggaactcctgacctcaagtgatccccctgcctcagcctcccaaagtgctggtattacaggcgtgagccaccacgtccagccccaggctggttttgaactcatgggctcaactgattcacctgccttggcttcccaaagtgctgggattgtaggcatgagctcctgggcctggcccagaatcaccagtttttaatattaaatattttttactgcatttgctcatcctctgtctccctcttttccttcccttcctctccctccccttctctctctccttctctctgtctttttgcaaattcttgatgggtatcttttcgtgacaagaaagaaggtggtctggatgccagttgcctcctccacttgcctttaagaaaataactgaacacgctgtagggcaggtgcctgtatgtttcacttgtcttggttgatgatttattataatcccatcttagaatcctagaatctcaagttgcagagggacctgaaaggttatctaatccaccccttgctcacctgcccaccccgcctgcattccctacccatgctttcgaatgccatttattgtgtttgccagggtttgttggttagtccattctgagtggaatgaaacttgcaaataaggccttgtggagagcctgccctcttcctgggcatcatccaagcgatctattagcagcttccatttatcagcgtcttgtgtgggtgtagtgggcctaataatgggagctcagtcagagagcagcattttgatagaggactgaagtgttttgccaagtcttgattacccataataacaagaatgaaaactttggccctggttatgcacagatttattgaatcatggaatattcatgctggatggaatcttaggatcatctggttcagtccctgaagttttcaaaggaggaagtgagtggagaacaagagagaatgagtagtttgcctaaaatctcatcactaccatggtttctgattccaggcccaggttatctcccgagccactaggcttatctcaggacagcaacagaaaacttttcagacacacacacacacacacacacacacacacacacacacacacacacacagaggcatgccccacacattgcaaacataatcatatacacgggcacatctatacataagcataggtgggcacaggtgcacaaacttacctgcaatctcattcataaatggaatttccattccgttgaaatatagctcatgactggggcctccactgacctgcagttcacaatctagaagtgtgaacttggaaatagaaactcatccaaatacatgaccacagtttattcacctgtgtggtgcctcttgcagatagcagaggggaggagaataagaacgaacattgtaaggctgttgggatgactggtccgtggagtgacagaagagattagaaatccaggtttattgggagggcatctcaaagcagccacattttatccctattcgggtcagaaatgaaatgtttatgatggctggaatgagatcccacaggaaacttgagtttactaagtgccagctaggcagtctttccttgcataatcttatatagtcgtcatcatggttatgtttctggtgaaaaaaaaattagatatggaaatgctattagttaccccacattccacagccagtaaatggtaaaaccaagaatcaaatgtggatccagagagcactgagaacataggaatacataaaaaagaaaacgcatttcaaagagaaacacagcagagttttagaagtgtcctaatggtaaatctccccctaaatttttggaaacaaatttgcattttcctgctggtttttccaggcaggactttctcctctcagcaaagccctatagacctttagagcagtgtagtctattggagtttcctgtgatgatgaaagtgtttataatcttactgtccactgtagtagctactgtttacttatggttattgagtgagttaagatatatgctggatttcaaagacttagtatatgaaagtgttttaaatagctcattgagagtttttaaaaagtcgattgcctgttgtgataacatattgggctaaatatatttttaaaattagtcttacctgttttattttttcttttccctttttattttaatttaactttatttaattttattttattttatttatttgggaccgagtcttgctctgtcccctaggctggagtgcagtggtgcgatctcggctcactacaacctctgcctcagcctcagcctcagccttagcctcctgagcagctgggattacaggtgtgtgacatcacacccagctaatttttttttttgtttgtttgttttttgttttttgttttttgttttttgtttttgtttttaagatggagtcttgctcattgcccaggctggagtgcaatggcataatctcggctcactgcatcctctccctcctgggttcagtgattctccctgccttagcctcctaagtagctgggattacaggcgcccactaccatgcctggctaatttttagttgagatgggttttcccatgttggctaggctgctcttgaactcctggcctgaggtgatccacccccctcggactcccaaagtgctgggattataagcgtgagccaccgcgcccggcttttttggtatttttagtagagacgggatttcgccatgttgggcaggttggcctaaactcttgacctcaagtgatctgcccgcctcagccttccatagtgctgggatttcaggcctgagccactgtgcttggcctctttttccgttttaaaatgtggctattagaaaaattttaattgcatgtattgcttgcattatttttctcttgggcagtatggatctggataatttgtctatgaagatatatttacaattatatgtgcttctctctgtctatctgtatcagtctgtcttttgaaggacattttattaaacagcattatatagtgtataatgaattacaatttgttattatttaacggtgcaattagaactttttttccccacatattggtacctgtaagttaatatcatcctctgtaattattatatagcaatctttagataaactgatttattagttgcctatcaatttatacgtagtaccagggatggatataaagaatagaaacaggtacagctgtggagaatgcaaccatttaagagtgggacagaagttatctctgcagactgtctggagaataaagaaacaaaggaacagaagctacttggaacagaggtgttgatggaaatgaagaaatagaagtccctaaaaggggtcaggtgctgtggctcacacctgtaattccagcactttgggaggctaaggcaggtggatcacctgaggtcaggatttcgaaactagcctggctaacatggtgaaattccatctctactaaaaatacaaacattagccaggcctggtgatgggcaccgtataatcccagctactcgggagtctgagacgggagaattgcttgaattcaggaggcagaagttgcagtgaactgagaccgcaccaccgcactccagcctgggtgacaagagcgagactctgtttcacacaaaaaactgagaaaatgtctgcaaactacttgaaatatgatttagctcccctgtactagaatatactcttcaagaggtcagatactgcttgtttttatgtgaacatatgtcaccaacaactagtaaacgtgcccaacacacagtagggattcagtaagtatgtgttgaagaaatgaatggaatggcaactctcaattttggatttctttgcttcgcattttaaaaattctgatagtggccagatagcggtagctcacggctgtaatcccagtactttgggaggccgaggcgggtgggtcacctgaggtcaggagttcgagaccagcctggccaacatggtgaaaccccatttctactaaaaatacaaaagttagccggtagtggtggcgcatgcctgtaatcccagctattcaggagtcggaggcaggagaatcgcttgaacctgggagttggagtttgcagtgagttgagatctcgccactgcattcccacctgggcaacaagaaagaaactccatctcaaaaaaataaaaattctgttagtattcacatagaaggatgatactgtgtcccataaaatatatccaagtttaccaagtagaagtagcatatattacattggtgcaaaagtaattgtgctttttgtcattactttcaaaggcaaaagccgtgatcagttttgcaccgacctaatagttgtgaatgtgagcttggacaagtttcttaagcttactggtcttccatgatcttccatgtccatctcaggatagttcgagcccaaactgcttgttaaggtccaggaagctgatacatatcagtgagtgctgataacagaaaaccatgctatgtctagttgctaattttttaagataagataaggctgtcattttttatgatagaaaagtgactctcgcaatttattgccaatgagaaccaccacattgttcattgattgcatattttaaagctctgtgtccagatattctaatttactacatcacagttggctatttctggccaggcgtggtggctcacacctgtaattccagtacgttgggaggccaaggtgggtggcctgcttcagcacagaagttcgaggccatcctaggcaacgtaataaaattgtctctccaaaaaaaaaaaaaaaaaaaaaaaaaagacacggtggcgtgtacctttagttccagttacagaatgaggcaggagaattacttgagcctgggaggcagaggttgcagtgagttgagaccatgccacgtcactccagcctgggcagtagagtgagaccttgtctcaaaacaaaagttggctatttctgcatttctccatttcagctaatacatctgtatgtacaggccctggacaggatgcctgggagacattaataagcaacattccgtttgggcctcaggaagctcatatcccataggggaactgacacaatgattagcacaaatacgtagataagtccttttgaaaaatgaattcccatgtgattattatcatcaacccacttctcaaatgttttttctttttgttgttgttgttttgagatggggtcccactctgtcacccaggctggagttcagtggtgcaatctcagctcactgcaacttccacctcccaggctcaagccatcctcctacctcagctgtccaagtagctgggaccacaggcttgtgctgccattcctgcctgacttttgtagttttggtagaggtggggtttcaccatgttgcccaggctggtcttgaactcctgagcccaagcaatctgcctgcttaggccttccaaagtgctgctaggattacaggtgtgacccaccaggcccagcccacttctgaaatgttaatgtgcataggaatcacttcagggttttgtatcaaattcagtttcttagatcctacccacagagtttctgattcaatcaatagggtggtgggggtgtcccagatcctgtgttgttaacaggactccctgtgtttcagaagctggtgctatgaaaactacaccttgaaaactattgtcagagtgtggtccacctctagaaaatattggcctgtctttgccagagtttcacccattccttagggagaacgggtgtagctgtctcttcctttccagtctgtgtaggaagcagaaccaagctcatagagaagcaattttttgttttttttgagatggagtctcactctgttgcacaggctggagtgcagtggtgcaatctcggcttactgcagcctctgcctcccggattcaagggattttcctggtgcaatctcggctcattgcagcctctgcctcccaggttcaagcaattctcctgcctcagctttcccagtagctgggactacaggtacccaccaccatgcccagctaatttttgtatttttagtagagacggggtttcaccatgttggccaggctggtcttgaactcttgatctcacgtgatctgccttggcctcccaaagtgctgggattacaggcgtgagctactgcatccagcctagcaattccttaagtaccttgttcatcccttccaaggtcagcttgggttcctcagtagtcgtggtatttctctgtggtgtaaaatgcacataaaggacttaaaaactaggtaagaaggcagttaaggataaaagttacacaacttcaaccatattctgttagagccacaaagggcttcagaaaccagctaatgattttagagaaaagatggcatgagtccaagaggtcacatgatctacccaaggtcacttgtgtctagagtttttgtgtatcatgacatgaccaatggccatggcccagaaaggctgattccttccttttccaaaaaaaaaaaaaaaaagatttgtgatacttcaatatattcagtgcccaccgcccaagcacggtgtcattcacaaggaattataatggatttcattgtagaatgcagactccttcttcccaattacttctttgctttaaacataaagccgagagcctgaccctgggaatagttcttgtctgaatttctgatagattttaatttcgcagctggagcctggtcctcacagtcattccctaatttcttttgttagtctactgcattcatctttggttctgtgtaggatccatagatggactgaactgtaacactgactttcttttctttgtctcacttgtcaaataaaatcatttgaggctgaatggtattgatagctgtgcaatgacttgttgctactgtagaggggaccctgcacacaccttcctgggagtcatgtttgttgttcaaatgagtcttctgagaatcaggatctcttgaaaaagataacacatcagtagtattaaaaactaacgaatagggcaaatcctcatttagctcctttcggtaataaattcatttgcttgggttcaggatttgtagagcatattctaaatgcattgctggctgagggatccatcagagtgggaaggggagatggggaaagccatcctgttgcattgaagaaacggaatctgtgatcaggaaacctggttaaaggtcctttcccctttgtaattttattctacatagggaggcaagagtggtgctgcaacatatggagagacttgagtttaattgttaaaattccactcagccgggccacttcttcactgtgatttgcactatttagcatttgtgtgcattaggtaatatatttaatgtttctccctccaatccaatttgcgtgtgtttggcagcagcccagctccatgggcatggggcaggggagatcataaatctgccatcctggagcatggaaactgtattgctgcatttgatagtatgcttgcatgaacactccaaaatgcttgtgaagcaataccacctcttccccgaacgtctctcagggacaacattaatgtatctcatattgtattgattgtagccaataagtgcctaaatgatttggtgcaaggcagaaagattatgcagggaagaggggtggaggtggctttagaagaagtatgtggtttaattactggctgaatttcctcaatccacctccccctctgggagtttaacaaacaggccttagtgcactttagctgttgctgacatctgttgaaatgatatctgcccgtgatgaggggagtttgggaattgcgcttggggtattggcgggatcagggagccacaggaagctcctttccagtctgcaaaattagaaggaggaaaacactgcagtagtactctaaggttaagctatggagagcacagttttatctaatggaattctgccttccgacttaatgaagccatcttcatcttaaatgcagggttggatgtaagtgtctagagtctaatgatcttaaagtcccaggtgttgataacaaacacagagttgagctgaaaacatgaatagtgcatgggcaatgcttcaggcacccaattgtaaaaaccacccccagctctctctttttaatgccatgctaagaactgttaggaaacttcacagtttttaggtaaacaacaagtgaccgattttcttgcattttttaatagaagcaaaagaagccaaaacctagctaaaatttcatgttgggtccagcaccaggaagaatgatgctgtgtatctgctagtgttttgattacatcaataattcaaagaaagtgccatccacttaatctcttttatgcctctccacccgaaaggatcctggttgtattctgaaagtcctgaagctatcatattccacagctttttctgaaatgtgttattatgttatgcttgaaacatttatatatgttaccgaccaaattgcatggaaacgatttgctttcagagactgataaaaattcacttttgatggtagacacaaggtgagatgttatcaaaacaaaattccaaattaacttggatatctctatcagaacatatccctgattgggcatgtgattcttgcattattttgtgtgtgtgtgtgtgtgtgtgtgtgtgttggtcattgtatttaaaaatgtgtttgcatacgtgtgtatatggatatatatgtgccaggtattaggctggctaattattgtgactaaaactctctggggttaagtggaaaattaaaaattcagaacaaccatagtctgttatctgtcacctgtaatttaggctaatatctcaattctcttgttatggacatttctcttacagtgtggctttacataatgggaattggatgtaatgtgatcaattaattagagcatatgatttacattagtcaaacctgtattgattacaaaatgactatgatctgaaagtagccttgtgtgtgtgtgtgtgtgtgtgtgtgtgtgtgtgtgtgtgttagaagtggtgatcctgctttgtatgtggccaacttggggagggggatggatttttcactttattattgtgacgtgtgatagacctatggggtgttttaaaattcccaagcaaataatcttgctggtggtgacagaagaggaaggctttgaagaggggtgtggtggctcacgcatgtaatcccactactttgggaggccaaggagggtggatcaccttaggtcaggatcaccagcatgggcaacacactgaaaccttgtctctactaaacatacaaaaattagctggacgtggtggtgcacgcttgtaatcccagctactcagaaggctgaggcaggagaatcacttgaacctgggagcacagaggttgcagtgagccaagatcatgccaccgcactgcagcctgggccatagagtgagactccatcttaaaaaaataataataaaaaacaaaaaaagggaaaggctttgaggtaaaagctagaggtacttacacttgagattggttcagattttataactcaacagacaagtatctgattctctgcatcctcctatgtttgaaccataaatttattagaaagcatatataggaaaaaacaacccagttcctttgagtctgaaactttctagtccctaattactttttcccattggaagtatatttatagcatacaaatctaaacttctcaacttaccttgataactggtccccatgttgatggccatggggcgtcttgaagaccatcagtgatccaagtatattccattagttttcatgtcaagaacattttattgtatcctaattatctgaaacttggtcatctgaaataacatggcagttcccgataaatcattgcctttttgatttcctagccatcttgaatacaggaaggcttagtttagcctttgcttttaaattcatataaatacaatgatattgagtatctctactttagaataacactgaactagtactgggatttttaaatttgatattcggacagctctttttctgttctgtggttttgtgcatgtgtgtgtgtgcatataaacatgtatgtgtgtgcatgtataggtatctggatacacatctagatgtgtttatatctagattgatacatacatgtgtatatatatccatcctcctatctggacacgcatatttgttacttgaaaataagtagggcttgcatacattgtagttactattgtaagtgctttccaaatatttaactcatttactagcccaacgactttatgctttaggcactgtattttcatttaaccaatggggacagtgacgcacaaagaagctaattagtttgtctgaggtcacagaggtagtaagtggcaggattgggattcaattgataatgcagtgcttcatacaaataatgctttgcaatttttgagcacttttctacatgtcagatagagggatttaattttttactcatttgatttttatggccagtctatgagttgatttccatcattgctagtttgctgaatgggacacagaggctgaaagaataacacatctgtagtcacagagttagaagctgatggaactgaactttgcatccaggaaatcagactagagaatttttaataaattatcaagaaagtttataggcagcattgaagatttcctcatcagctttatacatatgtatatgtatatatgtttatatttatatgcacgtatttataagtacattgtagacagatgaaaaataataaaagcaggaagtaccttttgttgtgttgactgtgttttgcccccaaacttacaactctcaatagttgtcttttctgttagctgaaattaaatagagaattatcttagcattttcccccaataactttaaggtttcttaagagatggtaagtccctttgaagactagagtgatttgactcaacttctccttctagtaaaaaaaagtctgccaccaatacatgtttatatttgttaaaataacatacttatcagtatgaagtggcatcagcaaaaccaatgacttaaaggtacaattgtcaacctatgttgaaaatatgttgaatttccaagagggaaacggctgcttgatcagagttcatttatatccacgagcattgcaccagcaataaactttaagttaatgttaacaattttaatttgtatcttttaattgttgaagtctgaattgctttccaatttcccacagagtttaatgtgtatgcaaattgcacagccagaaatttaagatacaaaagatagactgcgttttgcaaacataccataattattgcttaatttttaaagggtctttctctttgtcagggtattgttcggtttcttgaaactgaacagaagaaaacttttggttaatgattagtataaatcttgtaatggaacttaattgaatattaactttgttgttctcacaactacagactactcaattccctgtttctctgaggtagggtttcttgctctgttagtgcaaataatttgtcttctagtaatagcaggaaacagttatcagaacaccagtttaattgtctgaaggttgtgcactacatgtaagctcttagaaaaaggttaaaagaattctcatgtctattttaatattatatttcgtaatcatttaaacagcttggcagtcctagcaaagtaaaaaaaaactaaaattgaaggtaaatgccgttcttttgttaaaattcaaggtaggaaatgctgagatttagaaaaaatatagatataaatatatgtacattatatttagtgtacaatagcatatgtagtatataattatctatttatttatttacttattgagtgtaaaatgaaagcagccaaagcagtacatttggtggattagtagtgatttagctatgaagcatttatatattcaaatatttgttgctaaatattcctaaagcctatggggttctagaaactggcttaggagaggagactgaaggatgaacaacactcattagtgtcttccattgtgttcaagtgtttacacatgaatccaagaaataataagatgctacagatggtgaaaactaatctgaagggggcaaaatgaagccagtgagacacagaatggtttggggatgggggcagttgtgttagacaaggttttagggaaaagatgatgtcagagctcttggcaatgacttggccctaccagaagcaagagacaaagttctaaatgagaacagctggttgtattgaagaaccaaaataggattttaatttggttatatcattgtgatcgatgacttttgttgctttttggtgtctccaaattgcaatcctgtttcacattttgtgttcctttccctcagactattccaagaatgaaggatgtttgatgatggctacaggttgtcttgtacagaaaacttaatatatcaggctctcttgagagagtaggaagggcattttattacagactccagtctaaaattccttctgagtactttaaaatatacccacaaatactggagtcatgtttcttctttttttaattaattaagtattattattattattattttgcgactgagtttcactctatcacccaggctggagtgcagtggcacgatctaggctcactgtaacctccgcctcccaggttcaagcgattctcgtgcctcggcatcctgagtagctggaattacaagcatccactaccatgcctggctaatttttgtattattagtagagacagggtttcaccatgttggccaagttggtcttgaactcctgacttcaggtgatccgcccgcctctgcctcccaaagtacagggattacaggtgtgagccactgagcctggcctttttattttattttattttattttattttattttttatttttatttattttttttatttatttttttttttagagatcaggtctcacttgttgatcaggctggtcctgaactcctgggttcaagcggtccacctgcctcggcctccaaaagtgatgggatgacaggcatgagccgttgtgcctggccaggagctacatttttactccagattcattggtggaccagagtgatttggtgatacttaaactcattctgattttttttaatttttattttttatttgagacggagtcttgctctgtcacccaggctggagcattctcagttgtttaatggtggttttaaaatgttttattatgaaaaatttcaaaaaaacacaaaagtagaatagtatactgatccctcatatgctttacagcagatttcaacaactaccaatatgtggccaaacttgttttgtgctttaatcttcttctcccttccccatcaatattttgaagcaaatccaaaatatactattattattaaatatatcagtatgtatattggaaaaaatgaaactttttaaaaaaagaactgtattgtcattaatgttattatgcctttaaaattagcaataggccaggcatgttggctcatgcctgtaatcccagtattttgggaggctgaggtgagcggatcacttgaggtcaggagtttgagagcagcctgagcaacatggtgaaaccctgtctttactaaaaatacagaagttaaccaggtgtggtggcacacacttgtaatttcagctactccagaggctgaggcaggagaattgcttggacctagcaggcagaggttgcagtgagccaagatcacaccactgcactccagcctgggcaacagggagactctgtttcaaagaaaaaaaaaaaaaaagattatttaagtaggtgtccaaacatcatattatttttaaagttttcagtacttacaattagaatatgagaattcttaaggaaaaaaaaagtactgtcattagcgttattatgccttgaaagtagcaataatctgttaatataagcaagcattctatcattgttcaagtctacctgataatcttacacatttttaaagttttattatcagaaatttaaacatgatcgatatgtctcaaattaaaattagtcgatacatctctcaagtttcttttattaaactggtaccacctccaactcagtgtttgcaatctatttgttgaggtcaccgggtcatttttatgcaacagtctctacatagtctggttttgctaattgcattctttcttctttatattttctgttgactggtggttaaattcagaagtttgatgagatttttgttcaattttgcttttggcaaaaacacataataagttttcttttctttttttctttctttttctttctttttttttttttttttttttgagacagagtctcgctctcctctgtcgcccaggctggagtgcagtggcatgatctcggctcactgcaacctctgcctaccgggttcatgccattctcctgcctcagcctcccaagtagctgggactacaggtgtccgccatcatgcctggctaactttctatatttttagtagagacggtttcactgtgttagccaggatgctctcgatctcctgaccttgtgatccgcccgcctcggcctcccaaagtgctgggattacaggcgtgagccaccgcacctgggaaacacataataaattttcttgtttacttccattaggaaccacataatgcttttctttattgaagtcctttttggaaatttttatcagtcactagcaaccattaccatcactcctttttcatttattagatagaatacttgtacagagaaaaatcttttactgattctttgcttaccccaaggtagagttcatgtgagaaaaataggggcatctgtatcttccttcatttttttccagttttcaaatccgtttgagttagtttgcttgcatattccaaaggagactaatgatcattctaaatgtccattctgaagctctgttgttggccagtgggaatgtctttctgctgtctccttgttcagatggatggagagattccttgctttgtgaggtgacaaggtgttcctggtcaacttatgtatttcctaccctggccctgactctgtgtgtgtgtgtttgtgtgtatgtgtatgtgtatgtgtatgtgtatgtgtatttgtatatgtatatgtatatgtatatgtatatgtatatgtatatgtatatgtatatgtatacgtgtatgtatattttgagatggagtctcgctttgttgccgaggatggagtacagttgcatgatctcaactcgttgcaacctccgcctcccgggttcaagtgatgctcctacatcagcctcccgagtagctgggattacaggcacgtgccatcacaccctgctaatttttgtatttttagtagagacagggtttcaccatgttggccagggtggtctcaaactcctgacctgaagtgatccatcctccttggcctcccacggtgctgggatcacagggatgcgtcaacacactggcctctattatttgtttttagaagcttttcagaaccaggaggcagctcaatttgggagattttgtgaacatctttattattattactttaactctgttcagcacttgtctcaacttttcttattaagtggggagtccccatagtaagcgggggtccccaaaatagaagatcagttctactttttttctcctggagtttcttcttgtgcacacgattgagcacgtgagtgaactcctggtgtttagagtgacagtatccctgggcatagttgattcagggatgggcatgtgatcaggtggaccaccgagagattcctgggggactttgctcttagacgctatggagaaatttttttttctcatggggttgttgatcttgttaggtgagtctagggttattgtggccatccacctctcagtgtactgacatgcaatctaagaaattaggaaagggaaaaatcttgatgctgtcacttgaggccctggatacagcggtgcatgaagttaatctatctactttggaactttgcaagcatgtgagccagtgcattttcttgtatcctctaaagctattttgtgtttgtgtgagcacatgtgtttacacatgaaattgccctgatatgaaggttttctgtttatccagcaagaaagagatttaaaaaagatcttttcaactattttcgctgggcgcgatggctcatgtctgtaattccagcacttgggaagctgaggcaggcggatcatgaggtcaggagttggagaccagcctggccaaaatggtgaaaccccgtctctactaaaaatacaaaaatttgctgggcgtggtggcatgcacatgtcatcccagccactcgggaggctgaggcaggagaatcgcttgaacctgggaggcagaggttgcagggagccgagattgcgccactgcactccagcctggtgatagagtgagggtccaactcaaaaacaaagaaacaaacaaaaaactattttcaaatagcactaagtggcttaaaatacacttcctgaatgtcggctttgtttgaggaatgtgttgtggtagatgctatataataaagggaaattaggctgataggagtttctctcaacatcccgatacactcagcgtgttaagataaggctagaaatcagaataacacaagacagaaacttaggaagttagaaagtgtaagaatgtaggaaaggcgatgaggtcaacattttattacagttattttctccaaactatgagtggatcttggtggtctttttttttcttcttcttttttctctgttgtgtttggtttcccaaagagaggttatacaatcaggccatgatttacaaagaatagtcttgcaggagcattgcgtaaaatgggtttaaagaagaatgaaagatgctagacagatcgtttaaaaaggagtttctgggccaggcacggtggctcacgcctgtaatcccagcactttgggaggccgaggtgggtggatcacaaggtcagcagatcaagaccatcctggccaacatggtgaaacccccgtctctactaaaagtgcaaaaattagctgggcgtgatggtgagcacttgtagtcccagctactcaggaggctgaggcaagagaatcacttagacctgggaggcggaggttgcactgagcagagattgcgccactgtactgcagcctggtgacagagcgagactccatcttaaaaaaaaaaaaagaaaaaattataaaagaaggagtagtttgtgaagccctgttaaatcctgctctcagggatgcatatttacaccctttaaaaataaaataaaaccagaggttgaaacaaggtattaaaatacctctggagaaaaactaacctcttccaggaaagttttgttagctataaactcaaaggttgatacatgtagcatcaaaggaacataggaaagcttagttgatgctgtaattattaaacacaaacaatgtaattaagttagtatgtattagaaaaaaacatgatatgcacatcaagtctaattttattaatagaactttttgggatgagactaaaggacaattccttgtccaggttctacttataaattgcaaagactcactaatggttttcagatgattggttatttggtaaattggctttcagtgggtcaatgaaatggtcattaggagaactgtcaataaatttatctgctttcttttaaaaaaacatcccattttcccagggtagaaatgaggggtttttttttttttttttataaaaaaagtaacgcttcacaaatttgcgtgccatctttgcacaggtgccataccaccttctctgtatcattctagttttagtatatgtgttgccaatgtggacactagaaatcagttttgttttgtacttaatagagcatctttttaaatcttatgcacagaagaatgatgcatagaagaatctgtaatgcataagaagcatcttatgcattatcttttgaatcttatgcatagaagaatatataatgcataagaacaacgcattatatattaattagattaaattaactccattcggatacctaaggttatatttgtgtattaaactcctcaacatcagggtaaaagcaaagacaacatggcatcagattctttgtccaccggttttatttagtctcagagacccaagctggtcagcatttggctctggtggagtcaccatagcctggatttgaaggtttggagcccagcccaggtttggaggatcagtaagttggtatgccagcactccaagagagagaccatctctttgtcatggacacgtcctagctatgtatctaaggtttattagtacaatgaatttctatttaatggctttaatttagaacagttttcttgaaagcctcaacattggtattccattgtctgggcattttttctatatagggaaaatatacaaaagccacatcataaccaggaagatgtatggtgagctggtattcaagaaaggagaagtagctgtgagacaccaaggattggctgtaccagattaagataacctaatccacgtgtctctataagtggctgggtcagctgttggaacctgttgggacagaacaggttgaatccttgagcaaagaggccaggtgaggtgactcacacctgtaattccaggactttgtaaggtgggccgatcacttgaggtcaggagttcgagaccagcttggccaacatggtgaaaccccatttctaccaaaaatacaaaaattagcagagcatgatggtgcgtgcctgttatcccagctacttgggaggctgaggcaggagcattccttgaatccaggaggcagaagttgcagtcagctgagatcgcgtcattgcactccagcctgggtgacaagagcgagattccatctcaaaaacaaaaaacgaaaaaaaacccaaaactaaacaaaataaacacatatcctcacctttttgtgtgtgggacatacagtatgaaaagatgagtgctaatagctttccccttacctttcaagagaacctaaagatacttgcctccattccagtcatcttcctccctttcaatgagactgtgttcttgcttgctttgggggagaaagactaagttgacttatagaatagagggatggcaaggaaacatcccaatacagtcagtatttcttgtggaaggacaaaaagagaaaagtttctgggttatgtctagaaagataattgacaggaatggggagaaggaacccagtaatggcaggtgaacgagaaaattggtacaatgataagtgttctgtaatttttatcttgagaaatggaaaagcagctcctgaaagatcctattagtgatggcttggtgttggtaggaggtggcttgacactcacagatagactttggtgttgcctgttgaacacaaacaatttcatagaatatcagcatcagacaaggccatctcaggactgtggtgggtcaggacaagacaagaccgctaggtgatcatgtctgaactcagtccaaaacatggaccttgcctaaatcgcaagatgaccattcatcttctttttctggctcacatgagtgactgctgcttcttcaccgactacagctttcgcttcactaaattcttcccttcttctggataagaactatgaagatacccagtgatataattggtctttctgacagcatccaatccagagaaaagccccaattctttaacccctactcaggatcacgtaacagaaaggcaaatcctctaagaagctggacagcatcttactgagatactccgtggttcctcatggtatatgttctcctttgcaataggtagtaaaccctactttgttcaaatacaggtgtacatttaaacatctttggctagaggacatacataatgtcattaaatttatttatttatttatttttttttgagatggagtctcactctgtttgttgccaggctggagtgcagtggcacgatctcggttcactgcatcctctgcctccgaggtccaagcgattctcctgtctcagcctctcgagtagctgggattacaggtacacaccagtatacccagctaatttttgtatttttagtagggacggggttttatcatgttggccaggatggtctcgattttctgaccttgtgatccacccgctttggcctcccaaagtgctgggattacaggcttgagccactgcgcccggccaaacaagtttttttatgtagagacagggtgtctattggtcaggctggaatggagtgatatgatcacagctcactgtagcctcgaactcctgggctcaagcagtcctcccacctcaccttcctgagtaggtaggactagagttgggaaccaccacacctggcttggtttcgggttttatagagacaaggtctccctgtgatgctcattctgatcttgaactcctggactcaagtgatcgtccttccttggtctcccaatgtgctgggattacggacatgagccaccatgcctggcaattaatttgattaagaaaaagtaaaccctatgcagaagagaacacttagcaaagttaagtcacctgcccaagaaccctcagctcccaagcagtggaatcacactttgaaccctgccattttctgtctgagcctttgttctgcctttaacatcacctccccatatggacgcaccgtcttgtctcttccatgttttcgtagtcttagttttctaccactgccagaagtaccacacatttggcaccttgaaataacaaatacatatgatctcacggttctataggtgagaaatctagttggctcatctggtttctacactgtgagtttttctcaacgctgatgtcaatggttggctgtatggactgataaggaggctctgggaagagtccattttcaaactccttcaggttgccagcaaaatttatttccttgcagctgtaaagctgaagtctccatttctttactggctggtagcagaagggcttctcttagatcctgggagctttttacgtccttttgtgaagtgtggactcttccaactcatagtcagcaatggtacgaatgcatctcatccttgaaatctcattgacttcttctgccatatgtacctcattgcagctggagaaagtcttgtgttttaaagtgcttttgtgattagatgggattttccccaataatccagagtcatctccgtatttttaggtgcatacttttgataacatctagaaaatcctatttgtcatgtcacgcatcgtattgacaggttctggggattaggacatgggtatcttggggaagtggggcataaatttgcctactgtacattgttaaacaccctcccatcctccagccatctttgactgttttagtcattctttcaatgtaaatgtacgtttctactctttcttgtttggaagctcttctctttaacatgattttgcatgtacttttgctgctaatttcttgactatacagggtaaactcccatgaaaatcatctcatttccctacatgcaggtccttagaaactgtgaggatggggtaaggctgctgccattgaagcctgcacgctcctgtgcgtttctgtagcccacctagtggacacctcagcattaggaagtatcaacatggacttgtaagaaccttcatgctgtctcctcaagcttgctagctggggcctcctagtacaacaggtgccgtgagaaacacgtgaaatggcaacagatttcagaaatggtagcaaaataaaaccagtataatgttgggcattgtgtctctcacccaacttagcattatctatattcagttgagagcaaacttggatccagttttcagccacagctactcctcttgccctttattgtttcatgtacaagttctcactgaaaaaaatatatatccacagcataatcagaatagttgttaccgaagaaaatgtaacaggatgatatttttggcgaattggctttaatgagttttgaatgaatagcttaaagtattagaaagtaaaattcaggccaggtgcggtggcttatacctgtaatcccagcactttgggagactgaggcaggtggatcacctgaggccaggagtttgagaccattctggccagtatgatgaaaccctgtctctactaaaaatacaaaaattagccaggcatggtggcgcatctgtaattccagacactcagaagtcagaggcagcagaatcgcttgaacctaggaagcaaaggttgcagtgatctgagatcataccactgcactccagcctgggtgacagggcaagactttgtctcaaaaaaaaagtagaattcagtgaacaagagtaaataattcaagaaattcaaggttgatagctataaaaatgaaattccctccctccctcccttcctccctcccttccttcctcctcccttcctccctccctcccttcctcctcccttcctccctccctcccttcctccctccctcccttcctccctccctcccttcctccctccctcccttcctcctccctcccttcctccctccctcccttcctcctcccttcctccctccctcccttcctccctccctcccttcctccctccctccctccctccctccctccctcccttcctccctccctcccttcctccctcccttcctccctccctccctccctcacttcctccctcccttcctccctccctcccttcctccctccctcccttcctccctccctccctccctcccttcctccctcccttcctccctccctcccttcctccctccctcccttcctccctcccttcctccctcccttcctccctccctcccttcctccctccctccctccctcccttcctccctccctccctccctcccttcctccctcccttcctccctccatccctccctccctcacttcctccctcccttccttcctctcttgctctttctctttctctcttcctttccctctttctctctgtccctctttcttttttcttcttgtctacttcctctccttcctctccttcctcttcttctctcttttctctctcactctctgtctcttccttctttctctttctttgtacatgtataatttgaagaccctgcgccaagcagtctcttggaattagaagcaccttaaaatgaaaaaaatgtctcgccactgtgacaaatccacaggccttgcaagaaaccctgcagatcactaacacacggccataggaatatattgactgcagcccaagcacaggagaagattaatcaatccaacagacttgcattaattgtgaaatggaagggatgatgcgatcaatgataggaatgaaagtgcagcagtaacgatgccacatccagctaatccaataatggagaagctgatgtatagcatattggaattctaccgtctgggcacttgtcaccataaagaatatcctagaattatagggaaaaattgagcaggcagcagttgagccaacctaatcagcctgataccacagtagttctcttgattaaacactaaattaagtggcattcagctctgtaacctgcttgccttgtgaaaaataatactagagctaacgtgaaaagtttgtattttaatcaaagcaaactacgaatattaaaatattcctgggctattttggtgccgtttagctgtgaacaagtttaataatttataaatggttcttttgccattggctacaaggaaaaagggtccaaagctatattgggaggtaaggcttcctgtgctaaaaatcaattagacttgatagaagctcagagaactcttaagaaaaaaaaaatgcactcaagaggccctgggagaattcaaatttagttaacttctataacggtttgcctaagggcatgaactctattctttgctgcaaagcacgtgatcattccaggaggggtgagacttaatcagctgtgaatactatgagggtcccttatacatatatgtcattattaagtcctgaagctcaaatacacagacaacctagagctaaatggcaaattctccaggaccaagagaaaactgcttttcatgaacatttagagaacactagagaaagaacttacattgtgagcatcaaacccagtctggttagactttctgtacagactcttacgctaggacacacactggtgagatcttggtgattattatatgcattggccagtgagacctcttagagttgaccgagtccgtgagcatccgaggggctagatctctggtggccagtgaaggagatgtgggttggaaaaggagggagagacactgatcacatctccccttttttttttgtttgtttgtttctttttttgagacagagtttttctctgtcacccaggctagagtgtggtggagtgatcttggatgacttaaaccaatggctctctggtaccgcctcctgggttcaagagattctcctgcctcagcctaccaagtagctgggattacacttgcatgccaccactgcccggctgatttttgtatttttagtagagacatggtttctccatgttggccaggctggtctcaaactcctggcctcaagtgatctacccatctctgcctctgcctccgcctcccaaagtgctgggattataggcatgagccactgctcccggcccacatctcttttcttgagcagaagatagtgtgctgataaagttctcccaccaaagtgagtcttagcagggccttgggcaagaggataaattaactacttaggctgttctttcctgttatattttgtttgttgtttgtttgtttttatttcaagtcaatttgtggccttgccttttaattgaaagcaaattcatttttttttttttcctgggtgggaaagggtcactgaaagaagagaggccatcaggctgtgtcttacatagttgaaaagtcaaaaactgcagacagatttggatttatttgatttcaataattagcagtcattcgtggagtcctcataccattccagggctggttctaagggcttttgcaacattaacttatgtaattcttttaatgattctgaggtcaagatgctatcatcattttcactttgcagaaggagaaactgaagcccagaaagcttaagcaatttgccaaggtcttaaagagtgcaagtgtggcagatggggattgaaaccaggcgggctgtttgttgctatgtgtttttaaaacaggttgggccttccaagttggatttttgtttgtttgtttttgttgtgtgtgtttgtttgtttttgttgtgcgtttgttttgttttgttttgtttgttttttgagacgaagtcttgctttgtcgcacaggctggagtgcagtggcatgatctcggctcactgcaagctccgcatcccgggttcacgccattatccagcctcagccttcaaagtacctgggactacaggtgcctgccaccatgctcggctaattttttgtatttttagtagagatgggagtttcaccatgttagtcaggatggtctcgatctcctgacctcgtgatccgcctgccttggccttccaaagtgctgggattacaggcgtgagccgccgcaccgtgccccaagttgtttttggacagtgatatcagtcatgagaaatgggaaggagtgggatgcctttggatgatgttagctcaagtggtattgcatgctcttccaccccatcttctgcacatttctctctggaaatacgcccttcattaatcctctgacattggctaagtagatcatgatgtggtgttctgatcaatgaggtctagtccagtcactgtaggtcaaatcagattatccagacctccaaaataataagtggactttaggtcagacgtatggagtcaccaatgagaaacagcttcagaatccatccagcaaagatctagaataatcataggatgagactatgatcactatcatttattgaccatcactgaatgctgggagctcttgcgggtgtttttgttcaacttgcttaactcataacatcagcaagatgaaagaaattttcccagttttaaagatacaggatctgaggctgacagaccaaatgtctggcaggtgagatctcataactactagtgacagacctgggactgaatcaggtctcttcaattccatcaccttttgtctatgaaagtactcatccttcaggtttctgaggccacatgggtgtgtcataggcaaggagccttcaatcatagatgacatggaaagtcgcatctgtctcatttcccaagccatgttaataactgcctggaacagacagtgagaaaaacaaggacattggaacaccttatttctggtttcctttctctcttgtacagtgtgatttttaaatgctgctaacaaaacattggaacagaattgtgctccagaaaaaaatgagatccaacagacctttctttattatgggacaattaattttaagctgactttatcagcaaagggaggccagagtgacttgctttgtaattgttgggaagctgtgcacactggattagaggagaagtaatgtttcctttcaagttttgacccattttaacaaactgatatcttagtgtgttcaggctgccataacaaaatgccgtagactgggtggcttgaacaagagctatttattttcccatagctggggaggctggaagttcaagatcagggtgccaagatggtcaggtcctggtggaggctctctttgtggttggcagatggccaccttctcaatgtgtcttcagtggcgtttcctcagtgtgtacaggtggagagagagagaaagcaagccctctctttctctccttttaagggcagtaatccccttatgaggatcttacttttatgatgttatcttctcaaaagtcccatctccaaatgtctttagactgagggttagggatttcacatacaaatttgtggtgtaatgctctgatactcattggctttgtgactgagattgagccatttagttctctaagcatcctttctttggtgaaaaaatgcttgtagtccctactcacataggactgctgaggtaattcaatgaagtaaggtatgctaggagcttaactcagtgttctgctcatgttatacgtgcaataaacataaaccagtccctctcacttgaaggaaaaattgcccactttctgacccagagaacatgtgacaatgtctggagacatgtttggttgctacgactgggaagaggatgctactcgcatctagcagatggagtgaaggcatgcctctaaatatcctgcattacacaggacagtccccaaagcaaagaattgtctgtatcaaaatgttagcagtgctgatgttgagaaactctggtataacctatcattgcaacacaactactaatgttatattacctggaatcagggaggagggaggatgccattaacaaattatataaagtctgttttttaagagagactgtttttctctgttgcccaggctggagtgcactggcacaatcactgctcactgcagcctcaaactcccaggctcaagcaatcctcttatcttagcctcccaaggaggtggaactacaggtgtgcaccaacatgcccagttaattttttaaaaacttgtagaaatggggtctcaccatgttacccaggtcattcttgagctcttgatctccaaaaatcttcctgcctcagcctcccaaagggctgggattacagatttgagccacggcgcttggctaaaatgctatatactctattccgtacgtcagtattctcactaaaagaaggaagagtaggtttcaaggaacttgaggatgaaatatgtaacagtattcactcagtatattaaaaataaatacacaatgtcattggaatggccgatttattgggacaggcaattgtgtatgcagaataaatgctcaaaaagaactgtccaaggtgctgaaactttgacaaatgaaaataacctgttcaaaatgatgtgtaaactgaaggttttgtttgtttttgaagtggagtctcgctctgtcgcccaggctggagtgtgcagtggcatgattttggctcactacaatgttagcctcctgggttcaagcaatcctcccacgtcagcctccctagtagccaggattacagtcatgcatcaccacgcctggcttttttttatttttatttttttgtttttattttattttatttttttttaaagtaggggtggggttttaccatgttggccaggctgatctcgaactcctgacctcaggtgatccactctcctcccacagtgctaggattacagtgataagcctcccaaagtgctagaattacaggagtgagacactgcaccccgtcttaaactgaattttaaaggggataactgtctttgcaaaaatacatttaaaaggttgggaaaatatattttggatttgattctcagtctttcaaggtaatgggaatggaatcttgagtgagagagagtggatgataaactagaagccaagttctttaccaggttgttttttcgagatggagtctcgctctgtcacccaggctggagtgcagtggcactgtctcggctcactgcaacctccgtctccaggattcaagcacttctcctgcattagcctcctgagtagctgagattacaggcatgtgccaccacacccggctaatttttttgtatttttactagaggcacttttgaacatattggccaggctggtctcaaactgctgacgttgtgatatacccgcctggacctcccaaagggctggaattacaggtgtgagccaccgtgcttagcttctttaccaggttctatgcttcctgaatgcagggattctgtttatctttttcttgcattatggaatagcataaacttggggtctgagacagagttaagggtcagttcatgttctctttttcctttcttcttagtcactctcagtagtctggatttgttgtggtgacagcagcagatgcatccagtggcattgtgaaggcattagtatcattataggcgctgaggctatgggtgagcatatggcctgggactgcaaatcagaaactgctcgcattcctgggattgttcttctagactatggagtagatctggagcttggcttcttagccttttctgggcatcagaaccacctcagagttggcaaaaacaaagaaacttgagccgtattatagacttatggaatctgaatcttctggagtataaggcactgagcaggaagttttgctcatcagtgttcagacagaggctggggagaggaaaaagtgtttttcccttcccaaatcaagcatcaattaattctcaggactgctttggatagaaggttgttcacattattctgagattttggcttatttaagagcctattagacaccatttgtggttcatctcctcttgtttaaaaggctcttttgagcaaacaagaagtatttgaaatttttttatgactagcggtctagttattcacatttctattatgttccattccattcccaataattcattttaataacattttctttttttttcttaaagattttttttttctgactaataacattttctgatttgggtagaaagaaatattattccacaataagcaattgtgaaatactaaatttacttggctttaattacatctatagaggtaagcaacgtgtttcagggaaatctaacttctctttgaagggtaaagacccagttaattcatcatttacccattatttggtgtgataggcaacaccagtagttattgctgtgtggtgatagggtttctttcttggaaagactacacttcctagtcactcattgcagttaagtgagaccataaggcttgttcttgccaatgaattgtaggcttagtaaagttcatcacttctgggacaaagcatggaagagtgagacaccaccagacatgaccatcccttgccgcggtgaatttgaagtcctttgttgagatcaggaaatcgccatcaacatgtatccccaagtaattatgtggaacgggacctgcctcatccccaagatctgtctcggacatgtggtagatccttctgccatactattcaaactgaagactgggagttaatatggtgtcatggtataaactagcctatagagttgagttttagaagaagcctttcggatactgaaaacaaggcactgaacttaaattctgcagactggatttaaatctgggctcatgtttctcacttgtttcgggacgtaacctaagtcactgaactgccgtgataacagacacagccacagtgtattcagcacacctatgtgccaagcattgcacacagcgttttgcatatatcatctcacgtaattcctccagccacacttccacttgggtagacacgcctcacttggtggatgtggaaacaggcgtgatacacgatgcaaaaccagaaagtggaaatgctgaacttgaagtcacatgtgactgatgcctattcccgtatttttcttttttctaaagtggagttgattaaactgtctacttcactgggccgttttaggatgctgtgagcagggtaggtgacaggacgtggttacccgccaggtgaggttattgtgatttggtttcggccagcacttgctgcagagaacttaagactgtttcttttctggctgtcacttgaccctgtgtaccaaccttgaaatccctcactggcattttggtaaatttgtttcatgtttttgtcccatcagtagtaaaggtttcaccattattttcatttcctggttgagcgaccctctttctttcatgacttttggcttcatccttcagcctctttctctttttttattgttccatgttgctgtgagcagaactcatttttcaaaagacagatggtggcaaccctgttctctctaaataaaaaagcaaaacagctgttaaggtgcaaacagagtcgcggccagcaaatcgtatctgcttcaagtgttggcgaagtttcccttcagggaatgggagctatctaaacaaaatgtgcagcctcggctgtgctctgccaaggcccaagtatagaatgatggcaaataatggaaatttatagtgtactatagatccagcacctttctatcttggcgggtgcatatttaaatgcagtgctaacggagctgaaatttatggctctctaataacgataaaatgccatcagagaatgagataaatcttggccccaaaccttagcatgcaacgcacacactgacgcgcgcacacatgcttgtaaaatatagccagatactgctaactcaggagtctgcgtttggaagaagccaacggaacagagaaagtagaggaagtgttttatagacgactgcaaattgttgttttcatgaggctggggtcaaggtacattgtggcctcaggttgaaatgagtgttgctttgtctcatggctgatacatgcttgaccttggtgagggaagcttttccttttctagatgttcaatagcttttctcttcacgttttcacaaccctgtgacaggccaacttccaaacaaacactgatgaattatcaccctctgggaaaagaacatcgtggtgtgcttaagcgttttcttctgtttgtttatttatttatttgtgcattcattcattcagagagaattggagtcttcgaggcttagcaacaacagagagatgaaagacatttaccaaaatgctatatttgcaaactgtcggcgacgtgtgaattaggtgtgccccctttctctacgggcagttgtggtcttcagggaatggaattttacaaaatatcatttaggaggttgtcattcacgtttgaaaacaggcgtggccagctcctccagccaacctgcatgtacacccagctgttttctctctgtggagcatctaggtcttaggaagggaagcccatctggaaatctgtcttaagcccttgctgaatttccacgagccgtgcattcgtggatcctgcaagttagtaactacctgaagaagggggcattctctactggcttgcattctaggtgtttcctccagcttctccttatgcaaggggacttctaatattttgggcgagatgtttagtttcagtgagaagcctaacctccgggagttgtttcaggccacctccattaagagttagatacttctttctagatgcttctttatgcataattgtgtgtgcgtgggtgttcatgaatattgtcttaattgctcctgtttttgaaatacaacgtctaatccagtctatcattgatggacatttggattggttccatgtctttgctattgtgattagtgccgcagtaaacatacatgtgcatgtgtccttatagcagcataatttataatcctttgggtatttacccagtaatgggatgactgggtcaaatgttatttctagttctagatccttgaggaattgccacactgtgttccacaacattaggagatatacctaatgtaaatgacatgttaatgggtgcagcacaccaacatggcacctgtatacacatgtaacaaacctgcacgttgtgcacatgtaccctataccttaaagtattaaaaaaaaaaaagaagaaatacaacgtctacagattaaaacccactctaggccaggtgcagtggctgacgactgtaatctcagcacattgggaggccaaagtgggaggatctcttgagctcaggagttcaagaccagcctgggcaacacagtgagacctcgtctctacaaaaaaattaaaaagcaataaataaataaataagcaaagaagaagcaaaaagaaagcgttcttgttcagaactgaaaaaaactgttcctggtttcctagtttttagaagtgtgtgtgtgtgagtgtgtgtatgtctgtgtgtgtatgtgtaaagactgagaggtaatgatactgattgagttgaaaataaccattcctttgtaatatttctaaaattttttaggacactaaattattttatataaaattatataatattaggtggtttggtgtgtttgccttgtttaggttttgttaggttggtgcttgagaaaaaaacaggtagatttggaaaatgctgatgtttaggatgaaaagggatccaatttttcatataaaatgaattctttggagtaagaccttttagctgagattcatggacttcatgaaagtatgtgtgtgtttgtgtgagtgggagagagagagtgggagagtgcattcatgctgttgtaggttttgctaagagattttgtactttttgttaagttgtcaaaagctctcttgtctgaacccctgagcccatggtcctctctctcctcttgtttgtgctgtggatttgcagttactttacagttcgaatgaatgatctgttctgtgaatacgtagtttcattttacagttagaatgatgtgatcagggctgtgattcctaggctaggccattactgggaaaggtgtgacttggaccagaaaaaaagtaaggaagtgaatctcatgctaaagagaacaagcttggtttcaaacactgcatgtttatgggctttgcccaccaggtttagcttgtacaaggaaatacccacgccccaattcccattaatcctgaacatatgattctctctagctgttccacacctcccaatctgtggtccagcaatactgacatttttgcgtgtgttccaactaaaccctgctctcttttacctcccagcctttccacattttgttctctccacctgaaactatattccctttcttctggctctctcttttttttttttttctctgatgaagtgctgctaccctcaggaaggcgtctgtagtgttttctagatcagcttaggtgaacctttcatgtcttcctgtagcctccccacttccattgtcaaggtatttactacaattgtcatgtctcaggccaggtgcggcgtacccggggactcttttatgccatctttatacctctgtgtaaatctaaaatattttcttttttttctttgtttctttgtttctttctttatttcctctttttttagacagaatcttgccctgttacccaggctggagtgcagaggcacagtcttggctcactgcaacctctgtccgccaggttcaagtgattctcctgcctcagcctacggagtagctgggattacaggctgccatgcccagctacttttttgtagttttagtagagatgaggtttcaccatgctggtgaggctggtcttgaactcctgatcttgtcatccacctgcctcaacctcccaaagtgctgggatttcaggcgtcagccaccgcgcccagccaatctaaaatattttcaaaatataatgtttatgaaaattaaataaaataaggaatctaggtcaatatctgtgttttatcaaagcaaccagaagatcagacatgtccacataaagagtgatgaacttgtattaacagaaaaggaaatgacattggacactgtctgtgtcatcacactgcagagggaagaggaagaggaggagggaaatgtccttccctctgagaaccatgagctcagtgaaatccctgcattcccacccacatccttaatgttcccagtatccaccaccctgaccggcttaagtgagcacttaagaatttttctcgaggccagtcttgaaggctcatgcctgtaatcccagaactttgcgatgctaagacaggcaaatcgcttgaggccaggagttctagaccagcatggccaacatggtgaaatcctgtctctacttaaaaatacaaaaattagttgggcatagtggcaggcatctgtaatcccagctactggggaggctgaggcaggagaatcggttgaacctgggaggcagaggctgcagtgagcccaggtcgtgctactgcactccagcatgagtgagagagcaagactctttttcaaaaaaattgttttttgttgaataaatgaataaacgaagcatcacaggacaagggaaacttgtctcttctcagttagttgctgagtaaattgttgtttcttatgtgttgcgtcggcccccacctcatttggttactacttgagtcctcttggtttcattttattttctctctctctctatatatatatatttactttttaatatttaaaaacatttttgaatattttagtatttatgttcttatatattttaaaatatttttatttttaaatttgttttatgtatgttttttatatatttgtatatatgttttatatatcagtattaatttttaatataatttatattgtatatattttatattaatattttatataaatattatattttataaaatttataaaattttataaaatttttatatttataaaatatattatattttataaaatatataaaagtaaaatattttattttttataaaatataatattttataaattatataaaaattttattaaaatttttatttccctcagcctatttgcacagactggattaagtgtccatcatagtatttaccaagctttttgcacataacaaaaatgaccctaaaaacaagagtaacagtttttatttattgagcatgtactatataccaggcatgcttgaaaagcctttatagatttatttctaattcttgaaggtagttggtattatcttcattctaaattgccagaaccttctttctctctctttctttctttcttttctttctttctttcttttctttctttctttattttcttttctttctttcttttctttctctctctctctccctccccttccccctccccttccccctccccctctccctccccttcccttccccctccccttcccctccccttccccctccccttccccctcccctttcctttcctttcctttccacagggtctcactgtgtcacccagattggagtgtggtggagcaatctccactcactgcaacctctgcctcctgggttataaatgatcctcccacctcagcctcctgagtagctgggactacagacacacccctaatttttgtattctttggtagagacgggatttcaccatgttggccaggttcgtcttgaactcaagacattaagtgatccacccacctcagcctcccaaagtgctgggattgcaggcatgaaccaccactgcacctggccgtgaaccccatattcttaaagatggtagagctgggattcgaagtcaggtctgcttaaacccagagcatatcttcatgccccacatttccctctgtctctctgagtttatggagttggttagaaatgtcgtatttctttttctttctttatactccagattccctgtgaggtcaggaactaggcctttttcatgataaccctagtgaagatcctaattttgaaaacttatctaatatttattgggaagctgttgtgagccaagcactgcagtaggctctggatatattaggcccatccccgtatagagctgacatgtagcagatgaaagcagaaaaagagaaaaaaaggtaagtaggcaaaatgaggaaaaacgaagtcttagtatgggccaaacagtttcctaatgtttggtatattagctcattttatccatgagacaagttctattcttattgacctgattttatatccaaggaagctgaggggcagagaatttgaacaactgcctccaatgttcacacagctagaatgctgcagaactagggcttgcaccccattgtctcactcttgagtcttcattctttatcactaaatagacacagccaggaaggaggcagaatgggcagtgaaatgcttttgcagaagttggcatttaatgtgaaggttgaaaaataagaaggaatgaccatttgaagtgtagagataagagaatcctatgcaaaaagcccagccagtgcaaaggcactgaggtaggagagagctgagtaaattcaaagaaaataaaacacatagtgggaggctgcagaaggagggaggtaatgaccattatgaaatgaatgggctgggcatggtagctcatgactataatcctatcactttgggaggccaaggcgggtggattgcctgaggtcaggagtccaagaccagaccgcatctctactaaaaatacaaaaagttagctgggagtggtggtgcatgcctgtaatcccagctacttgggaggctgagacaggagaattgcttgaacccaggaggcagaggttgcagtgagccgagatcatgtcattgaattctagcctggatgacagagtgagactccatctcaaaaaaaaaaagagagaaatgaatgatgggcttgagttgggtggagcacttgatgccagggctttaagaacagcctggccaacatggtgaaacttcgtctgtactaaaaaaaaaaaaaaaaaaaaaaaaaaaaaattagcttgccatagtggtacatgactataatttcagcactgggaaggccccagtataccttggaactcctctgcctaggttatctcccttgtcttaaatcagagatgggtgttacttactctacagtacacagaaacaggtatcacttatcaatccctgtgttcttttccacttagctcaaatacagcctcggcatccttctgaacactctggagtaggctgccatttttaatcacccagatgttaaatttattcatcatccctatatatatttcccacaggatcaaagtatatcgagtttggaaagggagttgaaaacaaggaagactccctgcttttgattcccatgagggcaatagctgtcactctcctaggggatgttttgataagacagccacttaggtttctatatcctcctgataaccgtatgttgaaaaaggatttaagaggaaggtcataaaaccagggatttcttaacagcagggtgtggcttggcttactaagaatatacttgtgatgcattttaatgacatgctttatgttatcatattaaagattgtaaaagcatctagtaatcatttaataaatattaatgaagcatttacaaattgcaccttaatttacagcattggcactcatatcgtgctctggacatgaatgcacagagacatggtggctttgacaaagactaccatggagagcctggttctgtgacattgtgccatcctggtaccataagtgattttttaaaataataattcttggagggcagttgagtgcaatgaagcttgatgcctaaagcagttttagcaattatttttctgtttggggaacattaaaacataatctaccatgaatttataatccatagcttctctctcatgcacttcttaataataagcagtagttataggcccttgtgcaaaaattctttgtagatgttaggagatacttcctcattgtgtaaacactggggcaggtaagggatatattgcaagcgataactgtggggtcgccactcccctgccaccatctttgtttgatgcttagggagatctcctgttctttgcaggcacttagatacgaatggaggagccccaggcacaaattcctcagcactctgtcctgctcttgttgctggacttgattgtctttcagacagtgcattcaatgttgagttcagagccattccctgcaattccctctggaccctgttggatgttaaccacgatggttctcacacggggctgggtgtcacgtggctcacagaaaactacagatggaagggccttagaagtcacctgctgcactcctcactttatagaggaggacactgaggcccagagaggaacaggacattcacaggccacacaccaggcaagaagcagagatgaaactgttacaggcaaggggctggatcccgaccccaagagagcgttctcagatctcccgcaagacaagagttgagggcgtgtctgtagagtgaagcgaaagtatgtttattaagaatgtagaggaataaaagaatgtccactccatagacagaacagccctgaaggctgctgcctgcccatttttatggttatttcttgatgatatgctaaacaaggggtgaattactcatgtctcccctttttagaccatatagggtaactctgtgatgttgccatggtgtttggaaactatcatggcgctcgtgagtatagcagtgaggacgaccagaggtccctctcagggccatctgggttttgatgggttttggctggcttctttactgcaaactgtttttatcagcaaggtccttatgacctgtattttgtgctgacctcctattttatcgtatgacttagaatgcctaaccttctgggaatgcatcctagtaggtctcagccttgttgtacccagcccctatggaagatggagttgctctggttcaaacacctctgacaaaaccggatcccaagacataagattgtgcagtgtgcatttgcatgcttctcagcctcagagctaaggagacctgggcatgtcctgggggggttttggatagaggggggcacctcttcatcaggggtgctggagaaggcctggcctggcctctggagcctgccgcactgccagtcaggacatcctagctgagcaggagccatgggcgtcccggggaatcctaggtactgagaggagatggccagcagatggcgctgcagggattcaaactggagcagccatatctgacagcaaccccaggtcagggattcaaagctccagcaaccaggatgagctgcttaatagtacaggcctggacttcagggatgcctagacccctctcgggagctcccacctggcctggaaagagagccaggtctagaatgggctggtgcaggtatctgtagactggtcatactgggtttgggatcagaccccagaccaagaaggaacaaagggaaaacaaaaggactagcgcagctgctgtgtccaggctggggtgcttgctatgtgggcaggactatggtcacaggccagggtggaaatggcagccagaaggcctccctctgcgtggggtctcccttaaacccaacttcttggggcctactctgaggacatcaagaccgtctcttctaggaaggcaagaggccaacacccatgaagctgctgtttttcctttcctgctcctgacttggaggcgtggagattgccaccaggccatgtttaatgtcttttaattaacggtttaactcgggtatccatgatgcaagggttttgcaaaggaattcaatctagttttcaaaattgcagaattaagtgggtaaagaacagttgagggcagcacttacatttctgaatatttagactctttttttcttcttctttcatttttttcacacttccaatctgcctcttttcttcttctctctgtttctatctctctcacacacatacacaatcacagctgcttcatacggcttctccccgtcccctctcctggcagctgtggcgtttctgcacagaggtgcagggaaggaggaaaggccttgggtcccctggtcaggatccagctgaaacaaccagaaatactgtccctgtacctctcaggtcgggtgacttactgtgcctctgaaccctctttcttccatacctcccctacccaattccgaggcctcaactttgtgctgccagagggcactatgccacctttaaatgagatttagaaaaagtttacacatggcacctgctgatctggacattccagtcggcttgctgtatctcctagttgcaagggagggctttgcttagagcagcctgtgccccgtagggtaataccggagctggcggcctcccaggaaggctgcaaagtgcttgggtgctttgccctctctgaagcatacatcagcacccctaaggtttagctgtgctgcagccacagcccacacactcctccattctccctgaacaataggacccttgctgagatagtctggtaggagaggggaggctctttcctgaacccgtctctcctaaacgctttctatgccttagagtgctaagaacagtctaccctccttacgagactgagtgtttcctgaaggcaggagctgtatcttattgaactctccagcgcacagaaaaaactcataaatatttgttcaactaataaacaagtaaatgaatagagaggatgaataatcttttagggtaagttaattacatctattttatttaaaatgcattatagaattttgtctctgtgccaggaactgcttaaagtattttttagatataatctcatagatgcctaacaaaaaccctgtaagttagacacccttaacatctccttttttcaggtggaataggagaggtacagattgggtaggtaacttgcccaaggtcaggcagagccaggattcaaactcaagcagtctggcttcagggcttttttttctaaatcactccctgtggtttctcttagtcttagaccaagactaatgtacttagaaatacccagccagggaacaagaatgcatagaatttaatcccccaagcccaactttcattattcagctttcaaaagacatggcagggaaggtttccagacagaagaggaatagtcagtttgtttttaattcaccagtaaaacaaatagacttctttccttttatatttgtaacatacagcttgcatttttttttattttaaacaagaaaaggaagaaataaatgagaaagaagggaaggaaggtggaggaggtgggagagagaaaggagagggaggagagggaaaccgggagaaaaaaagaagggagaagagaagggaggaagaaaagaagggaaaagagaaggaaggagggagagaaggggaaggaaaaggaaggaagaaacaagggtggaaggacgaaaggcaagaaggaagggaagaaggagaaggaaagaaaggaagccttatttaatctccagcacagaaagtgttcgcagccctgagaaacgtggtttctcatttgcctgttacttggcacagtttgactgcctagaagcctgcagaaatattggaagtcaaggtccaatataataattggcttacagatttgaagaaggatagatagactcttccatttccaagattcattagtccagctttctccgtaatagacagggcttgctctacgtgtaagccattttctaatcaaattggcacacagttcatgctctgacttggtataaatgggcttctgtgaaattgctctgcctgggctcagggctggagttagatgggatggattttatctctctgatgcttgatcatcttgggctctgcatggaggaaacctgtctctactaaaaatataaaattagctgggcgtggtggctcatgcctgtaatcccagctccttgggaggctgaggcaggagaatcgcttgaacccgggaggcggaggttgcagtgagctgaggttgaagcattgcactccaacctgggcaataagagtgaaactccctcacacacacacacacacacacacacaaaaaaaaaaaaaaaaaaaaaaaaaattgaaccacacatcattgtgacttctatttgtgaaatgttcccaaaggatatttgaaaatgtgaaccaactgtgaattattgcaggacttgatatgcacaggaaatgtaatagggacgtggaggttcgtaatgtgagtttggaaaccatggaacatccaaacattggcgatcaacaaagccagcagtatgtggacagcttatgagaaaaggtgtgggcatcgcttggatctgagtgggaatccaagctctgccactcagctatgtgttgctaggaaagtttgcaagcatctatgaaataatgaaagtttaaatgaccatagcagcaagcatgctgtttggaagaccaatctccagatgaacttaactaacggtttctagtaatgctaagcataaaacagaaaaaaaaaagctatatatatatatatatatatatatatatatatatacacacacacacacacacacacacacacacacacacacacatatacgtatatatatatgtgtatatatgtatatatatacacatatatatacgtatacgtgtatatatacacatatgtatacgtatacgtatatatatacacacatatatatacgtatacgtatatatatacacacatatatatacgtatacgtatatatatacacatatatatatacgtatatgtatatatatataaaatcaagaagagccagaagagattggaaagctctttggccctgatagaagaaagctgatgcgtcacacagaagaaacatgagtcttcagttcttcttttgctcttgtcttctctgtcaagaaaaatcatcttcagtcaggatggaatagagtttggtttaggtgacaaagtcagtgttggtgaagcagaatgaagagagtgctagctcttaagaaatctaatattttacctggactaatatctccaaacaggagagtaacttggacatgagatcattaagtatcattgacaatttgtggcaaaaagcagaagggtatgagatttgaaatgcggaaataggatattctaattttcaaaacagatgaaagaagctgggagactctataattatagggtggtagcatctcatggtgtaaccactattaatggttcacttgttcaatgattaaagtcccatgtgatctgatcttcacatgaatctggacattatgaaaagcatggcttgtggatttcttgaagatgaaagaatgataacttgattcttatgtccattcattgggaataatgaagacccagcaaatgccatttcttctcactagaatgggagatttggagaatggggtagacacatgatgtgtgaattccagcaagacagtcaacaaggacacacttttcggtcacgtgtgtgtgatccctttatgggaaaagtggaggatggtgggatagatagtcagaaaagtatgtgggaaagtaaaacattattacaaattggtgccaaaaattataatgagtagattggcccataaccctggtggttttaattgtagtgatgtcattgagctttgttctgagatatgtcctgatggcattttttctaaatggttggatcatgatagagaaggctgttcttcagtgacacagatgggatggagtggagtgcctctgtttaatggagtcaggactttcatacccattttacagatgaggaaatgaggcatatgaaatgtattcatttcctagcattgccataagttaacgccaactggatggctttaaaacaacagaagtttattcattcaaggttctggaggccacaagtctgaaatcaaaatgtcagcaaggccaagttccttctgaaggctctagggtagaatccttccttccttctcccaccttccagtggctccaggcgttccttggtttgtggccacatcactctagtctctgcctctgtcttcacatgctattgtctttgtttctctgtgtgttctttgctatttcgtatgtggacactccctttggatctaggacctactctaatctactatgattttctcttgatccttaccttatttacatctgtaaagactgtatttccaaataaggccacattctgaggttctgggtggacctgaatttgaagagacactattcaacccattatacaaagttatggggtctaattaaggccctcaaataagaggcaggtccaggacttgacttcatccgtgtctgactctaaaccacacattttttcttttgtcttaggggagataaggatagggaaatgaatccaatccttgtcatttgacaaagagtggaagggaatgtgggtatttatcttggaaataaaatgatcaagaaaggacatggggtgtgtggagcagaatgatcctgcagaaagaggacctttatgacctagttggtttgggatgggagatggtgtatgatgctgatgctgcttcttccaaggagggtagccagggttgtaagtaagactgtagactgggtggagaggaagcaactgcaggtatgctgcaggatagtggctacagctttgcatgtagagagtcagcaatgccttacagttaagaaaataaagctaagcttggctgcctggcctggaatcctgactcctctatttactcatgatgtcaactttggcaggttgtttaacctttgtgactacactgtagagataaaagcagtatcatggctgggtgctatggctcatacctgtaatctcagcactttgggaggccgaggcaggtggatcacttgaggtcaggatttcaagaccagcctggctaacatggtgaaaccccgtctctactaaaaatacaaaaattagctaggcatggtggcacatgcctgtagttctggctacttgggaggctgaggcaggagaatcacttgaacccgtaaggtggaggctgcagtgagccaagccaagatcatgccactgcactccagccgaggcaacagagtgagaccctgcctaaaaaaaaaagaaagaaaagaaaagaaaggcaatgtcaacgacatcgggcagatgtgatgaataattttgatgggattggcgagataatccagtactttataaatgctacctattgtgatttttaaaatactatactctgtgccctcaaacaacatcccgtgttttacccactgcagagaagatgcagatggcttgtgtctcatggggcctggctcacatgtaagccaacgtggtccttgctggcctgctggacacacagggagctccactaccttgccttctaactgatctctccctgatcagtataattacggaggccctgctttcttccagcagccaaattgttgggatggacttcctcgttatttgaagcatttgttactgaagttagtatggcctcctggctttgctcacatctgggaaagaaagtcgattctcctttgtatttagtggcttggaagctgccagcaactttcggatggccgtagtgtcccctcttgagaatcagagaatttcattattatttttaaaaatcttatcttggcggggtgcggtggcccacacctgtaatcccagttctttgggaggccaaggcgggcggatcgcttgaggtcaggagttcgagaccagactgaccaacatggtgaaaccccatctctactaaaaaaacaaaaacaaaaacaaaacaaaaaaatttagctgggtgtggtgggaggagcctgtagtcctagctacttgggaggctgaggcacaagaattgcttgaacccaggaggtggaggttgcagtgagctgagatcccagtgcactccaatctgggcaatagagcaagacttcatctcaaaaaacaaacaaataaataaataaataataaaaatcccatcttaattttttaaaggaaaaaaataaaacctatggtcatgagcaaattacagatcagctaaatcttatgtgggaacatctccccatctacagctatttctgtttgtttgtttgtttgtttgtttgttttgctagacgagtattttccctcctcaagctaattgcttgatggaattaaagacgataatctctaataattccagtgaacacatggttcattttcaggtagttttatcctcgaatttcacttgttattttgttgtcggtggcaaattttccttttaccctctatgagacacccccgccttgggtctacctgaactaaaaatgcgtttggtgtctccaggctcatggcatagccactctgggaaacttgtctaacttccagattctcaaatttctgcagctgagagcatgtctctcttttgggaaggaggcttttcctggctggtgggagaacagcttcaatttgggagacagtgtgagtcagcaggaataacgctaaatggctggaaatcagctcagcaaaaatagcaggagcacctactgtgtagagactgtccactagccctgtcttcagaaggcaagaaaggaatgccaactctctcctcttgggctgagtggggagatgagacagggcagggaagaaggaaagtgcagtaagcaggttctgatgacgaggcggtaaaggtgttgattttagggattatagggagaccacccgtgccttacctcctccttaaaagtccaaaaacaggacgggcacagtgggtcacgcctgtaatcctagaactttgggaggccgaggcgggcagatcacccgaggccaggagtttgagaccagcctggctgacatggtgaaaccccgtctctactaaaaatacaaaaattagccagatgtgatggcacatgcctgtaatcccagctacttgggaggctgaggcaggagattcgcttgatcccgggaggcggaggttgcagtgagccaagattgcgccactgcagtccagcctaggggatagagggagactcagtctcaaaaactgaaaacaatggtgaatgtgaacgtcctttaagaggacagagctgatcatcatgggtgatatgcttaggataactttaaagacacagaatggctccctgtggggcaacttaacagaaacaaaagcagatgaggaagggaggctgggatggggcttggttccctattgaacagtagaaagacattttgtccgggcgtggcgacttatgcctgtaatcccagcactttgggagcgtgagctggggaccagcctgagtaacatagcaaaacctcatctctactaaaaataaaacaaattagcccactagagtggcatctgcctgtgggcccagctactcaggaggctggggcaggaggattatttgagcctgggaagttcaagctgcagtgagctatgattgcactgctgcatttcaggctgggtgaccaagcaagaccctgtctaaaatgtctaaaataaaataataaaggcatttaattcaatacttagtgaatacttggatttctctccattgcggagatgaggtaggtatggcaggggatggggacgcggtggtgcaggtgtccatgccatggcttaagtgccatccctggagcaacaggacgttgtctgagtgattctcattgctggttctggattcaaatagcctgggtttgactcctggctctggtttttcctaacttggggcaccttgtttagcctctctccatctcagtgctctcatctgttcaaggggataatgataatgacagtatctactgggtaaggtccctgtaagaagtcactgtaggatgaaggcagaaagctagatcatgcctggtaatgaccaggttggtgctggaggagagggggctgaggttggagatcatcaatgcaccaggggtctcgggatgatgaagagagtcgctgccctctgcttcttcccccttcttccttgctgggctccagctggctgaaagtgtatgaccatctatctctagggcacttcagaaagatggatgggaagtgggaagaggggatgaggctgcctagagagccttgaaattttaacttctgtgaaatatccagagaagatccctggcaatgtttttgtgtctatctcattgaagacacatcagtgaggctagcagagggccctctttattggggagcagaacaggagacattcgcctttcagtgaggacacctcacatcagtgcccctgtagatttattgtgaattacctggggtttgggggaggggtctcagaaaatgcaatttctaattcacttggtctggggtggagtctaagatattgcattactttttttttttttcttttttcttttttttttttttttttgagatggagtcctgctctgttgcccaggctggagtgcagtggcgtgatctctgttcactgcaacctctgcctccccggttctatcgattctcattcctcagcctctgagtagctgggcctacaggtgcccaccaccatgcctggctaatttttgtatttttattagagacagggttttacattgttggccagggtggtctcaaacttgtggcctcaggtgatccacccgtcttggcctcccaaagtgctgggattacaggtgtgagccgctgcaccgggcctctgagacagtgcatttgtaatgagtttccaggtgatgccaacgctgttggtcctcagtctcactttgagtgttaagatcctgcaggatactccaagtgagaactgtacttgggattccgcaccctccccttcattcctcacccaggcttgcccatttgactgtggtgctggcccatttatcctagttaaagggttccacagttccctgtgattatccctcatgatacggatcacgttatacacttaaattaaataaaatgcaccctatcgaatgcactgcacacaaaaagaatatttatttgaatattaagtacagataagacttcccctgggattatttcagagcgcatttgcagaatttaattgcaatattttcccactcagtttctttctgaacgctacttgtgaaaatattttctttctgaaggtaaagctctgcgttgttggtttattattattattattttaaatctgaagagctctctgagctcggtcattacttccagtgtctaattaatcctgatgatgataaagtaaacagccaggtgacctagattttccttttaaattgctagcaattaacatgaatgcctgctcattgttgcagaacttttgggaatctagtccttccagttaggattccttaagttgggggttttaagagttcattttgtgtgaagcatatgtcttccagcactccttccattaagctttccaggaagaatgtgaacacagacacacacacacacacatatacagagcaacagtcaccaccaccacccagccaaccctttcagacaactgaactggaaaattagaaaatgaatactcctcaagtttctcaagctacagaatccttcccatttcttaaataatgacattttgtaaagtcatagaaatcagcaatagaaaagacctcttgtgtaaagatctcttcagatgcgaaagtcagaatagcatggaaagacagcctggggatgtccaccttgggtgccttctatccctatttccttgtctggagaattggtcccatgggacttagttcaccttgacatttttttttttttccatgacagccttgtagttgttacatgatttatttcttttgacattctctacaatgtgtagatgtggatttacagtgtcccatcctaaaactttcagaagcagtagccaatttttcacaatcttggttttctaccgctgtgttataggaaaggggtcccaatgcagatccccagatagggttcttggatctccctcaagaaagaattcagggcggccgggcgtggtggctcacgcttgtaatctcaatactttgggaggctgaggcaggcggattacaagggcaggagtttgagaccagcctgggtgtctgtactaaaattagaaaaattagctggatactgtggcggctgcccataatcccaactattcgggaggctgaggctggagaatcgcttgaaaccgtaaggcggaggttgcagtgaaccgaaatcgtgccactgcactccagcctcgtcgaaagagcaaaactccgtctcaaaaacaaacaaacaaacaaaaaaaacaaaaaacaaacaaagaaaaaaaaaaagaaagaattcagggaagtccatagagtaaagtgaaagcaagtttattaagaaagtaggggaataagaatggctagttcatagacagagtggatgaagggcagaggagcccctcatcagagtggatgatgagccccttggggctgcttgtttcccatttttatggttatttcttgatgacatgctaaacaaggagtagattattcatgcttcccctttttagatcatacagggtaacttcctgacgttgccatggcatttataaactgtcatggtgccagtgggagtgtggcagtgaggacaaccagaggtcaccttcgtcaccatcttggttttggtgggttttggctggcttctttactgcaaactgttctatcagcaaggtccttacgacctgtatcttgtcttgtgctgacctcctatcttatcctgtgacttagaatgccttagccatctgggaatgcagcccagtaggtcttagcctcttttttttttttttttttttttttttttgagatggagttttgctcttgttgcccaggctggagtgtgcaccggcacaatcttggctcaccataacctccacttcccaggttcaagagcttctcctgcctcagcctcccaagtagctgggattataggcatacaccaccatgccagaggtcttagcttcattttacccagcccctattcaagatggagttgctctggttcataaacctctgacaattgtgatgctgtctgctaaatatctaaggaaacagtgaggcacgtccagtccactgtcaacttatgaaaagaagaaatcacaacaacaacaacaaatggactactgaattcagtttactttcttgtagtgaaaaggcacgttatatagtgctttccgtgtgataggcactcttctaattgctttgcaaatattaactcattcaaatcatgtgatgaccctgtggggcacatgggtagacccaggcaaggaatttgttcaaggtctgtaagctaataaggagttgagttgagctttgaaccttggaagtctggctttcgattttgttctctgaaccactgcattttagatgcctctcaaatgtctctcagttaatatgatcaagatgactgcccagataaggccatggcctgtgtgtctctgctgaatctatttaattgggatgcagattataaaattatcaacttctgataaaattattattagagctctgtaatatccaatgagaaagaaaaaaaattacagttaaaacatcttaacttgaaaatgtcttgagaacatatattctatcccagtagagagattcaaatggtatgtaaatcccccacttgccctcccctccacactctttcccacctctggatgtagagagggggatgatgggaaaatcttcgctgagatgctcattctacacagagtttcctggctatagggtaacgatggtcccaggagaccggttcagggaagcatgccaagcccttttagttacccaggacattttggtgagtattgcttgaattttcttagactgagcaagggtttgggatgggatggggttgaaggagggcaattataacccttgatcatgagggaaagaaatggtgattgctttcgctgctgaaacaaatagaaatcatctttgtaataactgcaattgttttctccagccctcctctgccttggttcacaaaataccttattaaatctggagaataaaaatgtacctggggtaatggtttattattagaataaataataggcaatatgtttcttccaccctgcaaggtatcagatgccaagacatttcgtggtttagcttgtaaaggtgcttacatgtgtcagaccagccaggctcttcatggccaggggctgccctttcatttcaagaccagcatcaagcctgaagtgaacaactccacgagactgcattcttgcagaaagcagatgtgggaggccgaaggggatattggccacgtgctgcctggggctgccatgtcttgctcaatgtttgtctgtctgattaatctgtctggacctgggggacttcttttgttgataatggggtctttaccaagagggtgcatggcagagcaagtgtgaaaagcacttcctcccaagaaaacacctcattaaaacgtgtaatttgaggtttgttcaaattctgtgggcatcctgacctctgacatccctttaatcagataaccaacacttgaatctctccagtgacttatagccagagcagtgactctcttgatataagtaccattattaccaaacaatatgatgtttaaaggaatatcagaagtgctcactaaatgtgttgtcctgcctgggagatagcaccccataggtcattcgagtgctaagaatactaagtgttttgagattttaggatatgctccataaagtattcccgaggactcttagccataaattaaatatgttagagctttcagcatttgggtttattgtgcaagtttacgtataacaacaaatccattattattttttctacttagtacttagccttgacaagctctttcgtccgtctcccttgaccctccaaagctggcatcctttcaaaaccagacaagatttttacagcagataatggtcttccccaaggttaagaggaaaacatcgtgggagagctgggtgtgttctccaagctattttctcaagtgtattttgttcgtttatgcaacatgagacagaatcaagttcattaatcatggctgacttgagtcattgttgtgactttttgtttttacttttttaattgattatttctcacctcctttcctgaaacctaagcatttactagtgtaacacacttttgttcttccttgtgacaaaaagtaacaaccgccatgaccggtggtgggatctgtatttgcttatctgacataaactatcctgtcttcttagaatcagaggacacactttattgtgtgatacacttgcaagaagcagtgggtatgattacaaccatacgtcggattataggactgtattatgttcaaagatttcaggcctttataaactcaggtatctaataaacattacacatgagaccctagaagcagacgaggcaaagcgacctctctctttttattttctgtttgtacttttactttcctactgaagagaatccacacaaaaatacttatgtccctgcagaattggagcttttgttttgtttttcaagatagccaccctacatttactcttttggtgctatggggagttattttattattattattattatcattattattattattttgagacaaagtcttgctctgtcaccaggttggagtgcagtgacatgatctcagctcactgcaacctctgcctcccaggttcaagcaattctcctgcctcagcctcccgagtagctgggactacaggtgcccgccaccatgctagctagttttctgtatttttagtagagacggggtttcaccatgttggccaggatggtctcgatctcttgacctcatggtcctcctgcctcagcctcccaaagtgctgggattgcaggtgtgagccaccgtgcccggctgagttattttatagccaccattaatcacatacttactatgtgccaggccagatttggctttgatgctctacaaataacatctcatttaattattacaataaccatataactcaggcatttaaattatattattattgctgctcttagtatgaatttataaaactgatgcatgctcattgcaataagttgaagtgatataacagaatccaagattaaaaatgagaaaacctgcttctctgtcccttcttctccactattggtctggttcccaggacatcatttttctgcttttgtctgaagtttgttgtttatcattccagacttttttccaggtataaatggatatttttctgtgtgtgtaccttgtgtgtgtgcatagttttttatacacaaatggattataggttaaaaatgattttaacttgcttttgttttattttgtcatagacatcattcctgaaatcattcattttctaatggattcataatattccgtagtataggtcaaagtttggcaaattgtggccatgggccaaagacagctcactgcgtgattctgtaaataaagttttttttttgttttgtttttttgtttttttgtttttttgctggggggggaaggagtcttgctctgtcccccaggctggagtgcaatgatgcaatctctgctcattgcaacgtccacctcctgggttcaagcgattctcctgcctcagccccctgagtagctgggattacaggcaagtgccaacacgcccagctaatttttttttttttttttttttttttgtatttttagtaaatacggggtttcaccatgttggtcaggctggtgtcgaacatctgacctcatgatccacccgccttgtcctcccaaagtgctgggattacaggtgtgagccaccacatccaaccctgtaaataaaattttattggaacacagtggcacccatttgtttacacgttgtcagtggctgcttttccaccataatgggagaaccgagtagctgcaacaaagacaagagagtctgtggctctcaaagggcaatgcatttcctatttggctcttaggagaaaaagtttttcaattcctaatgtagatgaaccacaattcttttaaccatttcattacttgtggacattggcattcttctcagttctgggtctgttctgtgacaagcgctgtccttacttcctcattcgccgttgcactctggtaaagtgattcctagaatactaaccattgaattaaaggaaatggaagttctacatagtgataactgccagctgccccctcgaaacagtcagtaccaatttaccacccttcttaaaaagataatatcaaacctttcgaaaggaatctgatgctacaaaagtgtcattaatttagccaaattcacaaggcctcttggggaacaaagccaggatttggacccaagtcatttgacccagtgcttcttgtgaaaacctcctgtgtcattaatttgaataccaattgctggtatttgctgaatttttaaatgtgttaagtgctttgcttagtaattcttatagattatgctcacaataaaattagacactttgcaggtaccatattatctctatggtacaaatggggaaattgcctgcagagattatataatatggctaacgttacttaggagatgttcaaggactggacttccttagtctgattccttaacctccagtctccattggggagaaaactggatctacagaagggcccagtgctttgatatcagagaaatctaatttggtggaaattatactggttcttacctcaataagccaagtttggaaatttatgtgttttatggaactagacaacactagctagtcggtgcatgtcttgttttagagaaacacaagtgtgtaaacagcatcttgtcagggcacagtagctaatgagcacctgctaaggacaagtgaggcgcagattggggaggagggctaacagtgtaggtatccatggttttgtttggtttacctgaccctggaaactgtgtacaatggtgattcagagaggaaacctagtcaacccatccagatggtaattccctcttgaatatttcctatctttacggttttaggaattcactcactctgtgcctcagtttttccacctgtaaaatggagctaaaatcaaatcagctaatgaaatcaattgtcagctgcttacaaagttctgagaattaactaagcttataactaggaactgtttagcacattttatgacatattacaaacattggatacattttaacgaatgttagtgtgcaatttatttcagcaaaaagtgattaaggccaggtgcagtggcttgcgcctgtaatgccagcagtttgggaggcccaggcgggcggatcatttgaggtcaggagttcaagaccagcctggccaacatggcaaaactccatctctgctacaaatgcaaaaattagccgggtgtggtggcgctcacctggaatcccaggtactcgggaggctgaggcaggagaatcacttgaacctgggaggtggaggtttcagtgagctgagattgcgccactgcactccagcctgggtgacagaggaagactttgtttcaaaaataaataaataaataaagtgattaaaacaattactttcctagcagcatagttaaaattgagcaaaacctaaatattttgcaatcccaaagttccttcgcttccatcctccaccccccacaatctccctgactttatcctgcttttgactgtgccattcacggtatcttgtttctgtatccttggggaggtcctcccgcccaactcctatttactcagtaagggttagatcaagggtctcagctccagaaacaactgactgatgtctcctccactgcttcccgtccttcagcaggctgggttggtgcatctcctttgagcacccctggaaccctgttttttcttttctatcacatacgaccctgtatcatcatcattattttattcatcactcctcccctgtcttttttaaataaaatgtacaatgtgtcatttagatacacaccccctttcattagcacagcgctaggcagttagtaccctgagtacatatgtcaaatgtgtatcatagtcctgaaatgcatcaaggaaaacgcaaactccagggctcaccctaggtacttggagacgtgcgtttataggaaaatgccatcttgtttcagaagagtttataatgattacaaaaacagcaacgctgagaaataaagctaccaattgatttgatatattgagttctatgctggtaaacttgtccagtgttttccttctaagtgattcataattgtcctgaaaactggattttccaacattctattattgtggacatgaaaacatgaacatctatttatccattcatttattgtgtgtcttctgtttctttggactcctactttccccagttcaagttaatctctcaccagttccctcttgcacttgactcttgtgtcatattcaattactgcacttccataatctcactgagctttccacacatcctcctgcctttcctctgaatatatttttttcattctttacctggatacattgtctaaaagacaaaacaaaaacaaacaaaatacactaatacctttttcaattctccaagacaagttgggccacctcctatgcactgcaagcacctcttacactttcactgtacaaatgttctctgtattgtaattatccatagactcatctttttccccacctagacaatagctccagtagccttctttgctgttgtattcctggcacttaggacagtgtctgacatccagaaggtgcttgagatatgtgtatgtatatgtgcatgtgtgggtatgggtgtgtatgtgtgtgagtaaatatatatgaaaggatggatgagtaaacaagtggattccaaacatcgtactcatctctagaaaaggaaagccacctaaggctcagttctagttcttgcagagccagtctgatgtgtgggagagaaaaatcagactgaaaacagggtcagaataaagcaggaagaactgataagagagaactcaaagtcaggagaaggatgaaaaaggctgagtgagaaagcgtctttggccctgttggctaaatgaagataggagacggggaagatgaatccctgctattaaacatctcgttcaaccgggagagcaaagggtctcatgctgaagtttattgcttcagtttctaacctttcataagtgcttacttggcagccctttcaagagtggtatttgattctggaagcatcttaaaggaacagcgcccgaccttccactttactttttttcatttaggccataaaatatattggttttgtgcattactgccatgggagaaaaaaaatatcacatgttagtttccaaatgaaatgacatttgataaagtgtacatttaagatatttttcaaggctagcttttaaagaatgcacaggcagggtctttcttcatcacagactgtagggagttacaggtgcctttttttccacctcccctctccccacccggagcctctcccataatggttatggagaaaattttttaagagcctcattagttgcagcaataacttactgagtcttccaagaatcattacaccctgtttggggtgctgtttgatgagcaaggttgcagccgaaacacacaactcatgatgggattctgccgttttgtgcaatggacagctctttcttcacggaagatgtgaggaaagcatggatctgcattcgatgatccctacttaaaggaggggaggtcactggccacctaactcatgagatgtgtatgtcactggattgactcaaattggccagggactcccacttccaaacaaaggggttggcagtaggtggagtatggtggtggtggtggcaaccagtttactaataatttatgaaatggaacaggtgcatgacccaaaaaaagaagcaggatattgtcactagaatataagcaaaataatatgggatgctgtgcagggaaaaataaacacaacaaaaacaaacatgtctactatagagattacttgaaatatcctttttcttattcccaaatctcattttccttatttggcttcatttgaaggacagcatggctatttccttggctactgttggattttgcattgtctgcaataggaatatgataatgtggtgccacttcacatggcacaagtcagaggtcagtaggccccctggttccttcagtgtcgtcattgtgcttttgtgagtctggcaaatccttgtgatatttgaaggcagatgttaaaaatattaatcttgttatatactttttttttttcaatagagcgagacattgtctcgctttgttgcccaggctggagtgcagtggcttgatcttcattcactgcctacctctgccacccaggttcaagcagttctcttgcctcagcctcctgagtagctgggactacaggcgcattccaccacgtgtggctaatttttttgtatttttagtagagacagagttttaccatgttggccaggttcttctggaactcctgacctcagatgatctgcccacctcggcctcccaaagtgctgggattacaggtgtgagccaccatgcccggccaagataaactttttattaattaacgaaaatcaatgctatcactattactatacatttttaaaaacacttgtatttctgcaaggtactgatattaaaatacttgctgattataaatgccctgtatgtcacaaaggatagtttgaaaactacagaaagcattaagaaggaagcattgccctcagtctttaattgcatcagccatttagtttatattttacatgtagacaggtgttccattttgacttaatttttgtataaagtgtgaggtttaggtaaaggggtgtgtgtgtgtgtgtgtgtgtgtgtgtgtacacatccagttactctatcattatttgttctggatgtttcacttttttcggttttcttaaaggttgtgttatagggattatcacacacatatttctctcagtctacaagactcagtattttgcctctttagttggaatgcagaaaccttatcacccatgttaattagcttgacttcggtgattgtttttacaatttatacatacattaaaatatcaagttcaatacgttaaatatatgtaatttttattttttaattgtgcctcaataaagatgggagataataaagtttatcaccacgtatgcctctttgtttctgtagtctttgtgttttatctttttttttttttttttttttttggagttggggagtacagagtctcagtctgtgtgcaatggcatgatctcggctcactgcaacctccgtctcctgggttcaaacgattctcctgcctcagcctcccaaatagctgggattacaagcacgcgccatcatgcccagctaatttttgtatttttaatagagacggggttttgctgtgttgaccagactggtcttgaactcctaacctcaggtgatctgcgagcctcggtctttcaaagttctggaattacaggcgtgagcccctgcgcctggcctatattttgtttaacttccgtattgtatatccataaattaaaaagctcttcatgcacttccctcccccccagttttttgctttaagccattaaacatattttaatgaactcaagagtatagaaagctcttcatgcaatttcctttttttttttttttgctttaagccattaaacatattttaatgaactcaagagtccagtcacctattaacatttactcatatgtttaccatttccatttccagctcttcctttcttgttgtttgaagtttccttcaggtatcctatttcctttatctggaaaacttcctatagcgattattttagggcaggtctgtctgcagtgaattttcttagttactttcatatttcaccttcatttctaaaggatattttcattggatgtagtattctcagttgacaattattttttcagtatttcaataactgtgtgttattttctgctgacctctctggatttttgtttgtttagtttggattttgttttaaatccatagttctttgaattgttgggcccttacaagcattgcattgtttgtctctggttgttttcagtgttttaattttaggctttaccaatatgactgtgatatatgtggttgtggatttcgttgattttaactcttttagttccttgaaattgtttatatcttttgtcaaatgtaggaagttttcagccattatttcttaatttttttttttgcagtgaactctttatccttatattctagaatttcagtaacatgaaatattgtacgttttgatatttgttccacaggtcctgcatttctttttttttttttttttttttttttttttgtcttcaatttttttttcccctatgttgtttagaatggatactttttatgtactcaagtttacttctttttcttctgttgtcttcattctgtgtttggacaccttcagtgagattttattttattccgttttaattaattaattattttttttgagacgtctcactcttgtcacccaggctggagtgcagtggtgcagtctttactcactgcaacctccccctgccgggttcaagcgattctcctgtctcagccgtctgagtagctgggaataaaggtgcctgccacaacgcctggctaatttttgtatttttagtagagaaggggtttcaccatgttggccaggctggtctcaaattcctgacctcaggtgatccgacccgcttggcttcccaaaattctgggattacaggtgtgagccaccgtgcccagcccaatattttatttttatttttttaaaaaaatttagttatttttatggttgtaaaatttccttttgatttttttgttttgttttgtttgtttgtttgttttcgatggagtcttgctctgtctcccaggctagagtgcagtggcacaatcttggctcactgcaacctctgcctcccaggttcaagcaattttcctgcctcagcctccctagtagctgggactacagtcgcgtgtcgccacacccagctaattttttgtatttttagtagagacagggtttcatcgtattagccaggatggtctcgatctcctgacctcatgatccacccgcctcagccttccaaagtgctgggattacaggcgtgagccaccgcgcccagctccttttggttctttattatcttttgtttctttgctaatgctgtcaatttttttctcagttattttcagtgtgttttttcttaccgtttggagtcgttttataacagctgctttaaagtttttatttgataattccaacatctttgctatgttgatgttggtgtctgtgaatgtcttttcccatgcaaatttagattttcttggttcctagtatgctaagtcattttggtttgtattctgggtatattgaatattgtgttaggagactctaggtcttgtttaaaatcccatggaagttgttgatatttttgttttaataagcaatcaatcttgttgcattcaggctgaaagctcttgcttttcttctgtggatttgtttccaatatcagttctgttgggtgtctcccatatatatatcaagtctgggacatgggcagtagtctattccttagttcaattctcaaagcttatggaaacattttagggtcagatacagacatgagcacagaggtcagtgcaggagtttataaaaatactgtttgggggtgattttcccaaattattttctctccgggatcctcaaagtaatatttgttttctagggttccctgtttgttgtcctccacccagaaagctggtggttttttgtttgtttttaatttttctgttcacctgcttctcatctgagtctgcatttagggcaaagtgtcaagagaagagaggaaataaagaaaagcaatgggaggtgggagttgtttgcccaacctcttgagaccacagtcctagatgttaagtgtctgcagccacccctgttgccactgttgtttatacatgaacactaccctgagattgcctggagactgcagcataagaggacacacaaacttttaaaaagaaagaacagtaataaaaaaaaaagaacaatggggattttccctattctcttagtgttaagactcatctgtcttgtttttcaagacaaaaccagagtgcttctcctgagtctttatatggctgggtgtctgattttcagcccttggctaccttgcacccacactaaggggtattggtggtgggaggtggtaattcaccacttatgtggcggtactttaaattttggtcgttttgttcccccctccacttgctgctttttaattttcagagatctcaaatagctcccccatgcattctatacagatttccttgctgcattcagtgggggaaacaggatgaagtgttttcgctccatcttgtcaagaaccgaaacctcaccacccacttcatttattttgtgttaaaatacacataaaataaaatttaccttttttatcattttaaagtatacattttactggcatttaagtacattcacaatgttgtgcaaatatccagtttgagaacattttattcaccccaaatagaaacctcatacccattaagcagtcactcctccttttccattaacccagtcctctggcaacatttaatttgttctctgtctcaatgaattttccctacttcatcttttaacagtttatggagacataatttacataatataaagtcacctatttcaggtgtataattcaatgtgggctttttttttttggatatttatagaattgtaccagtttcttttttaattttttggaatatttctcccagtcttttcctctttagcttctttttttttcctttatttttatctttttttttttttcttttgagatggagtttcactcttgttgcccaggatggagtataatggtgggaactcagctcactgcaacctctgcctcccaggttcaagtgattctcctgcttcagccaactgagtagctgggattacagatgcccaccaccatgcccagctaatttttgtatttttagtagagaagaggtttcaccatattggccaggtttgtctcgaattcctgacctcacatgatccacccgccttggcctcccaaagtgctgggattacaggcatgagcaaccgtgcctggccttccttcattttctttaatgatctgtttcactgtatttttaacccaagataggaaccataatattgtatatttctgtggtttcttttcttaacaactaaatggtgtcttttgaacatttttcatatctctatatttaaaactatgtttctaaatggtacatgttatgccatactatcagtatactatattttttaatttttccattatcacacataatgtttataatttcttttttcatacataatgttgttgttaattgacatggaaataaacatttgtgtgcctctgcatatttttttaagagctaatcttagtggtaatatttctgggtaaaagggcatagaaaagcactgatttatagatttggggctctggtgcatccttaagtaaatattcttccttttttgtttttagagaaagtcaaaacaaactttgtatacaaaatgcgtaaaatatacatcaaaagttggttcctaaaccttcatatcccttagtaaaagtttcaaaaacttacagtatattgtctggtcctggaagtcgggagttgtttcactggttaaaaaaaaatactggaaagatatagaataaaggtgaatgaagacctaaattttatttcagcttaactattttagttgacagtggagtctaccagctcctgatgacagaatgaccatatatctcaaaattccttctatgtgttcctttttatttgtgtccttagcataatcatgtaatacgactccacccatccccttaacccacctatgttttcttgtttggataataaattatatggccactccaaagaagcgtccttggacattaagtaaaacatgtcagtagggcaaagataattaatgcatggcatatgtattgctaatacccactttcctatctgatggccgataccagaaacctatcaggatctctttctgtgattgaaggattggcttcacaattctccccagcacaatcctatggggacttactaccatctgattagaactggaccataaaatgtaacccagttgccaaggcatgacaactgacactactggccctaaacattggagaagactttgtgtgttttccactgacttatcatgaccatctggagtgggcctttatggaggaattcttgcacctgtgatatagggcaagctggggttttcagggaaaagggtggggagtttcatgacaagaggggaggtgccctcatcccaggcagatgctgcctcccacacatactcctgcacgtctctcctcttcccctttccagtctctgacttatcctagctgtgcttctgaatcacacaattgaactccaagtgaagcttgagctatgtagacctaaagaaaaattaaatacataattaattaattatgggttttctttgagctgagtaattaaaagtaactttctgttttctttcatgtttttctgatccggagccttctgacttttccccttcattttcttttctttctaggtttcaagacaacagatgaattgtgaaagagagcagctaagggtaggtgcacctgcttgtaaaatgcttcctgattctcatttttgtgtgataagcaaaaatttccttgtctctcccaagacacgggttctaaataacaggcttcatcttaagactggtagagttgaaaatatttatcccagcttatttagtattgattgagctgttaaatacagtatatcttctttggaagtgccgttatagtagatatggattttttgatttagattcagcaataaatacttttcttctggaatttgtttgacatcattgtactctttttatgtacaacacgaggtctaagtaataacaaaggtcaaaaggatggctggctgccttcttaatatgaataccaggctgtttgctgagtggctaaaatgctctttggctgttgactggggtgggtgagcaaggaatatgtcaagggcgttttctgggagaatttgtgttatctatagacctcttggttttagtgacatttgtgtatatgggagagggagacaaaattttaaaccttatattctgtttccccacttaaaaatgaaactgtcttggtgctcaggcatatcggtgtaagaagtattccctagatgtgcagggagtgtttggttataaatggagcttggtgacattgttctgctttcattgtgtcagagtggacattcttcttggtatggggatggcattttaagaaactttgggatttcttcccatttgttttcttctaaatgaattcgtgttttcagtggatgagatttagattatgattggtgtatttttcatgtcactaatggaagttggcagtttttactggacaatgtgccttatagccatgttttcaaattgttataaaaatcagagaaatatgctgcttttaaaaccacaacagtgggatttggcgttaggaaactcctgtgcccaaaggtgtctaataaataagcataatgtatttaacaggcctaatgccttcatacactgccctgtaacttttcagagcatttacctaatgatagtctcatgatggcaataatttgtagagttgcttccatttcacagttgctgttggcatcaggtttgtgaagtacttgggtaaaataaacaacagaatccaggtgcatgaaaccgagaaagtgagacaaggttttctgtttcttttatgcatatttgttttatgcagtatctcagtatggccctctctacccactttcctccaagtacctgtgccgacattcgttgtgaccctttccttcatggaacagacttcaagatttttaagcttttctgaactgtcttactgcttttttcctgtagtctgaattactggttcatcctgttaaataatgtattacaactttagatttctcttgctgtttggatggggacgatggtcagaactaggtcagagctagataaagagaaatatgtgcctttgtctccaggagtccctgataaatgcctgagaattaagataatattgaaatctctattgcaaatgacacttgcttggcaagttaaggacgcagtaggtaatgaaggacctgtttgcattttgagggattatttcccatttatgagtccattgtcgacaggagtgtggtttaggttcaagaatggagtcttcccctctctgttacataaatgcagggagtggcttgatattaacataatggttcatttagtttagtcccaagtatggctccaatagccccatctctaacatcacgaaccagtgctttgtttgttgttacttttatggtcactgttcttgctttttaaatgaatttatgttttgaattgatagatggcacatttgattggatagagcacacatatatagggttcaaaatttaaatagtaccaaagagagtgcaatggagttttcccttcccacgtgacttaggcgtctagttccctctgggagacccctagtgtgattaagtactggtagctatctcatctgtagatattttcttctgccctcttcatttttgttctctgtctttccatctctttcttcttcctttcctccctccctcttttcctttcacacctgtgtctgtaagagcccttccatcacctcaaaagaaaacttcccttattaaggtgattttttttttcggggggggggggcggggagcttttttttttttttttttttttttttagagagagtctctttctttcatcatgctggagtgccgtggcgcaatctcagttcaccgcaacctctgactccctggtttaagcaattctcgtgcctcagcctccagagtcgctgggattacaggcacgcgccaccacgcccagctaattttttttgtacttttagcagagatggggtttcaccatgttggccaggatggtctcgatctcctgacctcgtgatccgccagcctcggccccccaaggtgatgggattacaggtgtgagccactgcgccaaacctgggtgggggggcattttttaagggtttctgaaaggaatttagaactggaaggtaaatacctgtccatctcaatgaaatgcattttcctcaatctcattttgctttcttagaaagagagtggaagaaaattagaaatctgtttagttaccacatcgttgaagggtaactgtctgcaagccacaataaaaatgtgtcctaagtgcagcagtcaaaatgcatttccagatttgctatccaggatgactggactgtggccgtgttatcatgtcgagggtccttcattagtgcattctgttgtcagaattcagggatataagtggatagttgtcaaatttattccttttccttggcctcctggaaatagcagatgatttagaaagataaagctgcgctttctgttttgtgccccatcgaggctgtgtaggaattggcgtatccaatacttggtgttaggatctcctttctttttctcacgaagcctaaattaatttttccaaaacagacactgtgaagtgcttaatatcttgaagatattaaggagtctttaaaatgatcatatgattaattttaggaaataccatgttaaaaaaagctaaacagtttttattttttaactgcaggtcttctcatagcctttaatttgcaaaaatgaaatacaaagagttggatataatatacaacgtttttctaactcagctgactacgcaacacttttgtttatagaacatactcttgagatcatatcagtattatcagttaagatgctattatctgtgagttatagacaagctaagagttatggaaaagctaagagttatttacaaaaataaataactctccacctcccagttccagggttgattcagaggctttttggtatcagggcagtggtttgcaatccctgtgcttccgttggcctttctttccttcttccaagatgtctgccatctaccccatatcacgttctcacagggcagcactctcatcagaaggaaggagaagaggagtttctccttcacacgtcttgcattttactgcaggaaaataattcccagaattcgtcactgcagtcgttttcttagatgtcattggccaatctctacatcaatcactggcaaggtgaactggaatctcagcgattggctacagcagttatgattcatttgcagcatcaggcacattgttacctgcacaaaagtaggatttacttaaactggaggaagcagaaaatgcactccagtgttgttacccaatggagtctgctacaaaaggaattcacaggggtccactctgtttgtcagggtgctggtttcctgtcattagttttcattactctctttcatcctacatgtgtgggctcagcaactttgtgaattctggtttgtggaatttgacacagatgatttctctgccaacattgaatctcacaggtcacatcttccatcctaacctatatcctaacttttctacccatcttggcattgtctttgtattttgccttgtgtaatttggactgcactggatatagtctttggtcatatcccctcagcattaggtgtgggcagcaggcatggggcatcgtgcattagtaaccagctcagcccacagatgctgtccatgagcttcctgtcccctacccttccccaaagaagggcatcagccagttactcccaacagtagggtcactcttctcagagaactattgggattacttacatcgctcggttgttacgcacactacacaacagggaaacttgttcattcctccgtcccaaggtttgtcaatctagagtagactgagtgttcttctgagcttgcaattcacattattggctggattcttctggggacatggtcagaggagctcactatggaatctgtgcattaaccactcctgatcctataggctgtatttaccagcttgttctagcatcagcacaggttatggtgatagtcgtacagtgaccatatccaattatcaacatttacctctccagcatctgcaccaacagatggacaaataaacaactaagagagaaataaaatgatcctgggggcctgttgtttccctgaactatctaccagttgagggagattgtatgttcatagggtgggagattccaaagcccacctttctgagcactcataaaatatttgattacaaagggatctttgtgcttgagtggtagatgttggtttgggggctgattaacgagcttagttagaaaactactaggtagccaaatgcatgactgccagattctgttctgtggattcaaatactgatctgcaatatggcaatgtgactctatagtcagcatactaggaagggtggttagggctggtgaagcactggtatggacttaggttcagatcccacttctaaatgctccttagtgtctcaaagctttactttacctatacgtaaaataagaatagctttctcataggattggtgactggataaaacaacttcgttaaagcactgaaaaaaaaaaaaaatgcaggcctgatactcaacaaggtgagctactgttaatacagtgttattcccaataattatttcacttctcttcctcctagaaataccaggcatgagaatacagagaacacatatctactgccaccaaactccccacaaggaaagacaacataaagggcaggctctgtatttgatttcatggtgaagtatttaggagataactccctctcagttaaggttgtttggaatgcaaacaatagagacagattccagctatcttaagcagaaaaggcatgcaaccaggcctcccaggaatcagagcttagaatgggaaagctgcctgaactcaacgtatgtcttgctcatctcctgtctttgtttctgtttatgggtccactctggatttttcttttgataaagactccctctacctttatgcacacatcacaccttctagcccctaagatgtatgttgcatcgctttccaccggtatagggactaaccatcagtgcatcctcgttacaaattcctggaaaaggagcctgattggcttagtctggatcagttgttcactctgggccagttggatctgtccagggaagtggtatgaagcaacacagttgcccagggccaactcttgagggaagacttcattactggggaaaaggagccattgctagctgagtaaataacaccatagatgccgggtgcagtgactcacacctgtcatcccagcactttgggaggccaaggtgggtggatcacctgagatcaggagttggagactagcctagccaacatggtgaaaccccgtctctgctaaaaatacaaaaattagccaggcatggtggcgggcgcctgtagtcccagctactccggaggctgaggcaggagaattgcttgaccccgggaggtggaggttgcagtgagcagagatcatgccactgcactccagtctggtcgacagagggagactgtggggaaaaaaaaaaaaaaaacacgaaaaccaccagatatagatctctgctatgctttcaaaatgtggatatcagctgaacaaaggatcctggaaaatacatgtgctaccaccaactgctagctctgtatttctcaaaatataggacacctaccgcacgtcttactcacagctttcaggcgaacactaactcattaagaaagggggaatcacttagaaagttactcccctttccattgtctctctgtggtttttatgccaatcagaaatgctcagtttaaactaaagtatctttagcagggctgtaacactttctaagctttcttttttaagggaaagggagtgtgcctcaggatgagagcctccagccccagagcatctctttgcactttgaaaacattgtttgcaaaatacactattaagaatcaggggcctggagctacgcctactgagataaaatctagactttgcaacttagcactttgtagccttgtacatgttacttcaatcctctctatgtcaaattcctcacctgtatagtggagataatcattgcacagatttcataagtttgtgtgtgtgtgtgtgtgcatgcgcatgtgtcttcgtgtttgtatttttgcatgcaaaaaaagattaaactaattaatgcatatgaggttgttagaaaagtgtctggaataaaaaaggttcttaattattgttggatattaatggatttttttcattaacttttatgtgtgactgttgatattggtttttcatttaccgtggcaatacaaagtttccttggcacacatcgtattttatgttccatttattgttccacttatttaagttaaaaatgggttgctttaaagataaatattaacttcataatgttacatattgcccgcagttatgacaaagattgtgatactggaatgcaaatgactgagttttttagaaatactgaaatcatggtacccgccttgtgaaagaggttgtagagcagatctgcattatcaatatttaatttgccagttacaagcgagtttctcatttctgctagatatgagagtgatgtggattgcataatgaaaattgctaatgatcttcttggcttaaacccatcgccttcatctggacatcagataatgaaacttcccaactgccttgcaattgagctatcagaatcagagataccttctcccgctgtgtctcacccctctccactttttaaagcccagcttttcattccttagtggctcttacgatagcacggaagaaaatgtaagccccccttctccccaccccttggtgagacctcacaggatccatgagttcttcctgactataattttaggatggttcgttgtagaaatgcctgcttctgttcagttatttattcaagaaatattttttgagcagaaaccgtatgccaatcactgtgctaggcagtagaggtataataatatactaaaacttgcaccactcttattctcttatacctcacagcctagtggaaaagacatgcatttgtcaaataatcattgacaaccattggcaaaaaatgttcaatgtgaaactgatgaatatgagaaacaagagatgctgtgtaaaagggtatgaatagaagaagcttacctgattgaccttcacttatcaaacgtaccagattaatacatactgtcccatctctttataaagcatattggcagatgtgcacagcatcctatgtagtgactgtttggtacaaatttacctttctcttcacccgttgcagtgtctgcttgccaagagtcagttgtatttgttcccagggctgcttctgccagctgcacttttcattgtaattacattagttagtggaatattatgtaaactgatgaaaaatgagtgcagtaagaaaaagagctgtttctatgaaaactaaatgctttggaaacattgtatgaaaacacgattcaaaaattattttgcttagctgtgggtgagaagactgtaaaatattagtggaaaaaagccctcagaaatgtggaaagattctgcagtcagattcttttcaatgtgtcttgacattctcattccactttaatcaaacccagaattgataccatagagttaacaaactttaaactttttctgaaaaaagccagattgtgactattttaggacctgaaggccatagggtctccattgcccccactcgacactgccataatagcacaaaagcagccatagataaaatgaatgattgaggctatgtctcaataaaactttatttacaagaacaggcagtgggccatagttagccaacccctgctggtgactgaaatgttagtgaggtgtatgtgggaaggttaatgagggatttttatcaacagagaaatcattcaaagaaaaggccttagactcacatcaaagatcaataaatgcatgcacgttcatatgttttacattaaaacaaaagcctgaagttatttctatatcactttaaaagtgatttcttgctttaaaggcttccagttaaataccttctgccattctcaaatgaaatggcttttaaagaacagaatagctacaattagggctggaaacacaaaataaaattatgcttatttttatgttccaaccctaatgactcagaaccccatctgtctataatggaagaacaaatttatccttttttattggatcccccagcaagtaatttctgggactccccaaggagggtgacatttccacgtatacatcctggtgcttgtcctatgcaaattgttgttcggctgttccagaattctcccctcacttaagaaaagtctggtaagttccctctctggattgttctgtcctcaaaagcattcctctgtaagcatgaataccattctttgcattaactttccaaatgatcagctaaagccagacttcagtgattagctcaggggttagcagaaatcccaggtaggtggtgacttacagagaaccctcaggattcaggcctgagatcttcatggttgatgagatttcatgtatgttctcctgtgtgtgtgtgtgtgtacgtgcacgtgcacacatacaaggaaaaaactggcagaagtttgcttgctttaatcttacataacgaatggtcccaactttgtgattttctccaagcaaagggagtttgccccaaagtaattagttctctacttctagaagctgcaggaactcaggcaaatgatccccaggggcagcttctctagtaaaataagaaactcataagtacatttaaaatgttttttaaaatgttttttaaatgtcatcttcacaagacctgttccatacagagcttgtatgttctccagtctttgcaagaacattaattgatgaacgcaaggaaatcaacttcttgattgattctgatcaagaaatcagccaactagtcacagattttaatttctccaacttcattgtgaaatatgattaaataaagaagtgtacaggtgtccacttttcttcatttttgatgctgaatcttataattcacatatatgttaattaattctttgagtctccccaggcatttgaacactttatttggagaagactcaaaaaaaagttcacacatttaggatatttggcctaatattcattctccctttcccttgctttaatttagcctattatccccagtcctcatgcccctttccagggaaaatctattcccatttcttgctttatcattaaatctgtatcaaacagctccaagcaaatcgctaataatgctgacattttaatttgtcatagctactcttcatttctatgactgatgcctcagcaaggacttgtcttcctgctctgttcctttgaggtctaaataccatttcaggagaaaaaaaaatacgtgataggcaagggaaatagggcaggaagcaaataaatagggcatctctagttccctccagttgggggtaggaaggggcaagtttcagtgggaatgagtaaggagcaagaaactctcctttcctgatgatgcagacaaacctgagatggtcccaggaaaaatggcaacgaggccgggtgtggtggctcacacctgtaatcccagcactttgggaggctgaggtgggctgatcagcaggtcaggagatcgagactatcctggctaacacggtgaaaccccatctctactaaaaacacacaaaaaattagctgggcatggtggcgggtgcctgcagttccagctactcaggaggctgaggcaggagaatgccgtgaaccgagatcatgaggttgcagtgagccgagatcatgccactgcactccagtctgagagacagagtgagactccatctcaaaaaaaaaaaaaaaaaaaaagaaaagaaaaaaggaaaaatggtaatgagatataaaagctttctgtcttccttcatggccatagttaaaccttatttaccctgtgcttgtatgtggatgaatcatgggtacagcaagcatgtgcttccttgttgtctgcagtatatgcttccttgttgtctgcatccaacagacatttctgcctatggtagctagtactttattattctatttgggttaaatttcctctttcacgtgtgcagtcttggagagaggataaatcacaacacctgtccctagccaacagatgtggatatggccaaggcaggacagttgaattctttctcctgagactctgaatattgagtagggtaatgctaaatatggtgaagaaaacaagcatgattgaaaacctggagttcattcatttcggtagtgatattctggtgaaattgagtgaagagacggttcccagggctagacctcagattcaccctgattcctgcctttatgtttaaccctggttatccatctatccgtcccttaagctacctcatctcattcaaatgatcgccatttttttttttttttttttttttttttttttttttgctgaagttagtcagacctattccttttttctgtgatcgaagaatccctactgatacactggggaaatgtgctaaacttggagaactgcagagccaagagtttggttaaaggtttgctaaaagccaactcttcatcataccctgcaatgcctccctgatgcctctgtgaatcggcgctgactttatgtattgacagctaagagaaaggagctcttggtttagggcacacgcagggctagatgcttacctgaatttgtacatctttttgggtcagttctcagtcatcaagagcaggtaggcacaggaagagaggtctgtgcttcagggtctttggaactctgtccttccctgtaggagtaagatattccccccaaccccaggggaccacccccgtgcccacagataaaggatctgtatcagtatcaaagatatatcagtatcagaggaacttgtgatgttacgggatcatcacatgtctctctgccaacttcttccttctcagagtacccttcaaaggccactgagaatgtttataacaagtgccatttcctcagctctaccccagacctactggatcagattctggagatggacccaagggactatttttaagccatttctcaagtgggaatgagagttgagaatagtacttttcaaatttagctggtaaaatgttttgatgtctcagccttatcctaggaatgctattggcccttcatatctgtaggtttcatatttgcagattcaaccaactgtgcttcaaatatatttagggggaaaaaaaacccaacacacacctgggtctgcacggaacatgtgcagactttttgtcatcattccctaaacattctggataataactgcttacatagcattcgcattgcatcaggtattcaagtaatatagagatgttttaaagtatgtgggtggatgtgcataggttatatgcaaatatcactccattttatatcagagacctcattttatatcagcatccatggactttggtattcgcaggaagtcttgacaccaaggtccatggatatggaggaacaactatactaaattatcatgttatatgggctgagttgtgtcctgacaaaagtcatacatggaagttctagcctctagtaactcagaatgtgactgtacttgaagctaaggtctttaaaaagataagtaagataaaatgagtccataagcgtgggccctaatccagtatgactggtgttctttttttttttttttttttttttctgaggtggagtctcactatgtggcctaggctggagtgcagtggcgtgatctctgctcactgcaacttccgcctcccaggttcaagtaattgtcttgcctcagcctcctgagtagctgggcctacaggcacccgccaccatacccagctaatttttgtatttttagtagagatggggtttcaccatgttgcccaggctggtcttgaacccctgacctcaggtgagctgcctgcctcagcctcccaaagtgttgggtttacaggtgtgagccaccatgcctggctgggtggtgttcttataagaagaggagattaggacatagacacgcacaaagggcaaactacatgacccaaagggagatgatcacctaccagtcaaaggaggatgatctgagaagaaaccaacccccctgacacctgagtcgcagacttctggcctccagcactgtggggaagtaaatttctgttgtttgatttccctggtccacggtactttgttacggtagccctagcaaacgcacatctaaacctcgtgagaatcaaatacattgctactaaaatcaaaagcaaatgaacaaccaactaaccaacaaaaagccccccgaacttgatagttcatcctgatgtgtattggtacctctgatttaattacatattctaaatcctattgcccttttgaaatgcaattttaaactagctgtggtatgatactccctctgtatgtgcattttcttgtttacttaaaaaatagtggactcccttgggggatagagatgatgtccttggctccctgtgtgtcaccaccacatacaacaaatcagatggacgcagcaatcctctattgttcgatatggatggagaaaggaacagatgagtatgtgagtcacagcgtgttacttggtttcatctctggagtttacagcctcctgtgagaccaattctgtatggagacgcatttgtaaccttacctaaatgagcaagcaactggtgtttggaagaatgcattctaatatttcatggtttagtgcccctagcttacttagaaattttgcttctatctagctttcttgtagcgaaggtagaaggtgcccgtgtggtccttttagggatgatctgatggagccgtgtaatctgctttcttcaggtgcacgtctcatcttgaatgccacctttcccctgatacactccacctgcccactcgtgttcagcatcatctccaagcaccctgcctcgttcctctgtccacatgctccatggttttgcatgggtttttctgaacctgcttctgcagcaaagctgccatctatctaagacgctgaccctttttaataccatttttctaaaattgacaaattaaaatggtatatccttattgtatacagcatggtgttttagtatgtgtacattgtgaaatggctaaattgaactaattagcattgcatgacctcacatacttaccttattttttagggtaagaatacttaaaatttacgctctcagcagttttggggaatataatacgctgtgattacctgtagccgccatgttgcacagtagatctgatgaactcattcctcctgtctaagtgaaagtttgtattatttgaccaatatctcctaaatcctccagcctccaagcctctggtaatcaccattctactcttgcttttatgagtttaatttttttagacgctacatggaagtgagttcatggggtacatgtctttctgtgtaaggccctgatccttatgtgtttttcccccacagtaacttgtgtaaaaccctatacccagagaataacaaataaataacaacaaaaaaaaactattaccaattgaaatggtttaattcactccaagggggaaaaaagttttgcaaacatctaagtcacttcagagtgttttgatagtatttgcatgagaatcttaaagcctatagtcattaggcacaaacaaatgctaagcaatgcacatattagtccagagattctctttaattcacacttagagaaaaagggaggttaagagttagaaccatagctaattgtggagctgggaattgaacccaggtctatattcacttgttttgacaaacatggtacgttaccttgatgtctattgagattgccttagctcaaggtaagaatgcatttgctttttagaaaggagctaaaatgatcagtcccattgtgaggctaagatacgagaagggtatggttttctttattgatttggactttggggttagacctagcattgaggcccaacctttgtaggatccaactatgacaggtggaaaatgcctcccctggttagttagaaatttaaatagctaccaaatgagctgagtattttatgtgcaaagttttaggtgctaccagttaaattatttaacatctaccttcttgaccctgactcataaagcggggggtgtttttgttaaaagtgtagacaatttcccaaaactatagcagcaattatagaaatctatgtgttctaatttaaggtccttccacagtcaggactgaagtcactgagtggattggtggttgaaatcatttcttctttgtatgccagggttttccagggagaaaagtgaaagaaaacacaaaggtttggttcaataagaggagcacttgatgtcaactctgtcttcccagccagtgagtggcagaatccttctatttctagccatttacttattttgaacccagaccatttattttctaaaaacagattactcatgtggtagtttatataccaaactgtagaatttttcattccaaagacacatggaaatgcctctttatgctcctaacaaacagtaacagattatgcacacagagcatctactgtaagtaaataataataagttaagctgaagggacacacacagaatctataccaggcatatctgaaggggaactcatatgccagcggcagccttccatgcttgtgacatgggcccggagaactgaacaggtgatcctttcaccaaacccagagggtgatcttgaaaacttaattaaagcagagttcttccaggcagccgaaattattagttcagagttggtactcatgttgaaatctgtgttagttttttattgtggccctaacaaattaccacaaaaaaaatagtggtttatagaacacaaatttactattctgcagttctttaggtcagaatttcaacaagaatctcactgaagtaaaactgaaatgtcgccaaggctgtgtttcttttggaggctctaggagagaatccttttttttttttttatcattctgattgcagtcagagtccaattccctgtagttgtagaactgaggtccctgttttctttttttgttttctttttttattttattatattttaagttttagggtacatgtgcacaatgtttaggttagttacgtatgtatacatgtgccatgttggtgtggtgcacccattaactcatcatttagcattaggtatatctcccaaagctatccctcccccgtccccccaccccacaacaatccccagagtgtgatgttccccttcctgtgtccatgtgttctcattgttcaattcctacctatgagtgagaatatgtgttgtttgattttttgtccttgcgatagtttactgagaatgatgatttccaatttcatccatgtccctacaaaggacatgaactcatcattttttatggctgcatagtattccatggtgtattttactgggtgtgagctgagggtcattcctagtgtctagagggcgccattttttttttttttttttgtaattcatggctccttccttcatctttaaagccagccatggtttcatgaatcactctcatggtttgactctctcgtgcctcttcttctgttgtatctgtcggactggtttctctcctgcttttaagggttcatgtgattacgttgggtccacccagattatccaggataatctccctattttaagatccgtaattataattccattggcaaaatcctgtttgccatgtaccatagcatacatagatctaagatcagccagccaagattgtcggtccaaaatcatgccacactagttatgtagtatccccactctaagtagactgattctccatgtgtattcaaacactgcagacatttgatttgtgttctgggatggtccacctccattttcatataaaatatagaaagtcagagaccagagcattcagaactaccatccaaggtagcccagggtggccattggcccaggactcacctctacctgccttttgaacttcttcttttgcagtccctactggcattcattgcttcaccatttaagtccagctgttacaaaagaagcattgttagaatgtctaccataatagtactgactctttgatactattattattattattatttattattttgagacagagtttcactcttgtttcccaggctggagtgcaatggtgcaatctcagttcattgcaacctctgcccctccgggttcaggagattctcctgtctcagcctcccaagtagctgggattacaggtccctgccaccacacccagctaattttttgtatttttagcagagatggagtttcaccatgttggccaggctggtctcgaactccagacctcaagtggtccacctgccatggcctcccaatgtgctggggtttcaggcatgagccaccgcgcccggcctgatactattttattacttgatagttctgttgatttctactcacgaagtgtgtcaagtaaggtaatgagaatgtagaaatgtaaaattattaaaaccagaagcatttgtatgtgtcacttaagtgctaagtaaaacacatgaatgaatgagtgaatggatgtttctaaagactctaggagatgtctgtagcagatggcatcagatccctgacattattttatcacccactcctttatgtcaaaagctggctatgaaaaacacctatgaacctatatattttttaatcctttaatttatttattttttaattattgttttttaagttccaggatacatgtgcaggatgtgcaggtttgttacataggtaaacatgtgccatggtgttttgctgcacctgtcatcccaccatctaggtattaagccctgcgtgcattagctgttttccctaatgctctccctcccatcagtctccccaaagaggcccggtgtgtgtggttccccttcatgtttctgtgtgttcgttgttcagctcctacttacaagtgagagcatgcggtgttcagttttctgttcctgttttcgttcactgaggataatggcttccagcttcatctatgtccttgcaaaagacatgatagtgtgcttttacactgaacctcttcataagggctatttttctggctatgggacacattcctttcacggcctgggtaagcaagaagcatcatggaattaacaaccctggaaaaagcactcaactgaggataaatggggacttagtggatcgtgccccagcttcctcatgcgctagagtaagtggggcagcatcgaggtgtgttctgccatctcccagagctctacaatgggattaagccccagttgcccatagtgggcacttgctcgttaacaaaaattgtgttcctcctatccatgtctcaatttccattccccattgatgttcccttacatcactccaaaatgtagaatttgcgcttgaattttaccccagctctgctttcagggaaacggaaactaaaatagtacattcgccataatgagaaacaccatagcctaataattccatcaagtaaggttttctgatcagtggatattctcatcatcatccttttgccatcagtcttttatccctcctcctctttttcctctcttgcacagtacatcactgctgttgtaggatgtggattcttggattattgaataggtttgcaagcaactgccgctgtgctcatggtgcatttcccaaaagttaaaaaacttgagtttggctcactgagcgatcagagcacgaggttttgatggcacagtgtcttgctcacatatgaggagactgatgtatttgctgccacattccactcatttatacttgcctcagtgtggtttcttatttgcaggttgcttttaacaatatagatgctttcctggatagagaacatggaggcatgattttggaaaacttgtctgcctcagatgcacccacgcatacacagatatatgcatataccgagtattctgataacaacttagagatttaaatatttttggcaattttgtggtgttattttcaggggttgtatattcttaatcttgattgcatatgtgtcttgacatctttacgccaaaggcatgtttttatagatgtctgaattaaacactgaactcttttcaagatagctgagtttacgtttaagtggttttgattaacctgggtttgcttatttgctcctaaatgttctaatgcagagccatctcccttggcatgaagtgatttgggagcacagctttagtaataatacttttctaagtaggcaagagcatcctgccctgaatgtttcccaaaactggccttaaactgaagaattgaggtttagccatcccccttccccttagccattcaggtggtgcggattgggaaactggaacctaactgcacagacaccaaattgaccaagggtgacaaaaccagcactgacaagactgtggttgttgggtaggtgaagggttcatgagctagtaagcaggactcagcttggaatttggaaaatccttagtgcaagcaattttgcccagagtggcatgttgtcaagttgtcctcaagctacatttgccattaagagaaatgaacttcaaaaaacagcatagcccttcacaagcctatctttactcaaagcctgagaaaggagggtcccatctggcttaacacattacaatttcttcacaagtggagcttctcggctgctaccctgaagcttccgttttgactagtattggttcttaggtatcacagaggaattagattattctaaaagcttttattgagcatatactacatacaccactaggagaatagtaatgtcttgctctcaagggctgtgcattctggtaggtggtgtgaaaaggtaggtatatgtaattataatgccaggaaaaagaaaatgcgatttgttagtcatgaaattaggtgttagaaaagcgcagaggagagtattattacccctcctagcctcctagctgcaggaagtgtggcagatcatttaaaggatatatatgtattacatacatattatattttatgtatctgctaattcttggatttttgaatagatttgaaagcaactacaacttgatcacaaattgttgttggggtcacaactgaccccaacactaatttgcccagatatgtgtgtgtgtgtgtgtgtgtgtgtgtgtgtttgtctgtatacataacctgggtaatttatacatacatacatacatacatatatatatattttcccagtattgaaatactacctgaattctaggtccctatacacaaaaagttactgtttattttaacttaaatatcacttagacatcttaaacttcatatacccaaattcacactcatcatctgtgtcttctacacacacacacctgcccattaatctgctcttcctcccttatcatgtctttttacaacagctcctaattcagttgttgagaccagaagctcagctgttgctcttcactactacatctttttcagctctaccttctcctttagatttgtgattcctaatatctcttaagtctatgaattcctctcaaaattcactctcgcaaacctactcgaagtcataacgatttctaaactagattatttcaatagcattccaactttctgacccgttctctagtctttgttccttttacggtaaacatgtatcttgagctgcctggaacaatagtagttacaactgttgtcctggtataattattaatagcactttcttctttccccagaaagtcctggtttggagaataaattatgatcactgaaccttctattcactccttagggccagaatgacctttaaagagcttaattaatgctactcttattcttcattcatcactttcattacagtgcttatcaccttccttacgcttacccacaatctgttattccctcgtttgttttgtggtttacttggtcatggtttctcgttctcctgtcttcttactccctttagattgactcctcttaagggtaagagaatgcttattttgttcttaactctactctctactgcctataacatagtagaaactaaatattaatacatgtttgcaaataccagtggctattgttttttgttgttaatacaatgaaagaatcagtatgcaccaataacataatctggctacaagataaccgttattctagaaagctgccctaggaagagatttcagaatatttcagaggatcttctgttttttgccatgttagaataacttgtaccataaacaactttaatactggacaaaatatatgaagcatcattttcaggcaatgggtacaaagcagcacagagctgtgatccttcagagaatcggagacatgtgagatgaagctaccgttggcccagttttattcctgggaggaacgtcttgaacataagtgctctgagatgaagaatttacaagttggggatgaggaagtagctggaatttgtggaaccggttgctacagaaaggacagatctgtgtgggaaggagaagtctccatgccctgagttcttggctgaggaataagccacttatgtgcagggtcaggctttgtgagtcctcacagggagggttaactgtgacacagaggccagggtagaggtagtacaggttgtaggtattcagttgagactccagaaagatcagactttaggagtaaagtgtgtatcttagggcaagggtcagcaaattatgctctgcaggcaacatctggctatgggctgtctttgtagtctgtgatcaactaaaatgggttttagatgattaaaacttaataatatgtgactgagactattttacctgcaaagcctaaaatttctactatttggctcttttcagaaaatgtcagccaatcccttccctatatgaaggggcatggcccatgactgtagacaaatcctaagaagatcttcccaacaaagcatgaaaatgagctttacagggtcaagagcatgcatgagttagccgagcgctgccagaacaaaactcaaccaccatttaaagaaagacgatataattcagaccccctacaattcgttctatgtattgaaatccacacaattgaaatgtccaatggtaaatgtccagtaatgataaataccatggctggtgtggaggctcacacgtgtaatcccagcccctttgggaggtcgaggtgagtggagcacttgagcccaagacttcaagaccggcctgggcaccatggcaaaaccccttctctacaaaataataaaaaaaaatatatacaaaaaaaaattacacaggaacggtggcacatgcccttggtaccagttactcagggggctgaggcaggaggattgtttgagcccaagaggtcagagtgagctgtgatttcatgactgcactccagcctgggtgacagagcaaggcattgtctcataaaaataacaaataaataaatactagatgtgtagaaaagaaaaaaaaattgactgacaatccagagcagtgtttggcaagccacagtttatgagacagctccctgtttctgtaaatattcttatttcattggaatatagtcattcctatttgtttccattttgcctatggcttcttttgttttgtaacaagaaggttggacagtttcaacggagaccatatggcccacagagcctacaatatttgttttctgtctcttttaaggaaatgttttgtccactgattaggagaaaaaacagtcagtagaaagggactacaagatgacccaaatgttaggattgaagtagacaaggactttgaaataactgtttgaaatattgtagggtttataggaaaagatggacatgatgagttcgcagatgggaagtctcagaaatcgaatgaaaaccataagcaagaaccaaactgagattctgttaggttgatgcaaaagtaattacggcttttgccattaaaatgataataattaaaataatggcaaaagctgcaattattttgcatcaacctaataaaattgacagtacagtatctgaaatgtaaacatcagattgtaaaatgctgaatacagaaatctgttaacttgaagacagtgaagaatagaactaaggaacaggaagaagaaaaatattgaaaaaaattgaaaaaagcctcagtgatttatgggaaatatcaagcatttaaatacatataattggatttctgaatggagagaagagacagacaatgggacaaaaaaccattttaaggaataaaagctaagattttccaaatttggtgaaaacatcagcttatactccagagagcatggggaaaaacaagcagtataagcataagaaaaaattatacctgaaaacattataaagaaatgcttaaaaccaaagataaacagatgcattttcttttggaaaagagatctatatttgtctattgcgcaacatatctctgtaatgagtacaggtaactaagttctctaaagccatcccccagtgagacattgtgaaaacttctgggattggaaatggtgaggttgggaagaggtaggggagctcattgagagtagaatcaaagggaagtcaaagggtgagaattaaagaaaaagagaaaaaaggggcaaaggaactccccaaagcgtaaaagcaacatacggcaaattcgatagtagccaagatgaagttctgtgttatttgaaatgtgtactcatggggctgaggctgtgcagttgatcttactacagacaagttggttttgttctgttgcataggtacagactgcagtgatgttgcatatatagggaatccacttctgggtaccaacagtaaaagtgcttcattgctcagtgatgatcaaaccgtcttcaaatgcaagcagttattggttttagttaacaattatttatagagcactgagaggttgcccaaaagaactctaggagaagagttgggaagtcaaaaactttcagttgctgtgttgccttgtaacagtgtttgttagcatacatgattaggggaaagaaggataaaacagttgcaagtatttaataatctggaagttttacagaaatatctagattttttttggcttctctttaaaacaataagtattaaaaaataaaagcccacacaactttgggtttgcatttctttttattttttcttttttttatttatttttctttttttatgagacggagtctcgctctgttgcgcaggctggagtgcagtggtgcgatcttggctcactgcaaggtccgcctctcaggttcacaccattctcctgcctcagtctcccgagtagctgggactacaggtgcctgccaccacgctcggctaattttttttatttttagtagagacgggatttcaccgttttagccaggatggtcttgatctcctgacctcgtgatctgcctgcctcagcttcccaaagtgctgggattacaggcgtgagccaccgcgcccggcctgggcttgcatttcaacatgtaaacaatttcctgtaactgaataaccatggctttatttgaatgaggcatactacactttgccaccgtccttgcacttccctattagtcccctaaactgacaccagttgtcagtttctatttatcctcacacttgggctttttttttttttctttttttttcgagacgagtcttgttctattgccaggctggactgccatggcgcgatctcggctcactgcaacctctgcctcccgggttcaagtgattcccctgcctcagcctctcgagtacctagaactacaggtgcactacctgctaattttttgtattttagtagagatggggtttcaccatgttggccaggatggtcttgatctcctgacctcatgatctacctgccttggcctctcaaagtgctgggatttcaggcgtgaaccaccactcccggccatttttttctttatggtagaattaagtagaaatgaaatcatttattttacccgagtctttgtcaaaaccagcaaaagaaaagaccaagaagagtcccatgcttgagaaaaaagttaagaaaataggatataccagatttcttggtggaagtgtaaaatattttcatatgcctaatatacaaaaaataatgccatatcccttctcacttgactcaaatggaacacctgtgggatgcctgcagatacttgaatttcttcaaattactgctttagcaaaactttatttttgcacatgaaatttttttcctcccaataatataccatcatactaacaaaggttaacaacacaaagtgtaaacaattctaaataccaccttcccatttctaaccaagatgttcactcgtaacagtgtatgcataatatgaaatgaccagtttaaacttccattccaatgtcatggtttatatgcccactcatatacctcctgtgagccctggggataatgacacagtttcttgtacaatttaagtggtgtcacctctctggagaccagtgaacagactgctggttgttgtcttagttaaacacttactttctaacaattttctaacattgcatttctgaaacagcttggaaatgtgcagtgttattgggtgtacgcgagagaggtgggcaaagacatccatctgatttcttggaacagggccatttagttagtggacgagacctcagaggttttctttgcacagacttctcctgatgcacttataattttctgcccagaaatctcttcaaggcctgtggagttttagctctgggggaattattcctctgaataagcggtttcccagctgcgcacataatgctccaatcaggctagtctttgttcagacaatccatgaggggaaatgttggcattggtgggcaaggtactgttagccccactgtctcaaagtacatcggtgatgtccatgtgtaactgaccaaagtaaatgcagttttgcaaactgcaatgagttttacgtgatgaattttcctacaaaagtcaaaatgggaaattcaggttagtgtaggtggtgaagctactacatttattagcatcaaaagcacagagtctcaaagacgaactaatctgtgaataactgtgccattagtaagatcataaacatggactaatggggatatggtacagtgaaatgctggtatttgcagcctgtcatcatattagtacaatgatgaaatttgctgctaagttcctcagcaaatgttcagtatcatgtttgtgcctttttgttataatttgtaccgtattagtagcaacttaccatattagtgactttaaaatgtttttaaaattatatctgtcgggttgatagaaatggaatgttctggggttgtgcaagtattagtcgtattaaacttgtcctgttagcagctttcccttgaactgatacttaaatgaggttttgatataaacaaaatgtgcttctgagatgtgcttccagctacaaccaatttctcccagtccattagctactttgtatcccttttaagcaacttgagattgtgcttttattgaggagccaaaatgtttgctcaactcattaggccaaacagagagaaagtaaactcaagggctgtgctgtctcctgagttactctggggcccggtgaatggagcattacctccatcactgctaagacagacaaacaccttttgagattttcctgcctttgcctctctctaccacttgctcctcctcctctttggctcatgagaaaggctggtaactccactgttcattctttctcatctttagtctctggatttcaaaagtcatcgttttcctgcagaagaaggagaaaggagcattgaataggcaaaccagctgatgtccactatacagagttttttggtgttagaaaagctggtttagaaaccaccttaggaagtgacctaacccagaaatggtttatctttgtaaaatggctttctcttgtttataaccaaccccatatactttatttatttatttagatggagtgtcactctatcatccagtctggagtgcagtggcacgatcttggctcactgaaacctccgcctcccggattcaagcggttctcctacctcagtctcccgagtagctgggattataggtgcctgccatcacgcctggctaatttttgtatttttaggagagtcagggttttgccgtgttggccaggctggtctcgaaaccctggcctcaagtgatccacccactttggcctcctgatgtgttgagattacaggcatgagccaccacacccagcccgaccctattttttattttatcttattttatttattttattttatttttttttgagacaggctctcgctctgtcacccaggctggagtgcaatggcatgatctaggctcactgcaacctccacttcccgagttcaagcgattctcctgcctcatcctcccgagtagctgggattagagtaatgtgccaccacgcccagctaatttatatatataccttttttttttttttttttttttttttagtgaagatggggttttaccatgttgtccaggctggtcttgagctcctgacctcgtgatccacccaccttggcctcccaacaagaccctattttcaaatgaggtcatattgtgaggcactgggagttagggtttcaaaatatcttttttggggggaaacatggttcaactcatgacagcctgaagtctttatttacgtgtatctatcccatatggtgtaccattctcaatcagcaggagccatacattgtctgttgctgtaggattataatcagactcactgacttcacttcctatctctgcaccatccaggcgcgggactgcatatgtttattggccaaacccagttttacttgctcatcatacatctggctctgccccaactggagcttgcaaactgagggttgggcaggggaggtttgttaagaggagaccagtgcatgttcctaaaagaaggggagcagaggaaaggtatgctgagcaggtacaacaaagaaaacacagaatgcttcatatggaaagttctgcctgagcagaaccacagtttacactgtgtacctgcattttgtcatgcagcacaagcaagaatagagggagctattcagcaactcacagtccttctttgtcaagttcagattgtaaattcttggagtatttagaggtggtgtcacatctgtttctctccctctgtataaagaaaaataaaatgccatattgaataagtacctcataaagccttttgcgttatgatggagagacagccaggaagatgagagtgaaaagtaaacattttcctgcatggcaaatggaggcttttgagggtgcttgagatgtttaagctcttgtcttgatctaggtggtggttacacagggtggtgtttgtgtgtgtttgtcaaactgtacacttaagatttgtgtgctttaaccccatggttgctagtggctgtagggtgataatgggaagttattattaagtgagtgtagaattccagttttgcaagataagaaaaagttctgtgggtggatggtggtgatggttgcccaacaatgtgaatgtacttaatgcagctgaactatgcatttaaattagttaaaatattaaattcattgtgtatatatatatacatatatatacgtatatatgtatatagatgtatatatatatacatattatatatatacatatatacatatgtatatatgtatatatatataaaaccacaatttaaaaaagactagtatactttactatatcaatattattcctcagccaaaaagtaaaagtaaataaaatgtcccattcccatttgtttttgggagtcacaagaagggttgaactgacctctgatttcatgcagcgtggacaggcaattttagggatctttactgcaatatctcagcagatagctgaacactggcataaatagattatttcctccaatgccttgcctatcattctgtaccttcttcggcttcctaaatcctagcaacaagtaacctgtctttatcctggcagaacggtcttcactatgatttcagtgccaaagtaatgactgtttgtactgaatacatgtaacagagcctcattccttagggaatgtgtgtttttccccttcatgtttgttataaagtttgcagatcaccatccctgtagtcacttaagctctctgacctgttcagagattcctcagcaatttgctctctgggtatccttttttcatggtccatgttctcttggggtacactcacaactttatttttctagctgcatgctgccattttgggattggctgccatatgaaccctgggtgttagggtatgcttcccatcacagatgacattgaatagttcaaccctctccatctctcctcttgcaaggtatcatcatcattcattgcgtggaagaccacaacaaactcttgactggccttttcgctgtcactttgcctcaaggccacaatccatcctcaggaccaagggagcctttgaaataagtcattccctccttgacgttcgttagcagtttctcattgcttgtggagcaaaacacagatagcacctttagtaactaaagctctgcatgaactggtctttacctcacttcccctcctcagcccttgcgagttgctggccgtagccacactggctttattttactttttttgaggcagagtctcactctgtcaccaaggctggagtgcagtggcacgatgttggctcactgcaacctccacctcccaggttgaagcgattctcctgcctcagcctcccaagtagctgagattacaggtgcacaccaccacacccagctaatgtttgtatttttagtggaggcagggtttcgccatgttggctgggctggtcttgaactgctgacctcaagtgatccaccagccttggcctcccaaagtgctgggattataggtgtgagccaccacgcccggcccacactggccttattaacatgcagaacatggtaatagtgttcattctactaaacctgtttgtgtgtttgtgtcctaaactttagctattataacttggccactcctcatgggggaatcaaagggaagctgttcttggctttagagaaattcacctcccaaggctagaaaaatagaagcactcatttctcactaatgatgggaatgagagtagtgggagtttttatatggaggacattatttatgtactttttaaattaatttgttcattgactcagtacaaattgatcatctcactacacctgtgttgtatatctcaagagttgggtagtcaagtgatagttttattattgtctatatttcataattatttattttaaatatttcataatgagtaattttttaaaattatactgatcaccctggccttggtaacatggatgatttgaacacctgcctggagaatccaataataggattgctcttattgatgaactaatatgtttaaccatcttcctgttgaggtcagtctttttagtggcataaatattccttccaggcagtggagtttgggataatgtagtagaaattgctggagtttctcctaaaggagaagaatctgtgcttgctcctgtggccacagagatcacaactggaaatgagcagccacgtggctgaaagtggaagaagcgattgaattcctcccatcctctctggttcatagtgatggtcggtggtaaccaccccaatttgcaggatctgggagaaccactctggagatcactccttggtatcctaattccctgttatctatcttggtaaactccagccttctggttggatattttagctactgcaacattgaagacctatggttcaggatgaatctaccttctcaggagcttcagttgtacagaatacattgtcaagtgatgtcctgtaaacacatattaaatgaaggttccaggctgggcgtggtcgtttctgcctgtaatcccagcactttgggaggccgaggtgggtggatcatttgaggccaggagtttgagaccagcttgggaaacatggcacaaccctgcatctaccaaaaatatcaaaaattagctggatgtggtggcatgcacctgtggtcccagctacttgggaggctgagatgggaggatcgcttgagcctgggaggtggaggttgatcaaacctccacctgggtgacagagtgagaccatgtctcaaaaaaaaaaaaataaaaattaaaaaaagaaggtttcagcactgattcagttgagtttatcaagtcatttttcacatttcgttcagtgtttagtaacacaactgtttaatgaaggcttgcagactttctttcataaagtttaaagttgtatgctgattgctgtatataattaatgtatcacaatggcattcaatttctgtagcagatcagaagccactgaaacagagaggccaccagtagcttaatcagtgttggtttcaggctattgctttgcagttgattaattattgtgttgagttgataactgataactggattaattattttaaaataatttctcttgaagcttgacaacaagagttgtaaatgtttccactgtgaaagcagctctggacctaccagcctgcttgtaaatatggaaaaaaatggttttgaattgaatatttgaatatatttactttgttattaaaatgatttaaaatggaaggttttgggagtgacaataaatagaaaatgtcactctgctcatttcaaggaacaaggtttgaggaattgattgaatcatcaatttggttatgagcagaatttaaaacatagaaataatttgctgacaccccccgaggggacagtccacggaatgttccattccgtctgtttaacctctggactccagagtacagggattgtaacacctcccacacttgattaatgggaaacagctgtctcctgcttgtgtcacagtgataaaatgtttctccatcttagggcgaatctcattccttgcagagggaccacatgttcaagcaggtgggagaatgaatgggtgcaaactgagcagaggcaggaagagcataaccaggggactcatttaggctcacagaagcttaagattaaatataaaaaaacaagaaatgacacataccaatccactggtgtatcagaggccatgaagtatagcctgtgtacacccctcaccgtggatcaaatgggtttctttgttggctttctcagagcttgtaagagaactcagtctgctaactcagatgcacaagaaacaacttattacattattcatttttaatcagtttaattttaaatccagattcttatccctatcaggcaaaatgttcactttcagctatttcactcctttcccttttcctagagatgggcaagagcctgggagaaggtagtgcccagaaggcaccgtgcatgggtcagttgttagtggttgccatggtgacatttgctttcaggtacacatagtgcatcttggcttggtggctcccttggttctctaccatcctgaggaatggtgactctgtggtgaagctaggaaccctatcacttagcatcctgcccacctagaggtaccatgcagctgtttttttcctgggacccagagctgtttgccccgctcacagtcttgataccctgtgacctgttaaaggccctaacactctcctgatcatctttcaggtcatttaccctaatcccacccgggggcttctgatcaaacgtctgcaaagcatgggcaaataaatgtgtgggacagacctggtataatacaatcaaaatatggaaggactgtggtaaacaggagagcatgattcaggtccaaaggcattcagatgcaattaaatataacagaacactgtgctggtcaaatggactatatatgtatatatgtgtgtgtgtgtatagaggtatgaactaatatatatgtatgaaatacatatatacacacacacttatatgtgagggagtagtggaggagggaagaaagaaaaaaatgtggatagaaaaaagcatattaatatttgaacaaataatcttgctatgtacacctcgaagaggaaaaaagaaaatgtgaatttgcatggacctagtaatgtcttacttagagagatccattctttcctttagctgatttcagaaggccacttgtgagaaatagtgccccatgcagcaatgccccaaaagaaaggggaatgtcaaggtgctgcctcataactgacttcagtgactatgtgagaggtataaaggatttcagaggtggtgatacatttcttcaaattgagcttcaaagaccagaggctgattggtctcctgtgctcacttgccctaagtgaaatgaggtttctccgtaatgtagaataggtgacctgtaactctcattgcagaaaatgagcattgagtgaatgtaaaatgtacacacaaccatgatgtgttcatattcccccctctctcatgtctgtctgtatctggcaatcttgtctgtctgtctgtctttctgtctatctatctatccatctatctatcttctatccgtttgtccaaccagccattcagccatccatccatttgtccatccatgcatctattcatctatctatgtatctgtctgtctgtctgtccatccgtccatccatccatgcatcccactaatatgtcagtgtcttactcagaatggaaatactgaagataaagtaggtattatattgtaaaagttctatatgaacgccgtatctaaagttgtgtgtgtgtgtgtgtttgtgtgtgtacttacatctcagatcaaataaagaggctacaaacataaatgcctccaagggccaggcctataaaggaaaattggttattctacttgccaaataacatctgattccatggattgatgcaaactagagaactggaacatgtttgtcacctaaagagaacagctgccactcagcaccggctcatggttatcactttgaaaatgtagaccttaccttgctggatcagccagtacttcaaaaaaaaatatatatgtgcaagttatttgaaatctcttggtttttaaatattggcaaataagttatgtttcaaaaaagtatcgatatattggccaaatgaactgcaccgtcagggtatttgctggcatggatttgaccgattcaccaccactgcatcccgggtgcctccacagagatagatacagagcacgtgttcagtagaatatttgtggaatcaatgaatgaacatatgcctgcaaaattttaaagagtagggtgcttagttatttttccctaagttttcctatcagaaagggcacattttgtccctgtgcaaattgagaatttgtggggatcatgtccggaggtgatctctgtcaccggaaaccataagaaagatgaattttcggttttttcttcactgtaatgacagagtgtgttcagaacttctcccaagtaggagaaagcaatcaatcctggtttgttcagatggtcctggttttagcactgaaaatcctgcatcccaggaaaccgttctgccccatcaaaccaggatggttggtgattcggttcttgatgctctgtgctgtgattcatgggctctaaaatgtactaagcagattggtcagtgtatgtgcctgattgagaacttgtcagttgagggctgtgttgttattttcttacctctctgagatagccagctctgaggctgtctccatcactgcttgttttatggcatggcttggtggtgattctctccatcatgcttagccagtatgcatcttgatgggactacctataggctattttaacaggttactcgccacccgtctcatgctgccaatgattccacagtttacctaatgctttttaattgtttaggttgacattttgccatgcgcagttgtaggtaaaaatttaaatcaacaaggggctcggttaagcagttttctctgtgtgccatgtaaaaatatcactaatggtcaaaactcagacctgagcaagagataatatttccccctctccccttctgtacattgtatgttttaatattaatttcttctttatccatatatcaataattgaacactgcatcaattaatatgctgggcaaattgcattccccatcctctcattcatgatgtgtttcagtaatggagataattttcaagataaagcatacaatttaaaatggattaaaaagaaaaactaataaaggaaaagtgatttatagaaaaaaattatggatactttcaggaaatcttagctgtgcttccaagccgatggattttgtaaggagagcctattgaaacgatcaagttttatgcctgctgcaaaatttcctaggtctgcgattgcaaagagagggagggaagaatgtatacacacacacacacacacactttaaaatttggtcttctaatgagggcgtgtgtatcatcttcatccttagattaggaagccacagattcatgctagcaagtcttcttgaagctttccatttgctgggcttagttggtggggcttggttttttgcttttgatttgctgaattggcacacaggcttctgacggcccatcccccggccctccttcccttttcccggtccacaccctggctgagagccctgcacagagatgggcaggcggcagctgcagcgatgggcaggaccgcagcctctgagcccgcaatgacaccgtggcgtcggtagatggctgtagacaagtgtgctgagctgtgcggtgtgaagagtaatgagtctggggaggccttgacctgactggatgctgcttttatctgaagtacatttaaagagataaaggggaagccgggttgctgcacatgttcttttctctgcggctggagctttactttgagtttaaaaaaattctcagatgctggcctcccagagtcaccggctctgtgcagatgggcttgcctcaagaggatcggccgccttcctgtaaattccaccagtggggcttccgtgaatctcccacccgccatcaggaaatggtgtagtgcctgtctgttgatgatcaacaccatcgctagtattatgaatattgctagtatcatcagtttttgttttcgccactgtggctggccgcctaaagtgtctggatttgctcattaaacagccaaaccaagaatttgttacctaagcaggcttgacagaaaagagaagaagggcaagagttaggaagggaaaagagagagagagaaggagggagagagggagggagggagggggagagagagggagagagagagaggcagccagaagcaagtcacatcacatacagtgccactgaaggaatgttatcctcataaactcataaacaagcacaccaaatcttgtgtaaggaaagaagagggtctctaaggacttgacaggaaaaggcaagattttctacccactgctttcagtttttcttccagatactcttggtgaagtaaggagacttctgtttgctgacagagcccttgatttctctttcaagatgatgatgtatttgtgggtaggtagtgtctcttcctctgtctctctttctctttctctctctctctcgctctctctttctctctgattaataaattgactttggggataaagattgcagcccagagtaatcgcattttgtgtaaggtgattatacttgtggcagaataatcttgcactggtatagtacatgtgctcgcatttccagtgggagttcaggcaagacctggttcattagcattaagctgcaattttattttcagttgcaaaaaggaatgacaaaaaaatgtgtatgtgtatggggtttggggggatgtacggttttctgttttttgaaaacattgatggtggtgaattcagaaaaaaggtctagggaagtcgggttagacatgaagcaaatcctacatcacttgtagctgtgaggtatttcatttaattaccaagaatgaactgctctgagtagtgatggctttgtttatttgttttgtttttgtttctgtttctctctcacaagtgactacttatttgtcattttggggttgagtgctgtagaggagagtagcgtctttcatttgctttaaccagatgtgtgtccgtatgtgtgtatgtgagagtatattttacaagattggtcttgaaaaaggtagatttacatgcacttattctggctttctgataaatactctgtagttgttttttgttgtttttttttctggagatcgtattaaaataagagcaatgaagtggtaacccgtagttatgaattacaatatttaactcttgaagcaagaaaaaaatagtaatctagcatgaatggtttagaaaaaattacttattatgttttgggagacaaatatatatcctagtgtagtttagccaataaagagcatgtgtgaatttcttatgccagtaaccaaagtccttgctctgtgatttcaggtttagagcaggtgttccctgctttgccaagggagggaggcgttttcgaggttcaactcaacctctgtctttcatcagcatcatcatcactgttgtttttcgttgctcggcaggcttagaaaatcctctttatccgcttccctccagtccctgctctggttcaactcagatctatgaactctctttgctgtaaaggaagaaggcctttttgttgaattctttgttaatcacattggttctttgacctctgctggtctctaggtctgccttgcccctcagtgagccttgtcatttacacccttgccccctttctttgggacattttcctttgtagcgactttagctccatttccacccggtttagttttgcacaatttagtacaatgaattctggcagctggagacagagtttattattattttgtcttcatttcagggcaagttttctcttcgagcttgcgtatcacgaaagaggtattttgaaatataaaatcactagttaaaactgcatgaacttaatagagagttctatctaacaacactgaattctcataacatttatttttgacagtggaggttgaagcaattaaaattttgaatgtttacaaatgctgatttttaagcattaaaaaaaagtagtcacgtgggattgtcgcctcaataattaaggaaaaaactatactagcatttcatggaaaggagcctttttggcttttattttgtgaacagattctggttaattataaacaaatatcaataattcctttaggctgtggtgagttggttgctagtcacactctttctctgagttgttaagtagtgtctgtgatattatttatgaagtttgttagctcttacatatgtacatatttgcaactcaaagcagaggaaaaatgatgcgtgtcccagacccccttccacatccgaaaaacttgctgatttgtttcctagtaattaatcttgacttaaaagcagcatccctcaatttctattttcttctctcagaccaatgcattttagggctacatggctttattaactgcatttatcacattgaaaaatgggcactaccttcctttcctgtgctcaagtattctgtttacatctttaattcagattttttttctgcattcaaaaaaaaaatggcagagactttaaattggaacagctggatgcaggctgtttaaggagatatgaattagcaagctagcattaacactgtgaggttggaggggttttccattcttttcttcttcttcttttttaatgcagaggttctgctcttgccttctagtctgtaaataaagatagtctaaatgtggttgatatctctgtttaagagctcatcttgctttaggaaaatgagcctcagctacattgatgtgtgaaaatagtggttgctactgtctcatggatataaaagtgaaaatgaagagacaaggagagacaataaaatagaatccatattcagtttactcctgtcattgtttcttaaatttgtaaagtaacctctttatatgcacctatctgtgttaatagcacacgatttcagtatgtttttactaagatggaaaactttttgctggggggaggtgtggggtagatggtatagtctcccttctctagactgactttgtcattttagtctataaggatggtcctgtgtatttgaaaggtaaagaaatgctttggaatcgtatcaattaaaaatagtgtggccccattaagccagtccaattaaatagttacagatgcttaatatgtccatcatttggtgtcatctcagatttatacatttttttcccttaaatttctttaagaaggttttcctatcaaaaataaattttgtagttttcgttgtattttattttccctgagtgagtacaggttgctgtacaggggaaagaaagttgagttctctgcaaccattggctgacttccgggcggttttgattcaccaaacttggccacggtaggagggggaaacagccttccctacggacttcttggaaaagcagggaagtcacgtttactgaggatgtgatctgagctgagcaccaggctacacttgccgtagaatgaagtaaaaccctcttgaccagcacaacctcccttgaccagcacaaactcctgctctcctgtggttatttaattccgccaggattagaggttctttggaatacaattgagctgtttctcctagggctggaaagtaggcaattggcacctactcatctaattcacaaacaggatacaaattcctctgccactcaagtcttggaccaaatggtccccgcttaaactctactacaataggtatttgtttgactttataaccttttcgtttctctttactttttagttggttgaaacaaataactctttccattttattatttttactcacattttctcatttacattccaagtacacttcctctgtttttactttaagttaaaatactgcaatttttaattttaactttactttttttttttgttacaaatttggtgttccatttattcactgaaaataacttttcttcactttatcgtttcacacttcatcctcaccttttaaaaactttttttttttagaaatatcattttatacaaacatacctgggtttaaaatgggagaagagcaacaagtcaagtcaagaatttctgagggatgttgaaaagacggggagagagttatgccaggcggcagcatctctccttttaccaatgtagttcagtcacttaaaaaaaaaaagaagaaaacgaaaatgcatcattttttctacaggatcctgagagtcctctacctcccagagtgtgttacacttggcagaaactccaccacccagacagctccagttctcagcctgctgtaagcaaacttgtgaagtagctgcctgtggcttatctctgctctttcaccccatcctcagtactgggggagcctcctctgaattctgcattttctttcctgaatgctaaagctttttctgatctgtactctacattctagagcttcgttattaactgagtatagagatggcctgatttgtagattctatgtggatcagagattatgcagaagttgcagatatagagttgctttattgtcttggatcatcatgccagtttaatttaaggtctttcaggacagaaacaacatctgcccattttgtttgacattctcttttcccctttatttcaaacaatacacgtgccctttgtagtaaaattagtcaatgagaaaaaaaataaatagcaccacctcttctagcacctaagatatatgctggaacactggttaaactcttaaagatatttaaagacatcttaaagatgtttttataacatgcacacacacccttcttttctcaatttgaatatagcattgattacaaagttacaaggtataccactgttttattagtagggtttgttgttgtttgtttctcttgtttgtttctgctttagtgtgtgtttgtggagagccagaaatgctatcgcattaaaagcctgtatcaattgtaaaacacatctccatttcagatacattaaaatgtgaagaaggaaaaacaaagcctctgagaggaaatactctgtttcaaaaaatgagatcacactgctttagaacttactgttttgtaacctgcttttatcacttaacattttgtaccattcaatatttttccacaacagcctctttaatactgtatagacagtgttccagcgaatggcgattccagaacttatttaaccaattctttgattatcagttgtttctgcttataaaaatccttgctagttcctggtatggtgtgaatgcattcactaatcatatatgtatttgttcagtgggttggttattgacagagcctttacggacttgggcactgtctatggtactgcgccttgggggacgcacagttaagttaaaagtatgttaaaaggtatgaagagctgaaaacagaggattgcttgttaatattaatcacctgttgattgcagttcacaagtttggtaattattttttcttcaagtattctgtcccctttaccaaatcgaaggctgggacatccgccttttcacagtgattcttctttccgccttggtgcactggaggcctaagtgtcatctgtttttttccaagttagttgacgcattcgttgaatggttccttttcgtaggaacttgtgctggaaattgcctctggcagtcaaaggaaacatttttgttttggagagagaaattttcgttttttattccaaagttcagcatttctgtgtttcctatgagtgcagtgctttacagcaaaatgcctcaggaatacaaagatgacttcttttaccccagtgaattctgattcagaaattcgtttctgttgacctggcaagttcattcagcacccatactggtcaccgtgtatctcagttagggggctgagaaaatggcccagcagactctgattactgtgatgaaggtgttcattatattatcccttatctttcttgactgtgatgtatactgagcttgcctctcttgtctgtgtcaccaggagatagttcagagccctgaatgttctctgttgtctcgaatattccagccgccatgtttttcttgcatacccagcccacttcttctttgacactctgacatagtcacatctttaatgttgcttaaagatgtttttgaacatttggaaagggctagtttcccagcatctttaagtcagaggtacccacttatccagatactcttcaggcagaggaatgatgatggaccctcatgaacatctcaaacttctcgttgattagagggaaactggatggatcgaaagttaatgaatgggagctcatttgtgacttacatcttccccctctagcttaaccattcatggcctccccactcactgcagactttgtctggcagagggagtaatacgctattttccgcttgagcacccagaagctgttgatgtaaattgatcagtacttttttgtgttttcctgaaattctgtttacatgcacatttcctctttgtctgtaaagtgatttgtatcataaagccacatccattttttcccactgtaataatgacacaaaactcattgaatatttgtgtttaaagattcttggaaaacataatggtgtgactatataaggcgtatataatttttttaaacaaaacctggtgagtattaataaaaacaatgatgttgtctttatgattgtgttttaaacatagtaattggtcaagtggatgttgcttagtgccagaggatcagagcaaaacatactagatgtgaaatagcccttctcttcttcattttacattttgagtggtgtttcacttacctttagaaaattttccaaaccttcagacaaatacttgatcaaatgatgcgggtttgaaagacataagcaaattagtttctgtgcaaacttgtgtccccattcagagaagaacaaattgaaaaattgatattcaataccaacaagataatttcgggaagcaatagagcattgttttgaccactaaggaacatgaagcttttaggagaagtagagagagctttgcccattgtcttccatttattatccgaagacattccaggtgaaaaaaaacatgggaaggaaaggtaggaagagaaagctttgaaaatgatttggagacatgcaatgctatttcaagtggttctggggactggatagaatacatcattgctttctttgcattcctatgtcatcttctcctgatgttatcattcgaagtcagactgtcaaatcctgtgtattgggaaacactctttgttcccttgacttggggactcctgcatttcttttgaagttttttttttttttttttaaatcattacattgttcaccctactccaatgtcttgttagtggttgggtggtatggctaagatggctgatgaactgaaataagggcagactgtacagctgtgtgtgtgtgtgtgtgtgtgtgtgtgtgtgggtgtgtgtgtgtgttgagagagagagagattgagacagagggtaagagaatttttctgcttacatttaaataactcacttatggataacatttggataacgtgttctctttaatcacacagacttttgccccgtctcttaatacctgtagaacaaatattgtatctgtaaacatctattgtaaacatcagtgtaaacatcaaaggtaaacatcaattgtggaataacctttttactcttacagagtgatttgcaattctgttatttgcaaatctgtctatattttgttgatgatattagtaatttgttttaactagaatgttctttctttctttcttttttctttttcttttgagatggagacccactctgttgcccaggctggagtttcactctgtcgcccacgctggagtgcagtggcacgatctcagctcactgcaacctccgcctcccaggttcaaacgattctcctgcctcagcctacccaagtagctgagattacaggctgtcaccactgtgcctggttcatttttgtatttttagtagagactgggtttcactatattggccaggctggtctcgaactcctgacctcaggtaatcgacctgcctcagcctcccacagtgctgggattacagtcatgagtcactgcggccagcttagaatgttcttccttaatagaactcatgacaaaatgaaaacatgcttaatttttatctgtgatgtggagttgtgtgtcctcttttccacttggttgtttcttttctcttactttgagttacattgtgagccctttcacacaaagaagggtctgagctttctctatacttggatgtcatgatacataccaggtgggagcttggaatgtgtttacagatgataatcatgttggtaaggtcttggttgatcactcgataagtagcaatttgttttttaattcatttccttgttaagaaaatatggagctgggcatggtggctcacgcctgtaatcccagcacttcgggagaccgatcatgaggtcaggagatcgagaccatcctggctaacacggtgaaacaccttctgtactaaaaatacaaaaaaattagccaggcgtggtggcgggtgtctgtaatcccagctacttgggaggctgaggcaggagaatggcatgaacccaggaggcggagcttgcagtgagctgagatcgcaccactgcactccagcctgggcaacagagtgagactctgtctcaaaaaaaaaaaaaaaaagaaaagaaaagaaaaaataaaacatggagagcatctaatgcatgagatattgtgtgtgctaagttctgacgacccaggagacatgatatgatcccaatcttcatataacttacatgtagtgaaggagacagataaaacacaacacaataacaaaactggtaaccatcgagcaaaagtagtcgataaaagtgttattgctaaaactcatggttgcagagctaagtggagactcaaaggggatatgtaggctgagatatctgagaagtccaaagatgacaggcagtcagaaccaggtggatgcagatcatctcaccatgtcatggaaactctgactcaatttctcggacctatttttctccgtgtcccccagcaggatgtctgaggcaaccactagtagcttctggctgacatgccactgttaacagcagccctggtgggtggaccacactcatccaagaagtagtaggctctaggaaaagttttgaggccaattttcttgcacctggattgaattccttacctacccctgaacccatccctgatactcaacatccaaccctgtgtaaaatatttgctgtttggatctaggagtggacttagccccagtaaaacggggactgagttgagcaggttggctcatgcctgtaatcccagcactttgggaggctgacgcaggtatatcacctgaggtcaggtgtttgagaccagcctggctaacatggtgaaaatctatctctagtaaaaatacaaaaattagttgggagtgatggctctcccctgtaatcccagctacgtagggggctgaggtaagagaatcacttgaacccgggaggcggaggttgcagttggccgagatcgtaccactgcactctagcttgggtgacagagcgagactccatctcaaaaaaaaaaaaaaaaaaaaaggactgagaatagggaagtggtggtttcccaggaaatattaaagagctgttaccagaaagcgaaatgaatcctggtttggtaaaaacaacagatgcctcctatacaaataaacacatgtgatcatttgcaaggagatctaggacaaaaacaaaaaatgtgcttgggaaatgcaaccgcgagagaggtattgtgaatggtgacttcgagcaagacttttccaagaaggtgtcttctcagctaggacctgagagttaggaaactgctatgaggtaggaggatgctagggaggtgtggtggttagaaggccattgtgtacgtggaaattccaggaggctaggctggctcagcctcagatgtgaggagtatggtcagagagagagagagttctgagacaggcaggaatcagagcctggtagattagagttgcttgcatcaaccccagtatcaaagatccccatctcccatgcaacaccctggcattaaagcagggaaagagagaagaaccctacagaggaggacagtaagagagtgagtggagttttcttttctgttttaattgagaagtgttagagaattgtggaatcatttctttctaggattttaagcacctctccatctgcctcaaataatcaaattccatccaattagatgctgttgccactcataatatgcaagtctacatatgtactaaacccagggcctctctgcatctggttttgatctatattttcaaagaaacctgctccccaaacttgcacaatgattccttcacagatgctgagtcagcagagagctagtgcatatttatccagagattctgatgaaaagagggagaaagaaaaatctaaaagcagaaaaatacgaagtatatggaaattttgaggtttcctgctgagttagggagaaggggttggggaatccttgaataaatcatagtgcctcacacaatggcctgctttgtctagtaaaagcacttttggttgaggatcagaaatacaaaacagtttaataatagtgagtgttgtgaggagtttcaagaatcttcgagggcatttgacttaaatgagctcagtgatggagtattcaagtaaagccagtgttgtcaatatgctaacttaaaaggctaatcaaacaggcaagtggtacaagtgaggaaaggaacacaattagttaatggaagatggagggtaatatggaagggacaaaaagttttttatttttatttatttatttagagacagagtctagctctgtcatccaagctagagtgcagtggcacgatcttggcccattacaacctccgccttcctggttcaagccattctcctctctcagccaccagagtagctgagattacaggtgtgcatcgccatgcctggctaatttttatatttttagtggagatggggtttcgccattttagccaggctggcctcaaactcctgacctcaagtgatccacctgcctaggcctcccaaagtgctgagattacaggcatgagctactgtgccaggtaggcaaaaactcttattctattcattcatttgtaaaattaagccaaagatagcatactttactttattgaaatgtaacacacacacatcagcacccttaaacatatacattcggttataatgtattggtaataacacaggaaattcattggtttcttatggggatataggacattagagtggttaaaatagtgatgatcttggctgggtggtggctcatgcctgtaatcctggcagttttggaaactgaggcaggaggatcatttgagctcaggagtttgagaccagcctgggcaacatagtgagaccctgtgtctatctttaaaataaataaataaataataattaaaatcgtggtctttctagtgaggcacagctatattcaaaatttggtccttatcctattttttgcagtaaccctcagtttcttcatctttaaaatgggactgttactagtgcctgaggttgtttttcaactgatattgagctggttgcttatagccattggtctttttgattgatggctgcctctttttggtgggtcagtgtccaaactctctcttgttaaatagttcacaaactatccttgcatagtatctttctcaaacagttatggtgaaagtttatattgcaaaaatagtacttagaatcagagatggcagatagtagctgtttactaaaagttagttgtaaccatcaatactgttgtcattacaaaaaaactgagtacaaacaatgtcttctgcatacgtgtggatgtagaatgagggagggtagatacagggcaggagagatcactctagctgcagtgggaaatggctcaaaaaccaaggaatttcgtaattcctggctggtgtaaactcattttgtaccagcttctcctcgtaggatctttcttgggtgttttatttaacccctctttaaaatggggctaataccagaaggggaatgggatgaaataatagaaccatatttagtgtctagctgagtggtttgcactggtatgtgagactttatattcttctcttctcctattacttataaaccaacaagtatctgagacaagtctcagtcaacttagaaaggttattttgctgaggttaaggttgcacccttgacacagcctcaggaggtcctgaggacacgtgcccaaggtggttggggtatagcttgcttttatacatttagggagacatgagacatcaatcaatacatgtaagatttgcattggttctacctggaagggagggacacttcaaggaggaaggtgtttccaggtcataggtagatttacacatattctgatgggcaagtggttcgtagagttaccgggagaaaagaatgtgtgggtttcaataaagggttatggagacctaggttttatcgtgcggttacagcctctaagtagcaggttttagggagaatagactgtaaatgtttcttatcagacttaaagtttgtgttgatggtaatggtggagaggggtataatgaggcatgttcacccctcagttctcatcatggtctgaaccagtctttcaggttaaactttagattgccctggtcgaggagggggtcctttcacatgatggggggtgagggtggtcaccttcaaattttatttttgatttacatactaaataaagctctctggtgaagggaacaaaaaaaaaagctttagagagggatgcagagaaaacaaaattgaagttgaaaggaatttcgaaatttgtgtgttaaaggaatgactattcagtgctgatatcagtgttgtgaaaaatggttagaataaaatgctcatgaaaatttctctttttaaaaagaaccctgactctttctgaaaataaaagtcatatttggacattatgaaaaaatttgctatatgaagtagaatctgactccccccagcctatcactcatcactcaacatttttgacgtatttcctcctcttttaaaatatcagtatatttgaattttcatagatacccattttcctccaaaacagaatcatactataaacatattttcatacaaattatctcataaacattttctagtgttactgatggtttgggaaaacatgggtttttaaaggttgttttttttttttttttttttagcatatggctatactgtagcttatttacccatttgcctactgttggatgtcaggtttttcttgacatagcctgtgataaatattaatgaaatgaacaataacaactttaaaaatgtacaaaatggacaagggagagtgaacagaggactcagagggggaaaaaagatccaatggccgtaaatataggacactgtgttcaccctctccaatgtcagatgaatgcaaactaaaaatgtgttgtcaaattgagaaatgttttgcaaagggcaatactatactgaatgcttgtgaagttaaactgctaaacatttttagaggttgctttgcaagtacaagggattttttttaagtgaaagtgattgtactttatagcctcatcaaggattattttttgaggaaacactcagagatatagtgaaaaaatgttgcatacaaggatatatggtacaaagttacctatatacactaaaacatctctcaagttttcattcaaagaataaaagctagtattctcatgctatggtacttttaaggcactaaacgatgcctgccgttggttgctgagtattaatttagtcagagctatgcatgcaggcagagctggcctatgcaggccccatttttgtgactaggaatttattctgcaccagcgtggcatagagagaaaccgagtgagtgcagtgccagctcgccgctagcttggatgaatacatgacacaccattgcgcttggagaaaatgctattcattgaaaataaaagggaatttaggaagaaatgtaatactcatcagtaattgcaaggaaactcttggatttcgttccagagtcttggtaatagtggttacataatatagcagtgaatgtatgcgtgagattagagaattttagaaggaagaaactgagattcagaaagagaccggctgtaccaaagtgtatccaaccaaaagcattcacagagagggggcagatcacatattgaacagtggtgcttttggaaaagatcatatgacagctataaagactctgatgaaaggttactagcaggttattcaaaggtactttttttgaaggcaagattttaaggcatgttagggtaggcattcaagtagggtgattttttaaaaatgtatttgcttgccgcagaagacaagtacaggttctgctctgatgcctgtcctggtcctctttcccttttaatgttagaatgtggcaaatgctcagtaatcactgagctagggatttccaaggctcttgtctttgtctgcatcccaggtccagggattgtacagttggtaaactgtaccaaagcatggagaccaggtgtttacgaggattgaagcatagttggtgctcctttcaccaagccttgtaccacaagcctagtgctgtatccatccagagacaagggtgccgttttccttactccaaatttacataagctaccagtgtttgcacccatgctgggctggccccacccagaggagggtgctttttctaactcacaaccaaacatacaggcagaaatggtcctgcctgtgcctacttctctgttagaaaagaaacactcctcttactcacactcatcggattccagttaagccactgtttgcaggggcattccctgaggaaattcgggctggagaagagagatgaaaatatctttctcaattctacctttgtataggaactccattctttgtctatccatagactattggattcccttagcctatatgtgaagaaggatctgatacagagcctaagtcttactgagagccttagaattgtctttagtgaagtgttaaatagtcgctttcaagcattcacttttgtagatgtcttcgcaggatttaaagaaagaataaaacatgccaggatatttatgaatcatgagatttaatagagaccaaagtagatcttattactgatgtgcttactgcttcattaaattccctttaaggtttgcggcttggatatggatcatttgcaataataattaggcagtgatcgattgattgggtctgacattgcacttgtcaccttgaaatgcaaaatccatctattttcaacagtgaacatttctcgctaatcttgcacaccagcatgtgatagtttattttatggagaaagtacaatttataaagtttggagacttaacattaaccttttactaagaatgaagtatcacttgtcattttacaaagaaatgaaaatcatccaaccagcaatttttttgagattagaaaacacagcctaatttcaaaagaatttttcaaatccaaaacgcatgcacttcaattgagtgctacaagtatattgtgagtattggagtttactaaaccttcacatggagtataaatgataaaattgtgagcttgagactagctctgctgtgtgtacagacacacacacacacatttagacacacacacgtctatttgtctatctatttccacatttaattccctaattctatctttgcctcaaaaaaaaaaaatgcaacactctgtttctgaaaagtgtgggtgctttccaagctgtcggaccaaagtattactgaaagttattccatttgaggatttgcacatttctttccaagttgtgatttttaaagaggggataaaaaaccaatgacctcattcttttgcatttgtatcaactttgatttccagaactttaactgttttgagtttatgacgtgtccagtctcaagtcagtatagcaatgagtaatcattgtagaattgcctattaaggggcaggcatcgttcctgatgctggaataaaatagcaaatgaagctggcctggcccatttctacacagaacctacatactagctaggaagcagaaggccaccttcagtcctgctgaatttagaaatacagtatatgaattggtatgaaaagacgttcacaatgtattggtatgttaagagatgatcagtgacaaaagctgtgtatcaaatgtatagatagattgataatctacacaccaagatgctaaaagtgattagtttgaatgatttctcttcttcacctctctgcagtttatagttttttgttaagtacatgtcttgtttacataataaaaatgacttaaagaaacgtaaataataacgaatatgcctcatacaggacaaactaagcaacaagtctggtggtatcagaatttgtacagaaaaacctctaaggtacccagcaatatgtcagaaattaccagactcgtgacttcaagtgcctttaactcttagtcatgagaaagtactattacctagtgataccatttgcaaaagaacacacaaacagatgtttctgttgtttagctgagtctctctttcaaacatccatggacaattgaaatcttccaagtatccgttggtttacacaacttgctccctattattaacaacaagagtaaaatagaatttaaattttgttttgtgtttttccacatataaaatctaaaatagttcgttactaaaagcaatcctgcaatcccacagatgtcagaatagtaatttaagaaatatgtacctatctgtatctgtatggaaattaaggccaagataagtaataacaaagtagcattgatttgttaaatgtctttgctagtgactgctgtctggaactactgaaaactgcagtattaacctctaaattgtatccctgagaccctcttcacactcacacccattcactggaattgaggatataagacagtcctgttagttgatgtaacttctcctaagggggaccagtgtagcttgaacatctacttaatcagtctggtacctcatccccatcaggacagtatgcccctctgattaaaacagactattgtcatcctgagatggagggaaattgattctaattcatggacaaggaaagagtaaaatttaaaaacataatctattcaagatcctgactttaaaagcaatggcttacctaagattacgcaaataatttatgataaaggtgggctgaaaatgttgggcttctatagtcaagtcaggacctcttgctgtgatattgctaactcctcagcctgggtatttacatcgggacaccagaaagacacatgttttcctgttggttacatattcatggtcagtggagttaaggacaattaaccaaggaactctaatgttcattttcttcaaccacttcatcctttcttgagtattgctctaccttttttgttgtgacttgcaaaaataaccaacacaaagaggctcagacaaaacacattcttcaagggagaactcactggtgtacaaaacagaaaagtccaagagatggatctcaggtacagccccaaccatattcagaaaatatactcagaaatctctgtgcttgtgtgtgtgtgcacgtgcttctgtgcttgtgtgtgtgtctttatgtttctcagctctgctttctttgattcagtcacagaaaagcccttcttggcacctacagatctccacttacattcttctagctgagccctttgagctgaaagagagcacctctgccactaaagcttggatgtttaagcaaaagtctcaggactgcctgtcattgcttcagcttaaagtataggcccatccattaaccagtcacattggcttggcagtagtctatggagattggccaggtctgggtcacatggcaacctatggaggccaatccttaatctttttctctggaaccatatggtctgattttttttttttttttttggcttcacctattttcttttttcttagttttttattttcataggtttcggggaacgggtggtgtttggttacatgaataagttcttcagtggtgatttgtgagattttggtacacccatcactcaagcagtatacactgcacccaatttgtagtcttttatcccttactgcacttccaccctttcccctgagtccacaaagtccattgtgtcattcttatgcctttgcttcctcatagcttagctcccacttacgagtgagaacatacaacgtttggttttgcattcctgagttagtctgcaatctcatccaggttgctgcgaatgccattgacccattcctttttatggctgagtcatattccatcatatctatctgtctatctctctatatatatctatctatatatggagatatataggtagatatatagattcagtcacagagatatatatctatatatctatgtagatgtatatagagatagatagatagagatatcacaggttctttatccactcatttgattgatgggcatttgcgttggaggaaccatctgatctgagaatggaggaggtattgtttcactcaggagaggtatacgtagacaatagatgctaaggaaggaaagcaattgttctttgtccagtctttgtctgtgctaatgacaactctatgaaactactcagtccaggaggatttcttacagcacaactctctggtgttcatgggactgacagttctggaatatttaaaactattcagtacccccacctcctgtcttgaattcctccttgtcctttgaaactcctttaccgtgaatctatagcagcatcatgacctgtgaagacacagtgcactttgagttcatttttcctgtgggctcttttttgttttcgtgtgtcaggttcataatgactgtgtgtgcatgaatgtgtgcatgagcatgtgtgtaaacacatacgtgagtttccatctctagaaattactgtcattcatcctggtcagagaatgtacagctttgtttaattaaatggtgaagctagttgagaattggcaaatggagtcagattgaaaaatattttacagctctttattcttcattttgtatttcttgtgttaaacagagaaagaaaaaaacacccttgggattgtaagtgatgaacttaagtctttgggattcctttataattcagtaggtcattaattctgcactacttgttgccttttggcttaaacatttgtgttttctatgtgcttagggacttctttttaatcttttagatatctgtctatctcaaggtcctggcataataataataattttatttcttgtgtaatgatttgatttaattcaaacattgtggaaatcctacgatgtgtgagctccatgctaggtgcttgagatatgaattcatgacacataatccctgccaccaagaagcacaaaatttttaaggagaattagagagtgacgtgaccagatgccctaaaaggtgtctgctggacagcattaaacagatacacaagcaaacaaaatagtatattaattaattcatgaaacaagtatttatcatgcaccagacactattcttggcagtgggcatgcaacaaggaggacatggacacgtccctaatcctacgaagcttgcattcccatgtaagccacacagttaaaacacacacacacacacacacacactaaatgaacaaatgcataattgcagcctgtggtaagtgctatgatgtcaggaaatacttctataaggaactgatatttaagcctgtttcgaaagttgggaggaccaactatgcaaagagtcagaatgcaagaacattgtatccagggagaacagaaagtgcaaagccatcgaggctgagagagattgctgggttcaaagactgagtggctggtgggtattaaacctgtgggagatcagcacactgtgagctggagagcaatgtggaaacctttattcagggatgtaaatgccttctggggcagacagacagtagatattctcatctaatgcagcatattctggggtattattagctcaaactggaagggggccactctagggtggaggctggacctcaccttaggattcctcgattcttgtacaacactcctctccttactcaggaggctttattttcttaaacacagctttattgaggaaggattaactgtacatatgtaaagtgtacattttgataacttgacttctgtgcatacctgacaaacttgactgtaatcaaggtagtgaacatctgtcaccccagaagcttcttcctacgtcgctgacatccttctttccgctcctccccttccaccctccccaaaacaaccaccaatccactttctatttctacacactagtttgccttttctagaattttatataaatggaatcatagaggaggtggagttactttttatagcttttaagcccacacagaataaaagtattctaatcttttttccatatgtctttttgtgtctgaaaaggatcttaaacatctctaacaataacctccttgttttctctacccgtggtctaaaacctgtgtttgcttgatgctaaacggtggagggatttttctgacttgaaaaaggcagagtttacctctccttttcttatctccattattattttgaaaaatgcaattgacctaggaaagaaaaagggggatgacagtgacataagattgggggggagagggtagagaggtgaaaggatgaatcaagcaaagatgctgcttcatcgttctgatcccagaaattagatgtgtggatgaccaattttcagctaattagcataaaacaaaatacatttcaggaaaattgtgctcgacacaatttaatctctgatggttcagaacagtctctgggtcatcatgagcatcagctctggaatcagaagcactggggagaaggattaatggggaactggtattcagggagctcaacatatatgctcacaatctccccattaacaaacaagaacttctttctattttatttcagtacagcttgtcctttgtttgcttcctgaataatttgaaaacatgtacaagttgaagtgtaatgcaatataagactttcagatattaaacattacatagtttaggtatacaattgattcatccattcattgatctggtaaacatttattaaacatgtactgtctccaggatatgtttctaggtactgagtatatggtggtgcagaaggtgattctgtatgtgcctgtaattgtttgtgtttgcgtatggttcagtgggatttgttagagatatgattaattgcttgtaaaataggaaagtctaccctgagcataggagtttaaagcaatgcaacaattttgcaacatccaccacagttaaaagtgtccatactctttgatcctctgatagcactagtggaaatttatcttggagatacactcacccctgtgctcaaagatgcatgtattacgaggctcatgaaggcttgtttgttgtacctaaatccccgtcaaggatggactagtgaaacgagtcatgatatatatttatggttgaatactatgcatctgtgaaaagaaggaggttggtttgtctgtactgacattcaacaaactcagacatatggtcaaggaggagaaaagcatgaagcataacgttatgtgtggtaggtttgcatttgtcaatgggatggaaaagagggcagtatacgtgcagcataggaaaatacaagacactgctaacttctgaaaatttattgatgagcaggggagtgaggatggaaaaagagccacctctttgaattactttaaatatttccaaggtgaatgtactggattttcagttttggaaagctaatcttaaaagtggaaaaatagataaaacaagtataaaggataccagtagattttctaatgttaaccttgggacctcatatattattggatgcaaacgtctacaaaggttgctattctgtcccccttctcccttgaccatgccgtgaaacaaagagaaaatgaacaaatccctgcaaccaaaccctctcaccagatttgactactgccaatgagattattgagttaccaactgcctctcagaaccctaaggcaatttggagcccagaaggaaagtgaggcccccaggtggatgtatggaaggaaggtggtgcacctttgggcccttgtgatccaggtgagtgacagagtgactcacctaaaaagagagggaggtctctgcagttggaagctgcaaatgatgatggtagaattttgcacaacccagggatcacaagcccagttttaggggaaagggctctaagagtagagacatccatataggcgcagatagtcctcctttatttaaatacaccagcagctgcaaggagtaaagggtcttgaggtggaaaagaagaggggtcattccagatccaaaaaatcgagatgactcctttgagcaatttcattcactcgtttgctgaacaaacctgaattgacaccttcttggcacagccttgcactacgtgatgaggtgaggtgctaggaccaggtcactagcattcactgaacttttcatttcatgcaagggaaagagccccctatcaggtaatctcacagacaaatatacaattaaaaactgtgataggggttattaaggacactgcagagtaaaacaaacaagcctgattatcttacagggaggaggagttataattcacctgtttatttagaaacctgctaatactaatcactaagaatctctgtgtggtggctcaggcatgtattcccagcacattgggaggctttggaaggaggattgtttgaggccaggagtgtgagaccagcctgggcaacatagcgagaccccccgtgtctcaaaaaaaaaaaaaaaaagaaaaaatagccaggtgtggcaccaccctcgtgtagtcccagcttctcggggaggctgaggcagaaggatccccggaacctaggagtttcaggctgtggtgaactatgatcatgccactgcactccagcttgggtgacagagcaagatcctgactcttaaaaaaaagatcgttcccactttacagttgactacattgaggggttgaaagatgaatttgcttgcaaaacacagcaaatatgagtggagacaagacttcagccaattaacacagggctccggcttaaggagagcctgagcacagtagttgcatagttggttattttaacaataaaatctaagaacttcgagtacacagtggctaatagctaggagggatctctgggcacgaagattagtgtagttgctctggtgacatttggcatattaacatgagacatgaagaaacctaaaccatattcattcaccatagttaaatgaggcaggagtcaacaaaatacagcctggcattaatagcctaaaaacaagatttttgagtttttcttaaaattgtgcacgtaatattacaaagtggtcatgtcacaggagaaaattttagtgactaaaggctggaatgtctgtctatatttattctagtatataactggtaaagaatatgtgttccctcccatcccagggtcagctgtgatatagaattaagatttttaactttgggtagtaaaaggacaccagggcatccatgctctccctgaaattgtgtatcgtacagtatttctggaaagaagtcttcatttgtttgttgtttttttctcctagaagggcatggcacacacacacataaaggttaagaaaaaatactgtttttgaaaagccaaataactgtggttcactatgtcgagacatgtggccaatctcattttcctacagatgttgttggacataaattgatgatttcaagaagcaaaaagaatattctgcaatgctcagtattaaggagttcagtgtgatcagatgggcctttgtcaaactgaagtattttaattaacttacaccgtaaaagtgaaagtgtaaagctttgcttttcttcctagctaatcaatgaagattaatattctatgggaacccgactttgcagacggagctgagcggcactgttttccctaccattttttcctcatagtaaataaatcatttttattatactgtatgaatttacttagctcttttaatagcctttgtaagaataatgcttcctttgattatattacatttttaaatgagtgcagtgtggaatacagttctgctgttgggggaagggtggtgagaaaaggaaagagatactgattatatcagttttatcagcttatcctgtgtgttttaaaccagataaagcagtgtctgagtatcctgggagtcttaggagtaaattactaagtatttgctaggattgaaatggctcatacctgtgccttgtataaaactacttctggggaagatgaggttagtctgaaaggacctggtctttataaaattattctgattgttattttgtacttttttttttttatcttcaaggttctggccaatctatttgattttttttcccccaaaggagagaagtaaactttataattccagggctaacatccacttgtataaattgatcagttgaattgaaaagctgctgactggctgatttagcatgttcttcaagtggtctcattcacaattgataagctgacttgtcaccctgaattattggaggcttaacccttgaaggacagatacagtttggcctatacagattgtacttttcatgagacaggaaaagggaggaagggaggtaagtgtgtgtgtgagagagataaattaatttcattagaaacaaaaatatcctgtgatcttatgcgttagaccaagtgttgaaatattaaagttcctgatgagaaaattcagaatcatacaaactttgtttttctatgtcatccatcttgtacatagtcagcaaaccaattcatttttttgagatggggtctgtcttccaggctggagtgcagtggtgcaatctcggctcactgcaacctccaccttttgggttcaagtgatcctccagcctcagactccaaagtatctgggactacaggcacatgccaccacacctggctaattttttgtatttttttttttttttgtagagacgtggtttcgccatgttggccaggctgaactcctggcctcaagttgtccgcccgcctcagcctcccaaagatttgggattacaggcatgagccaccgtgcccagcctaacaaacattcttttaacatatattgtccatcaagtcagaacctttaatagctcctattcagaacctataatagctccacactgtttatggaaaataaataatggctgaggctgaaaatttaaggttatcttaaatgcagcctcaatatgtaaactctgtgtgtgtgtgtgggtgtgggtgtgtctctctgtctgtctgtccgcaaatgggtcaaagtgaaaagctcttgtgaccttgattcacaagactcaggtttgagcttcatttctgcagtttgttagttgtgtgcttactcatctgttctaggcctctgttttatgatttgggtaacaggaatattagtaatgacagcaataatggggatgactgggctataatgctacttacctaatttaactgatgttttctggaaagaatgaaatcagaaagcatatctgcaagtgctggcaccctctgtaaggcgctgccgaattggttggttgttcttacatgaattcaggggtgagtcagacccatcgaactggagtcagagaaagccttgcaacctggacagaatggaaaattaatttttcctattgcttcaggcacatgttgaaccacggtcaattcaagtttgagatctctgcagatatatacgtttttaatttgtcaactaaataaatacacagatacataaatacattgagctttctgaggagacctggagtctgcatattctgtggagttgatttgaatggagacccaagagtgtacctctgagtcattttgggtaagagtaatgctctatagttttttatctttttttggactttgaggacttatacaatataatgaaaaacactgtttttaagtctttccgcagtaaagattcttacaaagcaaaagataaaaagtttcccttctttctcatctacttgccatgttctcctcctgttgacaatatcctcccacttccctttcgatcttgttatgtatttggttgaatcagattccattgctgatatttgactacttagatgtattgtaacaggaatatattatgcaattatgcacccgcaccattggagccacatgatgaatgtatgcaaattattatgttagcatagagtgcaatactacacagtgtcttctgactcaatatccttccacccaagaaacacatcttggagattgttgcatgtcaacatgtggagatctattttgttctttgcaaggctgcataatgtcctatgttatagatgtgttctcttttttttgtatatttgctcccttattgatgatgggcattaaagttccctcccgtgctgatggacattaaagtggcctcccactaccaagttttcacagttactcacaatggcactctcgggtcatgcatctcagtgtgtgcatgggtgatttctttttataggatatattcctagaagtagaatacttgagctttaaaaaaaatcacttgtgccttttgcatcgtgagtgcttagtgaatttataattatttgatcaataatgaatgtgcaatgaattttatgagcaaagaactgtcacctcatatttggcaaaattttctctcacctcagacttgggctattttaagaaaaaagaaacctgaaacctcttgagtttttaactttcagttgtacttaagagatcagagttggtgttcagaggcagatcagtctttacgtggaggtgctaaggttgcaaattacaaaataattaggaaagtgattgtgtgtgcacatgagtgtacttgtgtacacattttggagattttatattcaaactgcaatgaaaaaaatatgaatacctgggtagctgccattttgctatggaggtccaaggtcacatatttaatagttctaaatttatacccctgggaaggaagtatatgctcactgtaccctttaataaaggcacagaaatgtaccgtgcagtctgcatgaaagcatgagtgagtgctattcattttaagaagcactcaagcactgtgaaaattagcagtggaacatggttccaaatgaaagtgacaccatgagcctaatgagaaattgaataccatctatttatctcctctagcccaagatctttctcttctgtcatttgaatgtttctgaaacgccttttcttcctgggctgagaagtgcctcatgccttcttcccctgcctctctggaaatgagagtccttgtgctgttttcctttctacgctcatgaagagtcctgctaggtgcatggaaactttgctttctgtttacatgtgcttctctgtcttgctaactcgttgtcctaagttttaggtgtgatagctgtagtggttttcatgaagccaaatcgtaaaggtctgagaaatacacactgtgtgttgcttggcttgtcttagagcaaaccaaaatttggaaaattgtctgggaagggtaagatcacttagctgtgaagcctctgcttttaggaactggagaagtgatttgagggtgaaaatagggtaagcgtatttactctttagctccttaaggaatgcttcttcaccttcttcaactcactgagtttgtgtttgaaaaatattccaaagcctttgcttaaaaataatgtattatataatatccttcgattaagtttccaacgtgtagattcttgttagcacttagtggtgcaacttttataaagaaacctggtatttttttaattaactgatgaaaatggatgtaagtaaggggtggacattcccatgtcaatgaatcttgatggtggcctccggtcactcatggaaaaatgtatttttgattacttgtgtgccagcaacgttgctaggctttggatgcatggaagcgaataagaaatatgaaagtcctacctacatagagcttatattctaatggaaaacagaaactaattcttttgccttagttacctattgctatgtaattaccacctcatagttgctgtggactgagagtccgaaagcatgtttgctgagtagttttggcaggtgttggcaggagctaaaatagtgtcaaggctctctttgagggggaccttcactgagctctctcacctggctgttagcaggctggaagtttgctgcccacagatttacctctggaaaggtgtcttgggacaaagtacatagctcctccagaataagcaattcaagagagaatgaaagaggggacacccaagacagagaatccagtcgcttttattgctgatttaggaggtgacattccatttctcatgctgcattcttttcatccctataattaattaatctagcctgccccgaaggggagggagttacacatgaacagggatcactggggaccatgttacaggctttataccacatttattaaatgcctacgctggggagcactgagaaaagcataaaatagcagtgatgcgtataataggcaatgacacttattgggggcttcatattgtatcagctgtgtaccaagggtaaggataatgaaagctcacatatatggagtaaccattgtgccaggcactgtactaagtggccatgtgccctttctcatttggttttcataacagccctttctcagtgggtaccgatcagtacccattttacagataaggaaactgaggcacagacaacaatggcttctgaaattctcttctccgtgtcatgcactgcatttttctcccgttcaccagttgcatcttaggtctcagttcattttcaccaccttcctgaatatatagagagaaagcccatgcagtaaaccaatcaaatcctggctatccgagctgctctatctgcctctgaaagcctaggagtaaaggaaaattgtcctcatgagcagttcatgaggtgtcattcaaagcacttttgaggcaaagtattatgtttcacagccatggttcccagtagggacagcaatattgcagtgaaatgcaccaacatctctgcccatcccaaactctcctctcaaaccagtttattgaaatgaggcctcacttcacaagtaaataagtagtcaagctctggatttgtctctgctccagcttactgtatatttccactaaatgagtccattaaagcttaaactaaaccttttggaaaagaaaaacaaagcccacagcagctgtccagggctgcgggagttagaaaatgcaattcatgtgacttggtggaatgccagtgaagctaccattagattattctgtttactgttaaggtacgtggagacagacaggctctggagatgtccgacctgcatttggatgacaggtattgaccacctccttgatgccaggcatggtgctatgcagaggcatataacagcacacacaggacacagaccatcccctcaagggttttgcagtctcgtgggagtcatcaacacaagatttaaataatgtgtcatgtgtgctagggagaggaagtttggggttctttgggaggatataaccttgagaagaatcaggtagggaaagtccatagagaagggtttgtttcctctgagatacgtaggccaagaaagagttagggaagtgaagacaagaggggacagttttgtcaaacatcagctataaatactcaaaagcagctaaaataatgatatatctgcaaaactggaagcagttcagtagggttgaagaaaagatagtaaagtgagggctggaatgggagggcagagaggtggcaggttggaagactagctaagcattttgggctttgtaacaagggcattgacacatgttaaactcgggaaaaactgatcgtttcattgtacgaacagcctagcttataaagttatttaattagaaaattttcagaatacttttgattcggtggtaatgtgtcaacaaccctaaaatgttatgtgtttttctgtaaagtatgtggatgtgaagggaagcaacatggggcatgattattaagagtacagcttctggaatcagagatcatgtaagttggaattctagcttatccaattacttaatgtgtgagtttaggaaaatatctattaacttaccaccaattacttaatgtgtgagtttaggaaaatctattaacttaccacaatctatagtacctcatctgaaaaatgggaataattaattaatactgagctcatagagcttttggaagaatcaggttaggtttttacgctgcatagcacattaccacctgcagaagcttaacacaacactcttttgttatctaacagtttctgtgtatcagaaatttgagcatggcttagctgggttctctgcttaaaatctaatagactgcagtcagggtatcagccaggactgggttctcattagagactcatctcgaacaggatctgctttcaagctccctcaggttgctggcaggattcattttgttgtagctgcaggattcgtggctgcttgcttctgcacatccagaaatgggtggagagagagacagagacagagagggagagagatccagcaagagagttgctataatcttatgcaatcacttaggttgatttcctctctttgcaattgtgaattgtgctgcattaagcatgcacatgcaggtgtgtttttttatacagtgacttgtattcctttgggtagataaccagtagtgggattaactggatcaaatggtagatctatttttagctctttgagaaatctgcatactgttgcatactgtttgccatagaggttgtgctaatttacattcccaccagcagcatataagagtccccatttcaccacatccatgctaacatctattgttgtttcactttttaacagtggtcattctggctgggtaaggtggtagctcattatggttttaatttgcatttccctgatgattagtgataagcatttttttcatgtttcttggccatttgttggctattctcatcttctgagaaatgcctgttcaagtcagagactcagaaggagggaggcaaggaggagggtaaaggatggaaaattacctatcgggtacaaggtatgcaattcagttgacaggtacactcaaagccaagccttccccactatacaattcatccatgtaagcaaaagccacctgtgcccccaaagctactgaaattaaaataaaccttatataatcacatacatgtaatcacacttatcttatcacctctgtcatattccattggttagaaacaagttgtgggtcctgctcacattcaaggagggattagtaaaggcgtgaatgttaggatgtggggatcatggtgagaagaatcctcaaggatgcacaccacaagaatttggtaaaattgtacacataaggacagaatagaagcatttagccttgtgaagaattaccagggcaccgaaagagagaatggaagcatataccaaatagagcacatagagaacttgctcagatctcttaactgttgttgttctggttatgatatgatttttaggaacatgtggcagagtgtttctgtgagtttggtagcaaatacatattggatgtacttgcttagtcagttctgtgtgccagaggacactcatggggagagatcaaggttactttttgcaggtggggcattttgtaactgaataaaacccagtcagtaaaagtaagcaacatgcggaatctaggcaagtgttgcaatgtatgtgtgctcttgatctgaggaagaccatgcatttgactcagactagaaacctacaccacagaaatcccacccacaagcaatgctctattactgtaggtacaaggcagtaatttttttgtgtccattcacatatgcatgtgtgtttgtgtgtacataattgaccaactatcctcaggtttccctatggtgaatgatttattgagtcatcagacttgtggaacacctactctgtggtggccatgatgccagcctctagagataaaaagtacaataaacgagctatcttaaggaaactcaaattactttggcagacagaactagtaaactgaccactgacaattcaaaaatccatggggggagttccatttcgagttagatgggatatatttagggcaattcccatcctgtttcacttagatatgtttcactacatatcaaagtaaacttcagaggaaaaacaacaacaaaaaaccacccagacatacaggaggacattatataaggataagagggccaagtcaccaaaaagacaaaacaatcttaaacaatcatgattatttatgcacaaactatgggacttttaaaataaagccaaaactgatagaactgaaaagagaaatggagagtctacaaacataagtgaagtctgtctcactatttgataaaattaatattgagaaaattaacgaggctgtagaagtactgaacaacaccatcagccaacaaaacatagttaaaatgtgtaatcaacaccatccaacagcagcaggatgtccgttctgttcaagtccacatgagatatttaccaagataaaccatattctgtattataaaaaacttaacaaatttaaaataattgaaatcatatagttgctttcctctgacaaaattgagttaagctggaaatcagtaacataaaataaactggaaaaaatctaaaagcacttggaaattaaaccgcaaagtctaaatcacccatagttcaaagaggaagtctcaaggggaattatagaacttaaatgaaaatacattttacaaaatatatggtgggaagcgaaagcagtgcttagagggaaatacataatgctaagtgcttctattagagaataagaacgttctcaaatcaacaatgtaagtgcatatcataagagactattaaaaaaagcaaatcaaaaactaatacatgcaaagagaaagaagggaatagtaaatgtaagattaaaaaaatgaatttgaaaatcaaaaagcaatcaaacctaaatctggctctttcaaagcatagaagtgatgaatctattctagcaagactgacaaaaagcagagatgacaaaaattacaaacatcacataaattaaaaagattataaggaaataatcaaataatctatgcacatgtagtcaacaacttacatgaaatagactaattccttgacaaccattaccaaaacttattcaaaacaaacaggataagctaaatggttcaatagacttatttaaaatatcctgccaaaataaaaattttcagacacaaatggtttcattggctattccaccaaacatttaatgttgggaaaaaaaaaaaaaaactatacacagtctcttacagaaaatagaagtggaagatatacttctcaactcaatttatgagtctaacattaatctgatacgaaaaccaggctatatgtaatattttatatatgtatatatacacacacacacacacacacacacacacatacgtaaacatatatcatggaatacatataatacagaaaaataataacatagcatgaccacatagtattagtcccaggagtccaaggctggtttcatattgaaaaaaatcaatgttatgtaccatattaacacaataaagaagaaaactaacacatgaccctgtaaaatagtcctgaacagtattggaaaacaaaagctaatctacattgatgataaaaactctcaactaactagaaatagaaggcaccttctgcaacctggtagaggatgtcaacaaacaaccccacagctaatatcatacttattggtgaaaaagtgactgctatctccattagagcaggaacaagggaggagctccactctcaccaaacttatgccacatagtactggaaatcttactcactacaataaggaagaaaaagaattatagagcatatcggttggaaattaatatataagggcatctttaatcacagataatagaattgtctatttataaaatcccaaggaactctaaaacctcttaggtgaaaacataaatatcaatcatatatctatatactaggaaagaacatttggaagtcaaaacttaaaaacaaaccatttacaatagctccaaaaaatgcaatacttagctataaatataacaaacatataagagatctttatgctgaaaactataaagtatttgtgaaattaaaaaagcaaatctaaatatatacatagattcaaagactcattgtagtaaaagtattaattctgtacaaattggtgtataagtttaacacaatacaaatcaaaattctagcaggtatttttgtagctataaacgtgaagattctaaaaattataaggaaaaacaaaaactagaatatccaaaataaagaagaataaaattaggtgaatatatctaatttattttatataagcctatagaagtaaagatagtgcaaaccagtaaaggagaagacacattaatcaactggacaaaatagagactccagaaatagacccacaaaatatacttaattaaatcttagaaaaggtacaaaatcaaaggagaaatgattttgttttcaacaactggtgttggaataattgcaaacacatttgccaaatcatatgctttacaaaaaaattaactcaaaatggatcatagatctaaatataaaacgtagaactgtaaagttttagaagaacacatgggtaaaatattcacgtccaaaggagttaaaataagaatttttggccatgacaccaaatgcacaatctcacctccccaaaaaggtttaatttgacttaacaaaattgttaataaattatatgtgaaggtctctattaaaagaaagaaaatacaagaatctgtaaagaaatatttgtaaaccactcttgacaaatgttcagtatctagaatatattttgaactctcaaaacataaaagtaagaaagcaaacaaactatcttaataatgggaaaaagacttgaatagtcacttcacttagagtatattcatactcctttcttattgggtcctgagtggggggaaaagaagagaagaggatattcatcaggcaaaaacctaaaaaagaaacaaaaaaccgtgaaaaggtatttaacatcattagctattcagcaagtgcaaatgaaaactaggatggaataccattaaacacctagtagaggcataagataaaaaaaattgacaagacttagtgctgtggaggattcagagaaactggatttctcctgtactgctggtaggaacatagaacaatgcagacattcttaaaacattttgacagtccgttacaaagttaagtatatgcttatcatagagcctagcaatcctactcctgggttccttacccaaagatattgtatatttataaaaaacatgtacatgtctgtgtatagcaactctaccatagccccctagaaacaagccatatgtcttcaaatagatgaatttgaagcattacatgtacacgtggaatactactgaacaataaaaaggagcaactattgatatatgtgacaacttggatctatttcaaaagcattatgctaagagaaggaagccagtctcaaacgatgacatagtgtataaatccattcctatgacatctgcaagaaagaaagctgtaggtttggggagaaaagatcaggggctgccagggattaggggttggggggagggtagttgcaaatgaatagcacaagagagtttttggggtgatggaactcttctgcttcctaattgcacagccgttataagaatctgtaaattatgttaacatttatgaaattgtacatccaaactttcaaatttatggtatattaattccaaataaatgcaagcccatagattatatgaggataaagtctctgcatatttttgttgttatatctccagcccatagcatcattcctggcaaacattacacatttaaaaatatttgtggatggaataaatgaaaaagtgtagaattaccattgttattattatttatttattattttttgagacagcggcttcctctcttgcccaggctggagtacagtggtgccaatacagctcactgtaaccttgacctcctgggctcaggtgatcctcctgccttagcttcctgagtagctgagactacaggtgcacctcaacataattggctaattcttttaattttagtagagatggggttttgacatattgtccaggttggtctcaaattcctggcctcaagcaatcctcctgcctcaacttctcagagtgctgggactggaggagtgagccaccccacctggcaaaaattatcttttaaaagccatatgttaggagctagtttaggggaaatatggtgactacttggacatatatatttatattgtatgatgatactttacagctatagattactaataatttataaagtacattgttttatatttagaatttgcaatataagaagaagggttttgcacgagggtggggctgtggtcatttgatccagtttctgttttaagaacatgccacagtctgcagtggagaagagaaaggagagagggaaagtggaatctctaagttgtattaatgctacatcagtgactattcttctacataggtctttgtgcatatgatgtctatttaattctaaaaatggaattactaggtcaaaggttatgtatatttagaaatattacacatatattacatgaccctcccaaatgcccagtgttttatacttttaccaagtctcaggagagttttcaacgaacttgtacataaaataaaagctggtggcatggtggctcacatctgtaatgacagcacttcgggaggccaaggcaggaggactgcttgatctcaggagttgaagactagcctgggcaaaaatattttttaaaaaattgccaggtgtagtggtgtgtgcctttggttctagctactcaggagactgaggtgggaggatcccttgagttcaggaggttgaggctgcagtaagccaagatcacagcactgcacgctagcccaggtgacagaatgaaactctgtcataaataaatagataaagctgatacagtatctgtaatttgaaatatgtactgtacacttctgaaccaaccatcctccctcccttcctcgctccccctcccctcccctcccctcccctccttccttccctctctccctccctccctccctcccttccttccttccttccttcctgtaataagttgtgagttttctcataatgtcttcaccaatagggcaacacatgatagccctcatttcacattctacctaaaaacgtgaacctcacaatactcgaaaatctccccacatacacaaaaagactctatatcacatacggaaaaggtagctggctttagttcagtgatttttcaatgaggaatgctgcacttccaatgaaaacagacagccagtgtagagacagtccgtatcctgtttctactgtatgactctgattcataaattactaaagtgtattcctgacaaataaatatttcaccagccagtgacagcgttatgagctaattaaaatctgagccctggaagaagtggtgccattagctcaattcacaggactggaaagtatgtgtctgctcacggactgagaggtagacatttacatatgggaaggagggggccggcttattaagagcaacattgaggtttggatgaagagagcactctgtcaaagctgagatatttaaagaaaagccaaaatgacaatatgagaggtttcttttgcccttgggaagaaagaggtaacactgcatggtggtgttaagtgtaagggcttgggggacgggccacactgtcttgagttcagatcccagatctgccatttagcagagatagaactttggggttgtcgttcagcctttctaacctgcagcatcctcatttgtgcagtgggcatagaaatccacatagtggcaagggtataaaatcagatactacttttagatcctcagcagagtgccaggcaaatcaatagatggttgataccttgtcactagcgtcaactcttgtatccacaagaagtcatgtttaaacgtccagttttctgttaaaaatttcaaacctgtcggatgctaagcagttttctagtttgaagtttgttccttcagaaaatatggttaacacacattttttgataacttatgatgtgccaagtcatggatggttctaagcattttacggtcaacatctcatttcatcatcgcaataatatagaagatggatatcgttaactctacagaggaagctgaggaacagcagcaatgagttatttgctctaaaatttaacactttttttttttagacagatgcctaaactccctttgtttcacacaactatgcaaattgtgaggccaaggatatgactgcaaacgattaaggtttaatttacatgaatagccaggcgaagtgcctcacacctgtaatcccagcactttgggaggctgcggtgggtggattacctgaggtcaggagttcaagaccatcctggccaacatggcaaaactccatctctactaaaaatacaaaaattacctgtgcgtggtggcacacacccgtaatcccagctgctcgggaggctgaggcaggagaatcacttgaacctgggaggcggaggttgcagtgagctgagatcgcaccattgcactgcagcatgggcgacagagccggactccatctccccccaccaaaagaataaaaaataaaaaagtttacatgaatgagctttcttccccatgaaaataactgtgtcacttctcccttggtctaacccacacaaaatccccaccctgtctggcacagatacacttaacatgcaatattaagtacaatttccattttatttttctccagagtatcgtgtgtcttcagtcttgaaggactcagctccttacatgggctttggtgggggtcatggggcagcacccgcaggtctaaatcgaggtgggggtttttggtccctgtggggttcacaagatcaattcctgactactttactgtgaactgtgcagctcacacagtaacgtggcttcacatacagcttgggaagcacaaaggcatcgaagacgcttgcttcagaaacatccctgactgctgtggcctctactatgttttgaatacaaatttcttaatggccttgtctttgggcacgcgctgggcacagttcgtgcagcaaataggctgcatgtggctgcagccctttttggcatgactgttgttcttccttttcttagtcatcttggaggcaaggaccggagatcctaagttgttcttttaaatatatatgtatatatatataatattcgtctgggtacattggctcacgcctgtaatcccagcatttcgagaggctgaggcgggcagatcacctgaggttgggagtttgagatcagccaaagattttcttttagcctggccaatacggtgaaacctcatctctactaaacatacaaaaaaatgagctggatgtggtggcaggcacctgtaatcccagctacttgggaggctgaggcaggagaatagcttaaacccgggaggcagaggttgcagtgagccaagatcgcgccactacactgcagcctgggcgtgacagagcgagaatccgtctcaaaaaaaaaaaaaaaaaaattattgcagacctaagagaaaatctggttggtccttcctagaccccttttgtttaaacagctatgactgaggggagcacttcatgtggtcataaatggtggctggtgttctacccctgactgtgattataatttcagagaaagaaaagtctctgtgaactagccacaaatgcctccgaaagcataaaatcgttattcagcattctccatactttcctgtatccatggtgttgtcagcaatatgtaatattatccatagtacttatgatactgtgtttgcttggtctcaagagagaaggttaaaagtaacaatctcaggtctggttataagcattttgtaaataataacttatttgatacttattatcaccctatgcacttagccactattatccccatcttatatatactgttatgtcaaggtagggagaaataaatatgttaagaaataaatagagcagtttttgatgacagggatttacttacaggtcttttggtatatggtgtgtactgtatgtgtatgcacgagcgtgcatgtgtgtggggaatgtgtacattctgtatcatggtgtgaataagttgagagtgagagtcgggagtaagggagatgacaattgtgtggtgatgatttcaagttaagagtataaatgtggaatgaatgagtttctttcagaggactttgggttgtatatgcttcaaaacgagcttttatcttctgcattcttcctcatagccccgtggaggcaggctgaagccttggcacatcttggtaggatgacctgactgagagcaaaggtcgtttgcaagcatataaggactttattaagcagcatattaatcaggcactgttggttgcaagcaacagagtcacaatgcacctggtcttttgtttagaagagggagttcattggcttacacaactgcaaaggtccgaaagaggctgggttcagatgcacaaatacacggtttgaaatctggttctttgctgtttcttggctcagcttttcagtcttgacatcgtcctctggcaaattcttccttaatgggggctcaagtgatgcagcagctccaggcttactttctatgaaatggacagccctggtgaaaagcaaatgtctccttcctaaccattctgacaagaacaataaaatcctcaaagattttctttcaaagaataatagcatgtattaagtgccagacactaagtcctttttgtatatgaactctgttatttccttgaatcctcacaataattctgcaagataggtactatacttaaccccattttaatatggtaaaacttagttacagaacagttctgtcacttagctattgctgtgtaatgagctagtccaaagcctagtggcttgaaagagtgaccatgagtctgataaattggcaaaccaagagagcctgaatcctccagggtgacatcagcggggatagttcggttctgtacgtgtgtgtctctgatatccccagcaagctagcctggttcacttagtgaggtagagatacagcagtgagctggcacaattgtacatgcagaaggggcaaaggtactcaaagcctggagaggctcatgctaggaactgacacattctcatttctaccctattgttaccagaatatgttacaagtccagtttggattcagagggtggggaactaaactctaccacttgatgggaggatgttcatggtcatatcacaaagggctagaactggggaagaatcggaggctattttggtaatctgtctgacataatggtaacttttttttctttttactttttttttttttttttttttaagacggagtctcactttgtcgccaggctggagtgcagtggtgcaatctcggctcactgcaacctccgcctcctgggttcaagccattctcctgcctcaacctcccaagtagctgggactacaggtgcatgacaccacgcccagttaatttttgtatttttagtagagatgaggtttcaccatgttggccaggatggtcttgacaccttaacctcgtgatccgcccacctcagcctcccaaagtgctgggattacaggtgtgagccacggcacgcagtcataaaggtaattaaacttgcccaaagttagatttttagcaggattcaaaccaggaaagtctggctccagagtacaagttcttcctcattgcaatgttctttatatagtttttattgattcggcttggatagtaaccccacaattgaaccaatcattttggccaggaaaacaaagtgtttcatcggtttggttagatttgggtcctgtcttcatttctaagatgaggtacaggagtcagccctacctaaaccatgggtactggaagtggcataggaacagtagctcaaaggaaagttattttcagaagaagtaatggatagagatcaggtgacaaaataatatcccccactgatagggatatggtaggggcaattgggtaaatttcaaggataagaccttgccatgatactcttggattacaatggagagacacatttgccctatctcctggggaaaaaaattgaggaattacagttggctttaagtgtatgcatctgattgttgactagatcatgaggaggataatgtggacattaggaagaggggccttgcagaaaggggcagaaatagcaaatttcaagtgcctgggagcccccaaatcgggttgtgtgtgctatttttaaagtaccaggagacacgacaactcctagctgcaaagagacatttatcacactgaaaaaaaaaatgagtgaatggttagacagatagatggatgatggatgggtgggtgggtgggtgcatggatagatggtggatgaaaaaataagcaatgaatgaccctctagatgataagtggaaccctgctttgttttccatttcctgcttcaaatctcatttgccagcaataccaaataggatatatactcctctacttccatctatacctggcctctaatcttcttcatttttgaagattttttttttttttttttgagacagagcctagctctgtcgcccaggctggggtgcaatggcgagatcttggcccactgcaacctctgcctcctgggttcaagcaattctcctgcctcagccttccaagtagttggaattaacaggcacgtgccaccatgcccagctaatttttgtatttttggtagaggtggagtttcgccatatttggccaggctggtcttgaactcctgacctcaggtgatctacccacatcagcttcccaaagtgctgagattgtaggcatgaagccaccacgccaggcctgaagactgattatttttaagccagctgaatgggttaagtgtttgtccattgtgctctggaaattctctgagcgtattcacattattacacttaacacttttgtgaaccacatccttttaggcaaaagtgatcatctctgtctcactcattgcagtactctaatgcctaacacagagcctgacccagagagagtgcactgcaagtatattctgaatgatggagtgaaacagtgagtcagtgtgcaaataatgtgtgttgataagcatatgtagggtctgcagtggtgatgtaggttttatagccaatgacatctccagtgcctttttacttgataaatataagactataattttcttaaaagcataaataataggaagtgttctcgaagcccattcctggccaaattctttgcctttaatatcgtgcttaaattttgtcaacgcatttcttttaaaaaatggaggaaaactgagtggggaacaagaacactttctcatctcattcataatctatcaggcaatcctggggtgccatcaagaagagatgatgaggcgacagtgacacagcaatgactgccttcagttttatcatcagtcctggatagagaaggtgcaccacctataagtgaaggtgatcagtttttccatttccaaagagatgggtatcttaaaagttagaaatttgtgactttgaattgcctttttaatcataagaatcatagcttctggccgggcatggtggatcatgcctgtaatcccagcattttgggaagccaaggcgggcagatcacatgaggccaggagttcgaaacaagcctggtcaacatggtgaaaccacatctctactaaaaatacaaaaagttagccaggtgtggtatcgcacacctgtagtctcagctactctggaggctgaggcaggagaattgcttcgacctgggaagcggaggttgcagtgagccaagaccacaccattgcactgcagcgtgggcattgcagcgagactgtctttttttttttttttttttttttaaaaaaaaaaaaaaagaatcataggttctgcttagtcagtgcctacttatgttttaagttatagttggccactttacatctcttgcttctgctccggtaggtttcataatctccattttatagttgagggaatgagtacctgaaaggatggaataaactcaccataatcaacctagctggcaagtgattggaactgaggtttgaaccatgttcatttgactctgaacactgcagtctttcctgaataccatccctcaagcagagagttgggcccagatgagataggcagagcttccttagcataaagtcaatattgtctttttgccagacagtaagccaagcataaccgcatacatctgaccagaggctcttgtacaaattggccactcaggttctctgaaggagcttgatttggggcctgtgaatagtcctgtgaatattgggatacatgagattaatttttccctacatctaaacatccaaatggcttaacttccagaggggcacatcttagcttctagggggtgagaggcttcccagtatcttaaagaagtggttcttaatctcactggcaagttagaatcacctggagaactttaaaaaacattgatgactagagtcctttttttctttctttttttttttttttttgagtgtcattctgttacccagactagagcgaagtggcacaatatcaggtcactgcaacctctgccgcccgggctgaagcaattctcctgactcaggctggaattacaggcaccttccaccatgcccagctaatttttgtattgttaatggagatggggttttcccatgtcagccaggctggcctcaaactcctgacttcgactgatctgcctgtctcggcctcccaaagtgctgggattacagtcatgagataccctgtccggccagagtccaagttcatcattgcaatgttctttatctgtatatatttttaattgaactcctatgttcactgcagcattatttataatagctgagagatggaagcaacctaaaggtccattgatgggtgaaaggttgaagaaattgtgatacacagacacacacacacacacacacacacacacacacacacacacacacacacagtcactttatcttgaataacataagacaaatgtattcaggtataagtattaattcatggtgccttgcataatggtgagaggcacacatgtttatgaaggcagaagtaaactatttgtaaagctgaaaaaaaaaaaccacacacacacaatggaatagtattcagccctgaaaaataagggcagcctgacgcacacttcagcatggatattccttgaggaaattatgctaagcgaaatcaaccagtcacaagaagacaaatactgcatgatttcacttatatagctatttcaaatactgaaactcttagaaacagtgggcttatcaaaattgaaaaaaaaagatacatctttcagtaactgccataaagcaagagaatgctgccacgtggtgataaataggtcccctgacatatgtgcataaaaattgtgcccattttaacaggatacattttttcacttgtgattctgatgaaactgcaaactagagtcagaaaacaaaccgttataccaggaaataaaccagaaaataaataaataaccagaaaataaatcatgtgccttggtattttcttgcgtttcagaagtgaccttattatggcaaaactattttttgatattatggtttgtatgcatcaaaaatgcaggttttaataccaagatccatgacctagaaagaggttttagtatcagattctcaatgtttttgatgaagagggaaagagaaaacatatcatttaaaaaattattttcaatatatgacagaattttatattttgaacaagatattgttttgtatataagccatggagagtacacttgaaaagctttggcttttgagatatttggtttctggactcttgtttctgtaaattagaacattccgatgtgagatgaacatattggttgaagatcattgcaatggtcatgtttttccaaagagaagtagttgaaatcatttagtagcatgtgaataaaagcaaggtttttagaggcaattcagtaattttggtagcttttgttgcaaccaacagagaatcaatgacaagacaaggagaagagagagagcagctcttgtcttaatttaaagctgaaagatacacacatgattaataccaaagaaactttccattttattggtggaatgaaagtaaccttgtagagcttttctgtattggtagaaagcaaaagcaaaaaaattaattgtttatttaataagtggtatttttctgagttctgcttatagtttctttagacgtagaataacacatcattaagaaaaataataattgatctgccatgaaaaaaaaagaatgactgacacagcttctttgctgtcagcccttttgtactccaaaacgtaatgcccattttgaaatatcatggctaatccaaaaaatatacagctaaacagaaaaacaacatcagttccaaatatgaatacatgatctgctacttaatatgtcagggtatttgtcaggttgataacattaggctctgcggcattcaattctaagccttgcaatatttgaagtgtgatactgtgcttcagtaaatttaatacgtgggcctcagtaatggagggaatcacgttagcacttggcagtttgttatgctgtataaaattgactgccctgcaaatacaatagcgatcataaaaacggtggtcagcagagaggggtgtaatgcatttttgaggtttcagtaaaggtccagatgaaatttattgagatttttgccatttggatggtgatcaatagagctgtgctaataatttgttgtgaggatgttctctggggatatgacattttgctgtgaaactttggaaattcagaaagtagactaagtgatgatactgctccagtatatataaccgtcaaagactttaacatcgctctgggagaggatttatagtgatggtgattacttcttcaggcattgaggatgtgatgcatccaattattgatatgttttcatgcattttccagtttggactcacagtcatttgatcgtattgctgtttcagcccagagttttgtgataggtttgtttttaatttcattcacagtttccaaattgctagcctattttcttaattatatcattgatttcccctgcctcctctcccttcaccctgcccacatccagaaaatgatcgttgaagaaaagaattccgtcagctttcattcacatcaacagaggctacttagaaatcctgactgtgaaaactacttttgttgtgttgtagttgctgttgctgctgctgtagatggcttgtgtgctgtaccgaatttgcaaacaggcttctgagttaatgttaaaggagtacatagcatgcagataatgtttgtgatggttacagttttaatgcacatatgtcagtggacctgttaaatcactgtgaggcagcattctttggctttatggtggttgccgttgaatttatcttttttttttttcaattttgattagccgcgttccaagagagagagatgaattatccaatctttgcaaagtgggattccacactgacaatacagagatatcattctgagaaaaataaaataaaacaaaataaagaaggttttaaaacttcacatttggtaaaactgacttatcctgaggctgtttttatgtctgttctgtatgttagaaaaggaatttctgagttcgtgtttatttccctgttacattgttctgtttcctcagtgtatttcatgaacctgaccaattaagtttcagccctgtctaggaatttttttgttgttgctgttggattaaagcaactaagtaactctgcagtggacagaggcttagagagactccacattatttgtttgcaagaggaaatttgtcagcactttgcagaaagaacactgagactaggcacagcagaacaatttattttcaatgagcatgcacaaagtaagatttatgactttgcatcttcgatgacatttcttacattgttaccaagctacagcaaattaaagggatccgtgaatactaaggggtgtgtttttgtaatgaggaaaaagagacagagcaataagaagataattaaggtaacaacttgtgaaaaattaaagtgtttccatctttcatttttgaatctctgagcataaactttgtagttgttaatttaattgccgctgttcgcggcatccctgaagaatattgaggattaatcgtctggttcattccaacaagagataaggcctaagtgaattgaaattttaccaatttaaccctgtcttcctcctaatatgacatgattaacatttttcaattaaccacatgtaattattctgaaggcctcattccacttatttctagtctttttgactgcagattggccttttcaggtagtttggatctagaataattcaaagaaagctctgtttgttctattttgcatctggcacacaggttcatctgcattgtctttggagttgccatttcatcggaaaataaagatccataacagttgcattcatttttgcctaggtgctcttcctgtaaagcacagtgctgctcattgaagcctgaaggagtaatgtggtattgttggagcatatttgtaactgagcagagtgaaagactaaacaccttgcaggcaagaatgtcaaaggaagagattggctggaaatggttttccacagtaaatggaaagacctcaagattcgggagagtttggcatttccaaggaacagaataaaggctagttctttgtgttcgtccatatggtagccagtaatcacagtggatattgaaatgtaaattaattaaagtttaatgaaatcaacagttcagtttgtctcatattagccacatctcaagtgtccaatgacccccctgtgactagtagctgtcatattggagccaatacctagtagagatacagaacatctctatcatcttgggattttttttttttttttttttttgacagggtcttgttctgttatccaggctggagggcagtggtgcaatgatggtgcaatacagccttaaactcctgggctaaagtgattttctaacctcatccgctcgagtagctgggattacaggtgcacgccaccacacctagctaattaatttgtttgtttgtttgttgtgtagaggctgggtctcataatgttgcccaggctgatcttgaactcctggcctcaaacaatcctcctgccttggcctcccaaagtgttgggattacgggtgtgagtcacttcacctggccccatctagggaaaattatcggatagtgctaggccagagcacagtcatcaggtggatagtggttagtattaaccagggcattctaaattctgatatggcaacaaaaatctctgtaccagaggggttaatgctacatgggtttatttctctcatacacaaaatctactgcatgcctgggcaggaaggaggcatctagaagtttgcgctggggccctttcattcctcgtcatggcccatgggccaggactggatgcccatgccctgcctccctgcaacaggacttttatttcagtcttttgtttgccaactggacactaagttcctatttgtatcaccaaacactattattatttctattctataaaggagaaactgaggcccagagaagttagatagtctaaaataaatacctaaagaatgatgcagtgggtttctaggtacatctgagtccagctgcaaagtctaatctttactgagctagctggactcttctggtgcacactaggaagtcatcagaggctttccagctttagaaaacctattctgaccagcacaggtgatacggtttggctgtgtccccagccaaatgtcatcttgaactgtagctcctgtaattcccacatgttgtgggagggaactggtgggagataatcgaattgtgggggtagtttcccccatactgttctcgtggtagcgagtaagtctgatgagatctgatggttttataaggggaaaccccttcacttggttgtcattctctctcttgcccgctgccaatgtaaggagtacctttcaccttccgccatgattgtgaggcttccccagccacgtggaactgtgagtccattaaacctccttttctttatacattacccagtctcaggtatgtctttatcagcagcctgaaaacggactaatacaaaaggaaacttagaagggaacctcagattaggggcaagctccttggttagaagcctgatacgtgacaacagcaacttaactcaaaggaataatggtggtaaactcgaacacataacattatgcaacagtccctacctggtcctggagtagaaactccaaaaggggaaggttgtagttcatctgcaaatgtatgtgcacaggctcactacatgttttggctgatttttattgagcatctgtgatttgccagatattgttttaactttttagcttgatgtacattagctaattaaatactcaatatttcagtgagttagcctctattttcatggttttacagatgagaaaatgcacgtagagagaggttaggtaacttgcccgaggtgacacagcagaggagctggaattttagtcaccatcttaagaatgaagcaatgtttggagagaatggtgactcagagattcgtatcacagccaaatcatacagaaagcgctgttgactcaaatagggtaaacagataatgcaaatccaaagctttgggtgtgaggatcagatggggcaatgaggatggcgaaaggaatacctgaagtcatgagagatggtaagattgctgagagggtgcagatataaagggagaaaaataagaggccacacatgagatcttcagcaacatgactcattaaataagaccaagggtttcagtgttaaacggacttctgtaaatcttggctttggcactatgtcacatgggcaagtcatgtaactttctgggacaagatttccttattggcaacgtggaggcaaggatgctcaaagcaccagacccaaccaggacaaagaagagaatgagcatgcacatctctgcccacaaactcagtcttggaataagaagcacagttttgtgttattgtgaaacaacgttaattttatcctcatccccacttttccttcatggccaggaaatgtaaccccccattatgcaaaagataataattctcacctggggcctacaaaggtgaaggggatggggaggacctgcctaatcatctaccttcatcatctcccagatatataggctgcatttctgcaggccgtatgcttgagacttgaatatttcactaaaacaaggaacacacatccatttccctttggagagctctgctgctggataaactcagactttttttataagatggagtctggctctgctgcctagcctggagtgcaatggtgtgatttaggctcagtgcaagctccgcctcccgggttcaagtaattcttgtgcctcagcctcccaagtagctaagattacagcctcctaccacctagttaatttttatatttttagtagagacaggtttttaccattttgagcaggctggtctcaaactcctggccccaagtgatctgccttccttgccctcccaaagtgctgggattacaggcatgagccaccatgcatggtcaacttacagattttgatattcttaccagtgtctggacatctcttttataatgcagatgaaatcaatctctctctgtgtgtgtgtgtgtgtgtgtatgtgtgtgtgtttgtgtgtgtgtgtgtctgctcctcctctcttctctttctttttctattttcattatagctactctgtcactccccatgcagaacatccaacataatcacttcaacaaccagcttttggaaaagcaaaagcttcttacagacagaattgtctttctgccatgcttggcttcatccctccactaactctattccttttccttcttgagttcagagacaaagagggtcctatatacctacctgtttgagtgatggaagagaggaggaaaatcctaactaaatagccccagatagtttgcaaccaggtttttaaaatgcttaacatggttcctggcatattatctgtgctggatcaagggtaagggtaacttctactactactacttttatcagcaatggtgaggaaaggatcagagacctgagtccaccctcgacagtttcagtttttggtaaagaggcaagggagaggagaatgtttcaagaatgttgggttggtgaataaaaccaaaggccatgaagaggttgaagactgagaaatacattgattggattcttttttttttaagttcatcggtgagctttcagggggcagttttagttgctgtggacagaagacaagcattcatgtcttaaggaatgaggaattgaggaggaagctaagacccttaggatggggtgagcttgtaaaatgttggctgtggaggaggaagaaggtaaagacataagcctggaaggaagaactgacatgagttttagttgctgacttgatatccaagtcaagactgcagtggatcccaggacacctggaaaaagatagctgtctgggcattaggggattaggaatattagccaaagaatggtaggctctgtctaggtatttatggactgttctctctttctctctgcatgaaactaattcattctcattctcttattctctccttctctccctctctctctctctctctctctctctctctctctctccctccttctccctcccaatttgtccattttctgaatggacaaataaattttgtccatttttttttaaatggcttttttttttttttttttttttagttttttaaaggtcaccttctcttggttatttttctgaccacacaaagtttcttttccccactctgagtctgtatgataggattttcttcattttctgtgccacttcgctcagtttgcacttatgttttcatggctatattgtctaacttcccaaatatgtagttttgtaaggagagaaatgatttcttcaatttattgttggatacccaggacctagcatatagtatgagtttaataaatacatcttttaagtgcataaatgaatgcattgatgaatttgggggcatctttctatttttttaaaggaatgaataaaagaatgtggcatatttctaggcagagctcatcaatatctgaaccaacaattcctgtgtgaaacgctgaaagcagaacctctcagagtgatatcctgtgcaataattattggaactgggagtgagagacggagacttgaatgaggaaatatttatggggaaggtagcgttaaactttccaggatgtttccttggtatgctcataatggatttcaaagatccacacctcttggcggactccaggagcaggatttcatgaagctcttttgtgaaatgcttccattaggcgttggcatctttcccaaagggattcaagcatggtttctaagtgtctcagagcctaacgtggaattgggagagagaaggagggagtgaagaggaaccctcgttggaagtaataatgaagcctcctccagctttgcagagctctgccaggaagccaccctcagcaaaccagggaacctcctgacgatgagctggggtggtttctgaaccatgagtcatcttgtgcaaagtggctctggctttatcaggatgatgtgtctagacttgcagtcagctggggagcaagtaggaggatcctggggaggaggccgggaaataatgggtgagtgttagtgctggatccagatcgcttcctgcccttcaaggagttaagttcagggcatctattcacacccaatatttattcattattcacccacggaataccagacacagtgcttggttctgggaatctaatgctgaccaagacagataggaccccttctctgatggaccttaaaatacagcttgggcggcagctagaagaccttatcgcatgattgttaatccaagttctcaggtgtgctctaaggggaaaatgcgcagcagtcaatgagagcataaagcacggaaatggagttttgctagagtgcatcaaggatcattgttattttatttttatttttattttggaaggtggggccatttatggctccctgtaccagatgaaagattgcatgttcattaacatattaatgccatttgtagtttggatgagttaaactcatctaactttagtgtttacaagggatgagctactatagtcttttggatcccttcttctcctttacctcatcatcctatccaccagtaagttctaatccatctttcctactctgtccctgctgtcaccagcctggtcacggtccatcatattgacgaccgcaccagccttctgactggacaccatgctactgctcttgtttcttctcacctattctctgcacagcagccatagtgaccttggaaattcataaatctgtcatgtcagtccccttcccccttaagatgtttcagcgggatcctatttcttattttccttctccttcttctccatcttctccttcttcttcctccttcttcttccttcttccttctttcttctttttatctgagacagggtctcactctgttgcccaggctggagtgcagtggtgtgatcatagctcagtgcagcatcaacctcccaggctaaagggagcctcacacctcagcctcccaagtagctgggactgcgagcacacaccaccacacctgaccaatttctgtatgttttgtaaagatggggtttcatcatgttgtccaggctggccttgatctgctgagctcaagcaatcttcccacctcagccttccaaagtggcgggattatggacatgagccaccacacctagccaagtcccatttcacttaggaaaaaaatcagactggttaccatgcccgtgaaatgaggtccatgtcctgagcttcttgttgatgtcatttcgtgtcactcttccatcagcccctgtaccgcaggcgactctggcttcctgagagtccctggaacaatttaagattgtgtcctacccctgagtgtttgtatgggctcttccctatactgttctccgcatggccggctctttcttagccattgggctgtgcctcaatattattttctcactgggattttcccttatctactcatcttctggactgtcaatcagagcattttgattgataacagtttaatcagtaattatcttgtttgtatatacatgtctttaatatgtgtctccctctctaaggtcactgcattccagtgagaaccacctctactgttttgtatatgacattcccaatgccttacaccgttctgaacacagtgttgcttaaaccagtattgaatgaatgaaagatagaaagaaaatggtcagccctgagtaattttctcttatttttcttctcttttccttaatatcatctgcagacacatctgcagagtattttttttttttctgtgagaatccatttctacctatgatatagctggtttctgacccttgagatatgactccaaaattgggactgggtggttgagagtgctttaggagaggtaaaatttgtcattaatactattgtttatgtgtgcagtgtccttcatattttttcctttcatatagcatttgacatttgcaaaatgttttccatttatttttatgttggggaaagcaaaaagccgtacgtgttttttggtgtaagtgagcataaaagcaaggcatctgattcagggtgatattttttgtcattttctttgtgttttgatcagggaaaattagagagagagagaggaagagagaggagaaatgacaatgcgtccaactgttttccagccctcctccaccgcattcccgacccagctctcagggagaggactgagccactgtagaaaagtgggaacattaaacgacccaagaaaatgtgaaatggtgtggggtgtgagatttctttattagtcaatttaaaataaaatgtgcctcagtaatttagaatctgtctggagtcaagcagaaaattagccatattcccatatcctacccccgcccctggaggcagcagaagcaccaataaaaataaaaataacaataccttgtatttatggggtagctttctcccagacctccttctcactcaccctttttatcttttctgtgtccttgaaggggagtgagtgagtctctgaaacctgggagttcagctctctgcagatacgatcctcagcattaaaacttctccaaagtccttcatttgatcatacattcatccatgggtttattggttcatttatactatttagcagtgcttactgagtatctacactgtgcttactgtgtatactgcttatacacagtatatcttacaggtagtacaagatcctagcaggtactataagatcctagaaggtaagagctactactatatagtccctaggagctattactgtaatgtctattcacagacaatggaataatcttgttagttttttttctgaaaacaatcataactctctttaaaccatggtgttgtctttggaacattcatagtttggttcctgtgtagttttcaaggtccgtaaaggctgagtttcgggttgatgtgtctgtaggctttttcccttgggggaaaacgtcttcatagaatttgctcctctaggtaatagatcatgaatatctctctagtttgcaaaaatgattgtttaagaaaggacatggatagacggatagactccatttctcctcttaaagatttcctcattttgaggggtcttggaattatttgagtgtttaatgaaagcaaagaacttcctccccagaggaattgatatatgcacaaagataacaccattttgtaccgtcactttagggttcacactttctggtacccatccttggacactatccatggccacccaggttaaaacttcttcttttctctttctttttctttcttctttttttttttttttttttttgagtcagggcccctctgttgttctggctggagtgcagtggtggcacacacacagcagctcactgcagccttaacgtcccaggctcaagcgatgttcctgcctcagccgcaaaaagagctggaattacatgcatgagctactgcgcctgaatctagacctatttagaaagttcaagtctgaacatttagtgatgccatagagagccctcccttcctgccagcattcattaaatgatggttttcactctgcagagcagcttccctccgctttccccagatagtctccctcccacctacatatgagaaaataaaatgttttcctgcatcactatgaaaaagagccctaaatcaatagcaaatcaagctatggaataaaagagtctttatggcccgagaaggtgattgctgaaggttgccatttagcagtattgggtttgtgtctccctggggtctccagcagcccagtgtctctgatgtgaggcacctttgcctacatgaaagtcagcccctctccccctcccccagtggagtgcagggagataagaattctgaaacaggtcagctgacgttgttttttaaaaaggttttgttctgggcaaatcctagccggatgtgactggtctgctcttttggtaccaatcctagcttgacagtgatccctttccagacataagcacctacaagtctcaggatggttttgctgcaagcagggggtaccatcccaatcatttctttaccccctacccttttttgtttcgttttgttttgttttgttttttgtttttgagatggagtcttgctctgttgcccaggctggagtgcagtggcgcagtctcagttcactgcagcctcaacttcccgggtacaagagattctcctgccttagcctcccgattagctgggattgcaggcatgcaccaccacatctggttcatttttttgtattttaaatacagacggggtttcaccatgttggccagtctggtcttgaactcctgacttgaagtgatccacctccctcggcctcccaaagtgctgagatgagaggcgtgagccatcacacctgggcttcttccccttttgccatgtgatttttttttcttgcacttaaagcaagtgcagaacctcatatgatgatctatatgcacttactgtgttttacccctctcggttatgttagtgggggtatttaggaaccatgctcattttctgggtgtttaatagctgaattctgtttcatttagatactgataagggtcttgaaatttaaaaaatgtatctttaagcttgacatctcccagtggtatggccctgtattagggagatataaaaatcatgtatgagtctccctatacctctctctgtttgtgttcccgcacacacactacttctccatggctcctccatatggccagtcctcttccttcatatacagcctagttctctgaggttcccatcccctcaagtccatgaccctctggcggagtagccgtagtggacaggtgcaccctccttcactaccttcctttctctgcaactagtcaccccatctgtgtccacagtttgatgactggctaggggctaagagtgctgtgattaaaactgctaacttcccacttcttttgactgttccaaatgggggcaagaatgaattttaaaatgaactttgcctgtcaaagcttgtctaggttaagggatgagcaatggcacagtgtcgtttaccccagagcatgaactgtttggtcctggttcaagccccttccccatttcccatgatactgggcctcacaatccatatgcaggaacagcagatgccacgtattgaaatttctagtttctctgccactaaaaatgatagctctgcttgcttgcaatatatgttgcctttgaaatgcacttgcagtgatggtctttcctatgcaagggcagagaagaaattgtctcatcagtatactttgctgaaccagctgaacccctcgcctacccagcagctctgtcacccccactgaggctggctttctagtgacgatgaacaaaggtggtcttcagctttctgatactagagagagctaggatgcataggccatcagagttaacttttgtatttctttcaggtcttcttgggtttctcattgaaacaaagcaagaagaataagcttatgatacccagcatattcttcagcactccagaaactcagaacccagcagataacgtaaaaataacaatgcggctgggtgcagtggctcatgcctgcaatcctggcagtttgcgaggctgaggcagacagatcacttgagcccaggagtgtgagattagcctgggacacatagtgagacccccaactctagtaaaaatacaaaaatatatccaaggatgtggcacatgcctgtagtcccagctacttgggaggtggaggtgggaggatcatctgaaccaggaggtcgaggttgcagtgagccatgtttgcgccattatactccagtctgggtgacagagtgataccctgcatcaaaataatgataaaaaagaacaacgacttttttttttttttttttttttgagatggcgtctccctctgttgcccaggctggagtgcagtggtgcaatctcggctcactgcaacctctgcctcccaggttcaagtgtttctcctaccccagcctcctgaatagctgggattgcaggtgcctgccaccatgactggctaatttttttttttatttattttttatttttttgtagttttagcagagacagggtttcaccatgttggccaggctggtcaggaactcctgacctcaagtgatccgcccacctcagcctcccaaagtgctgggattacaggcatgagccaccacacctggccctatttttaatttttttttcaacttttattttaggtttgagtggacatctgcaggtctgttacacaggtaaactgcatgttcctgaagtttggtagacaaatgatcctgtcacccaggtggtgggcgtagtacttggtagacggtttttcaaccccggccttcccactcccctgcatctcatagtctccagtgtcttttgctcttatcctgatgtccatgtgtactcaatggttagctcccacttacaagtgagaatatgtgatatttggttttctgttcctgcattaattcacttagattaatggcttccagctgcattcacgttgctgcaatgaacatgattttgttcttttttatggctgtatagtattccatgttgtgtatggaccacattttctttatcctatctgccattgatgggtatctaggttaatttcatgtctttgctatggtgaatagagctgcagtgaacatgtgagtgcgtgtgtctttttggtagaacgatttatttttctttgggcatatacccagtcatgggattgctgggttgaatggtagttctgtttaagccctttgagaaacctccaggctgctttcgccaggggctgaactaatttacattctcaccaacagtgtaaatgccttcctcaaggagtaatgcctagttagaaccttgcagtcacacaagaggtatacaaaggtaagagctgccacttcaagatcagaggccaaatgaaaaactttctctttagcagaacactcaagatgagcagacaaacctagtcacagccaatctctaggaagtgacgcacaattgacttaggaaaacaaagcaaaaaatgctgttctcagggctaactcagaggatttacaccaaatactgcctggggtctgttagatcaacaattaagatgaaaacaaaactttaaaacaaatggaagaagtttaaaggcacactctggcatgctcttggtattatttacaaaggagttttcctttcaatgttgtttataaggaaactccaagaagcctgattttagcatctatacaggccattatcatattaattttttgcattaaccaacactcccctcttttgaattttcacctcatcttaagttccttctctatgtattttaaaacctcttttgctgtttacatctcaacttcggatctttttcacacgccggcaggaggctgtatacatttaacatattaaggccgcagtgccgagttccctgaacagacaacatagctgtttgatcgagaatggagattttccaagtttgattttctaacaattcaccctttcccttgtacttgtgataaattccagttgtgtagtttaaatggtcattgaatagatgtgccgctctactctctacagttttaacatggttgaatgatctcaaaatgaggcaatcgtttgagcagaaacccgaagaggcctgggaggcagagctgcctgagactaatcctgagttcggcagccccaggcacttgccctcagacaggctctgagtatgtttgtagcaaagtgaccctcgggtcaccatcacctttttcattcttccttatgctcggagatagtcatctgactttgcatgtgcctaaaatcagtttagtctgatgcatttcatttcaagaaggcacaaagataggaaacctgaagccatagtattttgcttctttcctggcttagagaatgcgtcaagggaaggggccttctggtctaccaattctgcccttgttctttttttctaaaacatttcctttctcacagtgggagacagtctttgaaaacccaggtttccagacatggaagagagaaaccaagtattggaaatcatttcctactgcccagtttccccaattctcctccttcatgtttttttattcagagtcaagactgctggacttcctggtgctgttttgatctggtggaagagagagttgcaatatgactgtttgcttgttaaggagttggcagtagtcataccactcaggatgcagggtaaagagtcaagtctcttggttttatctctcaataatcataaaagtacatccattgatcccccactccattcccactggtgagagacttttgcttaagaccactgtctttcatggattggtgcaagcttcctgtggctctttctttttcttttctttctttcctttttttttttttttttttccccgacagggtctcattctatcacccagctgtagtacagtggtgcaatctcagctcagtgcaacctcctcctcccaggctcaaaagatcctctcaccccagcctcctgagtagctgggattacaggtgcacaccaccgtgcccagctatatgcccccgcaggcctcccaaagtgctaggattacaggcatgagccaccaggcttatcctcctgtggctctttccttccctctctacacccgcctctaccccattctgacaactgtagccccagtgacttttccattaagtaatgtctagccacattgcttcctactgaagactccccaaaggctcccagtcggagcacctcttccttaatgtagccctttctatctgacccctactcactgtctcatctaaactccagccacatcccgtggcttgttatttgcaaaatatgccatgtttttctcatactcagacttttatgtatggtatttcctctgctagaacccttctccacctctgttctgactcaacagagattacaactcttaggggaagctatctgtgaacctcctgccccagccaggttgcctgttcttccctctctctttccttgtgcttattccggtcatagggctttcatggtctgttgatgtttcctattagcagcctccttctgctagaacatgcacatccgaaggacaaaaaatatgttttatttacctattggctggcaaccatttaaatgtaagaggtaaaagagacgcctccacctatctgtacaaccttggctgtgtctcttaattctttatggacctctttgtatgtcttcacggttgtgtctatattagacagtgcccaccctacgttaatgccctatgatttgagattatttgagaacgtcatgaattggtccccgggctgtatttgaaaactgctgaatcacactccattgtgcaatgtcagccacaacttccaccattattaccactcaatggtggtaacaattccataaatgatgacaccatgaagaaagtaagggatggctaccgtgtgatcaactcttaacagatattttctctattacattacgtggctcactttcaggatattttcttctctattgacaacttaattctttacgactgctgtctcctccaggaagaattattgaaaagtaaagtgatgtttagaaagagataagtcaaagattgtttggatatcagctgttaactttttgcttcttacttgcaaaatagaatagaaccagcagtgttcactgcagcatttgtgggttattaataatttactcaatctattgatgcttgttaattgaagtcgctgagaaaagttagttaatgatgtgcctgcttacaccacattataattatgatggtagttcccctattattagggctgagtaggtgttcccattagaaaccttaatttctgagctgattgtcttcaccattttaaattacattgggccacatcttggcagacactttctgaaagcagatacgctcctttccaaaattatttttgtggtagcacagaagttctctccctcaaatgacagaggctgttaagtgtattctactttcaggaactgttttattaagctccaaccagcaatgtcctatgtaaacttatcccaaaagaaagatggttgctgaactagaggctaccttggcaaaaatcagatctcactgggaaagtaaatttttaaaagtcactcatagaatgggagatgggccacatttttcttgccttcacttggattcagaatggttctgattacagtcaacagaaaccaaattccaacgtatttaaactttatattttttgacagtgagatttattggctcatgaaattaggactgcaaaagatatgttgtcttcaagcagggcagggtaaaggggttaaactaatgtcactaatgtctttacttgttcgtcatccttcaactccctcctgagtgctgacttcattctggagcagatcttcttcacagggctacttgtagcctctagaccagcactccccaacctttttggcattagggactggtttcatggaagacaattttttccagggatgggaaaatggagggaatgatttcaggatgatttaagtcctttacatttattgtgcactttatttctattattattacattgtaatatataatgaaataattacacaactcaccataatgtagaatcagtgggaagcctgaccttgttttcctgcaactagacagtcccatcttggggtgatggtaggaagtgacagatcatcaggcattagattctcataagccacatgcaacctagctccttcgcatgcacagttcacaagaggatttctgctcctatgagaatgtaatgctgctgccgatctgacaggaggtggtaatgtgagctatggggaatggctgtaaatatagatgaagctttgcttgctcacctgctgcttacctcctgctgtgtggcctggtttctaacagaccatggactggtactaggccatcgcctgaggtttatggacccctgctctagagtatattgttgacagtccctgtattgaagcaaagcaaaaccttctcacacatgggttccatatataaaacaaaagaaggtgtcaattctgtttggatcacatcctcacccctgagctgattcttggagttagaaggagagtgaattttgatttccagtctataccatgcgtccatagcggtagcacaagtaggctgtgcatagctttagtaaacccacccatggaaagtattctatcagtggaaagagagatgttgctaccagaaaaactacagaagggataatggacaaaaattaaattataaatttactactccatggttgcatccagtacctaatcccaacccttggctgacccgatagccaaagaaattgccatcaattgttaatggttatcatagttcaaaactccattaaagattttatttcaactaggatctttaaaaattgtggccttatggtctggtgctaccaaagagttagctgtgcaatcttgataaagataggcagttaggttcactggatttcatttgcatcattgatagtggcttctctgtggtgtctgtcttattggaaagatgtgagtctggtatgcgcagatgtcagtgaaaaggaatttattttgctttggaaatgcagcatgggcaaaataagttgtgtcctggttatcttgactcctggaaaaatagtttagaattgttcctaatggggtccaggtacgatattttatgtctaagcatggtggaccattttccctccctagaagagacaatggaaggtgggtggcaccgagtcttgcatgaaggcacttaatcatttgcaagactcaagtggacataaaaatgcaacagagatgttttctgagaacaaacaaaatctaggcaaggagggaaccaaggagtggccattgctggtgcataaaacctatttattcttatgaaagagagtgtgttcatttgtgattctaatatatttttttgtttgtcatttggttaattatgtagaaccatggcatggtctaatattttgtacaaaacttgtctcttaatgttataatctggctggagagaaaaattaaagcagctgaatatcctcctttcctcctgttatgaatccgtctgtgtcactggtggacataatcattttttttttaaattctgcaataactcaactttgagtctggtaatgtctctatcaaatgcatacctggaggcatgggtcagaatctcctgaactttttcatgtttattgatttatttcatttgataaacatgatctgatttactctgtggccaaactataaatgcaaccttttattttagtctttccttcctgtcccaccttccaggaaaaatttggtttagggagggaggacatgtattggattgaaaggacatctgttggccgggcaaggtggctcacgtctgtaatcccagcactttgggaggctgcggcaagtgaatcacaaggtcaagagatcgagaccatcctggccaaatagtgaaaccccatctctactgaaaaaacaaaaattagccaggcatggtgatggtggtggggggaggggggcgcctataattccagctacttgggaggctgaggcaggagaatcgctggaaccctgaagtcggaggttgcattgaactctagcctggtgacagtgagacagtgtctcaaaaaaaaaaaaaataaggaaagaaagaaaggaaaggacatgtgttttattgttctgcttgttttcagttatcatgagggggaaaagtaccatgaggaagatgccctcaaacaggctatcagatgtttttgttcttgataccaggcaggaaagagatagaggtaaattgttctagttaggcattaaacctggttttaaaaaaaacccttttaaatgacgagaatggagataaagagaaaaagcattctgttgacatctgtgtggatttgattctcaatttatccatcatcattatcatagttgtttttgttactagtatttagcaacagatttgcttaaataatgggctagaacttacaggggaatattagcaggtagaaaagcactcaagattgtttttgcacatcatagttcatcatccaaaagttatttgttgagcacctatgatgtgccaagtgttgtgagactaagaaataaccaggatcatgttactgccttggaggatcttcattcagtcggaggaagacatggcagagatacttagttacaagctctagtgctgtaaaagagacaagtgaaagatacagaggaaagggaatcactcatccatctctgcctgggagattagaaaaactaccactgaagagtgtgacacacatttcatgtgaatgtgggaggaagtttgaaagatatggtcccatcacagaaggacaatagatctttcctaagatttacctgacaagaggtcatttgcttgaatctgctcagtgacaggaccttcctacaaggcagccatttttgcaggccttgagttgttagatagtcttcctcttgttaaaactatttatatttaaacttgaaggcatttagaagatactgaaaatagtgggcagttgtaagaaaatgtgattggagaggcataaaacttagtttgggaaatggctagaccctcttcctttgtgtgtgtgtgtgtgtgtgtgtgtgtgtgtgtgtgtgtgtgtgtgtgaatatttgcatgtaccacatgttgtatacatggagcatcagtgagtatgggatacatattttaccaaatgctttatgagtattatttaatgttttcaacaactgtatgaagtttgaagtttgtattgttatgaaacccacttcataggtaaggaaactaggattacagagttttataactttgcataatgagtgagagaatagggatgttaacttttctttaaataactgtatcctcagaataatattttgacttgaattaggtagattctgtacagtataaattgctattgagctggaatattttgtgtggcggagggcatcttatgtgtgtgtgtttcttcaaggtatcaatgcaaactctccaaagcctcttgtttcagaaagataaacaactgttatcagcctacagatttttgaagaggctgagtactaccacaagatttattttaaaatcaagctgaaacaaagtttttagctttttaaaaaaattaattttgagagagtgaacttcatatcatcacctttagagttccagaatagcaagtcttgagaaaggaatcgagagttggaggattggccaggtacagtggctacttgtgatcctggcactttgggaggtcgagttcagtgggtcacttaagccaggagttcaaaaccagcctgggatacatggaaaaactccatatctacataaaatgataataatagaaaatagcaaggcatggtggtatgcacttgtagtctcagctccttgggaggctaaaatgggaggattgcttgagctcgggagttgtaggttgccatgactggagattgcaccactgccctccagcttgggtaacagggtgagcacttgtctgaaaaaaaaaaaagagtagtggaataagagaaataccaatattcccaggaattgggccatggaagagctatcagccacttgccttcctcccttctcctcccaccaaaaaaaaaaaaaaatatatatatatatatatatatatatacacacacacacacacacacacacacatatatatacagacacatatataatcattcagctattctaatatttgtatatgtaaatgtgctctatataatacctatatatgtgatgaaccatatgtagtggtcataaaattggatataaattttatgtctctataactggacattaaatctcattcctataccccattaaaaactgatctatttttccaggagccaaaataactatgtaatatacagatatgttttatatatatatctacacacacactcacacatacacacacgcacacaggtatataggtatacatgtagatagagtttcaccatgttgctcagggtggtctcaaactcctgggcttaagcaatctgcccactttggccttcaaggtgctgggatcacaagtgtgaccactgtgcctggccgatccctcaactcttgattcctttctcaagacttgctactctggaagtccatatatatatatacacacacatatatatgtatacatatgtatgtgtacatgtacatgtacatatacatgtagatataggtagtgtattatacatatatagacttgcagcatatgtatatacatatctgtacatatacatgcacatatacatatgcgtgtacatatatgcacacatacatgtacatatatgtgtgcgtatagttgtacatacacatgtagatatgcatatatgtgtacatatacatgcacatatacaggtagatacacatctatgtgtgcatatacatgtacacatgcatgtagatatatatgtgtacatatgcatgtagatatacatatgtgtacatatgtatgcacatttgcatgcagatatacatatatgtgtacatatatatgtatatacatatgctggaagtctatgtataatacactacatttaatttttaatagttttagtagttctatagtattcccttctatgagtgagacatttaatggattccttattgatgcatgttaaatggcttgagttttgttgcttttctacttcaaacactgcatctgtgtatacttctatctctctgtacttgtacatgcacaattataggataatttcttatttaatggctagatcgatttacttttcatagatattgctaatatttgccctccaagaaagttttatccgtttacattcctataatatatgtgataacctgttctctttacagcaaaaagtgcctttaaaaaaacacttcccttataacaaacatacatcctctgctgtcagattgtgaaaggctgaaggaaatttacaaggagctctcctgtttttcccctattatacttgattatgctactaaatattcagccacttccatgctattgagtgtgggagaaagcaatcgtattctcattggcacaggataagggaagcaaactcacctgagcatcgtttcagccttagaattgcaggctggaaagcctctccttgtgtgtgtgcattggctggcagctgcctgccatgaatgctacccaggctctcaaaatgggaagaagaccatatgcttgattactaaatgaattcacaggacaaactatcacagaaaacatgtgtaatatgagataccatttcaatttggcaataaatgtatggtaaatggaaggttgcagcccatgtaaaatgcacttaggatctagtgttgccatggagtcaaaggaaatgttatggcagcagataggtgcaattctgccctggaatttggcactctgggattcgttgggggcctgtggaactattcagaatccagtgaacaccaaccatggggctttgcatagcttaagtccaggcacgtgaaaatatccgaatagggtctgggagctctgaatttcaaatatcattggttatttgatctaaactggattaaggtggtggaaatgacagtatctctacacgccatagccactctacatgcagtcccacgcatcacctcattttgtggtcactgcagctcttcactgggcaagtggaaacagcttcacaaaaatcagactctaggcaagaaattggatttacatgttttccctttggttttaaagaaaatgtagataaaaatctgatagtctacttcagggaggacaaatatatttcagcttctctgttcactttgacccattggtagagacttccgaggagctgtgtttgctttttcttaattaagcatttaatgttgagatgattttagatttgtagattgacaaaaagctgtaagaaataatacagaaaaattctatgtagcttttactcaggtttatccaatagtaacatcttgaaaaactacagggttggctgggcgcggtagctcaagcctgtaattccagcattttgggaggacaaggtgggcggatcacaaggtcaggagttcgagaacagcctggccaacatggtgaaaccctgtctctataaaaatacaaaaattagccgagcgtgccggtgggctcctgtaatcccagctacttaggaggctgaggcaggagaatcacttgaaactggaaggcggaggttgcagtgagctgagatcacatcactgcactctaccctggtcaacaagagtgaactctgtctcaaaagaaaaagaaaaactacagggttagggttatcacaaccagtgattgatcttactgatgtagaaagatatactggtcttatacagacattgataccacctactgatgcaatctcctgacctttttcagatttccctagttaaatttgtactcctgtgggatgtatgtttgtctgtgtgatgtgtgtgtgtttactgtgtgtatctatgtctgtgtggtgtgtgtttgtgtggtgtgtatgtgcctgtgtcctgtgaccatgtgtttgtatgatgtgtctgcatgtgtgtgttttgtggtgtgtctatggtgcgtgcacgcacgtatgtgtgtatggtgtgtctgtgtgtttgtgtggtgcatatgtgtgcatgcatctgtttggtgtgtgttgtttctgggtggtgtgtgcatgtctgtgagtagtgtgtgtgtctgcatgcatatgcgtttgtgtggtgtttgtgtctctagtgtcagcacttgtttgtatggtatgtgtgtgtgcatgtgtgtgtatggtttctgtggtgtgtctttgcacacgtgtgtgtaattatttgtattacaaacatttatcacttgtgtagtttcatgtggccaccaacacagtgaagatatacaacagttccatcaccacaaggatccctcagattccccccatttctctcacccctacccccgtccctacctgctggcaaccactaacctgttcttcacttctgaagttctatcatatcaagaatattatataaatggtatcatacaggatgtaacctttggagactggcttctttttctctgcatactgccctggagattgtttcaagttgttgcatgtgctaatagttgattgtcttagattgctgagtagtattctatggtgtcaatctaccacccaagaatcttttttcagtagacaccctgaggctgagcaggagagggtgccattgtcactgcgtcatgcctatcccagagacagggattgagaggggtggcaagcccctggtgaacctgcttggcttacatgtatgtgctgatatttgaaagagaatcagaaacgggacaggattagcatctatgtcactctagagatcagtatccaggattcagaagggtcatgagggctgtcactaaggggactagtgataggctggaaatcacgctccatgcgctaggactatagcttccatggcagaaggcaggatttgaacatgagtccccagccactttttcagtgatctctctactccgctatagcttcagtcatctcccgcttatcgtgtgtgtttgtgctggttctggagagcgcacaatttgcagaaggcagttttgtttggatctgccaagtacaaatgtggctggctagtctgttggatagcctgacaagacccagaaatttctgtctttcctccctcccatcaaataactgggctcctccaagagccaacgcatacatcccacctgtaccaacagaatgttgtagtttgcatacttggaatggaaaaataatatttggcttggctttgatcatatatactaattattgctaatataggcaccagatgattgcattttattatacctttgtttttcactaaatatcagaattccttccttgaggggggagttgtcatactacttaattgttttgtgttttcttgacatatctaagcattatctgtgcaactgtgtcagtgtgcctgttgctgtaaatattcaagggactcataacagtattagaactaatttcttaccacaacagaatattatccctttcataattttcaattgtttcaaaggaattctgaggattcttggtttccaaacttcatatgacttttgactttttttttttttaataaagtacagcaaagagttttatgactatgtgctttagaggccagatggcattgttttcttcctgtctttggcaggtttcaggcaagttgcattagtcttctggactttgactgcctagtgtgtaaaatggcaatgaaaaagtaaacgaataaaccagactttgtttcttcttctcttctgtacttttcatcttcttcctcctcccttttccttccttctttcgtaaggttgcacaaaataatgtacattaaatgtgtaacgtgcagcatgaactacattttatacatatagataaaaactgttatacatatttttttatttgtgtcattaacttgttcttgttgattcaatgaagattacctgcagttagctgaaaagtcgtaatacaaacaattattttatggctttcttttttcagtatgatttacactgtccagttatgtctttttgaggcataatcttcatcttagttttcctggggggtttttctgtaactcctgtgctacattttcaggcagtttcttaacataggtacctatgtctattcctcctcctcctccgcctcccccttttttctccctcctccgtctccccctttcttctccctcctccctcctccctcctccttcctcctcctcctcctcctccttctttttcttcgttcaatcttggaagctttccaattcaactctaacttcttcagcccgtcttttacttatgtgtagctaataccacatttatatcagcgacaaaccttcaatggttaggaaaaagaagctaaccctttattttctctttagatgtgttggtccatttgttgtcagtgttttggttcaggttgttcccagctacccagatgactacctttcatcatatttgcagagtgtatttagtgtttacatcaagaccaacctctgggattacaaaataattttataccactttctatctctgggtgattggaagtggctatctgcagcaggactatgtggatgatgatgaggtcataggcaggttcgtggagaaagagtgctatgattgattaatgatgtctgctgtgaccatgagataggggaatgcagtatgtgtaaggaatatttgctaaccgttttaaatgaatgttctttatgcttttagcattgctttaaaatggataacaaaattcatcatatatttgctaaatacacattatacctaagtgtataaataacatttatacctaagtgtgaggcacttgaaaaactcttctagtcattattgcctgtaattctttcttcactcttaggggttaggaatcatttttaattcctattttacagattcagaaagagaggtacatgtcagtgaagtcctttgctaaggctgtgtacctactaagaatcagatttaatgtttgaatctcggctaagtaatcccagggagctttctatggaggtaaggaagaggatcaggttcacaaatgcagaaataagtgagtttttctagtgagggtttctgtccttcatttgagcagcttcctttatgactcatctttctagaatcttgcaagaatacaaaccaacatttatagaggtgatttcagcacaagcactggatgtttagaagtttctagtcagtcctaaagtgagaagacagaacacgttcaattgatttccatttgcagtgcccagaatgagaaaggtgatgtttattctccctggtaaacacactcaaaggttttggggttacccaagttgagctttccaggcaatgaaccactaaaaacatatttgttcccagaacacagccagctagtaaggttttcccactggggctgacatttactgtaacaagagcctgtttccttctctcagagctgcagccagctcctcacaagggagttggtgtcttgccagagaaacccctctaagctccaagagacgtgccagggaagccagtgcttttccctttagctgaatgtgccaataatggcagaatgatgtctgctttttaaagtgacaagttaaaatattatctacaatttatctgtccactcatccatcatctacttatatttcctctctctccatatgtatatatatgtatacacacatacatgcacacatatgtatgtatatatctatttggcgaaatgaatatatttgctcatttaatatcacagtaattctataaatataatttagcaaattttatgatgctccattgtgcaggttctaaaaatgataaaagaatctagacttctgggcgcagtaactcacgcctgtaaccccagcactttgagaggttgagggggatagatcacctgaggtcaggagtttgagaccagcctggccaacatggtgaaaccctgtctctactaaaaaaaaaaaaaaaaaaacattgccaggtacgcgcctgtaatcccagctactggggaggctgaggcaggagaatggcttgaacctgggagacagaggttgcagtgagctgagattgcgccactgcactccaccctgggtaacagagtgagaccgtagctcaaaaaaaaataatccagatttcatgatttctagataaatacaaggcaaattgaaaacagctctcctcctcctcctctttctccttcttcctcatcttttgttgttaaagaattatagacttcaaagctggagaagcagtgtggggtattccctggtcctccttccaaatgcatgttgaaatgaagacatgtgggttttcttcccgttttggccatcacctgacctaatgaccttgggccagtcacctggcatctccacgatcctgttacattgcatataaatgcagacttctttgtatgatgtctaaggtcacagagcaggtattatgcccatcttgtttatctgccaagcacagtagggcacccataaataattcctaagttactgaatgcatctgcagctcaacacttttgacatttttttttctcattttaatattggccaactgagatttgaaaaggttttgacttgcctgagttaaagcagggggagtctactggccaatttcttttgactattacgttgtttgatttggacgaaggggcagggggttgtataaacgtcactgtggagagcccttgtcccctggtgatgagtaaccttatcaatccagagcaaagaggcatgtgaggagattttgctttggaaaatggcacacagttgaggaaatttcatcaatgtgtatgaagcggctggtctggtgacgttttgctttgcaagtgggtgactgacatccttcaccctctgatctgcccattctctcctttggtccttctgttcccgttagcactccctttaacatcagtctctctccctcttcttccacctagaatctcaataagctctttcatcatctcagtttctacagagcagaataagctgaggacttttttttcaagttttatttatgtgtttttctgtttttttaatttaaaaatttaatttttttagacagtcttgctctgtcacccatgctggagtgcagtggtgcaatctcatctcactgcaacctctgcctcgtgggttcaagcgaatctcccacctcagtctttcaagtagctgggactgtaggcgcatgccaccacacccagctaatttttgtattgtttttggtagagatgaagttttaccatgttggccaggctggtatcgaactcctgacctcaaatgatccatccacttcagcctcccaaagtactgggattacaggtgtgagccaccgcacacagcctgttttttctaattttaatttcagcaggtttttggagaacaggaggtgtttggttacacgaataagttctttagtggtgatttctgagattttggtgcactcttcactaaagcagtgtacactgtacccagtgtgtagtcttttctccctcaccccctcccaccctttacccagagtccccagaatccactgtatcattcttacgtctttgcgtcctcatagcttagcccccacatatgagtgagaacatatgatgtttgcttttccattcctgagttacttcacctagaataatggttttcagctccatccaggttgctgcaaatgccattattttgttcctttttatggctgaatagtattccatggtctgtatataccacattttcttgatccactcattggctaatgggcatttgggctggttccatatttttgcaattacaaatagtgctgctataaacatacgtctacaagtgtcttttttgtatagtgatttcttttcctctgggtgaatagccagtagtgggattgctggcagaaatgatatgtgtcttttgcaaaaatccaaaccagaaaagagtaaaatttatatactatgtgtgaaaagccccctctaaatcctcttgtctagagaaaaccacttttaataacgtgtaatttcttttctgtgtatacacacacacaaatacaaacacacacaatgacatttcaaaatcgtgtgcacatcacatttctattcagttttcccctacctcatggctgtatagaagtctgttgttaaggtggtattataatttaatcaaaaatccaccttctgatcaactaagttgttctcaaccttttgcttttaaaaacattgctgttgtacttctttgtagacattgtcaggtaactgcaggagaggcaataaattttaaatggataagagaatgaattgtttgcttcttgaattaatgctttgaatcatcaactggaataggatatggagttggcagcgtgtatcacagtaacctctccctgaatttggagccctataaaacaagttgtgataatttcagtcatttcagaaaagcttctgggtcataaaggagagctactattccaaattcccacctttgtctttggtagccaaggatgcaatcctgtcagtagtcatccattttcgcaggtatctgctgggtccctacttgtgttgaatatcatgtcaaaaactgagcaggaagggattagcaagacagtctctatctctgccacaggtgtgacatgcagtcgtgaggttgtgcattgctccaagatgcctaagcaagggggcagagagggtgacacaccttgctcacaagccatgcaccctggaatgggctgtgcccacccagggtgaaaaaatggacttaatggctactagaggcccagatcataactcttctgtaataataataataataataatgataataatcattattattattattattttaccatttgagatggagtttcgctcttgttccccaggctggagtgcaatggcatgatctcggctcaccgcaccctccacctcctggaatcaagccattcacctgcctcagcctcctgagtagctgggattacgggcatgcaccaccacgcccggctaattttgtatttttagtagagatgaagtttctccacgttggtcaggctggtctcaaactcccgatctcaggtgatctgcctgcctcagccttccaaagtgttgggattacaagtgagagccactgtgcctagctcctctcctggaatgattagatttaactttgttctccaattcttagacctgtgactctgaatagggtggggatgttcatcttgatttgccttctgctagaccaggaatgaagagatggatgatattactccttttgatgtttttattcttgaatagatatgttggattctctgtctcttgccccctgcaccccaccgcatgcacatacacacacacacacacacacacacacacacacatacatacatacaccccagatttcctttgaaggagtgcatagtctatttttgttgttgttgttgttgaggtggaatctcattctgttgcccaggttggagtgcagtggattgatctcagcccactgtaacttctgcctccgggattcaagtgattctcctgcttcagccttccgagtagatgggattacaggtgcatgccagcacacccagctaatttttgtattgtcagtggagatggggttttgccatgtaggccaggctggtctcgaattcctatcctcaagtgatccacccttgtcggacttcccaagtgctgggattataggcgtgaaccaccgcacccggccggagtgggtagtctttattcaagaaaattcccaaatcagcaaatagcttgtgagcttacaggtgaggttctgagggagtgggttgtaaggaaagatagaaaactatagaggagtccatgaataaatgtgattcagaggggagggggaatatgaaagagaagaacagggtgggtaggaagatcagaggttggagaagaaggaacaggatggcctcaaagaagcctagagctgaggtggccagagcatggttaaggacagcctcgtcatcggttatgggctgtgtgccttgttgttgtcatggactggccctccttcgacacccctgagcagtctggtgaggaaggggtgagtgtaaaccatctttgccccagtctgctgtcagccgatgcactaggatgactctaaccggcatgtcaaggcagacttcagcagcatccttggatgagtgcgcactgggtggatacaggacagacagccaaaggagtgctgctccaacccatgcggcatctctcccaggttgtgaaacaactcgggggtggtgcaggatccacgctggggactgcacagacacagccaccagtagccttgctctcatttgagtttttctttctttactgatgacatcagagagaaagccccagattgctgcattggtgttctttttttttttttttttttttttttttttttttttgacagtttctttctgtcgcccaggttggagtgcagtggtgtgatctcagctcgctgcaacctccgtcccctgggttcaagcgattctcctgcctcagcctcctgagtagctgagactacaggtgcctgtcatcatacgtggctaatttttgtgtttttagtagagaagggatttctccgtgttggccaggctggtctcaaactcctgaccttaagtgatctgccagcttctgcctaccaaagtgctgggattacaggtgtgagccaccacacctggctgaaaataggatttttacggatgtcactcattaaggatctctaggtgaaatcatcctggacttagagtggaccctaagtccagtggctggtgtttcaataagagaaatggagggagatttgaaaacacagagactcagaggagaaggccacgtgaagaccaaactagagctaagagtgatgcagccacaagccaaggatgccaggaccaccagaaactggaaggaacaagaaagaccctcccatgcagtctttggagggagtgcgaccccgccagtaccttgctttaggatttctggcctccagaactgacagagaatacatttcttttgtttcaagccacagtttttgataagttgttactgcagccctaggaaactaattcactagagggctgcaaactaaggcctgagagccaaatccagcctgacacctgtttttgtagattttattgacagaaacacagccttattcatttacgtattgtctatggctgctttcactctgcaagggcagagttgaataactgcgacaaaaaccatctggcctgcaaagcctaaaatatttactatctggccctctgcgaaaaaagtgtgccaaccgctcttctagggaggtgtttaatttatgtgcttgtctggggatgctgcggggtaggggatgtttgtagtgagagtctgtctttaacagcgcagaaccacacaaggtaaggattttttttaaacttacatttcaatttttatgaagcaggttttttcctccttagaggaaaaacatgaaatgttccagaatagttgacagcattagctacatttaaaagattcaaggaagcaaaatggttttccgtctgttgaatcagtcagcattaaagttcacttatcaatgatggcttttctatgagcagcagctttgtattaaaatggctaatgggaatgtggttcccctagcaagctttggtttgatctagaatttttggagagtctgagtgggttttcttcttctcagcatgaaatggaccaaggtctgttttgcagctgagacataaaggaagtgaaaccttgtctgatatgtgctagggtgcagagccaggtaggaaatgggaaagagtgtacctcaaacctcaacagccacattgtccaccaattctcattgcatgtgaattcgtgaacctcattggcgagctcaaagaggtggctataggaaacctaattataagcatcatttggctcatactggtacagaaaaccttcaattaagttgcagaaaaatggccacacacagaagaaagaagttagaagggtttttctggtattcttggtttacatctcagtggaagcaatttttatgtcttctgcatatttcactgagaagcctccaccacttctagccataacttcctttccttcctgttacaaattttcttcctagatttactcttcagtccctaaaaatatccataacacattatttattcactccataatgtacaccatccaaatacaacaattttgccaataaactgttattctaatgaataattcatgcagtcttcattctcctgacatgaacaaatatactttcaaataggaggagtgtgcctctatttttgtcttaactccatttcttaatgtcatatatatttttaaaggtttgtgatgtccttccttggatgaactccatggggaataattctgatactctaattaagagcaataaactatagcacagaaatataactagatttatagacagtgtttgttacagtgacagtgtagtttgcatgtggagggaggaagtaggcaaatcattcagtgtctcagggcaggaaaaatgtgaagttctcacctattaagaaggcaacaccaataattgtttcaaattttgacaatattcatggccatagtttcctcatatttatatgaacaggatgtgatgataatggtgacgatgaaaatcataataacatattattatgtgatgtaatgctaagaattttgagtttctatgagatactagccatttactaaaagctttgcatatatcagggtttctgaatctcagcactatgggtatattgggtcagataattacttgttatgggccaggggttgggggatccactgtgcatttgcacgatgtttaacggaatccctgacctagggtatctgctagattcagtagcacctgcctcttcaagttgtcacactgagaaatgtctatagacatggcctaatgtccccaggagggtaaaatccccttgtagaaaaacagtgatgtacatgattaattgcatcttcaacacattcctaccaggtaggtgcattatcagtcccatttaccagtgaagaaacagaaattcagagtgaatgacagaaccaaattttggtgcagggtttactactacaccaatgtcaagactattttgttgcatatgatgatacagagcattaattcatctgccttctcctcttacatgggtattttcacattttaaaaatgtataattgcagggtgcagtggctcatgcctgtaatccctgcactttggcagggccaaagcaggctgatcgcttgagtccaggagttcaagacctgccctggcaacgtggcaagaccctatctctacaaaaaaaataaaaaaaatagctgggcatggtgacacacgcctgtggtcccagctacttgggaggatcaggtaggaggatcacttgagcctggggaggcagaggttgcagtgaaccaagattgtgccaatgcactctagcctaggtgatagaggaagaccctgtctcaaaataaataaataaataaataagtatttggtgtatgcatgctgggtaattaatatatcttatgttttgcacagacagaacttcaaatttccaaaaccccttttatagaaactgtagcatgatgaccagattaatactttttaaaacaatagcaataataacagtaacaatttatcctcctgctcctcaccactgttaattgagcactctgtttttagagatggtgtcttgctctgtctttcagactggagtgcagtggagcagtcacagctcactgccgcttgaactcctgggtgcaagtgatactctcacctcagcctcctgagtagctgagactacaggcacaggtcaccacacccagctaattaaaattcttttttttttccaagatagagtcttggcgtgttgcccatattggtctcaaattcctcagctcaagtatgagtagatgggattgcaagtgcgagccaccacttctggctaatttagcactttccatgtgagaaactaaaggatttgactggatcacctgtttaattctcacatcttagaggtacccactttgggtatcttttagccctaagctgtataattcagagttgttttgttttctttgggtttggtttctgctgtatcctcacatacagtgaagtttccatacaccttggttgaatgaatgtcttcatgagcagctacagtcttagggaaaacatgtagcttattaaggtggtgacagagcttccacttaaatccaggagatcccttgcccttaaatcctctgctgtctgctctgcgcagttgagggtttcatcaaaacgtccagctctgctctcagccatctggttgggtctgtcttttatgactttatttgtatatcaggtttccttttgcaggtgatcctaaaacacacactctcccgtcttgctccagtctgctcaccctctgcctctcacctgcgatgtctccttcatttccatttgtctgaatcttatttcttgttggaggtccagctccatcccagctttcttcccaaaccctctccctatgtcttgggcactctcaaggccttacttgccaccattgccagtcggcaattggcgaggagctgcacaaatcacaggcacccagtactaactcccaggtctaaccctccatgaactatgctcttaggaaagcagcttaaagtccttgaaaccccaatttcctcatccctatgatgaggactgcagtgtcattgtacatcccaatttgctgtgagggttcagtgggaaaatgcttagctgagcacttgacacatagtattttcttgatgaattcctgccaccgctaatgtcactttatccctgttttgtatgttccctggttgctttatgtatgtgtgcttttgaactagattgcaggattatagaaagagatttctttcagtgtgaatccttaatgtgacacaaaattcagcacaaggggtaaaactgtggccaagaggccgcctcagtgtttagaatgtaattttctctctttatgttctgaaccgtggtgtctttatcaatgacatggaaggggccatttccatttacttcaccatgccagaagggccattgcaaatggatttagttatagggtaagcaatgagcttgtgttttctgaacagctaagcctcagaactgtaataactcattatcaatctgtctccatacttcatcaaagttcccaggtgctttgaattttggcttggccattgtctttttttagctataaaattttgcttatcgcatagtttaaagtgggatgatgactgagacacatctctgcttatgagtaccacttaagagaggatatatcctcaggtagaacaatttccagagaggagatgtgggcacggggtctgtgcctgccctggaagctgtgtagtatagtaggaagaatcctacattcacagagaggctgatttttgcttccagttttgtcacaattcacatgatattgggcaatttagaaaaaaatattgatttgctttaacgttctcatctgtaaaatgaaacatcccaattagataagttataaatgacctttcatttttagaattctgcatcctggaattaaagtgcattggaatgagccaataattccatattttcttatattacctaaaatccacatactcttcaataaatttaccaccatagggttttcaaaccccatcaaaaaaaccacttctttcatgtaaatgcccagcagtttatctctttttactcctcagtaccctacacatcttcctaataaagtatataataaaagtaaatcttcccactagtgtgtttatagtgtgaaacacattgttattcccaccatggcagtggtggataaaatatacatatttctctgtctcccacaaccaccctttgatccccagccttttatcagcaaatccaaagtgctaccttctgcaaattagcactacctcctgagaaattgtgccaagttccattaaatgtaattagcattcctgttgtttccttcatattggagaaaaaaaaaagaaaactctctcttacttactgggaacacacatcatgccaagttgtagcaacagaggcagcacaaggctgaaagcaggaggcagagggggatcttgacacacaatgatgagttcacctacatgggggctcaggtggcagacacagaggtgtcagtcttggcttttaaaagtaaaagttggcttcccaatgtagagttaaacagatggcagagtgccttctgaagtgagggtttagagaacatggggagatggttatctgcctcaatttgaaactgacctgccatgagattcccaaggaagagacttgaatatcctagagcagttaactacaaaactaaaatttgccccctcagtatggttttcgtgtaaaagaattgcaaaacaaagaaaaactaccacgtgtgtattttccctagaatttcctggtagaaataagatattagtacccaacaagtagaaaagaatatgagttcagaagaaagactagggtttagtatcagacatactttttgattattcatatttcataaaatcttattttcttgacttataacaaaaatcatacaactgttttattattaacgtaaaattaaagaaaaacatcactacttttctcctcccccttttatttcaaattacgccactgactacgaaaacctggtcaaatccaacgtgcatttagaaaccataatttgaagaaactaatagctggagctcagtgccaccatccacaacagatgtccttccaaactccattcactgtcatgctataaaacagaattcagaaacaacagggtatacgtatatatctgtgcattcagtgactctgaaagggaggcactggtttcgaatgttttgtgtgaacacgagttccatttgacacttttttttttctctcagaagtcattttgtctcattccttgcttacttcattgtatttcagcatttgtcatctcaattacagtagtgcatactacttttacacttcaactgcaatattcagaaacaccagggaaagagcagtaaagatattaggaggtggtaattaagactgagaatggctccagaagggtggaaacacatttaggatgttttttattttaatcatctgtaaagaaactaattccataggcccatctacagttaagttccacttgcagcacaaagcatcataaattgaatagtaatattctttatcccaatgtcatacaactgttgtcctataatactgtgacgttgaatcataagacacacgttaaataacctattatgctcagtggtttctctgacagttgaggatgagaccaaaacgtatcccaccctgggtgacgcagagaaacgaaatgaaagacaaaccatttggtcttccaagaaagagttcagtcaatcacagtgaactggttggagtatattcattaaacaaatatttattgagcatctgctttgtgttaaatgctgaatggtgatttaagctctagatttgcctttcctggacaggttgtagaaataaatccacacaatgtgtgatctgcatctggattatttaatttagcagaaagtttatccatgataaacttttttttttcgtgaacatgaggatgaacatgaggttcatccatgtggatgcatgtatcactactttgtttctttattattgagtaatattccatggtatggatggaccacattttgtttatccatttacccatttattgatggatacgtggattgtttccagattttaactattatgtagaatgttactatgaacacttgtttccaagttcttgggtggatatatgctttcacctttcttgggtagatatttaggagtggaattgctgggttgtatggtaagtttaagtttgagcttaagaaaccactaaactggctgggcgcagtggctcacacctgcaatcccagccctttgggaggcagaggcaggccaatcacttgaggtcaggagtttgagattaacctggtgtaggtggtgaaaccccatctctactaaaaatacaaaattagccaggcgtggtggtgggtacctgtaatcccagctactcgggagtctgaggcaggagaatcacttgaacgcgagaggcggagattgcagtgagccaagattgcgccattgcactccagactgggagacaaagcgagactcagtctcaaaacaaacagacaaacaaaacaaacaaaccattaaagtatttttccaaagcggttgcgttattcaatatccccaccagcaacatacaagcatccaggttgtgccacatccttgacaactatttgtattacttatctatctttcaaattactgccattctagtgggtatgtggtgatatctcatcatcatggctttaatttgcattttcctgatgtctaatgatgttgagcatcttttcaggtgcatgatctttatgtttgtttattttttatttttaattctggggtacatgtgcaggatgtgcacgtttgttacataggtaaatgtatgtcttggtggtttgctgcacctatcaacccatcacctcggtattaagcccagcatgcattagctctttttcctaatactcttcctcctatccaccccagcccccaataggccccagtgtgtgttgttcctctccctgtgcccatgtattttcatttttcagctcccacttataagtgagaacaaagtgcatgatctttcaatgaaataaccttcttcgcctgtgaaatgggtctcagtgaatcttgaggaatcttacattactacctataatttcctttcccttataagtcagcaaaggcatgggcaggggcctgaagtgggagaaagagctcctccccctttaacgtggattcagaaatgtgtgacagggagctgagactttcgctgcctggtcatactcattgagcctatgggctggttgtgtgaacatgccacaggtaggcacatagggctcataggcaaaggatcccatttgtgcataaggcacactttgaaaggtagggtttggatccattatctcaccccaacagctgtgtgcctccagtgtgcagcttgaaagccacgtgttaccctgtcagttcaagcttcccgaggttacctcttccagccacgcagtagttggtattatttctttcatttttttgataaaatgtcttcctctctccttctcagagtaaagcaagtctctgcacatgtttctcagctgggttgcagtaatctaggaaaaggtcactctttagaggagttgaaaggactccaggttcttatattagccctctgagcatataaaggcccaaagaaacagacaccaattcctctgctgcacagacttttaaacctggaaagctgtaaatgcagaaacttaagtatctgggaggtgcgtgcttagcagccatccgatgtgagtgtcagttcattttgacatgtaaccaagatggacctcagccaatagcagtctccactcacagaccgctggtgtggttaggagcatgtacttttaatcaaattttttttattggaatcccggtgctacatgctaggtgtgtgattttggacaggctccttaactgtgttagctttggttaatgaaactgtaaaatgagattaataataattcttggttcttaaaatcatggataggattacatgagataatgcatgtaagtgcttagcaccattttgcatttctttagcttttatcgtttttatgttatatttgattttacatctttggcactgggaagaatgcctggcatatagagtgtactttgtgactataatttgaccacacacagttaagatattcatttatataatagatatgtacgaggtatctattatgtgtacgaggtatctattatgtcagtaaactatacctctcgggaaaaatccagctctcctcttgtttttgtaaatacagttatagtggaacacagccacaccccttcatttgcatatcgattatggctgtgtttgtgctacaacgacacagatgattagtgacagaaactatatgggtggcaaagcctgaaatatttaatgtttgcccctttactggaaaaggtttccgatccttgttctaggtattgagaatgaaacaatgaacacaataaggtgatattcctacttttattatagtcaaggtaagacagacacgacacatataaataaatatgtacttacctatacacatatgcacaaaacatctgtggtaataaatgtaaagaaaaaaatacagaaatgtaagacagagagaaagcaggaatggggggagaggaaaattttttagatatttcccatttaaatgcctctaatctcagaatagaattttatagtatcgctttagtaattcatttacaaggtagttttcaatagaaaaataaaaactcactaccccatgaagtctcattgagcacaaaattcaggaaccaccccaggttgcaaataaattcagacattgcctgtcataaaaagctggttcggagacaactccatttagtattgtagaactgtgcaaagaacacgacactttgctgactggcatgcatttttgtccaggagtagttttccccacatggagaatagcgacaatacaaccgcttccaatcaaaggggaaatttgtgctccttatctagcttgattgtccatggataagaccaagttcaaaagtgtcagttctacaagcaaacaaacaaaaagccctgaaggcctcaagagctgaggatgcaaggaacaagtagagtttccaacacagaggaatgataaatgctggaggtgatgggtagtgtaaataccctgacttgatccttaaacattctatgcatgtaacaaaataccacaagcacactgtaaatgggtacagatagtatgtatcaataaaaaaaaaaaagaatacaaaaagaagtagatcagggatgctttatatggttttctaccttgtgtcttattttcaggtgtgttttcacaggcactacctttgtagaacaggttgcttgctgtgacagctcctatctgagcaaattgcattattaactagattgaaccaggaggtagggcacttccacaaaattctaggacaggggtcagcaaatctcttctgtgaggagccaggtcataaatattttagattttgcaggtcttttggtctccgctgcaactcctcaactcttctgttgtagcacaaaagcccctgtggacaatgcataaatgaatgagcatggctgtattccgataaaactttagttacaaaagcagacaggatttggcctgtgggttgtggtttaccagcttctgttctagtgtagtttttccttttgtaggtgtgctcagaagatcaactggagagcagacacaacatgctcacgctctggttcctttcttctgacctattgattcagaatctctgagagtaaaggccagccatgtacacttgtactgttgtacagatgcagaaagtcagtatgtgtcaggatatgctgctgttacaaataacccccaggatgtcagtgacagcagcagcagcaacaacaacaacaaacaaaaaacatgtttattccttgctcatgcaaagcccaccatgggcatctctagggaaactttcctccacacagtgacctagtgattcaatttgtcagaggcactatcagcctgtcgctttagtttctgcaacacacagccttcttgattgacgtcactgagaaaaaccaagaggagaaggtcttccaatggtaattaaatgactgggtcactaacaatttgggcatagctacttgcaaggacatggcaaacacaatcttcccaagttcgcaggaggagagagaaattggatatgggtaaacactaaattttttttattcgttcataaattgattcaattgatgtatcgattgactgataatcattactaaacaatgtgatgtgtgcatggcaaagaacctatctgcatggtatttatgggtatatttctgtttccatcaccagaatttaaccagttatctacataagtgaaatctgaaaggaaactactctttagacctggggtcaggcaccttttactttattatactcttctacttgatggtaaaagtcattatcagttttgttaatcacatgccggacctcagatgtattgctgtcctaaaaagtcaagcacattatactgaccaaatgtgctttgatcacaggtgagacatcgggtttcacacctgttattctgcaagttatgtataaggaacatacttcatacttctttacttcctgtactgatccagtttggttggttttactgatttggttaacaagatcgtaaataatagtgaagtctctctctgtttatggttaacactgctggcccattataattttcggtggcagtgcatatggcgggtgataaactaataaagctgcagtaggaagaatagttctgcttttatttttatggctatttctttaatctgatgcataattaatgtacaaagttcaacttcgttttggtcagatcccagattactcgaggcatccggaggggttaatattttttggtgcatttgggggtaggaggttgggataaaacaacaaatttttatctatatggaaggatgcttaaccgggattttttttttttttccaaaaagaaaatacttaagttatccttgctttcagagttcatgtccattggaagtgtcaagagattctgtgttcaaacattctcaaagcaccgctttccccttaccccttacctaagagaacataattctaaaaatccctttggggaataattttctctgccttccatctctctcaatgatgtgtccaatctccacaatttgtctggcctcctcttgaactgatttacggttcaccaaaatctgtgagaggatttgccaggctgcagaccaattaattatgtttgctgttagacctgttaggtgttggcatttccattttgtcagacattttaaatttaacgtggacacatggtttccttttttttttatatattaaattaggaagctgaccacatagggggagattccaacagcaacacaatgaatttatttgagatgcattgtccttcatttgtatatagaactctttaaaaagaaattcaccatcttcccagatttttttttctttttgtttgagatggagtcttgctctgtcactcagtctggaatgcagtggcatgatctcggctcactgcaacctactcctcccaggttcaagcgattctcctgcctcagcctcctgaatagctgggataacagacatctgccaccacgtccagctaatttttgtatttttttttttttagtagagatggggtttcgccatgtttgccaggcagatctagaactcctgacctcaagtgatctgcccgccttagacccccaaagtgctggaaatataggcttgagccactgagtccagaccttcctagatattttgaacagagcctgcttttctcagagaaaatatttcttcttttgtccacagcagccctgatatccatggtgaatagtgtgttagccattttctgccttgcagaactattattataatataataatatccaaagaacagtagcaatttttatatagcatttactgtatttcagataatttttaaatgcgttttacatatattaactctttatgtccttatgtaatgctctagggagggtgctataattattcccatttttcagatagaaaactgaggctaagagaagttcagttacagataccacacacaagaaagggacagcatctctggaagtctgactcctaatcatgggtcactcttgtcatcagatgccgggcaaggtgaagccctacattctacagacgtgttttcagaaagtctacaccacgtttatgcactagtattcatttatctggtagggtcctttgattttattgggtagtgctttatgggctgataaatgaggtgacattaaggatagtaacactgttttcttcccttttctgtaaaaggtgagatggttgcctatggtgttagaaaggattgcaaaagatttacttggggaaaattagcttcctctgcactcccctgctccatttctactgtaagttattatgatgaaaaaaaaaaaaaaacctgccagaacattggcttcaaggtgaaaatatttaggcaaaatattaccacagggaaagtttattttaagcatcaaggttaaaaagacacatgtgtcagatttaggattttatgcttaaagctcatgacattgccacaaagtatttggttggcaaacttttcctgcagagggtcagataataaatattgtagggtggtggaccatacggtctgtgtcacaactactcagctttgcagttgtagagaaaaagcagtcataggcaatgcaaaagcaatggaatgttgcggcattgcagtaaatgtttttaaccacagtcagcgaggctgatttggtccacaggccatggcttactgaccccctgctatcaaggaatgaccagggatttggagataggctttcaatccttccttgtcatgtgccaggtggacggccttgtggttcaaagacttctttgaaccttgcgtagtcacaatctctctagatgttaaatagggaaactgctatgccccgatgagcatggtcatgagaactgaaggagtaccagaactgaatgaatgaagtactggattcagtaaaagaaattccatgtcatccttctctgccctctccaaacccctttggttctacttttccctaccttgtaatatttttgttaacaagtggtaagagttaattaggggtccctgagatttttagggtgcttttacattttggtaaggctagtagtagaaaagtactacctaaaagagaattaactaaattccttccttccttcttccctccctccctcttccctcccttgctctctctctctttctctcatctctctttctctcttcctctctttctcgcttgcttgcttgctctgttgcccaggctggagtgcagtggtgcgatcttggctcactgcaacctctgcctcccaggtccaagcgattcgtgtgcctcagcctcccgagtagctgggactacaggtatgcacgatgcctggctaggtttttgtatttttggtagagacacagtcttgccatgttacccaggctggtctcagactcctgagctcaagcgatctgcccatctcagcctcccaaagtgctaggattaaaggtgtgagacaccatacccgggccccagaggagagctttctgagtcaccatatgtgaagtggttcttacgtaatttctacggaaaaaaaactcagccgtcgaaatacaggaaggaaaagggttaatttctttgtaacagagatagtgaataacaagcataccactgattccaccaatctaatatacatgacacaaatcactgaaagataataatcttcactgataaactgaatgagtcttcagaagcttgttcatgacagttctttagtcattgtcagtgattcgtagttgtctcataaaatgaaacctattaggtatctttgacctagttaccttttagggtcagagactttggagattttttcagattataagctacatgaagttgttacagggttgctagtttaccttcgctttgtaaacagtgatgctcctctatagggatgtgaggttgaattccgagagtcacctgcccccctgcaaaaaaaaagaccaaaaagtaaaaagcatcttccattcttcctgaagccccctctcttcatgaaatgtcctcacattgaagcctgatgaattcgttcatgttcttggctcgaaagttcttagcagcagcagcagctgaatttctgttgtctgttcttgttttccttgtttttaccattttctagatattttatggtgaactgttgttatagaaatatggaaacaagggatagtcctaatacatcctgttgcaaagaacagaaacccagtttagactcagttaagcaaaaagggaaaatttagctttaaaatattccatagattccagaggattccagaggaggaagagcggcaggaagtacgatgaagcaaagaccaggaaagggatcagcaccctggacagcatctctttcatttctctttggaaatggagcccatcagatttgcctcacccctgacttagcactttgtactaaatcccttagaaatgccttcccttaatctccacattcctgagttttttatggcaattgcattttagctcaacttctatgtcttccaaagatcttccctgttcacaacaattacatgccctggtcataaattatcttattttctttgttgcttgtttatcatatgcaccttcccacactggaatctaagcttcctgagagctaagccttatttagaacaatgcctgacacataatgggcacacaacaatatttttgcttaaacacatgtataagtaagcgaatgatcccctaactgccaatttcctaggagagagaattgaattgccccagctgggatcagtattcaaccctctttttattagttgaggcagagtgggttgagtcagatagaacagccacttctcctggctgcctgtgtctgaagggaggtgtacttgatttggggagaaaaagaagccatggtgaatcacgaaaacatattccccaatgacaagtgtatcgtgcttgtcaatttacagagggtagtgagggtaggggttgatctcaaatttgacagaagaaacagaggtaatttttttctacctgaaaatctttaccagcacttgaggccagtgggcaccatgaaagtatcctgaacgaaagtgttttatttctctattgttattaaatagtgaaaccttcgttgggttcatccaaattttagctataagagatgctttatctattttttctttactttgtcaatagttctgaataaatgtgtgtgcttaagtgtgcttgcacatgtgtgtattttttttccaggctttcagaagcctgcattaataatctcttagggtcccgaagcaggaacatgtatgagaatacagaaccagatgatatcttcaggcagaaatttaggaagagttgactcacactgaacacaagctagttcttaggcttactgtcagaacaaaattgataaagcttaggaggacatttcatctcctttcagtgtggttcagcaaggagctatttaatgcctcctattgtcaggtgtggttttaggtaccattcgtatcaggtctctgccctcatggaaccaccattctaattgagggagtagtttaaaggggatagatgggaattaataaaccaataaagagaggctaaaatttcagactgcaatgatgacgtcattaaagaactgaaataggatgatgtgaactgaaatgatgaggggcgatgcagatggctggaggtggcctaaagcccaggaaagtggtggtggagaagaaggcaggattggtgagaagagcctggcagcacaaagatgtgtgtaaaatcactgacaggaaagggctttgtgtatttgaagatcataaaaagagtagcacagggctggaattagctccgtgaacaagtggagagaaggaagtggagaggcagatcaaggaggacttctttgcttatagcaagggggttgaattttagttttaggacaataggaagctgtggaatgaccttagagggaagacatcatccaaatgacagtgtactctgttccttagctgaagagagaaaaaaacagatgcaagtgcaagaggttttagtagaagtctaggggatacatgatggtggttatagcatatccacaaacacctcatgacccagggtgtctgttcatctgcattgcatgcatgtttttacctcctctgacatagttatttgcagccctgtctcatggtcaaaagttagccaagtgattgaagtatgacatattggctgtgcctttgtgacaatccttagtcttgtctgtttagcaaacagtatggcaagttggaattctagagcagtcacagtataccatgcttgatcacatgggtatacctaaacagttacaaacccccaaacctgattatgagctcttgtgaaacttctctaaaaatttggggcaatgtggagttacaggtagaacttgagcttttcaagtcagaaaccttagttctgaatgtttgtgcctctatgtatcaactcagaactttagaggagatccttgccctttaggtgtgtttgtgtgttgaagtgttactaacactattaataatgtttacacatgggtaatattaaccataataatgcttacttggtgcccaaagtacgtttgatactttacatatgttacctctctcaagcattacagtaaacatacaatatgcataggatagccccactttgccaataaggaaattgatccttagattaaataacatacttgaaattgtgcagtaagtacatggaggaatgtccatacaatatatctatttaaaccacctaacagtggggtattatggaagagcatatgggagcactttgcaaagtgtcaaccgcagaataagtgcttgataaatttcacattatacctctctctctctctctgcagatttcagtcacttatgaccacagaattaattctaaagaaagcaaattgaaggaggtgtttgcacgtatttttttttccctaatgattctactgtaccctggagcattttcacggtttgtgtttaatcacagaatctcagccatgatgtttctgacaggcaatttccttaatgcatttgacagagatggattacatggagggccattggacgccatggttttgtctgcaaatggtaagactagattagagctatctgggtctagtgcctccagtgatattgcatcctaataattcttatgataacatggatcacctttgtggacacacacattcttggccagatgggatacagtggttttcaagaaaccctgccacttttattacactttgagaaacatctggactaatatttgtgtgtcagaatcataaatcaatttagtttgcggagataggcctagttatgcggtttatcttcaaaggcactcttttttgctaccactgaaagtggtaaatgaggcacataaatgtcgagatattgaattccttctgaaactgtaaagtctttacactggcatatgaagatctgagcatcagtcagactctcaggtacttgatgaacaagagtgatttggattccatggcattttatccctagataacaacaaacccaacccattcttgagcaatgatacaattcccactggtgactcacttcctgaccctttctccccgtcctctgaagtatgtctcagccattagttcctatgtttattggcgcactttagtatagatcaaaggcacacagacaggttcagcgatatttgctaaccctgggaaacatgaatgctactattttgaaggatattctttatttgtcactggtatttaattgcacagatatgtacaaccattgtaaaggagattcctagatatcatgatacttatctctaatgacataaatatgtatataaatatacataaatataaatgtgtatataaatatttatataaacataaacatatttatataaacataaacatatttatataaacataaacataaacatatttatataaatataaacataaacatatttatataaatataaacataaacatatttatataaatataaacataaacatatttatataaatataaacataaacatatttatataaatataaacataaacatatttatataaatataaacataaacatatttatataaatataaacataaacatatttatataaatataagcataaacatatttatataaatataagcataaacatatttatataaatataagcataaacatatttatataaatataagcttaaacatatttatataaatataagcttaaacatatttatataaatataagcataaacatatttatataaatataatatttatatacacatttatatttatgtatatttatatacatacttacgtctttaaatataagtttcatggtatctaggaatctttgtgtccttagagattctatatgaagcaatgacattattataactaacagcattaacttaaatctatcctgccatcaagtatccagtctgtattaaaatgtattcagtgttttgaacaatattctttatgacttatttttaaaatatagctctctaggccaggcacagtggctcacacttgtaatttcagcactttgggaaactgaggcaggcaaattgcttgagactgggagtttgagaccagcctgggcaacatgaggaaaccccacctccacaaaaaaaaaaaaaaaaaaaaaaaattcagaaattagctggacatggtgatgtggtcccagctacttgggaggttgaggtaggaggaccactttagcctcatgaggtcagggctgcagtgagccatgatggtgccactgcactccagcttgggcgatggagtgatactctgtctcaaaaaataaataaaaaaataaataaaatgtagctctctagtcattttgaagtactgaaatcatatgtaagaagagtaggaacaagtagcataacacaggatataaataattaaagtaattttttcttaaagtgcatctgtccttccttaatccttctgagagattatcgatcacttaaaaaattgtgtgaagtcttacaaagaagtatatacataatatgatactataagaaagcccttggccaggcacggtggctcacgcctgtaatcccagcactttgagaggccaaggcgggctaatcacgagatcaggagatcgagaccatcctggctaacacagtgaaaccccatctctactaaaaatacaaaaaattagccaggcgtggtggcgggcgcctgtagtcccacctactcgggaggttgaggcaggagaatggtgtgaacccgggaggcagagcttgcagtgagccgagatcgtgccactgcagtccagcctgggcaacagaatgagactctgtctcacaaaaaaaaaaaaaaaaaaaaaaaaaaaaaaaaaaaggaaaagaaaagaagcgcttttaaaatcttagaaacaaaaatcgctctctgtaaaataatattcatcagcatttttcttaatggtgagaaattagaaacaacctaaatttctgacatagaaaattgcctaatttatggcggtcatattggaaaatgttcaccatgtattgtcaagtgaacaaagtggtttccatgaccgcatgggtcaaatcacagcactttaagaatcaactcacagagagaacaaatctcgagaatgtatctgactgtgtgctagccatagttatctctagatagtgagattataggccatttttatttcattttaacttttctctgtttctcacattttttgcatgcaatgtggaatatttggtaattgtgtttaacaattttggaagatcagccaactcagcaagaggtgtattatctaactggaaagaaaaccagaggtataaatacgatggaatgaaacactccctgagcctgtgtgcattctgcataggcttcttgaaatagtccatggctgcagagatggaaaagttaacataagtgctttaagttaaaatgaagaaactgttgtacatcttcctatatttcctttggctatctaagtcctgcattagaatgttctgatattttctgaatggggttttatgaaaaacctagagttaaaatttgcattgcagttagtttcaaaatgctatttagaggaagcttttagctgcatgttacagaggtctaatatggaccctaactgaagttatgcagaaaggaaatgttttgctgtgtgtgtgggtgtctgcaccttttctccccatcacccacctcgttccctgaatgctattttatactctaagcaattaagagtggtttatgctgcagacttttccaataagcattgactcattataccagtccagtatcattatcctgagttgaacatgtcctgcagcaggtttcatttattctgctgcagtcttcatttctaccatatatttggagattcagatacagatttgccttgtaattgtcaaaagtaagaccgcaagagctggtatagggcatgctacgaaggaaccaaagaatgacattgagttggctgttaaaaatgcaaattttggagttggaaaggacatcaagaaaaaggtttaaggaacagaggatacagacagctaaggattggggaaagttctttgacaccatgaagactataattgcagcctgggtagcttgataaaccactcaaggaagggttggttcaagaacatcaggctagaggcaagtcaagaccttaaggcatttggaggtgatacggagtgatttctcgaaaaggaattctcaatggatagaatcctcataggaagacctacactgattcaggtaataaggagtgatttctagaaaggaatcctcagggctgggcacggtggctcatgcctgtaatcccagcactttgggaggccgacgtaggtagatcatgaggtcaggcgatcgagaccatcctggctaacacagtgaaaccccatctctactaaaaatacaaaaaaattagccgggcgtggtggcgggcgcctgaagtcacagctactcaggaggctgaggcaggagaatggtgtgaacccgggaggtggagcttgcagtgagctgagatcgcgccactgcactccagcctgggcgacagagcgagactccctctcaaaaaaaaaaaaaaaaaaaaaaaggaatcctcaatggatagaatcctcatagggagacccacactgattcaggtattctctccagtttagaatacattgcccccactccaaaacactatgtcccccaaaacacacacacacacacacacacacacacacacatacacacacaaaatagagcacataagccactctatgcagcataattatctgtatctcattttcccttcatttgtaaactagcctaccactgggaaaaaggtaccataggttataaattactgatggggtctaggtcagcagttcccgtggttcccacagacacctgcaggcaatcccttctataactttccctatgcatccagcaagtaagttttctttctttcctccagctttctggaagaatctgttcaccattgtacatcttgatcgcctttatgtctgcaataggcccaactcacatccataagaaaaacagatcattctcctaattgaaatagaagagcttgggcaagacatcaattagtgatgcaaatgtagagttcttcattgagcaatgacaaaatcccaagacttattagaagaccaataagaaatggaaaaccatgatttactggcagggctagcacagttaaatttaaaataaaaatcttggccgggcacagtggctcactcctgtaatcccagaactttgggaggccaaggcgggcagattgttctaggtcaggagttcgagaccagccttgccaacatggtgaaaccccgtctctactaaaaatacagaaattacccaggcatggtggcacacctgtaatcccagcgactcgggaggctgaggcaggagaatcacttgaacgcaggaggcggaggttgcagtgagctgagatcacaccaccgtactccagcctgggtgacagagactccgcctcaaacataaataaaataaaaataatataaaataaaaaataaaacttccctcattgtttttgttgtcagcctttacaagcattgatgcttccaactcttccacaaattcccaacaggtatttttacatatcatccaggcattttttttttctttcctgagtgatactctgatctctatctgatgagctggagagtgacctaagttagaagggaaagtagaggaggttgctaagagggtaggtgtagtactgaggtatagagggttggtagagtggtattgctactcagaaaccagtaccacatgaaatcagaaattcagctccccagaaatcagtgccattccatcaacaaacagatccactgtgttctcctggccttgcatggttctaggtttgtagagcaagtttttaattcgggtttatggcattgctcatattcgccatttcagtcatttttggtaacagttacgttgagcttatctgcatagacgcacatgatgaacaaggattgactattcttcagaggatgttaactgtttagagaatcatgaaggaagcatattttacaaagaccttttttttttcctggacttctccctaatcatctcaatcagaaccttgaaaaaggggcccaggaatgcgaagtgtatgcctgtctcccacccccacatagtgtctagatgatcaatcctattcggggaccccttggatgtgagtgtgatatcattagaacataatgaaactgtgattcctaacccagaggaaaatccatcttaattcttcaccatcatactttatagttagtgctctcttccaaaggaaacccctttcaacccctctcattttttaatatggaactttgtcttaataatggatttcttcagtctttaatatttgatgggagaagtaattccagtcatggcacatcagaaagttgctttttttcctctttctaataagacgtataatccgttgctgacaaaaaaagaaaaaaaaaaaaacagcacattgctacaatatttcctggatgctttacaatacactgtgacaaatggcgcctcatgttgtacaattgtcctcatggcttgtaacacatcatttaatgaattgatcacagtggaatgtaaagatgaagcagcatttattttgtatgttatattgcatataatttttagagttgacatttataaccatggaagctgttattttacatatcatcttcaaaccatatcagccttaaacacatttaaatttaataagcaagtagattagatttgcttttaagctaggcatatcattacagtgcgtgtttccgtcagaagggcatgctcacgattaaatactgtcttcagttgttttaaagaaacaaaaattttaaagaagggggttagagcgaaagctgaaataattgagtatgaagccctaagaattctctgtggtggacaactgtaagcatagccttctaaccattgaggcgaaagagtccgtttggttttattaaccatcaccaggcaactttgaggcagaatgtaagccttgggaatgaaatgcaaattctataataggaacatcattgtgataataatttattaaatttcctgagccgtctccctctaaggagggctgcacaaacggccctggtgattaatgttcaacatcgtttaacattttattagagggaaacagtttttaatctattgatgccctgtctgtagaattctacgagctgttttcaaaaccagagaaagggggataaaaaaagaagcaaaaaataattggtgggggaagggggtaggtagtagaaggaattcgcaatagcggttctagttctgatgccagatttctcagaatctcctgtgttttactggcattttattgttttagcctcttggtagcctgttgatgttttgtgcaaggagagagagtttccttgtgaatctgacgttagggaaaatgtcatattcagtggagaggttccatctaagagagttggggtgagaaattggctgaactgggtgcttctctgaatcctagtagtgtttgcttaggagctttagactcaaatgcctatagaggccagaagggtcccttcaatggagattataatacgtggaatgtagtaaagtacttagcaagcactcttcactttgaataaatattgaggtactgaagcatcaactgtgagaagaccaaagacaaataacagcaaaatactatgtgaaatcatagaggagatccagacacacgaaaagggggccaaatggaaaaactaatgcaatagacagtttagatcatagtattgtttcgacgtcaatttcctggtacccatcattgtattatgattaagtatgatgttaaacattaggagtgactgggtgagagacccaggagtgctctatattatttttgcaatctttctgtgagtctaaaagcatttcaaaataaatacaacatttttaaaaagtaaaattggaacatacaaaacacactaatacggaagatgaagtccgaggatcatgtgcttacaacattgttacttcgccagtctcacaccctcttctgagaacaatgtaaaaagcagagagaaagatctcttcccctcctctttgtgtcgacagacatctttgggttggacaaggtggtaggcaaaataatgcccttgccttacctatggccatgtcttaatctctggaacctgtgagcatgttgggttacactgcaaaggaaaattaagattacatgtagagttaggcttgctaatcggttggccttgagataggcgcattatcctggattatctggatggatccaataggattacatagggttgttataagtgaagagggaggcagaagagagagagtatcagagcagctcttcctgaaaagaactcaacacattattgctgtctgtaagatggaaggaagccatgagccaaaagcagcaggctgccgctagagtctagaaaaggcaagaactcagattcttccctagaacctccagaaaagaacatgccccacaaactccttaattgtagctggatgagacctgcatcagatttctgaactacagaactataagatgggttgtttgtgttgtttaaagccatcatgtttgaggtctttgttacagcagcagtatcaagctaatacaggcaagtaatcaatataactgcaaatgcttttatggtccttacacgtgccagatgctcttatgagcattttacatgcattaccgtccttgatccaatgaggcaggtactacattgtgtattctgctttataactgaggatactgcaacagtgtgatgttaacttgctcgctgtcacagagctggtatgtgacaaagcagatgcttagtcagaaatacagagcccatgctctgcaccagcaaccatggtagacagctcagaatattagtactagactctagcacaacaggtcctagaagatattatggtaatgtatttacgtaactcaaaatgatcagacatgtcacaagaatgaaagaatgacagactaaaatcttcttggagagttgactggaaggataagatattctagtagcagttgaaaatatagtagcatctatctctagctatcttttttttttttaaggattggctaaaaatagtctttcccaagtataagccgtatcatattattatggatttagacgggtatacatgatgctattaaataacattgaatcaattattgggagaaggagttattctctttccatttctctttccattaccctattcgtgtcaatgagaaagtctttatttggtactagagtgtcttaaacatctctctaatactttgtgatctctgtttttagtaataaaatggaagcctccggctcagtgtctacaggtaatggttgttagattttaataacttgtgattgcactgtatttattttatggctaccttttattcagaataagtgatattgttattttatcatttacattactgatatccagttgccttttaaaaataatgcatttcaatttaaacaaagcacatcaatgtaaaaagatactaagcagctgacaatttatgattatggtacaggatgaccgtctagtgactttggcagtggaacggctagagtttgggaaaatctagctctttggggctaaagatttcaaaatgtacatttaaattaccaaacagatactcattactaaaactcaatgcctgaaaccatctttgaatccattctgttttctacccctttcccagaaacacttcgttttattacatttagaaagtggtgaatttagcccaggcacagtggctcatgtctgtaatcccagcaattttagaggttgaggtgggtggattgcctgagccctggagtgcaagaccagcctggggaatatagtcaaacctcatctctacaaaaactacaaaaattagctggacgtggtggtgcatgcctgtggttctcgccactagggaggctgaggtgggaggattgcttaagcctgggaggcagaggttgctgtgagccgagattgtgccactgcactccagcttgggctacaaaatgagaccctgtttcacaaaaaaaaaaaaaaagtgaagaattcaaagacagctgaataacacctttcaatattttatcgaggttaataaaattgattggttcttaattagttgtttattgttcttctaattctagcaacaaaactttaaaaaattatactctctgaattttaataaagagctcttcagtctatcaacacccttaagtctgtcaacttcaccatgttttgtgcctcatattgcatttcttgttggaccagccatattaggagttggggtggactctgttcatggactgagtttcccagaatagccttatatttggtgataatgtctctggctgagcctcattctcttaaattaatttcatcacacaggcttgcaaaataaggcttcttgtgaaagtcttggttgcagtgtcttttctagccagtttcaccaatgacctggtgtgcaaatttgtccactgtaagagtatcaaagacatattgagaggaggtgatcattattacacgacctgggcaggtggctgtcctctaatattggcaaggcaaaacagaacaactgacccaacagcacagatttgaaagactgtttgaggacctacgatgcttgctcttgctctctttatttatgtatttatttatttgtttgtttatttattgagacagagtccaactctcttgcccaggctggagtgcagtggtgggatctcaactcactgcaacctccacctcccaggttcaagcgatagcctcagcctcccgagtagctggaactacaggcctgcaccaccacacttggctaatttttgtatttttagtagaaacgggatttcaccgtgttggccagactggtgttcaactcctgacctcaggtaatctgcctgcctctgcctcccaaagtgctggggttacaggcatgaaccactgtgcccagctcgatgctcataattttagaaaggtgcctggtttatatttcttataaatgtgtcactgaataaaggttagcccacgtgatatgattttttctttcattctctactgccacactgctatttgtggcaagatctaaggagtttcttccaggctgtcaccgtctgaaaaaaaaaatgtgagtatcatatttcccagcctcccatagggagttttaattattattattattgttattattattgtttgctcttttctcttcatcatcctactcctcctcatttttctaaaggaagtaaaggaacaggcttggcccaataattttgaagtataaataatcagtatgttccatagtcagaatggtaataatgattccgttaactcagtttatttagtgcttgtgtgcatggtgaatgtaatgttcttgttatcgactgtgttatcttcactctcccctttcatcctgaagatgtctcagggaatttctccttcaacttttcctacccaccctgcttcactccccctctccccagccccatttgccactgacttgcttagcagcacaaaatcaagaaacatctttcattcagaccattgccaacactgatagtgtaggtacccaaaggtccaatggcttcccaaacatttaagaggcgtctacaatgtgcaggttagtgcaaccggctctttaaatgcacaaacccacttcaccctgacaacaatcctgagccatgaatatttttattcgcattttttagaggaaaccagggtcaatgccttcaaagaacttgtagttaggcaaaggagacaggcatgtgtgtataactataagtaaaatgcaaaggcatctgtgtacagagggtcaggagtcatgctgcaaagtgagtttttggaaggtttgcggaaagaagggaagcctgggcaggcttttgaggatgggtgggaattttttcacacagatgatttatggaagggtgtttcaagcaaagaggacagcatgtgcaaagggaaaaggaaatggaattctgagccaaaggtaaatatgcacagctaaatataattagagtggtgtgcagaggggaagttgggttatctgaaatatataaatccagtggtctaatctttgcacgcaagtctgggtaattttaaggagagtttaaaagactccatttcgaaggtgcacaccatagccatctttcagccagttgctccttgtgtgctagacacctgaacacatgtattactcctgttccatctctcccagttattccttctctacccatctccaatctgtccttcattctagcgttctctggtttctccaggctgttgaaactaagtacagatgtggctcttccaagcctccttcatagccgttgtctttagggatgaagaaaatgaataaggaaaactgtggctctgagcagctattgcttcatgtcgtggttgaagcaggaagcgactgagcttgctatcgattttaactcctgatcttgggaatcccagagcttctttctgtttctggagtgatgtttttctttgaagctaagttaaaaggtagtcatggggagagagcctaaaaacctgtgagtggaaaaaaaaaaaaaaaaaaaaaacatcaagctgtgatactgcagaattatcacagatagtgtaaaactgtgtggccatgccttaaaaaaagttaaacataaaattaccacattaccaagcaattccacttggaagtttatttgcagtaacattgaaaacaagtactcaaacaaaaatgtgtacagaaatgttcatcacagcattatccacaatagctaaaaggtggaaacaactcaactgtccatcaccaggtgtgtggataaactaaatgtggtatatccctgtagtagaacgttattcaacagtaaaaataagtggagtactgatacatgctacaatgtagatgagagcattatgctaagggaaggaaccagacacaaaaggtcacatgttattccatttccgtgaaatatccagaataggaaaattcacagagacagaaaacagaatgggggttgccaagggagcaggaattgggagtgtaactgaaaaatgatcatgtgttttctcttttttcccccgttccactcagctcataccttgtggttttctttctttctttttttttttttttttttttttttgagacggagtcttgctctgtcgcccaggctggaatgccgtggagcgatctcggctcactgcaagctccacctcctgggttcacgccattctcctgcctcagcctcccaagtagctgggactacaggcacccgccaccacagctggctaatcttttgtatttttagtagagacggggtttcaccgtgttagccaggatgttttcaatctcctaacgtcgtgatctgcctgccttggactcccaaagtcctgggattacaggcgtaagccaccgcacatggccaatatacccggtggttttcttctggggtgatgaaaatgttttgaaactagacagagggtggtagttgtgcaacattgtgaatgtactaaatgctactcatttgtacacttaaaaatagttaattttatgttatatgaattccacctccattgcaaaagagataaaatcaaaaacaggaagacagagtgttttagtttgttttgtgtttttgtaacagaatatctaagactgggtaacttaaaagcaatcaaagtgtatttggctcatgggtttggaggctggaaagtccaagagcatgacactgcatatcacatgggctttcctgctcctccatcacatggtggaagggcaagagggaagaatagatgaactcacttttataacaatccactcacatgataactaactcactgcagcagtaatgactttattcgtgaaagtggagttctcgtaatctaatcacctcttactgggcctcacctcccaacactgttgcaatggatattaaatttctgacacatggactttgggggacacattgaaaccatagcacactatcagaggcaaaatatagtgttggttcccaggcaatgagttggctgccttgttcacagtttgctcagtatgaaccatgcttgcaggagaacccctgaaatcaacccttagagaaatggtgtccatctgggaaagtagaaaaggagacagctccaagcaccaggactgagtttcagttccaagggacaagggaagtaagaatatcatcaccacaggtccgtcctcctccccagaggaagaacacaggctgcagaggtgacagctcacaatgttagggactgttgatgagaaaattggaaatggatggatttttatggcaatgcatttttaactgcacttcagcatagagggggacattttaaggagctaagagcttaaaccagacaagatttccttcagtgtgataataaatacaccaaagtgcccttttatgtttaataattcaggatccactgagtgtttaaagggttttttttctgttttatcatttgaaaaatcgaatggtaatcatttaaaaagtagtaggtgagaaatgttttccaaataggccctgaatcatgcacttcaaaatgtctttggaaatgaatgactgagtgtttcaggcagcgtacgcctgaaggtttggaagttttaacacagccaaacacctgtcattgctgtgtatactcatgttcagaggaatggtatctacttccatacacagaatcagccaataatctgatcagggctgggatgaaattagacaaaaaggctgggcagtgcagtagctcacgcctgtaatcccagcactttggcaggctgaggcagaccaatcatttgaggtcaggagttcaagatctgcctttgccaacgtggtgaaaccccgtctttactaaaatacaaagattagctgggcatggtggcaggcacctttaatcccagtttgctcaggaggctgagacccaagaattgcttgaacccaggaggtggaggttgtagtgagctcagatctcataactatactccagcctgggcaacagagcaagactctatctcaaaaaaacaaaacaaaacaacaacaacaacaacaacaaagaaattagacaaaagaacaaacaacgtgttggggaacacttttgtaatctcattcttgaatgtgctcagaatgtggatagtcacaatcatagagccagatttctgggaaattctagagtgaaatctaaaagtcagatactagtcataatacataatagtgtcagggacatgaacacatagcaccaacaaaactggtttgaattgttctgggctacaaattgggcctccacctggaatataatgcaaaatcctaggaagtagtgacttttagaaaggaaactcgactgtccttgtagatggtaaggatgatactgtggttctgagatttaaagcaggtaggttttcccagggagtggagtggagaagtgaataacttaatggtgacactaagttggcctgtcttatggaagagcctgaatgtgacaggaagcacgcatgtgcatcgttaagtatcatcttagaaaatataacccacaactgtgctctctccatattcagcaaatgtttattgcacctctatttatggtgtgcctgtcagacactgcagtaggcactaaggatgatgttgcaatataccccacagacaacatcactgcttgcatggagctcatattttctgctcgaggaaaaacattcaagaaggagttgtgacagaaactgccagctgtctacccagtatccctttatgccttcttttaaaggaatagagtgcttggaaatagttcacttagtcagagtcagtatgccccaaattaaaggataataatgctgtgttcctcggcttagcagagagggatccccattaagatggcagtgaaaattattagacatgcatcctgggaaaagcctctaatagggactaactcatcgtgatgaaaacaccataggccctttcatgctttctccgcgctgttgtatgacattatgtgactttgaggcaacttcgttggtggaatctatgttctaaggataatggaataaaaaagtgaatgaggcaagaaggtttaagatggaatatgtagccctgaacttcttgtatgggagagaaaaattaatctatattttgtttaagccaccattatttggggactctctaaatagcaaccaaattgaattttatgagatcagtgtgggaatcacaaatataaatttatttctgaatgtaaaaattgctctgcaggcaacaaagctggaagatatgagagagaggaattggggcaagggttggagagaaagacctctctgaggttaaaacaaagtctggtatatgcacctctcagggagaaacatcccaaaccaaaggaatgccagataccaaagtgagcaacacagcatagcagagaaacaacggagagccaggtagtagaagaggtgaagtcaccagctgaggtgaaggaaacaggagagatcaagtcctgtgtctcctattgtgggctatgttaagaagtggggattctattctggctgaggcaggaggtccttagtttgatctaggcaagagaatgccacgatctgattcttttttttttttttcttttcttttttttgagacagttttgctcttgtcgcccaggctggagtgcaatggcacaatctgggctcactgcaacctctgccccactgggttcaaacgattttcctgcctcagcctcccaagtggctgggattacaggtgtccaacaccacgcctggctaatttttagtatttttagcagagatatggtttcaccttgttggctaggctggtcttgaatccagacctcaggtggtccacccacctcagcctcccaaagtactgggactacaggcaagagccaccatgcccggccgatctgattcttatttacaaagcttacccaggctggtagagaatgggcacggcaagcgtgaagttaggaagctcatttgggcagtgactgtagactgtagatcagagggagtattgatggtggggtagacttagatggcagaggagatgtacgagggatttatttcagaggtaacactggcagaacttgcagaagtttgggaagccaattaacacctaagtagcatgtgttaggaggatatgcataaatgtagaatttgcattgactttggaagatcctcccatggtctttctcctagagccgcttaactgtctccaaaaatcaatatgggttactcaacaacaacaacaaccacagcaatataaacaacttgattaaaatggttaaaggacttgaatagacatttcttcaaagaacataaacaaatggccaataagcacatgaaaaaagatgctcaacatcattaatcattagagaaaagacaaataaaaattacaatgagataccacctcacacacattaggatggctgcaaataaaaaaaaaaaaaaaagaagcacagaaaacacgtgttgataaggatgtggaaaaattggacccattacgccctgtgggtaggaaggtaaaatagtacaggtgctgtggaagacagcatggagattcccaaataattaaaaatagaactgccagatgatccaacaattcttattctggatatatatttaaaagaggtgaatgtagagcaggggtccccagtccctgggtcatgtagtggtaccggtgtatggcctgttaggaattgggctgcagtggatgagcaagcaaagcttcttctgtatttacagccactcctcattgcttgcatcagcacctgagctcgacctcctgtcagagcagccacggcattaggttctcacagcagcacaaactcttttgtgaactctgcatgtgagggatctaggttgtgcacttcttatgagaatctaatgcctgatgatctgaagtgggacagtttcatcctgaaaccatcccctgcaacagccccccaccctggccattagtttatcttccacaaaactggtccctggtgccaaaaaggttggggtctgctgaagtacagcctcaaagaaatgttctttttttttgagaccgagtctcactgtcaccctggctggagtgccaggctaattttgtttttatatttttagtagagatgggatttcaccgtgtgagccaggatggtctggatctcctgacctcgtgatccgcctgcctcggcctcccaaagtgctgggattacaggcgtgagccactgcacccagccaaagaaatgtttttacactcatattcataacagctaaaatatgggactaatacaagtgtttatcaatgatgaacagataagcaaaatgtgatactcacacacgcacaatggaatattattcaaccttagaagggaagaaaattctgacgcatgcttcacaaatgagccctgaggacattattctaagtaaaataagccagtcacaaaaacacacgcactgtataattccactcacatgaagtttgtagtgaaaagcagagagtcaaggagaatggtggtggctggtggagaggaaggtaggggaaaggacagttattgtttaatgggtacacagtttcagtattacaagacaaaaagagttctggaggttatggtggtgatggttgcataacaatataaatatacttaatgctactgaattgtatgcttaaaatggttaagatagtaacttttatgttgtatttgtgttaccactgtgaggaattggaaaattatagaggtgggccgtgcccaggattgcagtgagttttcagctggcacagctttgtccatgcttctcacagctcagatagggtccctctatgtgtgagccctagtccacattttggttaatacatggtctcttccatttctctgtttccctttgcaaatatctgcttggttagtgactctttctcgaaatctcctcataacccaccaagcaaaggcaatcttgtgccttcccagcaagtgattgtcttaccggccacggatttaaccagaaatctaagtttgtccagagagccagtcctcagaaggggctgaagtcagaactagtcaagaaggacaggtgcacatttacatatgatttgcatctgctttacatagggctgtacaagctgtgctgtgttctcaaacatcacttacgttatattttaagactgtcgcaatctttaactaacatttcgatctgcagccagggtgcccctgacttctccagatttccatatttaaactggctacaactctaatccatgggaggtgggaaatccacggcacccacagggtatctgcagatacctgccagaaggctttactttctcagagtaaccattcattccaatgatccattctcaatgaaccatctcatcctacctctcatctcttgcctctatctcaggcccaccctaaacttgcagcatcactcaaggccattgtgtgtatcccattttaatctgagggaggacaggattgcaaacactttaatattagcattcccatatttataagttcctggtcaggtgtaatggcatatacctgaaatcccagtactttgagaggctgaagtgggaggatcacttgagcccaggagtttgagaccagcctaagcaacatagtaagacattgtctctataaaaattataatagtaaattagccaggcatggtgatatgcacctgtagtcccagttacgcaggaagctgaggatggagaatcacttgagcctgggaggtcaaggctgtagtgagctatgatcgtgccattggacttcagcctgggcaacagaacaagactgtgtcttaagaaaataaaaatgaaaaagttcctcactgttctaagacatcagggattattcactggcatttttccttgtatttttagagcgaggcttccttcatctccttttctccccctctccccaatcctttctcttttccttcttttctcccttaatgcaaactgattggtaactcctcattttcccctccgcacagtttctggcattcgccattctactccttggttttctgttcttgactgttttggatatattcatctttctatgtctcttgcactgtctgggactatgcacttcaacttgaaattccttgtcttttttgtcccaaagaatattgtgactttctctttatcctacactctcttttccatgtgtaacaaggggaggtgggagtatgatgccactcctctatgagatagaggtagaagttacatgtggaatatttacttccccttttatctgattttctcctcccacctcccttcactgatagtaagatagaggctgagagaccaagaaaaatagtgagagagatgaggcttgctcgatgaatattttggaaaactccagttgagtgaaaatgtatggaaatgggcggggcgtggcggctcacacctgtaatcccagtgcttagggaggctgaggcaggcagatcacttgatgtcaggagttcaagaccagtctggccaacatggtgaaacctcatttctactaaaaatacaaaaattagctgggtgtggtggtgctctcctgtaatcccagctactcgggaggctaaggcaggagaatggcttgaacccaggaggtggaggttgaagtgagatcatgccattgcactccagcctgggtgatagagtgagactctgtctcaggaaaaaaaaaaaaagaaaaagaaaaaaaagaaaacttacggaaataaacatgaacctttcagtagaatgttcctatccaccctgttttcacttctacaatctgtgtttacaaaatacgatacattttagaaaccaaaattccatgccttcttggtcattaataacattgacgtaaacttggtccaccatctgcagtctttggtgatgggcagaaagaaaacgaagtccctgagtctttgaaaagggcaaaagtgagtgcagggactgcagtgattatctgtatgaggtgaattgaaaccttaccactgagagaactgtgtgtagtaattactgaggagccaattgtgctctgcttaacgcatccaaagcaaggcagctattagtggtgtccccacttcggtgtttatgctagaatacaggaggacagcctggttttctcatacgatttgatctacgacatgatgagcctatggccgatgttgtgttctgaacacaggtgtggcttgcccacccagaggcgagtaggatgtttagttttacttagactgacactaggaactcagtaaaatgttaagcaggtttagggaagtgcttacctgatagtctaatttagaaacataatcttgtacacacagtaatatttattattggagtaagtcagtagaaacagactcataacctttctagggagacccagtaggtaaagtggatttaccagacagtaacatcttagtcttttgtgtttgtatggcaagtatctaagttaataatgggaagtaggtgaaagttttcaggttgtgtaccatgcaattggtttgactttgccttgccaagtaagcctaacataccccttataaatacactacatgcatttttagcaattagaatatttacttactgaaatatatatatacatatatgtattatatttccttattaatatatataatatgcgtgtgtgcatatatatatgcacacacacacacatatattttagaaagacacttgcaagctctcaaaaatgagttgctgcaataccattccctctgccaatcatatgggttaaggctgattttattgccagtcatatcgtactcaagttgaagtgctaagaatgctgtcttatccctcagctagattagttttaaaaggtgatcctgaagtcctgacaagcacagagtgaggatttacgaagtgacaaacagatgccgacgacatttactgtgagatttctcatagctgaattcccagtcctggccaaggagaaatatgcaacaggggagagtgaaaggggcattttaagttgggatttataaacaatcaattctcttcttatcagaaaaaaaaaatggagaggctggagaaaccgtcttaacttgaaacagtagtttattgcttcttacagcatggtctgtttctgttctgtgtggtagtcccacttacagtgcacagagcttcatggccttttgcagccaatttagccccttgcagctcagtgcaatgccatgcttcatcctggcaacttcaagggctttatggaaataccctacagatgtgtaggtgcttttgtacagttggtaactgaggcttcaaatcaccccatccatcttcatggcatttcttagctgatcagcaagaggtgtacgctgtattttcttttatagcatcttcattacctttgtgtcttccgtagctgctcatttttatgtatatggcatcattggccgggcgttatgggggttcctctggtcacgttccggcccttcattctgctagcttcaggttggtgagtcatgcatgtttctgaccagatggaacatgatttttcttatttctccactgtcccttccaagaatctttatttctctctccgttaggttcacatgaatggtagagagaggaactcaacagcacaaaatagtcaaaacataacattttattaaaaccacatccagtgcaacccccggactggcccctagcacagtgcctgctacataatagatgatccagtgaatattgacagaatgaagacgtgattggattaacgactgatcttgccacaaaaaataatgacatggaaactatgacagcaaaacagtgctccttgctgagaacagtctctgcaacctaaagaaggatggagcggaagaaatgttttatctttgtttaaaagaatgcaacaactgtggagctacctagggttctctgtaaggcagttgcctccaacacagccagggttaatttgcctgttgcacccagttcatgtagcttctcctagaatgtgcagcaatagaacgagcaggccaccatctatcaccagagaatatcttacctttattcaggagagagagctaaggagaagataaatggtgacagtgagagttgaactccacagggtgcatcctctccttcctctcaatcttagtcctggggaagcttctcagttacctttattgtgagcctcctgtaagtggggtttcttttttccatcactcactgaaaccggcgcatggtatcttctctggaaaactaggactttaggcaacatcaatcctgcaacagggaagcaagagcaactttggtggttacaggaaaagctggagatggctgtttatgtatccctggagtttggtttttggaggcaggtatcttacttgggctgaggtatgaaactgtagccaattatgtcaccatctataatcggccagattgtccctccaccaattcatatgttgaaatcctggctccctttgcctcacaatgtgactgtatttggagacagtttgtcttagttcacttgtgtttcagtaagggagtagctaacgctggggaatttataaagaaaagaggggtgttttggcttatggttctgcaggctgtgtaagaagcaggcaccagcatctgcttccggtgaggacttcatgctgcttccactcgtggcagaaagagaaagggagctggtatgtgcagagatacatagtgggaggggaagcaagagatagtggggaggagccaggctctttttcacaacctgttctctgctgggtgcagtggctcatacctgtaaccccagcaatttgggaggctgtggtgggaagtttgcttcagggtaagagtttcagagcaacctgggcaacatagcaagaccgtatctcaacaaaaaattaaaaagattagctgggcatgatggcatatacctgtagtcccaactaatagagaggctgaagcaagaagattatttgagtccaggtatttgaggctacagtgagctgtgattgcagcacttgcaatccagcctgggtgaagagtgagattctgtgtctgtaagcaaacagataaacagacaaaaagcccaccagttctcctaaggactaagagagcaagaattcactcaccctctattcccttcctggcgggcattaatctattcatgagggacccatctactcttcacttcatcttccctctatgcatgtctgtgtccaaaatttccttttcagctgggcacagtggcttatgcccataatcccagcactttgggaggccgaggtggtcagatcacctgaggtcaggagttcaagagcagcctggccaacgtggtgaaactctgtctctaccaaaaatacaaaataataataataataataataataataataataataataataattgcagggtgtggcagtgcatgcatgtaatgccagctacttgggagactgaggcaggagaatcacttgaacccaagaggcagaggttgcagtgagctgatatcgtgccattgcattccagcgtaggcgacaagagcgaaactctgtttcaaataaataaataaataacaagatctccttttcttataaggacaccagttagattagattagagcccaccctagtgacctcattttaacttacttacctttttaaaagcccctgctatcatttggataataacctcaaggcctttgcacttgcagttggctcctgccagcttattacatggctggctcttgcccttccttctgctctcagtgcaaacattacctcctcaaagaggccaaccctcaccttctcatcaaaaatggctcctcttacccattgtaaccactctattaaatttttcctttttgagcacttaagtcgcatttaaaaaaatttttaatccgtatttggtttgctggttccctatatgcctcccttcactgagtgtaacctttgtgggggcaggagtcttgtctgagtcatcattgcccaggggcgttctgttgtgttcagccaaatgttgaatgaatggatgatgcaatagatgaatgagacaagagtctctccagggaagctgaagtggcacacacactctcaaggtcttgaaaatgcctgacccctagtgcaggggttccatgatgcaccatagagttgatggtaggcaggcaaaatgaaagcttttaagccccattgattcacctgtgcttattaaactgccttgcctctaaaaatgatcattctccagtgaaaaccagggatagcgacgctcagtgcagatttcccaaaggaagaaaatccaatgaagtgcatctttgcagtgtgtgcattgcttgtcaacctgccctgcaattgtgtgtattcaataagggtgataatgatgatgacaatgattttatcagtcaagatcccacacaagaaacacaaccaataggatacttctataggttaagagatttattgcaagggagtacttataggattgcgaggctgactaagcaattcagaaatccatgggccaggccatcaggaagagtatgttggcaactcttgggcaggagctgacagcgtggaccacactgtggtcctcaaggatcacatggaccacggtgtggtccttcctcacagttttgctcttaaggcctttttccaattgcactacactcaccaagatttcttaagacaatctactttacttaaagacaatcaatgttaggtgttattcatatctataaaatgccttcacagcaatacctaaattaacattttatggaataaacggatactgtattctaaccaggttgacacttaagactgaccgtcatactgatgctaatgttgatgatgatgacaactgctactctgtattttgctcttagtaggtgtcaggcatgctgttaaagttcttacatgtgttttctaatttacaacattgttgctccaattatcattctcatagtatcaataagggggttcagggaggttaaatgacatgtccaaggtcacacagggctgaaaagtacatctgtgtgtgagcaagtctagagatccaatgtacagtatgatgactctaagaaataataatgtattgaatactggtaatttgccaaaagggtagattctaggtactctcactataaaagaaaaaaaaatttcaagaatataaaaatagaaaggagggaagaaaggaaactaattttatgagatgatgagtgtgttaaattgcttgactacataatcacttcactctgtatgtggaagtcaagataagtatgtcaaagtattatgttgtataccttagatacatacacttaaaaaaaaaaaaaaaaggactctgggccgggtgctgtggctcacacctgtaatcccagcactttgggaggccgaggtggggggatcatgaggtcaggagatcaagactgtcctggctaacacagttaaaccccgtctctactaaaaacacaaagaaattagccaggtgtggtggtgggcccctgtagtcccagcttctcgggaggctgaggcaggagaatggtgtgaacctgggaggcggagcttgcagtgagccgagattgcaccactgcgccccagcctgggcgacagagtgagactgcctctcaaaaaaaaaaaaaaaaaaaaattggactctggtttctaaatttaaacgtttatccagtgggctggtagctgtcatagggatagaaattctaggctctaggactctatcactagtaaatacagggaattaaaaactccaaggagtatttttcatgtaaagcaaacaaacaaaaaaggccttgagtcttaaaagagagagaaagagttgttgaaatctagaggcacacctagtaagcaagggtaatgtattgcatttccaggagaaaatgaacaagaatgtaagttacactgattcctgccctggggtaatgggtgggtttccttttcagctctcgtgccaggtgggcattcgcctgaactaggaggactcggggggattcaagccccctgtctctaggttgctatgagctttcacatcttcctctggtttatcccccgcccttagcacgaggtggttgcagcgtttcctaatataaatgcaagcaaaataaaattagaaatgtgctggtcgggggaagccagctacccacaggcgccgtaaattgccttttcctctcacccctactccctcctacccaccccttctcactcccatcaagccaccccaaataacctgccttgcctggctgagtcacggtttctggaaaagtggggccaagaaggttcctaacaagtcactggagtgatgattagtggatgatcagcggtcaaaagagaatcatgcatggaaggaaggtggataggattcattggcatgagtggcagatccgggaggactgcttggggcagactgtttgagtgacataggtcttttagggtcaagggagagaaaccagagaatgagggaagcacaagctactaaattttgccatcacagcagctgcctttgtgtacagtccctttgcctctgctgttccaatattgggatggttccctaccctcaggaaagtattcgcttgcctgtagccgcgttgaccctagcgcttgatgactgaggaacacttgtgttattagcaacccctctttcccactattttaaatgaataggcatacttgtatccatgcagatgctgctttagagtttagggaattacaaaatcaggtacaccctagagtggggtttctcaacagcaccagaataatgggatcagtcctgggcacgaacatttttccaagcagagtagtctcacatcccttgaaggctgagaactctcatataaaggcattccacaagttgttttagaaaaaaaacgagaaaatagcctcaatatttgaggagtgtagttattaggaataacttacgctacatgaggacaaatacctaaagcatgtgggccttaaaacctagatgacaggttgataggtgcagcaaaccaccatggcacatgtatacctatgtaacaaacctgcatgttctgcacatgtatcccagaacttagagtaaaatcaaaaaataaaaagaataacttaggctacaatgatgatgtcggtgctggtgttgatgaaggcaatagtggttacatgtaacctagtatctagctcttaccgtgccactcatattttgagaataattctatggaacacttgacttgatccttccagtcatcttgtaaggcaaatatgattgtgcctacccttgcttttatagatgagcagaagtaaatgaaagccagagattggaataggttgccaagactttactgctaataggggttgagaatggagggacataggttatccagaccctgaagcccgaactccctaaccacctcaaaacactgtcaggatcaggagaaatgcagattacacggaacaatatctggggcagaaaaacaatgaggcatcagtttttccccctttatcagtggttccccattctggctgcaacacattcgctgaggttgccttaaaaaatcacgttgcatggatccaagcccaaaccaattaaagataattttaggaatacgggactcagtgatcagtatttctttaagttcccagtgtaataggcagccagagttgagaaccattgcctgacattaaagattcacaaaatgtggtccatgaatcagactttaatagatctgttccaagttttcatgaatgagtatttagtaaagatgtggtgcatggcttttcctaattctcaaagggatcctctaatgccaaaaaaaaaaacacaaacaaggtgggaaatcattcccttggagtatgatgggagcttaccgtgtgcctggaactgaagtggatcttgagatgagctatctcatttaataatcctaacagccctgatattgtcccattttatactcaagggaccgaggttccagaaggctagggaatatgcttgatatgtcatcatgaataacggatagagccataaaccaactcaaatctacttaatgtcaaagccagttattcttaatagacttctctgatggatgagggttgaaaaagtcctgcccagcaatagggggaacgactcaaagacagctagagggctttgccagccagagggcatgcaggaactctgaagtggtgggttgttaagaactaaaatattccatttgcaccgcagagctcagaattaatttccactgtcctgatggagcaggtgggaaggaatttgacctctcccctttgcctagaaactggtcctttctggaagcttctgagcttgctatggaaaaaaaaaaaatttttccacttctttcccctgctaccttattttcttgttctctgaccatttatctcaaacaaggaattattatctttctaatgaagccacagtagacccttcatttatcctaggatatgtcacccctacaattttctgtgaagtgtttttttctcaaaagacttctgaaattgaatttcttacgcatatgggaggagaatgatctttatgatgacacgatgatcttatccagcaaatatatttccctgtagatccctactttagcagatggcatgatcggggtgctcaagctaaacacttctttgtcctccttaattcctctctcatgggcagactgctcccttcctattctaaatcaccgtgtcttgccatgcctctccgatccatccactgcctccatctccatcatctctctggtccaaacctcatccgtctctcagacaggaaaccgctgtggtttctgcttggtcaccccactagctgtgctcctacctcatcgtctgcagccagagtaataacttttagtacaaatctgatcatgtctgagctacttaaaactcttctgtggctgctctgagccctgcacataaaatccagaacccttcacacaggctaccgtatactgcgcgatctttctttttgctctccagcctaatttttctccatggtttccttcactgtctcaatctcacccctgcaaaatgaagtagacacatgttcctcacatttaatgtctgcatatatgagattagaaatgggatagtctgggtgtctgtctcacagtgaaagagttttgtttattctttttattttattttactttaagttctcggacacatgtactgaatgtgcaggtttgttacataggtgtccacgtgccatggtggtttgctgcacctatcaacccatcatctaggttttaagccccacatgcattagctatttgtcctaatgctctccctctccttgtctccaccccccgcggacaggccctggtgtgtgatgttcgcctccctacgtccatgtgttctcattgttcaactcccacttatgagtgagaacatgtggtgtttggttttctgttcctgtgttagtttgctgaggatgatggttcagcttcatccgtgtctccaagtgtaaattagttcaaccactgtggaagaaagtgtggcaattcctgaaggatctagaaccagaaataccatttgacccagccatcccattactgggtatatactcaaagtattataaatcattcttctataaagacacctgcacatgtatgtttattgcagcagtaattacaatagcaaagacttggaaccaacccaaatgtccatcaatgatagactggataaggaaaatgtagcacatatacaccatggaattttgtttattctttaaagagctttatgagatacgatttacacagtgcaaaattcacccattttaagtgtacagttcaatgttttgtaagtacatttactgagttgtacagccatgaccacattctaaatttacaccatctttataaccctcaaaagatcctcgggcagattagcatttcttcccccagttccccaatgctaggccaccactaatctattttctatctctaagaattggcctattctggatttttttttttttttttgagacggagtcttgctctgttgtccaggcgggagtgcagtggcgtgatctcggctcactgcaagctctgcctctcgggttcacgccattctcctgcctcagcctcccgattagctgggactacaggcgtctgccacggcacccggctaatttttgtatttttagtagacatggggtttcaccgtgttagccaggatggtctcgatttcctgaccttgtgatccgcacgcctcggcctcccaaagtgctgagattacaggcgtgagccaccgcgcccagcctggatgttttatatcactggaatcatacagtatttgttcttttgtatttgccttctttcacttagcataatgcttacggggttcatccatgttatagatgcgttgccagacaacatactgttgtgtggatataccatgttgtatttacctctttactagttggtagataattgggttgtttccacttattggctattgtgaatcatgccactatctgcatattagttaagaacatcggaaagtccaggttctctcattgaccatgagcagaaatccagctagtcttttgacttgtctaagccactgtttttttcttccgtaaaatgggaataataatggcatctaccctagaccgggcgcagtggctcatgcctgtaatcccagcactttgggaggctgagggaggaggattgcttgagaccgaaagttctagaccagtctgggagtcagagtgagaccttgtcgctaaaaatttttaaatagcgtctacttcatgggttattgtaaaacttaaatataatgataggagtaaagggtgtagcacagaattgcttgaacctgggaggtagaggttgcagtgagcccagatcgtaccgctgtactccagcctgggcaacagagtgagactccgtcaaaataaaataaaaattaaaaaacccacaaacaaaccgagacaatgagtgtagcacagcacatagaatgtaattagcactccagaagcctgagctattgttataattcctcttttcattacagaaaaattcttagggtagcagttcctggtagttactgttttttcacaaatatgtatttactttttaccaagttctagtcatttattcattcttttcaatcatcctgtgttgtaatcattactttcccattttatacccaaggaaacaaagtcagagtattcaggaatgcacccagggcacattggtaaggaaaagtacagcaggattttccttccttcctccctccctcccttccctccctccctccctccctccctccctccctccctccctccctctctctccctctcctttccctctcctcccctgtttccctttccttcccttccctttcctttcctttctttttgacagtcttgctctgtcgctcagggtggagtgcagtggcacaatctcagctcactgcaacctccgccttccggattgaagagattctcctcccacagcaggagtagctgggactacaggtgcgttccaccacagctggctaattatctttttttttcttattcttcttttttttttttttttttagtagagatggagttttgccaagttggctaggctagtgttgaactcctgaccttaggtgatgtccaccttggcctcccaaagtgctgggattacaggcatgaaccaccacgtccagccaggaaaactacagcaggatttatgagcgaaagcaaccagtgaatatttggaagctttgttcctggtgttcgggagtctgctgtcctctgacctcttgacttccaacccctcgtccatcactctttatcttatccctcaaaaaaggcatgacaaagggtcatgagaggcctggttctgagaatataatcaattacttggcttgaaaaggaaaaaaaaatgtcagtgtttatttgtttttaatcatagggggaaggatttttttggtgaagagtcaccattcaatttcttctgagaaaaagctttatttacatcagtaaagattgcaaggagacatcagaaagaacatttttatagtgaaggttttgagatcctagggagttcatctgaaagacttacagcattgtcactactcactgcatgtgtgtgggcatgtgtgtacacgcgtgtgtgcatgtgtgtgcatgcgtatgtgtgtgcatgtgtgtgtgtgagtgtaggtgtgtgcgtgcatgtgtgtgtgtgtgcacatgtgtacctgtgtctgcgtgtgtgcatgtgcatgtgtgcacgtgcatgtgtgtttgtacgtgtgtggggtgtgtgcgcgcgtgtgcgtgcatttgcatgcgtgtgcgtgtgtgtgtgtgcgtctgtgtgtgtgtgtgtgtgcccctgagtagagctccctctgcagaagtcaggctgaatcatcccaccttgctgactctttctaaccctatgatcctttgcctgagtaggtggggagtgagtttaaaccttatgtcttattttccttcattaatttggccaaatcatctgaaaatcactattctctacctctcaaagatgtagatggtggtactaatttaaaaattgctataatactctaagccatcatcagtatattgttttctggttttcaccttcttcagtatgcttcctatgagacagagttagaagtggaaagaggtgaagatagagatggtgaaagagggtgagagatttaaagccatattcgatcccagtgagagagctcatacagaagaggcatagttgagagagaaaatagcaaaacagtaactaggtgtcactcttttaccagcattcacagtaattgagctgagaaagaggtaaaaagtttttttgagtgattttgttaaccagaagacgtgatttgacttagggtttgtgggggtttgctgtgtgtgtgtgtgtgtgtgtgtgtgtgtgtgtgtgtgtgtgtgtgtgtgtgtccttttgttcctaactggctgtgagactttggtaagtcatcttaaagtgttttttttttttaaagtagttttcagcagagattgccttttattttttctcttctactgcacgatgcaatcaggaacctgtctagaagtatcagaagttgctgctacattttggtggacttgcacctgactcacccctccagcctcgatgcatcgcatgcagttagcatgttcagcacaatcttctctcttgggtttgggcaggcatatggtctgtgcctagcagagctgatattgctggttccaaaaaactgcctgttacatgctggtggtcacaagagaagaagaggtgagaagggctcggagccagacaaagcacgcctttgtaaatgaatgtggagttggccaccagcagtcttcattatccccgtcattgcaggcagctgagctggctttgtgtcagccctgctcggagtagccttgttaattcacccccatgaaaatggaagtttcatacacattgacataattaatgaagaggcaggcagcatgctctaccaattaacaccacagggaaaagtaaaatgggctttcttttggcatattgtgccaaagttaaggactgtaagacacagcaaataaatagagatgcttttaatgagctgcaagatcgagctgaataagtcagaaaggagtgttgggtaaacactgccaactctttgcaccgttaagagtaattgatgagcatagttgaaagtttggggggaaagagaaccgtcggctgctccaaccgtgttcatttataaatgcatctttccctgaaagctactgttaggtgtgtttaagggtgtaatgtgcaagaggaaacaaatatgacagacttgctattttgtagtgcccagaaaatatgaggcatagctgttgtagaaagaacaagcgtggcggatttttcacacttgatgggattgtttttgtcaaactcggagtaaaactggctcctctgccgtatagatccctgctctgagtacaccctggaaacaggaagcagggaatctttaagagtggtattggaatgactccattccttttagaaaagccagacggataatttaatttttgttctctatgtttgtgatatgaaagcatgaccttccaccaaaggatttcccattgtttctgagagtgagtgtatttatataaagaagttttctaaccaaagagaaatctgttggatcaaaaaatagaatgatcagtagggtttagtagctatttaggaaattttctgaattcaaaccaattgaatctgagttcagttggtttttgttaatgtggtgtatcttgttcgattaagccttcattttaaaattaaaggtgtcttaaatggagttgcattgtttgaccttagagagatcaattgtgtgtatcagaccaaacaaaattcaccatattcaacaattgtcctagcacccatctcccctccccactcccgacaaccatcatgacaaaagtgcaggaggaaaattcttgacattagcagacagcatgctctgaagcaagtaagagaaggataattcaatatagtactcgtcagtgggcgtctggtcctgcccatttttcctggctctgacatttcatcatgctgagtgagattccatttctaaacttggtgtcattcatgcaacatggccccaagtataggacaactacttaatctgttgttgctcaaagaaggtgcaatgcattacaatgctagagagaaaagtgttcataggaacctaaagagacagtgtgttgacaccaacatgggacctccctaagcaagttgctgagatttgattatgtgtgatttctgccttatgtgcccactttggatgtaaccctgatgtcaggtgtggctcttggaaacgacactattttctgttgtgcaggtatcattgctgcatcttcctctggttgaggacttgttacctggacttttgaattatcttctttgtacatggggggatggcagtatttctctgattgtgatctgtgaacttgccacaggatcatcttggatcctggctgagtgtggaatttccaggcccacatctgacctatcagggctggccgtacaatcagcattttaaataggcatcttggtatttccatgggattctcttgatctctatccacccttaacatcccatcctactttctgcttgttaagactcaggatacttctgggactgctctatggaatgggttcttaggaattctaaatgcatttgcatttcaaagactgatgagaaagggacacctgtccaggtaagacaagtcatcggtttccaactccagcaataagaacttagtttatcagatgtactgtctaactagtagaggtgtgttcgctgtcttcattaaaatgaagccaggttgatgtgactaaattttgatttgatttgctgcgttttatgtggtggcttatacttgaatgtctctataatatctccctgtgtattttagagagtgtgaattaaaacagctgccttgtacattgtaagtgttcaaaaatagtttgtaaagtgttagaataagggcttcatagccacaaggagggtctcagaaggtgatttggctagattataaaacacaaatattaacttttgacttgtttattctttatttttatttgattatttatttatttatttatttttttatttatttatttatgagacagagttttgctctgtcgtccaggatagagtgcagtggcccaatcttggctcactgcaacctctccctcccaggttcaggcgattctcctgcctcagcttccagagtagctgggattacaggtgcgtgccatcacacctagctaatttttgtatttttagtagagaaggggtcgcaccatgttggccagggtagtcttgaactcctgacctcaggtgatccaccaaccttggcctcccaaagtactgggattacaggcgtgagccactgcacctgccgttgacttatttatttgtaaattatcctgttctccacatatatacttttaaaaagcacttcaaaatttcagtgtggttattcaatggccatcaaagtttgttattctaccagaatggtcttatcttttacaagcgagatctaagaaagcacatacagaggcctgaaaagttgatttccctccttggaggagttcctgatttaacttcataaatccacaagagctgacatctcttcatgtccaaccacaaaatgggtagaaaatgatgaaatgcagaagaggcttctaagtcttggtctgcttctgtgatagaacaggagagaggcagcattttatttttaccattattagccagcctgtcagtcacttaaaatttttccgtgaagacacaaagctaagttttgaatactctgtgtcactgcttccagctgatattataaaaggcagtggtgaggatttcagctaaaaaaagattcgttgtttcaaaagcccagcctgaagtaagacagtgccatagacacgaccacaccagagggcaggtggttcacaaagggccttgcattcttctttgctcttgtttactttacatgagggcaaggagtctcagaagcgtaagatataatactacactagacaggcaagcagacctaatgtgcaaagtctcatgttggctatataggtagtttatatgtcagttccaattatgaatacattcctcagcaactagagttttctcattcattcttactgaactgttagggcatgtggcagcccagagctctgtcaaaatgaattgtcccccttgaaaagttggcaatgcaaggaagtgacaacctaatgcatgttagcactcttgataacaggacccagaggagacggcgaagcaacaattggatatgtgtctgggcactggctgttgttcctgcctgggttcaaatctcctctctgccgcttatgatctgtgtgcatttacaagtttgttagcccccttacctctttgttccttataaggttgtcgtgcaaattacatgaaatgatgttacaggtgtaagccaatgcctgacacacatatgtattctacagtaatcattatcaaagtggtaagcaggaaccagtgccatttcacaactatcaggtactcttctgggtactcatcatgaaagactgcagtgttccatttacaggcattggttggtggtttactaaagagtgtgtttttgtccaagaagttcactcactacattttgctcaaccagtcctctcatttgcagcgatttttttttctttgagcgtcccttgttgtgcagcataaacatctgggctgcatggtcagacccatgaggcttctcttccatctggccacctgttatataattaagcctgattgcagatgcgattctcatttagctgtcagcagcagcctgggagactagcaactgaggtgaataaaggtagctcaccacatctacaagggtagaagggctgaagcgaagggttgaccagccaggacaacaaaggttattgcttatggcagtgtcagcctaagagctcaagttcaagatcagaagcatgagagggtaagacctctaggggagtctgcataggtccaggtgaaaccctgggtgtctcttgattgtcagagcatgtaaatgatttttccgtgaggatagaatttgacagtcagtgctagaaagggcttcagagtttggtaagtctctttggtggactgcatggatagatgtgaaaagataaaccaaatcaaaatgtatattccattgaatcatgacaaattcgcattggtaatgcgaatgatagaatattataggttatgcttaagtgctttacctgtggaagttacttatcagaactccaaattttcaggggcatttgcacagccagtaattgtgcaggagatccaactcacatccacctcagcttaactgcctcttgatgctttcaagcattatgctatttatttcagtgtcttatgtttcagaactaaagaaatgttgaattaaattccccactatatgccgtcagtgtttcagaaaaaaaaaaaaaaaaaaagaaaaagaaatgagcaaggcaggtggatttctggcaaagttttgttttcatttctgtctgatagaaatgggagcacttcctaaaccaaaagagcattttttttttggtagaaatagccatttattaaaaaccataaatctgttatggctggttggtgagcataccttacagtttaattgtaccaagttgaaagtggacacataccaggataggcacacctcattgttccacatgtggcttcagtgctttaatgtgaattataagtacataagtaaagtacatattatttatgcatatgttgtatttatgacctttgggatgcatcagaggttgcttaggctcgttgttctgggtctttcaggatctagattttctatcctgattcttcctttttctaaaaaaaaaaaaaaaaaaaaaaaaaaaaaggctcagttgaggaactcactcagctcactcagtgcaatactataatgggaagagttccatgatgctgccattccagttataaaatggcttcttttagtcatcgtacaagccagcagttatggacagtgtttctctaaatgttagtaataaagtgtagcaggtttcatatcagtatactaattctaccaaaagccattttcagtcccattgacatttgaattctgcccatgcaaattagtggaacttgccatcacccttggcctataatgccccataccaagcatcaccagcccagtgcttctcagtcttggctgcaaatgatcgagctataaaaatactgctacctgggacctgcccctcagtgcctctgatttaactagtaaaatcagagggaggtttgagcatcaggatttctaaactttcagattttcagttgggcgtgtagtggggtgggttagggggaggtaatgtctccaaatggaaatgtctttttggttaaaataaagtagaaagaccaaataagtgatatttggggagagcaatgaatattctaaaaccaatcaatgggaattgtcattttatggttctcctgaatgtgagtgtccaaagtcctcgttattcaaagtgtggtccaaagaccagcctcacttggtaactgttagaaatgcagactgttatgttccagacacacctactggatcagaatgtgcactttaccacgacttccaggtgatttcatgtactttgagttagagaagcactgtcctagtcacagtgatgaggagggtgataagagtggcagaattcactttattgagcctctgctatgtgtcaagcactatgctaagacatttttgtgacatacttctccttaagttgttgccggagttaaataaagtgatatgtttaaaacactaagtgtagtatccaatatcaggtgttccaaaaagggcttatcatcatcatcatcacggtcattgtcattatcttaaatccatggtcaccctaggacaggaagcatgaatctagtttgtaagtgcacgtgatctcctttccatgggtgatatgggttggctgtgtccccacccaaatctcatcttgaattgtagctcccataattcctacgtgttgtgggagggacttgatgggagatagccgaatcatgggggctgttttccccatactgtcctcatggtagtaagtttcatgagatctgatggttttgtaaggggtttccctctacggttggttctcattctctcttgtctgccaccacatcagatgcacctttcaccttccaccatgattgtgaggcctccccagccacgtataactgtaagtccattaaatctatttttctttataaattaccagtctcaagtatgtctttattgcatcatgaaagtagactaatacagtgggccatgtgagatgatgagattgtgaccttacattcaaagataactaagctgtggtggcaatggatgatttgttctcctgaaatctttaggtggcacgggacagaaatccaaatagaattggcgtttgtcaaaagtagaatatattgtactttaaaaatgtgaatgtcagacatttgggggtggggggaggggggagggatagcattaggagatatacctaatgtaaatgacgagttaatgggtgcagcacaccaacatggcatatgtatacatatgtaacaaacctgcatattgtgcacatgtaccctagaacttaaagtataataaatatatatatatataaatgtgaatgtcatgtttctgagatgggtgtcaggaatagctgaatcaaggtgaccaaatggcgatgctctaaggaatgggccttgctgaatctgtacactctgcttttcttggcgtccactttatttcatgtcatattctctccaaatagtggcaagatgctcaccctcaactcaggactgagatcctatcactttgtcttgaccaggagaaaaagagcacctcctttacaatcatgaaaggtaacatcccagggataactctcaggtaccctgtgcacatccctgagccagttactcaagtcagaagcatggatattctgatcaggcaggttggcttcaaggatgaatcaggcctctcatgaactacaagctacggagttctctgaaactggagaagaggttcttcttcaaagaagtgcagtgtgtaatgcccacctgaagagggaaggaatttccagcaggtgtaagggactaatgtccactacaggccctcagttaaaagagttgggtagaaagaggtggggtgtgtgtatgtgcagcctgcattgactctccacttgatgctgtgtacattctgagggcaaaaccctgaattttccttgggtctgccgtaacaaattctctcaatggtgcctccatagggagaaaggggccaacatctgggggttctttcctggaacagtgttaagtgctttcagagttaacaagttttatattcaaacaactccataagatgagtctttcagacttaatttctaaaaccgcaaaaagtactgtagaggagttcagagatacgtctaaagtcacagttaatcaagaggactggtaggattcccagctcacttcaaattcatactcctgtatattcctctttataaataagtcagtgagcaaattatctcattaaaatgtaagtcagagattgccaacttcaggctcacaggcaaatggactttataacttgcagatacagtgggggtattttcatctgtgtgtctatatgtatggatgtatttacaaaataacattttatgtaagaatatgaatttctggcttgtcttcatctctccaggataaaaaatggctaaagttgagttgtggttgtcctctccggcattgcacactttcttcatttcccccagcattcttacctggccagtttctgtcatttatagaacctgtttggtcctggagatatttgagtttgaaaatcctggagtaatagtaccccattatgtcactcatgtacatggtagcctatgcaatgtgtcattccattcttctttaactgttgcaaaacatgccatgtgctctatctgtatatctctctctgttctcactgtcacataccacacacaccccaccccacccccacacacacacacagcaagggaggaatttgcgtttgctttgctcttttctttccctgccccctctcacttagctcactgcataatcctcctctcgtaaccttcaactccacaatgcaggaattttgcatgctctgtccccaaccgtattaataaagcacttaaaagtatgcgattttattcagggttatttatctaactgtctctactgaagtggtacttctgcagctcttcagacgcagtggtttccctgggggcagctttcggagtccgaaagcattgactgaaatgcaaagcccggatgccagctgcacgcgcaagcattccaagcccagtcattgtagccactggagatgggggtgggggatttgagtggatgggtccttccagcgggcatttgggtcatttggcccgtcgccctgcctgcaggctggcctgcacgcagcacctggcctaggcaccctggaatctctcccttcctgtggcagacacaggaaactcctacctcatcacggcagctgcatgtgtgggtaagcccacggtgatgatgacttctgtactggctgtttttactccttgctttaatgatattagctcacgtggttatcctttcccttctagcaggatttttccacagccagacaattctttgcggtgaggaggccaccctgtgctctgtaggatgtttagcagtatctctggcctcaatccacaggataccagtagcacccacccaccaggttgtgatgacccgactttctcctgatactgcctgatatcctctgtgggtgaattttcctggttaagaatcactatcttacaggaaggtggcaaagatgagagtatcagactgtaagttccgcgagagcaggcattgtgtctggtttggtcgtggttgtgtgccaacagatagtagattttcaatacatatttgttgaatgaatgaatgaatgaatgaacttccgactgatcagagctgaggactatattcatcctcaaggtaatataatgattattattcacatattaggaggaaaatcaagggttcctttttatcttctcctactaccccccgctgtcattatcaagtgagttcaactaagatttgcttaatgaaaacctaaatcattatggctctcttaatcagagtacctactatgtggctattctaaataggtgttctcattgaacttggttttctcagtgattcataaagatggttaatagcaatgaaattttacagattgggaaactgaaaaccagagaagtgaaggaatttgtccatggccacacagccgtaagggagtagagacctgattcaaatcttgggctagaaggattctcagaatcttcttttctctttgcacctgattggctgtgcctctcgctttattcagtcaaagctcaattcaggacgacgtgaaagaacattaattccaaggtgaaatgtgcaagaggttaagtgaatttgaccaagtttcccattataatttattttgggggaaaatggattaaaaacataatctctcggttctaacttcacgttcacttgaaaatgaaaagtgagtgttttacagatccacagcttcacgttatctgttgcattttgagagagaagaagatggatgcattggggtagagagtataataatattacaaggctttatatggaaggtcaagtgaggggaagatgagctggaaggatggggaatagcaggctaagaaagaacaatgcataacagatgtatctaaactgtttttaaaaatggttaatagactcaaggagaaatataaagaagggagcactctgaaaggtcagaacaagtagtcaagtaagaagcaaagtaatttaaacataaaaaggaaaatccgcagatatttctttcatgcttcagaaagcgtcggccttaaacattgcagtgtcccagtgatgcattgcaatcttctgcaagacactgaagtattttatgaaggcatactttttcctcctaagttgaggagaccctgagatggcccaaatttcctttaaaaatgaaatgaaactgctcggctttccttacattaaccttaaagataatgaagttttggtccttgccctataaaggatagacagaaagggcctagtcacatcttcctgtcatctatgtagatgatgtccttattcagaagtcattatatgagaatatgagtgttatgggaaggcaggaaggaaggaagggaaaggaaaggagaggagagggaggaagggaaggagagagagaggaaggaagggagggaggggaaggagaaagggagagagaggaaggaaggaaggaaggagaagaaagatggagggagggaagggaaggaagggagagagagggaggaagggcaaaggaagtaagggagagagacgaaggaagaggggaaggaaggaagggagagagaggaagcaagggagggagggggaagaaggaagggagagagagggaggaagggagagagaggaaggaagggagagagagggaggaagggagagagaggaaggaagggagagagagggaggaagggagagagagggaggaagggagagagaggaaggaagggagagagagggaggaagggagagagagggaggaagggagagagagggaggaagggagagagagggaggaagggagagagagggaggaagggagagagagggaggaagggagagagagggaggaagggagagagagggaggaagaggggaaggaaggaagggagagagaggaaggaaaggagagagaggaaggaagggagggaggggaaggaaaggggagggaaagaaggaagggagagatggaaaggagggaaggaaggcctcctcatcctttttttctgcgttcgtttactcatttcacttttttttttaattggacatctgtatatgtcagtcactgtggaagacatttgggaaatgatgactagtaaaaacccaaacaaaataaacaaacagaaagtacctgccgtcgttgtctagtggacaaggcaaaacatcaataattcaataattactccgtgtgttggggcagggtctgttttcttgcagtcatgcctcagttttggcttaacatatcagcttccatagttaacttattcatctgcctgcctctaaatcccacagattttgagatgtagatcagctttgtcctctcaagggtttcacattcaggaaagggctgacccatcaggcatgatgaagcactgcttgacagattcagcctccccagtcaatgaaggaaaggaaaggaaagcaaggttcgtttcatttcccaatcacgtgatggcattgggcactaccactagcttctgatgcattcattctggaacttgtttgtgaaaatcagttgagatactaaatatagaaggggagagccacttggagttgaaagtgacctttaaggccacttctgtcaacttagcaccaaatgcatgaatttacacaactgaatttctgctcttcggacataaactttccccattcttttttggtcagtttgtttttaccctgcagagctgatactgcagagggcagctcattttattcctggactatagttcctcattttgtagaaatcaactttgtcttcccaaggttactggtgttaattttaccttctgatgttaggtaaccagtcactggtttccgaagctgggtctgagtcccagaattcacattgatcagccatggtacctgaacaagcacctctagccccctgagcatcagggatctttccattaagtggagagtatcctccagaatctacctctccagaattcagggtaagataagtatggttgtttggatcagataggttttgtctccatggtagacaagagaccactatagcttaaaactcccattctgccaacagaacaaccgaaagagctagaatacgcttgtttatgtgtttgttttctggtagctgggcaaagaaataagggagggcttggctggtttgtcttgtaccatgtgtttatccttaaaccaatcagaatgaatcaggaatcgactactatcgttcacgtgactaaactggagtattagagaatcagcagggttcatgatgagggagtatagctgtgttcactgcaacacagctcctaagagcaaacagtttaatcagctcatttatcatcctaaccaaacttttaaaaggcagttcctcgggaagttaagcatagaattaccatatgacccagcaaacccattcccagttagatgcctaaaggaaagaattgtaaacagattcacttgaatccacatacacaaatgcttataacatcaccattcattacagccaaaaagcaaagacaacccaaatgcctatcaataaatttatcaataaataaatggatgaacaaaatgtggtctatccatacaatgaaatatcattgagccataaaaaggaaggagctactgttacatgctacaacgtggatggacctcaaaaacactgtggtaagtaaaagaacccagaatcaaaagaccacagattatgtgatttccttcacctgaaatatctggagtaggtaaatccacaccaacagaaagcagattggtggttgctacaggctaggaggaaggggttggggaataaccattaaataggtacagattttgtttcggaatggaatgatgacgtattttggaactagataggggtggtggttgcataacatttgtgaatgaacaaaatgccactgaattgtttccttttttttttgagacagagtctcggtctgtcacccaggctagattgcagtggcacaatcggctcactgcaaattccacctcctaggttcaagcgattctcctgcttcagcctcctgagtagctgagactacaggtacataccaccaggcccaactaatttttgtatttttatgagagacggggtttcaccatgttggccaggctggtcatgaactcctgaaaactgtttactttaaatggttaacaaccaccacaacaaaaaccatggagaccaagggagaaaacttaagtgagatatataacttgcttgagctatgtgttcattttataaaatgggcaaaagatgcctatgtctttaggttataacaagcttcaaacaagtgaatatttataggggaccaggttcctggcaactattaggtgctcaataaatagcctgcatgcaaatacctccccacacacatatgcccacttgtacccacgtaattcttatttaatggtgttcttttaaagaatgagataacaggccaggcataagcggctcatgcctgtaatcccagcgctttgggaggccgaagcgggtggatcacctgaggttgggagttcgagaacagcctgaccaacatggagaaaccctgtctctactaaaaatgcaaaattagctgggtgtggtggtgcatgcctgtagtcccagctactgagaaggctgaggcaggagaattgcttgaacctgggagggggaggttgccgtgagctgagatcacgccattggtcattacactccagcctggacaacaagagtgaaacttcatctcttaattaaaaaaaaaaaaaaaaagaatgaggtaacagaaacaaagaacttacctagcacatgatgttagcaaaccctgtcaaatttgtattcccatatttctcaaaacttgttcttctttccctctccacaccggtgattgttgtcaccctgctttcctggactgctaaaataggctacatttcccttttcaatcccttttgcttgctcttgatgttcccaacagcggccaaagaacccatctcacaatgtacataggatgctttcccttcccagttaaaaaccccactgtacttagagttaatcccaaccaccttcatataaagccctggaagtctggctcctgccaaccttgctaaactcatcctttttttttttttttcctgattcttatcccattgactttgactgtttctaagctggctctatcccaagtgaaaagtcacctcttcaaagaccttttctatttaaaagaattatcccagctcttctatattcttttccatgacatgttattcacgtgcttccaagtcctgatcaccatttgtaattttaaacattgagttgcttttccttgctctttctcttattcatgaaggcagctctgctgttgaacacaatacatggtagacagcaggccgtcgatcagcacttgttaaatgagatcaatgtgtggaaattattattaaagtcctgaaaattttacaaagtctattttgctctaatgtgtacattggtggtatagtctggggaatacatgtatagtttgcattgtggacatccgattgtttccctggatgctgccctttcaacaagaaatgcgaccttagcaaaagatgggggccccatgaacttccaactcgtcttttatttatggtatatgtgtcagagaaacataacaacatttgggaatttattaaatggcagttttctcttcaaattcttgctctagtttattgtgcctaatggagtcttactaagggcaaagctaattgacaacaaggtttatttctgccgatcttagccaaaaagtcaatcaccactcaacgagagctactctgactctttggccaatggacaaatttccatcttgactggcttgactggtcctgggagaatagaagtgaatgagcttaattctattttgatacttttcattttcagcaaaactgagacaacatcaaggagttacattatcatgagaagagaggggttgcatggaaattatgtcacaagaatgcttggtcaattttcattgcattcagctctattcacaaaggcctgttttgctggcagacgcttttgtcagatatgtggctcacggcaggcaatcaagctgtggcatgttgcagagggacagtgagggctcacatgctggaggcagaggttactcaggccaggtaatgaataaccccactggaagagcaaaagagctcatttctcagtggtttatcttccagtgggttggtgttgtgtataatacagtgagttgagatgaggaatctatttggttttggttccacccctttgccagcaaaaccacaaagtgggaaaagctaacctttgggaggtaaaagctaacagtgcaagatgccatcaataaaataagctccctcatcagtgaagaagggggaaccaggctcaaagtttgtcttctaccaggaatataagcatcgtgtcctggatagtatgaagcatttaaccatgaagtcttctgttgcaaatgacatgtgtatacatatgtgtgtgtgtgtgtgtgtgtatatatatgtttgtatgtgcttgtgtatatgtgtgtgtttgtgtgtatgtatatatgtatacatattttatatatatatgtatatatatatgttatatatataagttgctttcaccaaatccttgtaaataccctgtgctgaacggagaagtcagaaatgggtaatagactacattcaaactcattttcaatttccaaaaatatgcaaggcaccccatttttggtacgtggatgttttttagcatttaatggataacaattttgtatgtcccataagaattattcacagacatctcccaattccattttcagagacttactgtagacttgcttttatgcctgtagcttggatccaagaaatttatttctacctctgcagtccaaaaaacggaatgtctaacgattttttgcaaggcaagtcgaagtgctatggtggaattcttcttagcaagacaagcttcagtggaaggaagaatgtaaaacagaaaaagttctttaagaggtatataaatctacacatcggtagtagtcacactaataataaacattcatttggcatcatatatttttaaagtgctttaaaatgttgacattccttagaaaggagagaatagctctgggatgaggatttttattttacatttcagggatgggttacacagaaagaaagccacttgttcattattgactaagtgtggcaaccagtgtgaccattccctagtggtatttttggctcttggcttagaacagggtatgtatccaggaggcaagagaatgagtaagtgacctactgtactgaaaagaacagacagagatgtagtcacaaaccagtttagatgagggacctttgtttgtaagatgtaaacatcgtaaacaaggagatgctggtagtttttgacattttatgggcccccgtagcttcatcgcttatgtacattgaatggatgtatgttgtgatggaaaggcagtggctgcgtttgccctttcaattgatgggcagccatatcttgggatgaattagccttttgtgggatgaatatgatgcctccctctgccatgacatcaagaatatcctctttgagggttggagagaagttgtctcttttttcctgccttgcaatttatatattaagggttgaccaaaaattgttaaaaatgtttaaagctaagtaatatcctgtgctagcctgaactaaaaaataatgccttattctgacaattccagtttttacagttgaaggctattaatcaatgaagcagtgtggatccatataaatattgatcactgtctccttgccctcctgtgaatgttctctcttaatgacagccaatttcaatattcattagaaagggtgcattttctggcttgcaccattgctgattagtaactagagagatttaactagaccatggtcattttgtataaatagttcctcagatcaaaaagatcctggttattgtctatctggacttagcttacctcttcaacatttcagaaattagagtgttttcttgtttgtgtcatatcctgctcacctaaacattgctactgttaagcattaatcttctcatatttaatatataaaaatcaaagtaaatattcaagagttatatttagatctgtaaagggaagcccaagtgctttgtatgaggtgcgaactagggttaataggatgtatttaacaccatattgtttcagctcaagttagggagagaaggagatcatgtatgcaaaaagtagaacatttctccccttcctattttgtctagaggggcgtaccctcttttaaggtattgtcacatgcacaacatctggccttcagttctcctctccgctgtcatgcaatctggcagaatctctttctgctccatggttcctaaatgcatccatcccattgccattaggattctacttttggcattttccccatctgttttggtaattactgtcagatgaactgatatctctaagttgaaaatggccaccttttaaggtagcacattgtagtcaacttcccaaatcatgaagtctatgtggcttttagtagttgtttgcagaagtaatttagtaactttactttttcttttttttttaatttctaagccactgcaagcacgcaccagccttcagtggcctgaattattcagcagtcattaaaaatgcagtcagtgataaggcagacagtccttgtgcctgggtttgtcaacatatcttgtcctcagcaaagactaggttcactggaagcacgcaggatttagttcaccttctctagaatggctgttgttgggaggatttctagcaacattactataaatgatctgcctgcctctgtgttgtggtttataaactctgtgtaactaggataagctggctttggaagaggcaagccgttctttcactagaagggagaggttattgcatcacccatcagcaagagaggaattcaggagaggtagagagctgtgtggggtttgggtggcagccagctactttccaaaacttcccaggggctgcaatacagccgccaacccaaatgtcattgggataggccagcgtgccagatgccatcacagaaaataacttcccttgcctggcatctgggttcttgccttgtaatccagaagaccacatgctggatcagctggtcccagcggggaccatgagctcttccgtcctctctccctccctgtctgctgagcatttgaatgagtcatcagagtgcagaatggattttggccatgcccttaattgagtgttctgtacatacaataataattaataataatttgaactgatccttctatagttttgtctctggaccaggcactgctctaaaggctgcacagattgtaactcatttacatatgtaacacatatctacatatctcattagcctgaagcacaatagaatgagaaaagtgaaaagcaaagtgcttagactctagatttggaccaactggcttcctatgtcaactctgcctctttcagtataggtgactttagaaagtaaattctgctttctcaagccaagcgtccatgcacagacaagggaataaacaaaacgtggtgtatactggaatattattcagccttagaaatgaaggagattctggccgactgtgtggtggctctagcctgcaatcccaacactttgggagggtgaggcggacagatcacttgaggtcaggggtttgagaccagcatggccaacgtggtgaaaactcaactactcaaaatagaaaaattagctggacatggtggcacacacctgtgaagccagctactcaggaggctgaagcatgagaattgcttgaaccctggagatggaggttacagtgagcccacgtcgcgtccctgcacgcaagcctaggcaagaaagcaagaccctgtctcaaaaaaagaaaagagatgctgatacatgctacaacatagatgaaccttgaggacattattctaagtgaaatgagcttgtcacaaaagaacaaatattgcatgattccacttatatgaggtgcccatagttgtcaaattcacaaagacaaaaagtggcatggtcgttaccaagggctgggagaaaagaggaatggtgagttagtgtttaattggtacagagtttcagttttgcaagatgaaaagagttctggagatgaatgttgggaatggctgtgcaacactgtgaatgtacttaacactactcaactgcagacttaaaatggtaaaaaaaaaataaataaataaaataaaaattaaaagaagaagtaaattctgctttctgcacatctgccagctgcccttgtctaagttcccaaaacagattctgctttttgcttccacagagcctttgcatggttgtttccccttcctgcaatatttacttagtactttttcctaggttactctcctcatctttccaaccttgggctacacacgcacctttaggaaagcctacttctgtgttcttcccatcttgtgtacgttccaaattctgaatctccaataaaatgaatatgcatttctttctctctttttttgtaacttttattttatcttcaggggtacaagtgcaggcttgttacataggtaaacttgtgtgtcatgggggtttgttgtgcagattatttcatcacccaggtgttaaacctagtacccattacttgtttctcccgatcctgtccctcccctgacctccacctgccaagagaccccagtgtgtgttgttcccctctatgtgtccacgtgtttttatcatttagctcccacttatacgtgagaacatgcagtgtttggttttatgttcctttgttagtttgctgagaatgagagcctccagtttcatccatgttcctgcaaaggacatgatcttgttcttttttatggctgcatagcaccccacagtatacatgtaccacactttctttatccagtctatcattgatgggcatttaggttgattccacatccttgctattgtgaatagtgctgcattgaatatacacatgcatgtctttttattatcattttctcctttgcctttcctaaaccatgcagtttgatatatgatgaggctacttctaccattgatgtaggtactgtgggtgccaggatgcccaggaaaaggtggaatcagccagtaatcccagcaatttaggaggccaaggagggtagatcatttgaggtcaggagtttgagaccagcctggacaacatggtgaaatcccatgtctactaaaagtacaaaaattagccaggcgtggtggtgcatgcctgtaatcccagttacttgggagtctaaggcaccagaattgcttaaacctgggagctggaggtttcagtgagcctagatcgtgccactgcactccagcctgggcaacagagcaagactgtctaaaaaataaataaataaataaaaattggaatcggctgggatgatacctcaacaagtgaaattgtcctgtcaagaccatttgcatgtgtgaaagaataaaagaaaaacagaaaacactgagcttctctgaggctttattgccccctgataagaccgtgagaactcatttgtcttatattagatgattattttactcttctgggtctttgatctaggcagttagctggttagaatttgctgatgttgtattcatgtttctttgaatcagcagtaactcacttagggatgaaaatggggcatttggcttataagaagaaaacaaatatcatttatattcatttttctacttgaaactactacttgaaaactgggcccatagagttcgttgtgctaaaaggaacatttctcattggtagttagtatttcaattgtaatcaaattccaaaacttcctacctgttgaaactataagatgatggtgacgattatttgagactgagcctagctctgtcgcccaggctggagtgcaatgctgcaatgtctgctcactagaacatttgtctcctgagttcaagcgattctcctgcctcagactcttgagtagctgggattacgggcacccgccaccacgcctggctaatttttgtattttcagtagcgaaagggtttcaccatgttggccaagctggtcttgaactcctgacctcaggtgatcctcccgcctcggcctcccaaactgctgggattacaggtatgagccgatgcatcctgccgaatctataagatttaaggataataataatgaatgtttacggagcagtgttcatcaggtagtgttctaagtactttacatatattaatgatcttcactatgttatacttgtatatcaccatctgtgatcatctgaagcccttacagtttaagggaaaatctgcatttgatacatatagtgtgtgttaaagaaacatgttaaagatgaaggaggagtatgttattttattgtattgatttctgtttctaaatactggggttttcgtggtgttttttgtttgtttgtttgtttttgtttgtttgttttgagacagggtctcactttgtcacccaggctggagtacagtggtatgatcacagctcactgcagccttgaccttctgggctcaagtgatcctcccatctcagtctcctgagtagctaggactagaggcattcaccaccacacctggctaatttttgtagttttgtttgtttgtttgtttgtggagatggggttttgccatgttgcccaggctggtctcaaactcctggactgaagcgatccacctgcctcagccttccaaagttctaggattacaggcgtgagccgctgcacctggcaaaatattgttttttgaaactcttcttgaagtactaatgttgctttagatcttaaacagcagcacaaaaagtttctaactttgttggaacattctacttttcccccacaccttcccaaacaattctcttaatatacaacaatatctgttctggctatcgtgaaaattaagccactggatttgggttggaaaagaaggtttatttagcgcagtttttagtatttatatcagattgccatttctggcttgagacccgaggcagaagtatcccctgcatttggaaaatgaaaaatccactggaggattgattattcataaccctgaaatgtattgccccacctctaccataaatcacacggagtttttattctcattagctgaattctggcatctcagtctcggcactactatttattctaattctctcagcttgagtaatgggtgtggcccaagcaggaagcaggtcacctcctggcccgttggactatcttggaaagagcatgtgattccctgtaggattaggggatttgcagttcaatgggcaaattatgcattccaacgtctaagtgtggttgtttaattaaaccctttggttcattcaagatgactaaaatgtttcttgaaacaggacatcttgaaagttattaaaatttcacagcaaacacttttatggcaggaacttttatgaattttgtttgggttggggcattgcaagagggttacttaaaatgttttatctggaatttataataaagaaaaaacatttcttctttatgttggtcatattttcagtaagagtgcattacaaaaaatctacatctggatgacaaatgtgatacaaatggacaaatatatatgcatatacacaaacacacacacatgcccattttctcatccccccttctttttctctttcaatctgtctataaatgtagatactcacatatacatatatgtttatacatatattaaatatgtaaatatgtatataagtatatatgcatataaatatacttatatgtgatttgtgtatacataattacatgagtgcatatatacctaaatatgtatatctgcatatgcgtgtgtatatatttaagggttttcaactttggccctcttgatactttggattggtaatccctttttttgtgcagtgtccctgaccactagatgctattaccataggcacctcagtgataacaataattgaaaagtcaccaggaatttccaaattttccttctgttgagaacccctgcttattgcttggcacacatgcgcacagagaaacccatatatgtgtaggtcatgcacttactgtaagagacatggaaactactgtctcctagtttatccccaaaggactgacaagagtgttcactgaaaattcagagacagggttgcatgtaaatgtctgaataaaacacatggaaaaataaataataggcatgacatatcatcattggaaaggaaggtaccttctgatgcagacaggttgtgccacatgacagctgtgtgagcttgggcaagaaactagatctctctgagctttagttcttttatgtttgaaatgggcaacatcatgattatttttcaccacttgttgaatttatagatacagtgtacctccccctgcatcctcattacacattgactaaggaaatggaatggtctggaacacgtggcaacttggacatggggaggtctcttcgccattggctgagagtaagctgaacaaactttccatggtgacagctgcaggatgctcagcatgcagtcaattcagtccaacatccgtgcttcgtgatttgcatccatgtgacttgaagcagccagttggaccaggtttctgattgagtggccacgtgcatgatgggttgggttggactaactagttgtctgcaagaactggctaaacggctcagccaaattttctgtttgttgattcagacccgactgactttgccaggtttggactgtgctggtgagagagatatggagtctgcggacagtttgcaagcagtgcctctcgacattttcatcctgcatatggggctgtgtcggccttacctgtctaccttctttatcttcttccttcatttgttctcttcctcctcctcctcttgtttttgttacttggattttcaggatgtcaagccctggcatttttaatataaattggtaatataataatatattccctttattctttgtcattagctgaacgttttaggaatatcaatatagaatacatttgaatgttttcattaaaattgtaacacacccagtattaaatcagaaagtgaatgttcagcaaacacatattgatctcttgctacgtgccaacaactactccaagcacttggcatgaatgtaccacatttattctccaaaccagcctataggcgtggtcagggtgtgccacgtgacagctgtgtgaccttaggccagcaactagacttctctgacctttagttcttttatgtatgagatgaagagacatcatggtcactttgtaaaatttattccaaaacaaaaagatgtggaagaaaggcatattacctttggttgacattatctttgtttgtaggtgaagaaactgaggcttaaaaaattcacatatgttgtggctaagcagaagggctccccaggaagttgaccccttactctttattagtagtagtattaatacattttgagagaggctgtcactctgtcacccaggctgtaatgcagtggcatgataatagctcactatagcctcaaattctggggctcaagtgatcctcccagctcagcctcccaagtagctgggttacaggcgtgcatcatcacatccagctaattttattattctttttggtggagacagggtttcgctgtgcttcccagactggtcttgaacttttaggctcaagtgatcctccttgcctagcctcccaaagtgctggtattagaggtatgagccactgcatcctaccccttattctttgttcttaatgattatgttataatctgggatttcacataatcaaaactcttaatttctaatggatttaagagattcattaaacctctgaagtcacatacaaaactcgataactaacatacatttcttttttcctggagagaatgttcatagcttttaaatcaatatctcaaaatgatctttgttttcacagcaagattaaagataatcattatgtaataaaacttttattttctgtttcttaggtcagtctacagctcaatcttaaacagcagtattgtcatcaaagggtaactccagagaaaaaaaatcagagtaaataaacatttataataatatatctttcatcccttcttcagagtctgttctaggaaaatgccaaagtattccaaaaaaaaaaaaaaaaaaaaaaaacacccttgggcttttcattaactacacttcagtccttgagattatcttgatcttgaaagttgctggcctttgagcaacttcttcaaaccctcaagatgcatccccatggaccatgctggtcctttttcctgagccagccatttcagcacacatctttgtcatttcttgtcatattgagatcaagtttggccatcctctttgcaaaatcatattcagttttcttaagtaagattgtatttttggcatgcttccattagagtcagagccagcggtggctctcagttgcaatgctcctagagaaagggaactttaattaggacacaatggggttggcctagggctcgagttagattcagtattcaaccaatgttgctgcttaagcctgtaaatgtatggtatgcaacttgtgggtactttccagttttcactgactttcttccaatattgtgtagtgtgtaaagatcggaggtattaaatccaggacctgggaggtcatcacactcgaaggaggcaggctgggtcatcagacatatggctgtcttggttttgtttccttgttcccacttctgctcatgatgggcctaaataagagatattcctctactgtaagaaaagctccgtatcccaagtgaagctaattggtaattggtgtttcatgtcagaggcacagtagggagcagtggggattgtggcaaagtgaggaactcatgcctgccttcacagtgcagctgctcctcagctgcataccattttcatgaattagaaatataccagactttctgattgtttacctaagagagtctgaaaagtcttatttctaggtgctgtatgtccatttaattgttgttacttagtctagattatttttattgataacatagaacagtggtcttacatgtctctctagatcctaactaaaataataaatatcttatatttcatttgaaaaatatttcatatagttatagaattctagattttgagtaattttctttgagagctttgaagatgttatttcattatcttttgtttcctgtactcttgagtttttttaaattttattttaggttccaagatacatgtacaggatgtgcaggttcattgcataggtaaacatgtgccatggttgtttgctgtacctatcaacccgtcacctagtattagttgaatgtttgaaactcaaggttaaaccatacctgggggtgttatctggtcttcaattcaccactgttgaccaacagaggctattatgatttgcaaaacgtattttcataatcaacaagacaaaaataaataaaattttaaatctgatttttataacttttctgagaggttaaacttttggagagctagagaaagagctatgctgataaacaagcttacttagccttatgtttttgtttgtttgtttgttgaaagatgtttgcctgctcacttaaggatacttagcattagagaaaagtagcttttttgaaaaaagaaaataacttcgggttgccctttttgtccatcagtcttgcatagtgctttagacagcacttcatacactcatgcaactcttcacaaattaccaattactttcccctttgcgtttatctaatttaatccctacagtcttgcaaatagatattcaattctcccagcccatagcagcttgaaacagttcaacaaacacaattagcccatccctgaaaaaaagtatagattgcagtgtaaatagaaatttgtttttccacttcaagtgtggcacaaattatcacccaccttagatgaatgattaattccacaactgttaagtatgtttttacttttatctaagcaaatattttgagagtttttttcataacttagtttgatacctaagctggtaaatgttttgttcaagtttgctgaagccaagactaatttagaattagggaagttaggactgctttcaaatttgagagaaaatttggaaggaatccttagcctctccacagccaccaccctaatccaatgcaatccaattgcctctcacctgggcagctccagcagcaccctccctggattccctgtctccgtccttgctccctggcatcccccacagcaaagcagccatggagattgttctgaagtgataacccgaatgttttcctcttgaatgtgtgatttttttagtggcctcctgttgaaagcagaattaaatcaaactcgttgttttgctttcaggctctgcattatctggcctctctccagtctctcccttataactgtaccaaaccatggtggcatccttccttttccacaaacgccaagcttattatgaacctagggctttttgttgttgcacatctatttattgtcagactgtatggtcacctcctttttttttttttttttttttttactgagtttgaatgcaattattccttccctttcctccttggtaaaacagaactcttggagttttgttgtgctgactgcggtggtatcagcaccaaggacagcgcctacgtagcacatccagaggcttattaaatatcaggttcaacgactggctgactgactgatcaaagagagctacagcataaaggcttcagagtcaaagttgaactccagttctgccatccacgagacaggaaagttatacaacctccctaaacctcaattttcccattttacgacagggatgagaacagtgtctcccacattaggataccctatgtattcttttcctattggtccccagcaatcacaaatctaattggcaggtaacagtgagcacttgtttagtgcatgtgtctgtagtacaatggggtccttgatttaggctgcactcagtcatgtgtctgcaggtcagctggccctcaagtgaggaggctcagctttggagggaactctggtccctgtgtctcaagtcctctgctggagaatagtagctagtcagaaatgttctcttggtgaaggagaagtgcaagagaaacttctattgtgcaaacgccttcaagcctttaaccgcatcacactcgctgccggttaacattccttaaccaaagcaagtctcacagacacacccgcagtggaggggacactcacagccaacgggtaggaaagtacactctgcccatggaggtggagaaggagcaaatactcctctatggtgatctaccacacactaagagttgtgcaagataatgagtgttaagttcctggtatgtgataggcactcagtaaatgttagctaaagttgagaattactaatttttctgtaagaccctgtgcctgccacaataatatgaaagtaatgaatagttttatgttaacaaaagctaaaagcccccaggtcatccttaaatgaatgtatatcctgattcaggaatgccgtgattttaagaatacattagtgactgcttgtcatttacacatctcttaatttagctgaaatggaatacgggaaacatagcctctttaaatccaggttaagtacatttccattgcagggagcaaggtcggtgctgttcatctaggtattttaaaatgtggttccaaacactgcatgttctcacttataagtgggggctaaatgatgaggactcatggacccatagaggggaacaacacacactggggcctatcagagggtggagggtgggagtagggagaggatcaggaaaaataactaatgagtactaggcttaatacctgggtgatgaaaaaatctgtaagacaaactcccatgacacaagtttacccaaataacaaacctgcacatgtacctctgaacctaaaataaaagttaaccttaaaaaaatagaatatggttctggaaggaagaataaccgctgattttaggaagaactgtgaatgaaggcaaagacttcagagggagatggctctcagttttgagccttggtttctttatcagttagggatattaccagctctctgatagggtccctgtgatgtttagaaaagggtctacaaaccattaacacagtgagtggcacatgaacggctttgcaaattcttgctgcctttcctacctactgctcactcccttccttgttcataaaggaccgtgctgttggccattttgtcgtcagctcttctagtaggatgccctatgtgggtatcagaatacatttgtgcagaatcttctagctgagtcccttcatatctttccagtcatttgggggaaaaggtaggatctgaatgaacagagactttcacgcttacacttgctggcttagctgaattaggggtagcattacttaatttcacccatcacagatggttttacctgtcatctcagccatgagccaccttccttccagaactaggcatttcttctttatggtgagtgaacttagtttttgaccttcctttttataaaacactaatagttgcttataggaaattcaagtactgcagataagcaccaagaaaattagagttgcatgttattcatcatccagagataatgtgaattagcattatcattaattgatttttctgtatgtctaggcagagatatatcagggaaaatgctatttataacagttgcctttttgagtaatcatttagctgtcatctatttgtaatctgtatgtatatcctacctatatacataacaaggcaaatgttgctatgtatagccaacagccatcgcccaagaaaggcgggtagcaccatcttgttctaggagaggtccctttgtctgtggaatcccagataggtttgattttgcaagactgagagtgggagccagggaatacagcactgctctgcataatagagggagggaaaagtagtgttccaggaataggactgataggagagggaggggaagagagaaatgggagagggaaaggaaggaatcaatgctgaaaggaacagaaagctgggggttaggtggtatcaccaccaaccttcagctaagttgactacatttttaaatgtttttgcaagggtgggtttgtttccattcccctcttttttcccttctcttcattgtctttttctttccttcttttctttctattggatgaaccctgaaagtggtgcaatagagaataaataagataggaggagcctggaggacaataagaacaaaatctacctgagaatttgcaggaacctggggacatcactagacttccaagggccatagaaattggagctttataccaattttacttacatcaccaaggagaaagcatttttccagctatctgaattctctgtctttctctctgacttcccacattgtatatcaactgtttatatgttttgtagttttttaatatagctatatattatgaaaatttccttcttcataggcttctttctttaaaaaaaaaaagagcctgtaagaataatgaaagggctgaagaataaaatcattgaatgggtaccagatttatttttatgtattttttatttttggcacagtcccaattgctgagctttttcttgtgctatctctgattttccaccataacaaaccgacagtgatgagcaacattgtgtctatatcttaagcacacccaggactttctggagtcagttcctacaagtggaaatacttgaataaaggttatacaaatgtttaagccttttgatacacattgttaaatgatctcttcagaaaggttaaaccaatttacactctcaacagtagtgtttaagagactctttctctaaatctcctttaataatgaagagaagcattataaaatcctttccaattgccatttttataaaaaatagaacctatttgttttgcacgtatttggtaactctaagaatccctccccctttttttcccatagggttttgaaccagttgtgtttcctctgggaaaatctgcttcttcatgtctttcaagccttttattgattttcgagagaagtatctttatgttttgtttttaaaattcaaatgtggtgtttctaaatggtatgtgaagcatgatttcacttagtagacatttgtggattagccattaggtgaaaaataacactgaagagtaaaacaaatgctttttttgctgttcctgggagcgtgggatgcttatattaattgtttactggtgaccatggatgctgacacaatgattaaatgctttaaagccagcttaatgatataaagccatttcttcatttgtgtcttctaagtgaaatccttcctaagtgaaccacaagagtttcctgcttcatcgcctcagctgcagcctcagctgctgtgattacacttaccttgtctctgctttagttagtttttatcccctccctccaagaaagtaaactacctgaaggcaaagactaagagtatataccccagggacggggatcataactatgtacacagcagacactgagcaagcatttagaggagtgcattttaccattagactcttgaaggacgtcatactgaattttcagaattttttatgtacccagggcattttatgtgaacgtatttaccagggagggtcatgctgtgtatgacctttatgtcattctaccaaagaatcaggcaccaagacagctgcagtttctctggctactctgtttccttcttttagggaacttaggacactgggtgattctttaaaaaaataataacgaattaactttttgaattgacaaagatggtatacatttatcatgtacaacatgacgttttgaaatatgtatatattgtggaatggcgaagtcaggctaattaatacgtgtattatctgatatacatttttgtagtgaaaacacttaaaatctactcttccagtgattttcaagaacatgatacatgtcattaactatagtcaccatgttaaacaaaagatttcttgaaactattcctcctatctaactgaaattttgtatccattcaccaacatctccccaaccctcaccaaccccaatcccaccccagcccctggtaagcaaacttctattccctacttctatgagttcaactatttcagattctacatgtaagtgaaatcacgcagtatttgttcttctgtgtgtggcttatttcactcaacatgacatcctccaggttcatccacagtgttgcagttgacaagaatttatctctttttagggctgaatgacattccattgtagatacagagcatacttctgtccgttttttttttttttttctgtgggggatggagttttgttcttgttgcccaggctggagtgcagtggcgcggtcttggctcactgcaacctctgcctcgtgggttcaagtgattttcctgcctcagactcccaagtagctgggattacacgtgtctcccctcgccgccatcaagcccagctaatttttgtatttttagtggagacgaagtttcaccatgttggcttgcctggtcttgaactcctgacctcaagtgatctgctcacctcagcctcgcaaagtcgtgggattacaggcatgagccacagtgcctggtcatgtccattcatctgtcagtgcacgcttaggttgattccatatcttagctatagtgaataatgctgcagtgaacctgggagtgcagatatcccttcaaaatactgatttcgtttcctttggatatatacacagtagtgggattgctggagcatatggtagttctatttttaattttttaaggaacctccataccatttttttcataatggctgtactaatttgcattcccaccaacagtggggcactgggtgattcttaaagagagtcttcaaggaaaatgcaaaagctctacagtatttgggtggtgagacagaaagtggagaaggatattgtgttctagcacactgcaaacatggttactgaatttgaaattcagaaggaagagaagggatttattttccagctcagaattgcaggtagagcctagctatgagaactcctatttcttacatcatcaaaaaggaggaaggagctggttctcctttgagagatttttgtttgtttcccccatatctccattcatttattcgttcattcaaaactttaaattttaagcttttcctccattgacttgaagtaagtggaaatataacttataaggaaagtggaaaacaaattacattcaccactctgtgcttgctcattacaagtaaaggttacacatctggctggggcagaggtcttcaactgacagttcctaggccttttgtactttgctgtctttttgctgtttcatgttggaattcatcgtcagcactgaagtatctggaaattttgcacagatctttatatttctggcttttcattaaaagttggaagatctgacaaagcttgtccatcatccaatataacagcaatctgttgagctttggtagttgttaaatgttttgggtgtagcctgagtgtttcagttaacctgctttactcattggtgtcagctacttgtcctagacgtaacctttttcatttacatcctttttttttttttttaaatttgagtcacccaacgctaaaggtatttaggttggctattattatttccacttttgatggcattaggtatctctgggctaatgttacatagtaacgtcagatctgggatgtgaacgtggtacctaaattcagaccaagtgatctttccctaactcatatgacctacccatatttggcagagccgttatcttagagcctccaaaaatgcatgtgtgtaatcacacacattttgtaaattttgtaaataagcatgcacatatgttaaaggaagttcagcatcttgagcctctgataataagcccttctgggtaaatgagtgttctgcatcttttccatctttttcatttacgctcttataattacctttaaacacagcatcactggacacagcaaacatatctaggtcaatctgtttgcattttgatggctccgctggataaaatctcttctccactttcttgtttctttggaagaagcagagaccaagacaaaagaacctgtggttcatagtggcttcaccattcacaggtattctcctgggggtcaaatcaacaaatcattctgtcagttctgtggagctattcagaaattcgtgttgatgtcagtggcaacaaggaagagcggagacatgtcaggctttggtttctggttcattttcactctaactgctttgcatggtgttctccggcttgacaacccctcaacctcttccttgtccttagggtaaagtctgagttcccaacgagacttcaggatcaatcctctgcctatctatacatcattgaccttgtcatcacttcctttctaaccatctgcaaaacattaaatgcactctcacctctgagtcatttctggatgtctcctctgtctgaatgctctcatttccagcctcttttcctttttctgttcagctcatttctacatgaccatcttgcctatgctttgacatcacttctccttaccctacttctcaggtggcctagaaacccctactccatcaccacatagtattctgtgtcgatctatggagcctctcgttacttaccttgctgcctccttgtgactgggagttcatgatgggaaggaatcttttccttgtgtctccaacactgagtccaaggtctgcacatgagagctcttgagaaatgcatattggaggatttaatattttgttcgttcattacctgaatctgaagagtctttatataggagctctcttgtatctagaaaggggactattacagtgtgagacagcaaaggaagaattgccttgaaaatacgttatggtgttagcagggatggaaagtgtaaatcctcctaacatgtttttgagagtttacttcactttgggcattgtgttgttgtgctaagaatgccctttacttccacctgttattttaattctcacatcaaccctgtgacccccttgtttgtcaatgagaagaccaatgagaaaagaaatgaaatagtttgcctgaaatcacacagttcattgttggagaaacaaggatcccagaaggagctgtttggcagcaaggactcatagtattaaccactccataaagaaattcttgactcatttgcctttagcccttttcttggattactaattcagcaggaagaccaaccctgggctccttaggttaatcgggtttattggattatctagcacatttcttagattatccaagctggaatctccattgccaagatatcactggcctgattaaacaagctgcggtctctaaagactccaaatgtcatgttcctgtctctctctctctctttttttttatcaatatatgcccattttaggtgttattttattatttctctaactgtaccaactcatcattgtgttccaaaggacctcccaggtatataatcctctctgttgctacttaaaagaggaaaaatttttcttttcaatcctgtcttctgattggaggtgaaagccattcaaatctaagttagaaagacattcacaagccatttttgcaattgttattatcctaaaactaaattataggcattacgtctctgaagcattattgctcatacctagaagggtgctttatgttgtatttcatacaatgatgaacaagaagaaaaagactggaagtttagaatgagtgattttggtctgaaataggtatgaatttttcaagaatgtggtcactgcattttgtaccatcatttctctagacatttcaaatttcaattcactcattaatggctcaaccgttaataagaaggtgttttccacagttttcttgagttttatttgctgttgtgtcctgagtgtgcataattttggaactttataacagtagtgtttttaatattttattcataatattaacgttagctgttatttagggagtatccccaatgtgccaaaaataaccccatctccgatctttgcaacactgttgaaaaatagaaagatagtttctattttagacaatgaggctgagggtagagatatgacttgcttagtgataaacagctggttaaagcctgagacttaataggaaccaaaaattgcctgaccttaaactctgtgctatttccattctatcacactgctgtggaaactttgagtacaaaaagatttcgttaaaaggatgttaattgcagagttgtaataatagtgactacttggtaacaatataagtatccactgataggggattggtttaataacattttgttatatccacataatgcaacattatttaatgtttaaacatgcactttaaaaataagtgaatatgtattgccatggcaagatgtccagcttatatttagtgtaaaagagattgaaaaagaatttgcaccacattatctatttttaaagcatgtttatatttgtgcatgcatgggcgtatccctaagcaaggtctggaccagcactgttcagtagaaatataatgcaagtcacatatgcaaagtaatttttttagtggttgaattaaaaaaataaatgcatgaaatgtttgttttaataaattttacttaatatatccaacatatttcaatatataatcaatatagaaatattaacaatatattttacatttttttgtgctaaatcttcaatgtacatttttatactgacagcacgtctcatttcagatcagtcacatttcatgtgttcaatagccacatatggctttccgttaccttattggatagcactagtctagaggaaatataataagatcataaagtgttcactttgggatggggtgattatgtgtgttggtgttagtttattgtctccttttgtcttatttgcatttcccaaatttccataatgaatacatactgcctttgtaatttggaattaaaatacactgttaaagtcatcattcatttttaatagggagtggtgagcttctaaaatgcactgttaaaaataaatacatagaatgtaaatccgtgacctattttcagtcgaggcgagaagctggagatggtatgaggttggctctcctctttactcccttgccttccagctctgtaacccctgctcccaaaagccaggcctctggggttctgatgaggggagaggttaagcctcacctccacagtcagcgagcagatctctgatgaagccaccattcctaccagaagttctgaggtttggcctcagattcattttcaatctctttgaaagacaaaggcggctgtcatgggagaagcctacactagtttgtctcaatcttttatggcattattgctgacctttcaccaaggagcctttttagaccttttttcccttcctaatcaccattccccttccctcattaaattttaataccacacatacactgtatgtctgtttataccatgtaaactgtgtgtgcgttgatgtatggtggccttctggatggccacaaaccaaagtcatatctaaaatttcttaccctcttgtaactaagaatccatttccacccctttagggtaaataatcgctccctgtctcattgagaaggacgcccagggccatgttcactggtgccaaatgtcagtaatacggttgtcctgtgagttgcatttaacttcgaatcttggaccagtcaccagctctctcaccgttctacgcacacatctttgcctttgtggatacctgtcacttccctatccccactagggcatctgaaagtccatcacacccgggaaacctacccaagtctctctccctgaccacatgggaaacagcctttctgtttctcctgtggcatgtgtcatggctggcattctctgttactcgttctgatcctgtctcctctccccctctgatccgaccctcctggagaatgggatgctgtataatttcatttcccgtgtgtgtctagagccgggctttgcatgccatcgtccttcagtgaacagttgtgaaactgaacgaaattgccttcggaaaaccctttccggtccaactgtttctctatcagaaaatctcattaagacttaatcgctaacatcttcccatccccggggtcatgctgtaatccccagctgagagtgcgatccctgactgggaggaagtgagagtatcatttctttcccagaacccacacgcttcctgtgtatttcccaccacccaaaggtcaccacctggggtaaaattacatgcaacctcatgagacttgctgcccctctatcttccctcttttatttctgaagtcactgtagggaaaatgtactgattgcaaactgaaatagcagccactgggagctggactggtatggctgtcagccataccccccgggtttcacctgcttaatgagccggtagcccatgctttatccagtagagacctcactgtctcccattccagcccaccgttgcccacccttgcttatccacacctaccaagagccccttcccgagaactgctcttccaaagtgagattgtactcccaaccctcctctgtagccatccttgggtccagtgtttatttctttgtggccaggaaatctctcccttgctctgttctgcatagatgttgcctgtgttagaatttcagtagaactctgcagatttgaatggaagatttgagggctgcaagagctatcatcgttgatagcaagcatttagctaaggaaattaaattggaagtccttgcattctggctggattctgttactctttgggcagggaatgatttggtttcaaggagattccatcttcgtatctcctgctttcaagggaggaaagggggaaagaaagctgaacagagcctaatgaaggaattctgtatcgacacaactctgacatttgagatgttcaatgtaatcagcacaactggtagctttaggcattgatcactgtgctgaaatataaaattcagttggccatattctgttcatgaaaatgccttttcataattcactgcttccagaggtaccagcgataatttcttgactattttattctggagagctttaggtatggttaacaatgtgccatgtacagagaggcatgtatgcacaccataaagatcttaaatgcattttcagttcagtgtccttcttattaattattctagtcactttaatttattcagcctccgtattttatacattaaaatgagtgaaaatgataagaaatattaatggttgtaattattgactgtatatttgagattcatgtctaaatacacttaacttgggaagatttgacattctgtttcactgtgtgcattatttgcctgtttcatcttctatattctcctaaaccctctctctctctctgtcaaggggggaggcgaattactgcaagtagattatgaaatattgttgtacatgcacgtaaaaatatatcagtactggcacatctgtaatttactcataagtatgagattcatattagagatctatatatcatataagcaaaataatatccatcctgtactatattattttactaacatgatggctgaatttcaaatgaactgcaaaggtcatggttgctgttctattagagccatttaatctcatttgtctccccattactaacctcaactttattagttgctgcaactactgctgattttgaaccgagaaagggttcctctaactgatgtcatttcatgctttgaatttacaagtaagagaccctgatttaaaattattagggctcctgggaaaggagaacattaaaagtttgcagtggtcctctggtttcccataaggtgaagtttttagatggaagaaagatgggtcctgtttcacctatgacatattgcatacctttccaagcccttgtattccctcacctcttgcccctcttcaaactagtgatcacgtctacctttgagaaaactagtagctaaaatgaaacaaagctactttatgaaaagtccatgagaagcaatttaacctggttgaccatctccatcaatctgtcacctggagagaagctgttgacaccacatgacctctcctccaccatcacgctatgaagttatcacttgagtaagggctttctctttgatgctatacaattaaactgaaggaaggaaggctttcgctagtaggaaagcaactgcaaagagaggcttaaaccctatggaaacaccttcccctctcaggcacacacatgcaaattatctttaaccaaaagcgaatgggttccagtcgttcagcacacatcacatataagatattcctagggcaggaactttttttttaatgagtgagacccctgtagagttcatgccattgcataaaatattgcagccatttgcatttaatggtgatacaaatactgctttgaacactgggaacatcatttactgagagaaacaggagatagtcagtataaatctccaatgtaaaaaaaaaaaggattaagataaaaagtagtttaaactccaacactttctctgtattttttattatttctaataaacaagcctatagcttttgaaattttatcactaacttgagaggtgactgttttctgatgtttatacatcactcacttagtcatgaacttgtagtaacaatgccacatgctttatcaatagctggtgagttaattgggagggagggaaatgttttcttaaaaaactaccttttctccagaaaggataattttatgtgtgtgtaataagaatctagtatacctggtgtattaggtgcttaatatattgtaggcccttggtaaataattctgggataaatgaatgcctgccaatttatactgtcattatccctcccctccctgatttagtaatttcaggctcaagtagttgatcccaatgcttttgtgcaatgtgtggcttgtcttttgtcattgtttataagctccataagaacagagactgtctattcactgttttgtttctgtaaatatataaccatatattgtgtatatggatccttaagcatgaaggcttagaggagataatgaataacacttttatacagaaatcaaaccaagactttcatatcattatggaatcacatgcttttagcgtaattaaagttgttgcatatagaacaaataagactgcattttctttagctgttaacttggacttgccagatatccagacatgcttcacttttggtttgaattaacaggtgaaataatacagtgtgtgttttgttaaaattttattaaacgccgctcttaaaaattaagcaagaaaatgaaagaaagaaacaaaaacaattaaccaaagatcacccacaaagctcccaaactgttttgttctgggtgctaaggcactgtttgattttttttttcgtgcatattgatgtactctttccccgttaactgcttctagtctccctggacctccaaggctgcatcttcagggaataactcatcgcatctccattatgtgtcatgtagagacgctatgtaggtaagataacagagtctggctaaagggcacgtttggtgttatattccattagtttattgatttttttttaagtttctctaatgttctaatgagaatattttccactcaatcctgaaggagtccaaagctttttacgaacttcaggatagaacacacagggactgattccctaggctgccgaacagcagggtccttggaaagaccaaatggaaaattgcttttctatgaaccccaggtgcaagagttagggaacccctatctaattaagagctgggggagttctgatgcagtcactggggttggacccatcattacggtgaatgctaggctctggccaaacacctacagccccttcaagggtcaagaaagttcatggcaaaagatttgagtcacttcaggggatggtggaagtttctcccaagcctaccttggcgtctatgactccacctgaaaaatggcccaaaatggacaataaaggaatttggagggacaatggcatcaagtcaggacttcctctgtaggacacatatccaaagagccaacccactagagctccagccgcagttcttgcttgttttggctgtgtgaatttgggtaagtcacttagcttctctgagccttagctttcaactttgtagaatagttctgagcattaaaggagacagtatatgatgtataaagtggaattgatgaatggcaggttctcaataaaagttggcttgtggttatatcattatcatcactactactgtcatgatgtccagacatcaaggcagcagaatgtgtcctccatgtgttaacctggggcccagcctctatttggtgcctaatagttaaaagttggatgcttgttgagtaagtgagtgtatgagtcccttgtcgtctccctgccaaagggaacacttgatcagcataggagataactaacggcagtaactttgctctgagctcttgcttcttcatcaaaccgtgctttaaagacttccctgtgcagaggcagtatagaatgaggctcaggaactcaggctctgtaggctctctccactcacctctttatgtgtctgacaggatgccagtccaagcatccttttccttattgataaaaataggcatcatgataataatagtatctacctgataggatggtgaggacaacaaagtgagatcacgagagcctgacactaagaatcccctggagagctttgaaagcattactgatatccagaccctctccccaaagtcttggattcatttgttcaggaggcaaggttcctttgggcatcaatagtgtgaaaagccctccaagtgattctaatttagagcctttgcaagtcactagttaaggggtggtagggtggctgttgttaaatcatcctaactttttgtcttttcctgattatccctttctctgttggttcctttttcacatttatgggaaaagcaattatgtacctttttggaggtttcactatgttttccttttgctgggggtaccatttctgggaaatatgacacagagaaactttgtagtaagtgaaaggtaaatatagttatatatctatagatatggatctgtatattgaaatttaggaaatgagttatttctactgcagtaagccacattttcatgcatgcatagcctgccattttatggttgctgttgttaaatcattctaatattctgtcttttcctgattgcccatttctctattttttttttcatattaatgggaaaaccaatcatgtacttttttgaaagtttcactttgttttccttttgctgggtgtaccatttctggaaaatacggcactgaaaaattgcaataagtgaaaggtaaataactggatatatgtctatagatgtggatctatgtattaaaatttaggagatcagagttattcctactgcaatgagccacatttgcaggcatgcatagcaccccactttgtggggcacccattgctcctcattctgggtccagctttgattccctgtggctgctgcagtctctggctcatctctgcagctttgatagctgtctcaaatacaatctgcaatctatcaaggagggcgtggaggtgtcctgaataatcagcaggtgtcttggttatcaccaaggagagggcatcatgcccggcatgcatggatggcagaagagttactgcaaaggcagttgtaagctcaggaatccaattctttttctaagttagtgctgaaatgtggctgactcagatgtggggtgtcaggatcatagataggacaagagagaaaacttgtgttcttatttgaaagccacagcctgtgtggagaggcctgcagttcattgccactggacaagagagtaaaatttctgggacctccacttactctaggaagtgttagagggtgataggaaaggagtttgtgcagacttctgcagcctctgcaggtggaatgactgttctctcctctagtctcttagagtctgtccacaacctctgaatagcccttattccttggtgagtcactcagcaaatgagaaattaaatgctattgtgcatgctttatattatgtgtatttcttctctgttacattctaagccacttgatggcagagccgtgagttactttgctcaggatattcagcaccaggaaggtactaggcacacatccttagtacccaggaagcacaggggagttgaagatgctttgaaagacctgtttggcccttcaggtagacatgcatgggccctgagaagccccagaatttcgatgttctcaggaatcatcaggagactagaagacattgattctcaaccctggctgggtagcagggctccttggagagttttaactagtcttgatgcctggatcccagaagagaccaatttaaaccagtgtctctggatttggagccagagtacctacagtattgtagttccttaggtgctttgggttcaggcagggctgaggaccacagctccataataaaaggatggctgagctaaaaggggtgataagaggtagaaagaggctgggaacggtggctcacacctgtaatcccagcacagagaggccgaggcaggtggattacatgaggtcaggagttcgagaccagcctggctaacatggtgaaaccccatctctactaaaaatacaaaaattagctgggtgtggtggcacgtgcctgtaatcccagctgctcaagaggtaggctgaggcgggagaatcgcttgaacccagaaggcggaggttgtggtgagctgagattgcaccattgcactccagcctgggcaacaagagcaaaactcagtctcaaaatatatatatataaattaaaaaaaaaaaaaaaacaagtagaaggaaggagtgatacaactgaaaggagaaacaaaacacagaaagatcttggcggttttgttacatcttcagccccatcaaaccaacacccttcaagctagacactttgcttttagcattttgtcattgttaccctgtttcttactcacagtgatcttaaacaaaatgactaccctctttgtagcaaaggaaaggaagcttataaactgatgtgctaggctcctggactccagacctcaagcacttagccagtaaactgtgttccttcaaaaagacaaggtaaatatgaaggaaaaagggagtgaactggacagaagaaaaaacaaaattggtaaactcaaggaaagctgataggcactaaagcaaaaacaaatgagcagaattcatagttgttgagggcctccaagatcttatgagaaactcagaaggtgcaaagcagacccagtcatctccagcttacaacagatctgggatggctcacagtagtccagtgtcttgctcaaactcacaaagctaagtctctgagctagtttttctgtaagggccaaaagctaagtatgttagtctttgctgaccacgtagtctctgccacaagtattgaaatctggtattgtggcagaaagtggccacagatagataacatgcaaagaaataaatgtagttgtattacaataaaatttgatttatggacactggaatttgcatttcatgtaattttcaggtgtcatgcaatcttatttttctttggatttttctcaacttttttttttaaaaaaatgtaatcaaccattcttagctcttggctatatcaaaatagatagtggggcacatttggcccttaggctgtcatttgccagccctggtccaaactttaaagtacccagagggtaaaaagttgatgagaaagcatagaaaaaaattgatacatgactatttgagacatttacccccagtccaccttcccacagaaagatccatcaggccaagagtccaacactttccatcttccatgactcaatgccaccaagcagttatttgtagaatccatttgcggttttcaaaccataggctctggacttcaaagcaggccagtcccattctttttgtcttgaaatgagtataataagctcccagaccctttgttctagcaatatttattgaattactaataaagactagactctgttctgcgcactaagggtgcagtggttatcttagtctatccagttgccatagcaaagtgccatagacagggtggcttagacaacagaaatcttttctcttgcagatctggatactggaagtgagatcagggtagtaggatggtctagttatcatgtggtctcggtggcttatggatggtggccttctccctgtatcttcccttggcagagagaaagagagagagggagaggaaagaagtgggtgtggagggaagatgtcttttctttctttttctttatgttttcttttcttttctttcctttattcatttatttatttgtttatttatttgtttattttagatgtagtcttgctctgtcacccaggctggagtgcagtggcacgatctcagctcactgtaacctccgcctcccgtgttgaagcgattctcctgcctcagcctcccgagtagctaggattacaggcacccaccaccacgcctggctaatttttgtatttttagtagagacgagtcttcgccatattggccaggccggtctgaaactcctgacctcaggtgatccgcctgccttagcctcccagtgtgctgggattataggcgtgagccaccatgcctggccaggtgtcttttctgataaggacactaatcccatcaggagggattacctttgatatagtttggatatttgtccccactcaaatctcatgttgaaatataactcccaatgctggaggtggggcctggtaagagctgtttagatcatgggaatgggttcttccttgcttggtgctgtcttcacgacagtgagtgagttatgagatctggtgggtttttgttttttttttttttttttttttttttctgagagggagtcttgctgtgttgcccaggctggagtgcagtggcgctatcttggctcactgcaagctccgcctcccaggttcacgccattctcctgcctcagcctcccaagtagctgggactacaggcgctcgccaatacacctggctaattttttatattttttagtacagacggggtttcactgtgttacccaagatagtgtggatctcctgacctcgtgacccggccgcctcggcctcccaaagtgctgggattacaggtgtgagccaccgtgcccggccggtagagatgtggtgattttaaagtgtgtggcaccttcccccacgctctcgccctcttgctcctgctttggtcacgtgatgcttctgctctttcctcactttccgccatgacgaaagtcccctgaggcttcgctggaagcccagcagatgcctgcgccatgtttgctataaagccagtggaactgtgagtcaattaaacctcttttgtttataaattactcagtctctggtatttctttacagcaatgcaagaacaacctattacacctcatgccctcatctaaatctaatcacctcaccaaagctctatctctgaataccatcgcgttggaggttagggcttccgcatatgaatttggagggcacacttcactccgtaacaatggtatacaaaataatgaggtttctgtgttcatgagcttacattctttatatttgacaataaaaaagtaagcaaaaagtaagaatttttagctaatgttaaatgctacaaagggaaaaaaaataagaaaacatgtaccgattacagagatgaactgggacaggaattacaagtttggaaactgttttcagggaaggcctgtttgagcaggtgacttaggactgggggtgagtggtgtggaagcactcctggaggttgctggggggagactggaagactgagcaatagggagagagaagatcatgttcaaaagggccactgagaccaaaaagctccccaaaacaaaaacaaggttcaaaagggtgagccagcggggtagacaggaggccagcatacctgaggagagtcgaagtgggggacagtagctcccactgtggagagtttgagtgttacctattaaatgcaatggggagctgggcacagtgtggcttatgcactttgggaggccgaggtaggcaggttgcttgaggtcaggtgtttgagaccagcctggccaacatggcaaaaccctgtctctactaaaaatacaaaaatttagctgggcacggtggctcatgcctgtaatgcgagcactttcggaggccaaagggggcggatcacttgaggtcggcagttggagaccagcctgggcaacatggcaaaaccccgtctctactaaaaatataaaaaattagtcagatgtggtggtgtgcacctgcaatcccagttacttgagaggctgaggcaagagaatcacttgaacctagtaggtggaggttgcagcgagccaaggttgcactactgcattccagcctgggcaacagagtgagactctatctcgacaaaaaatttaaaaaaataataaaataaaatgggaagccgagcacgatggctcatgtctgtaatcgtagtactttgggaggctgaggtgggcggatcacttgaggtcaggagttcgagaccagcctggccaacatggcaaaaccccatctttactaaaaatacaaaaaattaactggttgtgatagtgcgtgcctgtagtcccagctacttgggaggctgaggtgggagaatttctggaacctgggaggcggaggctgcagtgacctgagattgtgccactgcactccagccggggcaacagagtgagaccctgtctcaaaaattaattaattaaaccttcaatgaggaggttttgttgagtcagaagcacttcagtacagtcatgcagcacttaatggcaggggtaccgctctgagaaacaaatcgttaggcaatcttgtcattgtgcaaacatcagagtgtactcacacaaacccagatgctgtagcctacgacacatctaggctaggtgatctagcttattgcatctaggctacaaagctagcaggttagtgtgctgaatatggtaggcatgtgtaacatcatggccagtgtccctgcacctcaatatagctaaccatagaaaaggtactgtaaaaatactgcattaacgtcttatgggactgctgtcctgtaggcagcctgtagttactgaactgaaatgtggttaagctgtgtaggactgtgtttgcattttcaaaatattttgggtgctattcagggaacggacagtagggggcaaaagtggaagtggagaaaccaaggaacaggctgctgaagaagtccaggcagccttggaggactcgctctcactcttactggttttcgatgcctgagttacttgctctctgggagaaggaagcaggtcgttcctctgcccaaattgctgctactcaggagtgcctgacactcctttccaaagatgctctgcggtaatatgttctaatgaggagtttgaattgccaattgacttgctctttgcagctaataaagaacagattatgcgctggatggtttgcagttggtggccaagttgtcttgtgattattgtaagttcttttagttgagcttgtgtaactgtgagtcaatcctgcccatgttttatttggaaattagtactagagcctccttgggactagcctttttctcacccaaaggcaaaagaatccatctcggctgggcacagtggctcacgcctgtaatcacagcactttgggaggccgaggtgggtggggcggatcacgaggtcaggagttcgataccagtttcaccaacatggtgaaaccccatctctactaaaaatacaaaaattagccaagcgtggtggcaaatgcctgcaatcccagctactcaggagcctgaggcaggagaaccgcttgaaccctgaaggcagagtttgcagtgagccgagatcacgccagtgcactccagcttgggcgacagagtgagactccatcttccatctcaaaaaaaaaaaaaaaaaaaaaaaaaaagaatcagcctctggatcacattaaccctcacagcccatagtccttcgtcttcctctgaaaaaatatgaaatattaaagattcttaaaccaatgagcagtttccggttattccagaatatacagcacgttggtgacttgttccacattttctttttctcttctcagtgcttcctgctagacatagacacatacacacacctacaccccttttaacccattttaaataattctgtttagaaaagcaacatatgatcatttaaaaatattgagaaacacatacaaaagcaaaaatcatccattagctgctcatcacccccaaataatcactttttaaaaacattttgatatttctctttttggggtctctgtgtgtgtgtatgtgtgtttgtgggacagagagagagagaggcagacagaggaaaaaagcttacagtatttgactgatagtgaatttttagaatttatcgtataattttttacttggtattaaaatgtgaacattttaccatgccatgaatcattttgggaaattacatgtaatgattccataatgttctgttgtaccaaaagttattacctctgttgttattgaagaaattttttatctttctcccttactattattaagaataatgtcacagagaattttcttatactcaagtctttgtttacatttttgaatatttccttggactaaatgctaaaaagtattgtgtcagggtcggaagatatgagcatctttatactttgtgaatagattttatgttgctttttgaactggttgtgcccctgcacatcccataaccatagcgtattagcataccgtttaatctagtcattaccaacattatttggtattattacatactttattaatttgataggtaaaaattggtattgccctgtttaaaccttccccttttcatcttgtctgtttcgtaatgccaagagtaaacacatatcatgctcttaacacaatgtgaaatactgtggaaagtagatactactgtcctcattttacaaattgagaagctaatacttctcgttgagaggtggagctaagatgggaacccagtgtaggcaatgggaaccttgagtctgagccttagccagggctctgttccgcccccaggcaggagcaggaacctgagaggaccttctcagttaggtgtgaaataggaaagcagcctcattgaagtaattcacactaacatgtgaatgacctggaagcatctgtctggtttttatgaaaaaccaaacagaattacttgttatttcagataagcttctcctttgtggatggaaatgtaagaagtttaacgcaagtaaaaaaaacatctaacaatgataaaggaagataccatcgggcagattcagaccttatggaaatgtaagaagtttaacgcatgtaagaacacctaacaatgataagggaaggtaccattgggcagtttcagaccttcttgcaatgcagtggtggctcactgctggcccacagactagaatcatatttattcctatgagataaaagaaaataggtcttaaaattcagtgtttaaaatactaaatcagttgctattagacaaacctctactattctaccttctctttaaaaatggaagctctggaaacattcactactgtttctttcagtaattgactgcatctgattaatcccactgatgcttcaccttgcatctgttagctggctagctctcttcttccttccctatcaactttccccgctttctccctttctgagccaactctctaaaacttttctttttgataagaatattatattttaatgaaaatcctttctgtcatggagaatcccctttccatcatggttaggaatggagacttaggggttacggtggggctgggtgctgagtcatttggaagacacacatgtgcaagttggggcctgtgtctttattagccctgcttaaattgctgggtaatttaagcctctcttattttgctgcattgcctcacagttctaaaggagacctgaaatagagtgtatcacattgtgcacatttttgaaggatcatgagagcagcctaaatataaaattcacgtccatattcttagtgtccttttcccctaaatggagacgggatgcacttgagcattctgtcccatgcttgcctttgtctacacgtgtttcctaatgtttgatctctgtcctttttgtatgtgagaacattcacaggcatcttcctagctgcaaaaagacgggcctgggttgcaacaactggatctttgttatttcttggggggagctcgtatcaaactctccccaatccatgtagtgatttttttctacatctaaaaatgatcctttaaagtttcaatgatgccttggtgacccaggaccactgttgtaatttttgccagtttctttgtatcacttggttgatcttgtattaaatgtctaattgatttgtttttttaaagatacgtgcatgttagtataataactagaagctcgatgttatgagttgaagcataattatgcaagcaacttaatactaaacttagaagatacgtgactactaaccaagaccatctgatgtaccattgatggctcaaatgccagatgtcgggaaacagtgatttaaaaggaaatatttcatgggggtcagcataaagtcggtcctgcttctagaaagccacagtagttctctgtatccatagctaagggtctcttaggctcttattgtaaatgtctgggtttcactcaggaaaaaaaaaaaatctcaaagctatggccaaggcagaggcttcctcacagcccatcccctgtgcatatcgattagttgacatccatgagtgccccagtcctgctggaaatatcccctcaggcttgcttttctgtggtatcaccacctattcccctcttgttactcggacctctttgaagtcatcatagtgtttttgggaatagagaataccactttgcagagagagtgatagcggcttgtgatcatatcctcttcatatccccattgtcggcgtttgtaagaccccaaatgctcctgaaaacttgatttctaatggttatgcaatatttaaatgttaatagattactctttgcttgaccatttccctattttattttttttgagaaagagtctcgctctgtcatccagagctggagtgcattggtatcacctcggctcactgcaacctccacctccctggttcaagtgattgtcctgcctcggcctcccaagtagctgggattacaggcgcccaccactacacccagctagtttttgtatttttagtagagactgtgttccgccatgttggccaggttgggcttgaattcctgacctcagtgatccacctgcctcagtatcccaaaaggctggaattacaggcatcagccaccatgcctggcacccgtttccctagtttagacatatatgttgcttcttattctgcatcattcattcattcatcaaatatttataggcaactatcacttgccaggttgtagagaggacaggaaagcagtgctgagcagccaggcctctggatccttcttctccatcaatctgtgaatttttacttatatctgagaagggggagggatggaaggagggaaacaagggagaggagagaggaagggaggaaacagacgcagctgagagctcctgaagctcctgaaacctctgaggagcattctcttgctttgtattcttttcacagaaccagtgactcttgttttcttttaaaatcctctcctccctcccctccctcccttcccttcttcccttccgttcttcccttccttccctcctttcttccttccctcctttcttcctccctcccctccctccttcctccctcacttccttccctgctttcttccttttccttccttctttccttccgtccctccctctctcccttccttcctcccttcctttctgccttccttccttttctttccttcccctcccttccctccctccttccctccctccttccatccttccgctctccctccctccctttcctccttccctctctccctccctttcctccttccctgcttccttctttctccttccttctttcctctctccctcccttccttcctcccttccttcctccctcccttccttccttccttccttccttccttccttccttccttccttccttccttccttcctccctttctctttttctcatctatgagccagaatgttacgctaagttttggaaacagcactctctgctgtgtctttaggatgcttgtttcctgcatgctgaccagacctcctgttggactgatattctggataatggcttggtgcctttctagcttctaatctaaacaagaattatttcattttagattctctctgctgcatcaagggtccctggaatttgatgatgacttaagtggaaatcccagctttagcatatataagctcagtaccatagaccaagtgggttaacctctttgtgccttcattttttcaatggaaaagttgcaaacaagatacttacctcccaggattttcctgacaatgaatgagaaaatgtaagagaaactgcctttcgaattgggaagctctattctgatgaaagatggaccttatttttaaatacaggacgtttagtaattttatctaaattccccattcatcagaatacagtggagaagatatttgccatacccatttcattgtgttgttcataaacttgtttatttttccagggctggattggtttgcctttctctctttctgtctgctactgcataatttcattatctgccatacgtaaatgtattatgtaattctctcagttgtcattgattgcttctgtttttctgtagtattactggtctataatactttttattaaatccccaaggatagttcctgaactgtggttgaaggaccctcctttccactaagtaaaatacaacacttagatatttgaaatgacacaaagtactagagaaaacataagtgtggaattttcccactggctttatgaaatccaggaaaccaattgagatatttgtttatgatgcctttgtctatcctggaggtttctctctgcgttctttcaatggcagtcacagcatcaacaaattatataaaattagctaatgtttattgagtgcttactatgttccgagtaatgttaggaactgcttgcattgtcatttaatcgtcacaacagcctcataaaggaggtacgctttgttatccccattttattcttgagagaactgaaattcagaaagtttaactgctttgctcagagatacacaataaagaagagatgaaactgtaaagcacacccctctcacacacacaccacacacacatacacaactttatgcaagcttagcaaagtcagtttccttcttagcttggagaatacatacatatgttgaatgcctgagagtttgggacttctctgctctgtacttgcttctgacactaaccttaaactaatcacttctctctggaactaggtctacttatgggccacgtttgaagggttggatgaggtcattagtttttatttatttatttatttatttatttgagatagagcattaggttttttttactttttattttatttttttgaggcaaggtctcatcctgtcacccaagctgcagtgcagtaagacaatcttagctcacatcaatctctgccttccaggttccagtgattctcatggctcagcctcctgagtatctggaattacaggtgtgtgccaccacacctggctgatttttatatttttagtagagagtggattttgccatgttagccaggctgtctcgagctcttggcctgaagtgacctgcctgcctcggcctcccaaagtgctggaattagaggtgtgagtcactgcacctgcccaaaagcattagcttctaattgacctcatgatgttcaagaatctgagcaggtggtcgaagggtggtggagaggataggaaggcagtgctgagcgggcagggttctggatccttcttgtccatctgtctctgagcttttgcttatatctgagagggatagagggagggaaagagagaaagaagggatagagggagagaggaagggagaaaacagacaatcgacatcacatgctacactactaactcattcaaaaatagcattgtgccattgctatttcccatgtatgtcattagatattccatgaaaacttgatttctaatcgttatataatattcaaatgtgttaataggttaccctctgcttaaccatttccctgttttagacatgtgtgttgcttctgatacttcatcattcattcatttatcaaatatttatcagcaatgatgattctccagacattaacataagtaagtagggtgtggattttcttatatataaatttttgacatgcctgcatatatgtgcttccataactatatagaatttggtatttttgctcttgctgctaattgctggacttctttagtgaaagattacctgttctggaaagcctgctaatttagatggtaggttggattgaaatctgtgcaaatgatgagcttatctgtttcggggaacataattggagttctggacacactctctcccaggattataggtatgagattaataggcattgttttgatggcatatgccacaagcatcaaaatatccactttgtgaccttcaggcttaaagggatcatcttgaaggtatagctttacatgttgcctagtttagaggtagatgaggctgtagataatgtccactccaacctgtgcagaaggatctgagaggcagccccaggggttgctgtaagacttggtgttgctgactccccttagaagtaatctccaaacaccaccaccaccaccacgaagtgtgtcatcatataaactgaagatagctgagattacacactgcctaaatttcactcagaaaaacatgatagagatcatttctgattgaaaaggcaataaagaaactcctaaacatacctctttgtccataaatggaaaccagacaaatcaggcttgtagatttaaagagaccctgcaaggtggcgattctgaaataccccttggaaggaccatgccaagtctgaagtgaagctgcagagtgaagcagtatccagagactgagctatttctggctgcagactttgtgtcatgaaatggtgataatttccccacgccccataatgttcctctccttcctgatggctctataagtttgagtgatgtcagtctgtttggaggcagctaggtttgcttgtgtcttaggacagatgtccagaaaaaacaaggctagaccctgaagagcctggacatccattagaatgacaaaagactctgtggatacaaaataccattagtttttcttccttcctctatattctctctttttatctccttccctgatagcaagcaaagggtagggaaatctaagtaggaggcttctatccttgactgatttttttttaaatttttctgcctcctaggggatcacttaattcattttatgcctctggaagagaccagaatttcctcactcctccaaattcctgggcaggttacctctcccaacctcagttcatcattattctgcactgagttatgtaatgatttgatcgtgttgaggagtaattcacctttgttcccacctacgttaagactgattacaaatcctcataaaatactgattatgctaccaaaaatgttcttaaggatagtctgttaggaaggaggtaatgctgctgctcagaagtgtgggcttctgtctaattatgtgtaaattatctgagtggaatctcaaatgtttagtgataaacagtttgatgcgtcccagcaaagtatctagtttgtgaggcaatataatcaaaagcagcttatgtgcagcaaatcgtagatggtataactttgcgtctttttcaagttatttttacagaaagaaatgagaatttgtctgcagccctttaagaatagcaaacgttgtattttgcattttttaaagaaagataattgatcctttgactatactgctgttctgttctcagaagaaacattaaaaagttggatttcttaagaaatgcaattaaccgacttttatttaatgattttttttcacgttattcatcctggaggaatggtttctgttggttattatcaaagatgaggatggattttcagaagcaaaatatcatgatattctactgcaatgcatctgtggttactcagggaagatccaatgtggtttgtatgtagatatctccttctttagaaaacctttcctgaattgcctacctccatctcccacccatctccagctggaatgttgtacattctctgtgccaccagaagaaagctattctaataatcaaagcgaataggacaccatttaattgggatgaagccacaattgttagtgtagctagtggtaattgaacctagatgttcataatctaggatcctaaactagatgttctgataatctagatcttcataaaatacaggtatttaagtctgaaagctcattatttcttagtctcagtggtagggttccttaaaggcccaagaagcttgagagaagtctaccagggcggatacccatcgaaaaatcaaagccaaggacttctataggcacagaatggtcaagatatttattcagcatagcatgaggaagtttagtccagtatagaaaacaggaatatcagttaaaatgaaattagcatattagttaacataagaattcccacgtcagtgtttgagaacactttgcagctcttctagagacattcttattacagaagaagatgactaactcagaagaaaaagggtatgaaagtctagtaggagaaaatgattagcaaaaaaaaaaaaaaggtactaagacattaatattttattgaaaagaggcaagaattctgtcagttccttattggtggtcaatgcagaataatgctagcattgcctatcattcagttgattccgtaggcggctaaattggttgcttaatgaatccatagtggtatttggctccgcttggtttccaaaattgtaaggtaaattctgtgcacgtggttttaagttggaaatggttgatatggttatacttggtgtatgcattcaacaaattaaccagttgcaaatgtgtgcctattcacaaaccccttgattgaattgcaagtataccagctaattagacatgtgttccgtaatgcttaaagagagatcaaacctccttcagtgtctctagatggtgaagtcttaaatttacccaagatcaaaatatctacataaagattcctatgtatatctgacatgtgcaagccagagggtgttggacattttgaaggccaaccatttagatgattgactaaatatatttactttcatcatacagatctgtccaatattaccagcataccttttaagaaagtgtattcatccttttagagttcattaaaatttatcatgactgtctgtgggatgcatttatttcatattgacttctgtttgtatcctttcctatcctacattctctataaccagtctttttgcaagtctgcaattcatatcaaaaagtctgaaggaattttatttttatttccttttcagtgaaaacatattacaaattgccaactcatgatgtattcagtttgaacttaaaatatcatttgtttaaaaaatgcaataaaacctgatatgtacactgatattcattctgaagattaaagctgccaatgaattatggagctgggccaaggctgtcttgttctcagcctaaatttatcttgtcgaaagggaattattctgaccggggctagagagtgaagatagttaaaatttgattgttcgattgctttcttctggcttttttttccttcttaaaaaatatttgattatatttctcttaagagctggattttaaaatctaaaaactgatgacggatggataaaaagtcctattttatctaattctaaaagtgacgtaggtttctggagactcttttttttttttaatgtacattttctctttccttttctttctttcttttttttttaaacatggatctttggccatgggggaccccatgctgagtgcctaccctctctgacttacacagaggaagcttcagtgtaatagaaataaatgctgcattttctctgtttataacatgtcacttgggcaaagtggtacagtgtctctttggtaaagctgaaatgcggatttctcagaaatgtcttgttttcagttaatgatattttctgcttttcaccaggtggtctctttggggctttgctcttgaattcatttctctgtgcgtaagccaggctttctgttactcgtttattcagccggcatttactgagtcctcaccacactcaggcctgagcgcagcgtccaggttgcagtggccacggaaaccagccctgtcctattggtgcttgctggctttggggtaaagtgacaggctgatactatattatagccagggccacgttagacatcaaaataaaatgttctgggaatagagaggagggatggcctggcatggaggtgagctgggggaatcaggctatctatggtcacatcattctatgaactagcagaccaggcataatgggcgacgtaagctcgccctggtgttgcctgacctgaatgagtgcttctctggaaagagctcatagttcctctttctcttatgtgaaatcccacaaggaaaggcaacttccagaaatggccaagctttctatccctaaagagccagccctcaaggactcatgaaggctgaaagggaaattgatcattggctcattatggtcctgatcaggtatgacctttgagaaaccagtgggcctggtaacaatagggcagccaagttggccatatcagcagatgttgcatttgctgactccatggccagcgccacatcacctgctctgaaggtgtttggttcccgctgcgattggatctgtattcaaaacagattgtgcctgctatggaaagagagccagcttctgaatcctggctgagtttgacttcgttgaccacagagtcttggttctttgcaaacgcaaaggaaaacacgatgtacaccttgactaaattcagctgttttcctcatccattcagccttgccttcattgcaaaatgagcaagcttgtgtttcagagggcttaggtcacttccccagcttcacttagatctgggtgttctgccttccagaatagagtccttcttctccctccatagaccctaagactattaacagtaggtcatccccaacctgttggttaagaaagacatgcacagtatctgcacaatgtccaagggatccccaggatcacctcacctttgtccaaagagaataataaggtgttggtagataagagggaggcccatgtgcctctgccattaggtcctgtgacagggagtccacatggagatcatcatgtgataaagaccactagggctgtagtccagggacaagcttgagtgacatctcagtggggccgctaccttcggagagctccgcacataaggacagagtggctggggcagtcaactggcatcctagaacatatttctcaagaggggccctgctgacgttttggaccagattgatagttcattgatatgagttttatccattgtaggatgtttggcaaaatccctggcctttccccatgagacactagtaacaccctttcctctgggagtcaaaacattgtccagtatcccctggggtgcaaaatcacccactgcttgagaaccgctatcctatggccatatttgtactcactaaagaaagggtacataatggcagctactctgggcctcttgaatcaattgcatgtgattccctacctacctccctccctccctccctccctccctccctccctccttccttccttccttccttccttccttccgagacagagtgagtctccttcacccaggctgaagtgcagtggcacagtcttggctcactgcaacctctgcctcctgggttcaagcaactctcctgcctcagcctcctgaatagctgggattacaggtgtgtgccaccacacctggctaatttttatatttttagtagagatggggcttcactgtgttggccaagctggtctcagactcctgaacttaagtgatctgcctgtcccagcctcccacagtgttgggactacaggcgtgagccaccgtgcccagtgcaattgcatgtgtatttaatgagcttctgcttggggggtagtttagcatacatttggaggcagatgggctgcttcccttattgtatgagagccaggtgactttgtgcaaaacacttgcctgctttgtactttagtcctctcttctataaaacacagatagttctaacactgtatatctctcccaagtttgtagtgaaaaaggattgcacacatacacacacaaagagaccattatgtaagtgttaactactattcttattagcattgtctgggcacaatatctggtgttggaagtcagagaaaatacacagcatgttcttttcttcatggggttctagtctagatgagaagacagtgtccagccactgagagcaatatgcaaatcagtcatcataaactgagtgactgttaggagagagtctattgagggaaacgtgggttatttatagtttgcttgagtttgaatccaggagacaatcttgacttcctctctgcagaccaaaataatctttctttctctcttttcctccctgccttcctttcttttcttttccttttatttttgttttcttttcctagaaaaggtcttactctgtcacccaggatggacaggaggtcagtggcacaattatagctcactgcaacctctacctcctgggctccagcaatcctcccacctcagcgtccggagtagctgggaccacaggcgcgtgccatcacgcctggcaatttttttttgtattttttgtagagacagggtttctatttgttgcccaagctcaactcctgagctcaggtgatccacccacttcagcctcccagagtgctgggattacaggtgtgagccactgtacctggccgactaaagcgatgtctgaaaagggaggacagaatccaccactcaccgccccaaacccattttctttgcagcgtttgctcagactaacagtcagaggaacaagtaaatggcatttgcaaaggggatttcatttattcctggatgccacagttacttgttcacccccaactcattgcaaggcacagggtcttaggaattctttaattgtaaggaacagaaactcaccctgtatgaagatatctcattataagaatcaaaagatatttcacaaaactcagttgcatgaaatatggggaaatacatggatattagaagttatcaggtggattttctgctgccttttgctcttgcaccctctccctggagccttctgctctctgttctctggttgattaagcttttttttttcctgttatcgttcttttaaaaaatttttccataggttattgggggaacaggtggtgtttgatttcataagttcttcagtggtgatttgtgagatttgggtgcacccatcacctgagcagtatacactgcacccagtttgtaggcttttacccctcacctccttcccaccctttctccctgagtccccaaagtccactgtgtcattcttatgcctttgcattctcatagcttagctcccacttatgagtgagaacatatgatgtttggttttccattcctgagttacttcacttagaataatagtctccaatcgcatccaggttgctgcaactgcgattaattcattacttttttatggttgagtagtccatcatgtgtgtgtgtttgtgtatctgtgtgtgtgtatctcacagtttcttcaatgcactcattggtttatggatgggttggttccacatttttgcaattgtgaattgtgctgctataaatatgcatgtgcaggtatcttttttgtataacgactttttttcctctgggtagatacccagtagtgggattgttggatcaaatggtagttctacatttaggtctttaaggaatctccacatgattttccatagtggtgggttaagcattttgactttgtgtgcctctctctgcttgtctctctctgttcgttcatcccctagtgcttggtccagctttcagttttccatggccttcctccctggtcccccaatctgcctctgcagtctctatactccaatccagcattcctgacagggagaagatctcattgaaccagcatggatcagtgtccaccatgagttcccacagttggaaagatttaggggagctcactaggtagatgatggtgcctcttccgtggtggaaaggagtatgaatttgctaagaaaatcgtatgggtggaggaaattggttgacacttccataacacctcccctctgtgttggccagggaaacacccttgacattctgtatctccatcccctagatcgcctctccctaaacaccactcagcctcaccgtcctcagaagctgtatccttactcagttttctttaattggcatcttctaaaataagactctcatattgttgcttcttagggtcacccagagcttgccagaagtgagaaaggatctcttctggacttgatctagatcatgtcatcagatcattgcatcaaagtcaggtttactgaggcataatttacacacggtaaaatgtactcattttagcacacagttcttcaagtttcaataagtgcatacagtgatgtaataaccaccagcgtccgcatgatttggagcatattcgtcattccaaaaacttgcctagggcctagttatagttagtccccagctctagatcctgggaattggcagtctcttttctgtctctacagtgttggtgtctccagaatgtcctacaaatggaatcagaagtacgtagcctttaggcctgactatctctgtgtaatggatttgagattcatccaggtagttgcatctatcaacagttccttcttcccttttattgctgagtagcattctgtggtacagatgcactatagtttattcactagttgaagggcggttgtgttgtttccagtttttgctgattatgaaacagttgctgtaagcatttatgtacaggtaattctgtataacaattcttagttctcctgggtaaattcctaggagtggtgttgctggattgagaagtatgtttatgtttaactttattcattcatttaagatatagactcctgctctgtatcccaggctgtagtacggtggcactatcacagctcactgcagccttgaaatcttgggcacaagcagtcctcccacctcagcctcctgagtagctgggaccacaggcactcaccaccacgcctggttaattttttaacttcttgtagagatgaggtcctgctatattgtccagattgatctcgatctcctggcctcaagcagtcctcccaccttagcctcccacagtgctaggatgacaggcataagccaccactcctggccctttttaacttcataaagatgttttttaagagaggcagaggacagagtggtagtttcggtgtttaatcctggatctgatacttcctagctctgcgacctcacggtttatctgtgccttactggattgcagcagaattaatggcaaaataataactctgcacaagttcagggcagtcactggctgagtgttagagctttaagatggcccctcatcttttggccactgccttcttgtactggatgttccttctttattgcctgagcatgcacactctttcttacatccttgccacacactgtttccttttctggaacattttcccacccacctttctcctcgccaacgcctcatccctccgttgcccaatggaatgccgcctcttcagaaaagccttccctcaccctcagtctcaatccagccctttgctatctatagattccttacttttttttttttttttttttttttttttttagcaacctgttcttatcctttatagcatttaccacaatgggcctcagaaaattaactgtataatttgatttttaattggaatttttattgagataattgcagattcacatgcagctgtaaggaataatacagagagttccaatgtaccctttacacagttttccccaatggtaacatttggcaaaattaaagtacagtgatcacatctaggatattgatgttggtacaacccagtgattttattcaaatttccccaatgttacttgcattaattgtgtgtgtgtgtgtgtgtgtgtgtgtttgcagtggtggtagttttatctggttttgtagaattttaccgcacatgtaggtctgtgcatccaacaccacagtcaggataacaaacatttccatcaccactggatcccttctgtttttctttttacaaccacccccgcccccactcccaattcctaatttctggcaaacactaattttctctctatttataagcttggacatttcaagaaatggacccatatagtacctgacttttaggcattgacattttttgatcaacgtaattccctggagactcattgaaactgctgtgtgtataaataacttattccttttcattgctgtgtagtattccatggtatggatgtaccacagtttgtttaaccattcatctattgatggacatctggactaactcctggatttagctcttataaataaaactgttacaaatcttcaagtgcagggttttgtgtgaacacaagattccatttctctgagataagggctcaagaaagaacatgctgggacatgatttttaagagaaactgattgatttttaaactgagtctctgctgatagacttttagttccatccgggtaagtagactgagttttgtttgtttgtctgcttgtttgtatctttaatcagcatactgggaacactgtacaattcttagaacataatttaccactctataaatatttatagatgatttaaataaggaacgaatgagtgaatgcatgaataccactgctggcatagggattaaatgaaataatttatgtaaatcatgttcagaatgtctagcatggagtaagctctaataggtaaacacttgtagcacaatcgccattgtaagatatgattttggttgaaggtgacatgaggaaatttcatatccttccaccttcagcatcatacaaacatcatgtggctttgcaggatcccaagggtctaggttcttgccactttatttctttaaataaaagcctatcttgtgaaaatgctcaaaagtgtcagagtgggaatttgggtttcatactttgatactttcttatttttttttttttttttttgagatggagtcttgctctgtcacctaggctggagtacagtgatgccatctcagctcactgcagcctcccctgccaggttcaagcaactttccctgcctcagcctcctgaatagctggaatttcaggagcacaccaccaggactggctaatttttttttttttttttttttttttgagacagagtcttactctgtcacccaggatggagtgcagtggcgagatctcgggtcactgcaagctccgcctcctgggtacccaccattctcccgcctcagcctcccgagtagctgggactacaggtccctgccaccatgcctggctaattttgtttttgtatttttagtagagacagggtttagccatgttggccaggctggtctcaaactcctgacctcagatgatccacccgcctcagcctcccagagtgctgggattacaggcatgagtcaccatgcctggccctgggcttcaaactttaaagaagatactgcttaaataggtcagggtgaagctacataaccacttgcctcattgaacatgaacgcaggcaatgcgtgatagaagctgtaggagtgtgaggatgtgtggcacaaaagaggttaactttgttccaagatcattatggtcccagagtgtgacataaatattggtgaagccaatggagttagcacagtacttaatagagagagaagattagtgattctcatttgcctgaggaaagtgcaggtcttgataatgtcttgatctatgtacaaagagctagtaaagacaagcagtcctcataataaaaatagaaatgaggttttcccgacaaagatgccaccagaatgatgagctgtcacacaggacctggagagacaagaaagaaacttctttggtgactataattaggattccatggagagcagcagtgtgcaggaactatgccagggtgctctctttctctttctagaatcaccatcaaacttgctctaaaggaccaggacagcgagtaggtgcaagctgatccttggtggaccaagcctgtattccccacaggccatggtgaggctctgacctggggtataataggcaagaagtgttttcagtctgtgacttgggctacttaaatggaagaagataaaaccttttatttttccttataatgaaagtacttcacgctcattattaaaaacttggattgattgacaattttgaaaaatgataaaagtcgcctctcaacaccacatttgggtgtttcctcaaagctttgaaaatatctatgtagatctatatgtttagatttagaaagagataaatttagaagtggagaacacaaattagtttatgatagattttacatatatggggtattacccaataattatggatttgcatattaccttcccccacccatttcgtgtgcatttttctgcttcttaagctgtttttccctcggtgtattttcaaaatacacatagtttgtgaggatctagcccaaatgaaatgagtgatgtgtgactggctgttgaacgaaaaatccaaaccaatctcgtgtgtatttgctggctgagatctgttttcctcatgttctgtagaagggaaggagtaacatggtctcctttagatgctggatcaaggtctgagatttttctaccttcaccctggtttccatataacagggaaatcctagagtggtttaagatacccacaagcaccctggggaagcggcacctacctcaaccatagtttgtgatcctgtaattcaatttaatttctggagaaagaatccactctcagagaactctcacatcaattgttcaactttcagacattctacttggaaatccatttaaggaatgcatcatacaataaagtagaagattcaaggtgagaaaatcacactcatctgagttagggcctcagggtgtacatttaaataagttatttatcttccctcattctcagcttccttacctgtgaaatgggaggagtcacatcaccttgcttatcagatttctgggaagatgaaataagataatgaatgtaaaacccttggcatagtgtctacacacagtaaatgctaagtaattcttaactgtgctattactggccggagagcagtggctcacacctataaccccagtactttgggaggctgagctgggcagatcacttgaggtcaggagttcgagaccagcctggccaacatggtgaaatgccatctctactaaaaatactaaaattagccaggcatgatggcacatgccaataatcccggctacattggaggctgaggcaggagaatcacttgaacccaggggatggaggttacagtgagctgagagggcaccactgcactccagcctgcgcgataaagcaaggctccatctcaaaaactttgttgttactttttacagtatttcttggacttgtgtgtgcttcttgataggacattggctatgcaggggaacaacattggaatcgtttgtctggtgagaggcaggggttggagaaaagaaagtgacagcctgctgagaatctgagtgatattagaggaagtatgggcaccctggaggttagtgttttcactaaaaagatcataaattattaacatccaacagagttacccagaagaacactcatgccagatcctgcctgctgtatcagagagcctccttagagatgtctgtggctgagttacaaagaagaaaaagcagtcagggtgatgatgggtattacatttgcttccttagtcaaacactagagttgagagagaaagcaagattggaagtagcaatgggctctccttagaaagattaaagagatggctccctttgtttctagcctaagagaacagggctggctgtctttcccacaaaggtcaatgtacattgccttacttttgtgtttacaatcaacagtagccagattatcattaccgataccaacattaccaccaccattatcatcatcaccatcaccatcatcattaccatcatcatcagcaagagcatcactgtcaccaccattatgattatcatcatcgttattacagtcaccttcatcgtcatcatcaccattatcaccatcagcatcaatatgataatgatgatcatcatgattatcagtgccatcattactaccatcactttcatcatagtcatcaccatcatcatcaccatgatcatgatcatcatcagcatcaccacccccaccatcatcattatcacaattatccttgaagctgatatgtgttgtgcacttcctaggtgctaaggggttgcaccaagaaatttagtgtattagtccatgctatcaaatttagtcttgtgagataaaaatattagtgcttgtctcacttataaataaggatccaagactcaggaagttttaaataacttgccaaaagccactcagctagtatgctgtagttcaaagattcagaaccaggaggtctgcctccctagtccttatcatccatttcgttatcaagaaggcaggacaaggttaggataaactctgtggccccagaataagctcttttaattcttattatttttcttcataggagagtaaacctataatctgtgcttcccagggttacatggcacaccactgtttctcagatacctacgtacatttacaccggtagaaaccattttagaaataaatgttacagaaaattccatctataagagagataaaaggagcaggataaaagatgcattttatgacttcaaatgtgaagcatgtatcgtaaaggcaattagtgagaaaatgaggctattttgatgaacaccaatatttgaaattgggagtatggatagataatattgttttcaattaggcttataatccaattcatttcagtcttttaatttgttgcctgctattgagaagatgctggttcacacactgatactgagatgcagaaggtaattttttaaccaggtgaccttaaaatatctcattaatctggaatgtaagctccatgtcctttcgtagttgagcactgtatctccaaggccagcaccatgcttcgcacagacactattttcaaaaggtagctgacgattgaataaatgaattaaccaactagtaaattaaatgaatctcagaaacatgaaaatggaagaggactaatattttcattttcaaatttgctcattcactcaactaatatttaacaagcatccactacagtaagccaagtgctgttctaaggtggtgagcatgcaacattaagaggggaaaaataccgttctcatgggacatgtgcgtgtccgtgtgtacaggatgggggcgtggaagatagacagaaaatagacaaggaactcaccattaacactcgctgtaatgtttagaagcagacagcttatctaagccttctgagtctcagcatgcttgtgggtaatgtagtattatcggtatgtacccagcaatacccctgtgaagaataaacagaaacacacagaggtgctatcatccttgcctccatctcaatattgcaaaacatacaagaatgcacatttcattctgtgattatttatttaactaggcactgggcattctgggatttgtacattcatatcattaaagcagtttcagccaaagagcatatatttggagatgttttaacatgcactgggcataagtgattatagccctaggttcaaggtgaccagtatctggacagagggagatatgtagaagaagtaccagttacgttgcaaggtaagatgtgcagaaccagcttaaagcattcaatactgtgccctaaccagctgaaggggtcattgatgccctttgaacagaagacagacatccttagttttgggtatttaaaattcctctgtggcaccaatgtgaggtatgagttgggaagagctgagactgagagcaaaggaacttacctaagtatagctttttcccccttttctaaaaatctaggctaaataaaataatgtgatgtgctagtatagccacaatggaaaattaagacagccttaatagttgggagatggaagagttaaaaatgatacaatttgggaaccaattgactattcagagcagcaaaggaagatgtgaagggcaaatgttcagctttcaagattaagtaaatggaagggaggtgcttccattaacaaacaggtaagtcaatagaggaagagcagcatgtgcagatgcgtttgtttgggggaatgttaaaatagcagcaaggatgggaccttggcactgagacatgcaggaggctgtctgaagttcatgatgattcctgagatgcagcctgtgaggagaggtcatggctagggatgcgataaggatttgtctgtattctgcaaagagtctgatgcaatggctttcaatcattactgcaaatccttcacaagtgtgtaaagagtatcatagccattactatattactatatataaaatatataatgtactatataatgtattatatataatatataatgtattttatatattatatattatgtatataatatataatatattttatatataatatagaatatatgatgtattatatgtattatatattgtatatattatattatacaattatagtatatattacatattgtatatattatatatagaatatatgatgtataatatataatatatcatgtattatgtataatatataatatataatgtattacgtatgatatataatatagaacgtattatatatcatatatcatatatgatatagaacgtattatatatcatatatatgatatatgatatagaacgtattatatatcatatatatgatatatgatatagaacgtattatatatcatatatcatatatgatatatgatatatgacgtattatatatcatatatcatacatgatatatataatatataatgtattatgttatatatcatatatgatatacatgatatataatatgtaatgtattatattatatatataaggtattatatataatatataatatgtaatgtattatatataatatataatgtattatataatatgtattatgtattatatataaaatatatataatactatatgtatacacacacacacacacacacacaaatatataacagaagtgggttgtgcacggtgatgacgattagggtataggaggtaagagacctaacaaagcacgaagtgatgccaagcgagagttttttgtctatgaggcatgtaagaacgctacaatacatgtgcattaaaaagtccagccagggacatatatagtctttttcttacatgtcactctactgaaatagtcttgaattattttatctgatacgaggtgaaggaaatgctatgttttcatcagtaagcacaataggtcttgtaatggagcgtacaggtttggtttggaaagatggcttgatacaaagctggataagagatgatcccctcaaagacacagaaacaactgttgccgagcttttaaggagcaggaaacagaggatgaaggggtgaggatacgaatttgttctctggctctcaaaaagaaaagagggaagaggaaaaggaagtaaggcagagaaagtctggaaccaagacagtttaatcaaagtcgagggcactagaatagccaaatgtcattttcaaggatgtgatagataccgttgaccctccacgtccttgggttctgcatccatagattcagtcaactgcagatcaaaaatattcagaaagaaattgtgtctgtgctaaacatgtgcagacacttttttccttgtcattattccctaaacaatgcattgaaacaactatttacatggaatttgcattgtattagtaaacctagaagatgatttaaagtatacaggaggatatgtgtaggttataagcaaatactacacatctgtagattttggtgtccttggaaggtcctagaaccaatcacccatggatagtgaacgatgactctaccgatccttgtctgtgtttttaaaatgagaatcacatcttccattctctctgccaccatcttcatgtctgctcatacatgcatcatttagtgggtgtattgcagaatgggctaattaattttatgtgtgggtctttgtaatggaacccagagacagggaatataagaacctggactcgcaggccagatgaggttgtgagaacatgagctgcctgtaaccgtgaattgcaatttggggactaaaacttggaatcctagagattgtctgtttgccgaggtgagatttttgagagccaggaaggttttctacccaatacccgatacatccccagtgtcaccttgtaagttttgcagataaacctagtttcgtatgattccttacatcgttcctagctcacctccaacaatcatcagactttgaaggtatgcaatgatgccagggactaagaattcctggggtgtctttgacctgtgttccaggatgagaccctgggaaggtccaggtcaaggtggattaattcagagctggagatgttagaggtgaagtcacttctagtcagaaatgcttaatgacaactcatcttgtactttaaagataaaatttctgagcatttctggggtcaaagaaccttgcagccaagctcatgaaagaggaaaaagagaatcttctgcaggctttgtttgccttcaggtttgcttgagtttaatccagaagtcgaaacacagagagtgggtggggtggagggttcccaaagtagaccttcccacccacttgttcattaggagaaatcaccacttagctgtttttgtctctgccgcctacccttccttgtcccacgcacttacattcagtcctgtgcactggaaacagactcccaccctctcaactgccaaacgctgcaccttgtctttgcttcacctcctggagtccattgtttcaggaaggctgctataggaactgaagttacttgcttgctctgggtaccttttaatttggggttctacctggtgtgtctcgggtctcttttgacatatgtcagttggctgctctgatagaacattgtctccataaattgtcacttttgccagaaatgatgataggaaagtgttggcaagaaaaaaaaaaaaaaagactgaagcagaatattttcttttgaaaagcttagggcaagctgtggatagggtgggacttactcctgctctaattgagtaaggacaagaaagctaggaaaatttcatatgataaaattaggtggctggggtcagcgatatattcctggaaaaagaaagcttgaagataaaatggcatagagtagttcttcacaaaagtgcttacgaggtttagatattgtaaaaaatgatgaatatgatgatgatgatgatgatgatgatgacagtggtgattttgtaagcagcatctctactgctgtttgtattgcatggttaaaaaggatactttctcattttgttcaacagaccagaaaaccctgttttccatctcttattagaaggataagatagatacttcttgtgccctcagtttcttcttatgtaaattggaactataaaaataatctaccttgcaggattttgtgaagatcagaaaaaaattaattaccatctggccagaagtaattttctaacatgtattacgcttgtcagtcttcacaaaatagtgaaggacttgacctgatgttgtgtgagatacagttggtgaagattttagttgacaagggttaatgtgtaagctggcattcatttgattcattagcaaggttaaataaattgtgtactcagaagaccagggcagaaaggtgatgtgtatgatgtctatacatttttgtatagtgccatgtcatttaaaaaaactttacaaaaagaaaattgtatctgaagttagtccttccataaatgtattgactttgttggtctcgtttgtgtaatttttttgcaaagaaggaggaatgatggtttcatcaactggtcaggggctgaaaatagaaatacctcataataatagttgctatatattgagtggttgctagataatgggcaccatttttatgacttatatatattacatgattttatctttcaacaacttaggaaggaaaagtatcattattctccttagaatgaaactgaggttttaagaacttgtatgtcagtagacatataatagcagctgcaaaggtatgatccagagatagatcttcagaccaagcagcaagactccaaaaggtgtactgctcactacaggtgtactcaggggagtacaccttttgcagtctcgctgtttgtgtttgaggcatacccacatatgaaccagaaagagttcccaaataccccatcgcaactccatatttcaggtggccttgaacgagcagggctgagtcattgaggaacaagaataaactctggtgatccaacaaattcaattcatttgacctttattaagcctctcctaagtgaaaggcatgctgctctgtggttcaggaaactcagaaatgagaagggtgtttggtttggtttgctgcagtgaacctgtgggggtaaagagaatagttattcaagcctaaagagtgtaactattaattgttttttagtctcctcgtgatagctaacaagtattgttgatacttgttgtgccagtgcctatgctgagaagcactttacattcattatctcggtggttcccaaatgccgatccacagactcattggattctgtaatgacattttcgacagactgcagctaaatgagaaaattaagggcaatttagtgaaaattttaatagacttaaatttaatcaatttgaaggactgtcctttattttcagattatgtcctcctttttttttttttttttgcattttcgtgtaaaatgctgtttcttttattaaatgcttatgacagtagacagtgtatgtgagtttatgtgtgtatgtatgaatgtactaccttggcaagaaatttaaaagctgttaattttcatgcagtctctttaccatttttaaacttttcttggaactgtccatgtcattgagggctaggggataagaagtctgagaatcattatagttctgtaagggtgctaccattggccccattttacagatgaaaaaaactaaggctcggaatggttagctcacatgctcatgttcacgatagcttgcaagtagcagagcttgaatttaaaccagtttgtgtgtttctgtagatgcagaacacctgcatgatgggcatatggctgcttttgctgcaatgaataggctccctagcctgtccctggccatggatgtgggccatgcaaccgttttcagagtcccaggactctgggcctttctttcgggtgcagactgaaatccacaatagctttagacattcatggtgtttcctaggagctagtttgcagcagttctattcctctacttggaggaatacaggagttaagagcctagctttgtgtcccttccctctgcccctgagtcctgtgtttctgtttaccctcaaaaatgtgagcagtataggtatgtgtaaaggtaaatgcagacatcctgcttagtggcttacagcagaacctcatgtcaggggaagagctgggttgaaagatcccgttttccaagcttgcactccatgggagccatagtcagtagccagtgagacgacaggaggagagacaaggctcaagggtcaagggagaagacactgtctgtacctcctgagctttctcttcattgtgcctgcagggaggagggaaggcagtttgggccatggcttgtaggaacaaaaaaggacaaacttattttccacatcttcctgctttatatgtgaggcttgatgtaaagacaaactaccccaccctgtgagatgggtaattgagaatgagacataactgggtttggaaatcagttgcatcccttctcttctccagaaacatatgcaggtttccaacctggcagtctgtttctcagcagccttggcacctgaggaaggggtaagatgaggatctgggtatttttattttgatttctgacattgtccctaagaagttatgctgtaaacggataagagattctgggttactgaaatcctgtatggatgctaaggtgctatgtagcttagtccattcccttttttgttgtggatgttaattatctagaatattgcaactcagtagtggctttaagcaggttttcatgtactagccagggaaagttaccaccattaaaaaaaattattctttaggaacgtgtagcctggggtctttataataacaacagttgtagtagtagttgtagtagcaatgatgataatataactgtttcattttattgtaaaagtaatacacagacacattcttattgtgaaaatctaagcgacataaatctgtacagagtaaaaattgaaatcccccccaatagcccctcctctattaccctagatctaaaagcatttattggattgatttatttgtttccgggcccttttgtatgcacttcacatgactgcatgtatgcctattttacgcacatgcatatgcacatacttctgtggatgtctatatgcatccacacacatgtttttaaagaatcgtagagttttgctgtttgttttggtttgatttttcacatgtgaaattttgttatctatatcctgaaacttcttagagaattttcttagagatttttccaaggaaagacactcagatgccccgcattctttttaactggtgcattgcatgcatgtcctgtaccttgttttatttatcccctgtttcccctattgctgtttattatagttgacccttcagcaacatgggggttagaagcatcaacccaccacaatgtagaaaatttgtgtataggtttttttttgtttttttttttttttttttttgagatatactcactcttttgcccaggctctggagtgcagtagcatgatctcagcctaccgcagcctccgcctcctgggttcaagtgattctcatgcgtctgcctcccaagtagctgggactacagatgcgtgcgactatgcctgagggctaatttttgtatatttggttgagagagggtttcaccatcttggccagtctcatcttgaactcctgtccttaagtgatccactcgccttggcctcccaaagtgccgggattacaggcatgagccaacatgcccagcccaaaatttgtgtataagttttgattcccccaaaactatgattagcccactatcgactcaaagccaacagtggattaaaacgtattttgtatgttacatgcattatatatgtattcctacaataaactaagctagggtaaagaaaatattaagaaaatcataacgaagagaaaacatatttactattgatcaagtagaagtgaatcatcataaatgttttcatctttgtcattttacatgaggtaggctgaggaggaggaggaggacgaggaagacaaggggttggtcttgctatctctgggtctctcaggtggcagagaatttctgcatatgtggtcctgtatagttcaaatctgtgttgttcacgagtcaactgtatttgcttttacaagcaatggtggagtgaatatcctggtttatgtatcatgtatctacctcaaatatttcagcaggacagatatctagaattagaatagttactttgaaagatgtgcgtattttagattttgatagtgagcaccaaaatattaatatcatctccaggactgtaccagttttgactcccaccatctgtgtttcaggttacccatttctccacagtgatgtcaaatctatatattattgataggcattttattcgttatttgattttatttgttaactgatgtcagtcttttaggcaaaagatggccgtaaactgttctaaaccaccaatgtaactttgaaaagctcatttgtagtgggagcgagttgtgaactgggtattgcctgcgcttgtatttctgctcttggaagcgtggtttatttttagtcctggactcactgacaacccacacccaaactagaaagctagaggagtttgagggtcctttacacagaatcaggctctaatctcgatcctgtcattacatgcaaagcaattgctgctgaatggttggaattggttctgcctgggacgaagccctttactctgaaaaaggagcgctgtgctcatttgagcactgccaaaatcctggaccctctgactcagtgtggagtgatcgtgcttttgcctagagaaactgtgtctgagaaatggagcttctgcaaaatacagctcagagggaccatcaggggttgagacattctagaggccaacaggccagcttaatgtatacattagaagtgccaaacttctcacccctatccctagtagattgacccaagagaactacagaattcatgtagacatgctcctcagtttacaatggggttatgtcctaataaacccattgtaagttgaaaatatcataagtagaaattatgttttcgacataggatattttcaccttaccatggatttatccagatgtgaccccatcgcaagtcagggaccatctgtattaaacaaatgtgaggcttatgcaataagattggaaggagcgggatgcaagaggggctttcttgaagctgaaactgcattttttcagagcaagtgtagtttttaggtagatttcactgccgtctcccttaccctggtttccctaattccctgatcttgatcttgcctgctatgcttcccacagcactcaccaccatctattgtactgtacttatttcttctctgtattacttactttctgctgcccctcccccacccactagaatgtaaactgtctaatgtcagggacctttgtttgtccggccccactgatgccgacctgggggctagaacagtgcctggaatgagatcagcactaactaaatatgattcaggtgtttgaacaagccagtgactcaaagtgcttttgatacagataaataataaagttttctaaagatactttcatgctcactttaatgaagatggagactatattgtcgtccacattaaatttggaagtgaaagtaaaatatttctaagtcacatcttgacgttgccactgagctaaccccagtatagatgattacattgaagttcaagtccttctttctgtctaactggagtcttgcttgctctgaggtatggcaactcttatagaaagtattttttttagtggaatgtctgctatttcaacagccttgggaagttataataaatagttatgaaaatgagaaaagaaaaaaatggtttccattcttcttttaaattgctggcaaagttggaagaaaaaaagttacaatattattttatgagtcaaattaaaacttgggtagttgccttctgcctaaggaagtttcatttgaagatgacattattgattgccaattttcctgcactttttcagcttcctgtggggtatgtataaccattccattaagggtccttgtagctgaaatgcaggcagggtggcccttgaatgcatatgaacccatgtgatgttgaatgtctagaatttttttttgtggagagataagagtattttctttccccacttctcccatttattgatgttggagaatcatgccagagctagtggccttgatatggctctttctcagtctcttttgagatggaattcaaatttgctatccccagatgcggtttaaaaggctggcaaagtgttgtcatcaagtgagcgatgattgtggatatgatgctaccatttgatttggggtcattggatgccctattcctgattaaggagcactgatgttatcaatggaaaagtgttcctctgggctccttaatatagttgcagtgtttatgggaaggggacttgtccctgtgtgtgattgtgtttgcatgcactggtggagagatgttcaggtttagttatccagagagcagagcccgactccaaataattttgatgtggatttaggtctggttctcatgttgtactttgcagatcttcagtgtgtctgactgtgaaaacttaagtttaagggaatgtcagagccgttattgcaagatggatctgtggggatctaatcactactgaggggttccaactttggggagaaaacggactggaaaatctgtattgccttagtgcagccaagagcatttattgggtctttacataatgtatttgtttttcattaaaccgttcagataaagtcttattaaagtgccatgtattatgtatcatgtttcttatgaaaatgagctgaaggaaaaaattctctcctcttcttgggttatttacaggcttttctaatgccagcaagagaaaaaaaaataaaggaaagcagtgcgaacccgtccgtacagcagattgcttgacgcaacagtaaagaatgggaaagggagagtgaggattggaaaggtagaatggttggccttttattccattcgtgttctgtggagtgactttctctttagttttgtgaatgcaaaaataaataaataaaggcaggtaggaagtaagagaagaaaagagggaattcttatattatttgttaatcaaagcttgtcccatgaatgtgacctctgatgcaacgtacagcaaacgtttttcaaactaaccactgccagcaccccccaataaaagcagtacagaatagcagcctctactttcccactcccctggatgaacttctgcctagggctaaagggttaaacatgctactgtgtccctgataaattgatgggatgtgtgagccccagagaggttggaggcactggttttgcaagatgaaaagtggaaagaaacagcgggttggggcctagtgttaggcagagtgaagacttcatagttatttcaaacagaacgacaacaaaaaatagagccgtgggataattagttttcttttcttcagaaagcattttgattagcctgcaaagtgagttgtgccttgcgagctgatggctgggttcagagccttcatttggctgaggatgtcggggtgagccctgaggaggaggggatatttgggatgtccctggtggccagttccagggttctgccccaaatattcttttgtgagagagcccccatcccctctcaggtacggttccgtcctgcaggtcagtgagaagctgtcagcaaggtttctttcaggaagcccaacaatcaaaaaagctgctgtttagacagctgatctcttggtctgaaaacaaaaaaaaaaaaaaagaaaatccaatcactgggtcaaaatctatattaaaaaaatatggctactcttcctgatcacgattttattgctgccaagaatgcaagaatgtgcttttttttttttttcctgtcaggaccaaggacgagttagagtcttaatattttctttcgatttgcagatcacatcctattttattgcataaagactaatgaaatctactaatgaataattattacttcataaaataaaggggaggggagacccgtttgcaagagcagaatgttaatttggccaaggagggctggacaggcaagaataaaaaaaataaataaataaaccattgtaatttgctccctgcagccgacggagtaatctcttatcagacacggacttccctaccctgtgcatttataatttgagaggagcgggtgttctgggctgggagaagcccccttccagtcgccccgagctggcacgttagtccaacaggcttgatttccacgccagcctgggcggttgctctcattgaacagctcaggggctggttcgctggctcggggctgcctgcccaaccaaggcgaggcacagagcgaaagctgcgccccaaacgcccgggggtgcatcggcgcttcggtgctctgctggggggcgcagaaacctcctcccctccctcagcccaagctccctcctgcccccagcccctaacgtctcagcactccacctcctgaggaggggaaatcccttttctgtgtttatttggcaaggaatccggcaaacgcaccgccaccaacatctaccactgtgggtcccagctgggccatcgcgctaattgtccagctcgcctgatgccgggcgcgcggggcgctcgctcgcctgctcaccggcagagggttttagcagaccgaatttaaattttggtgagtgtttttttgaaacaaacaaaaaaaataaataatttttaaaaaaagcgaaggggagggaaggaaaaaaaggaaaaaaaatctttcccctggacccatttgacaaatgaggagacagacagcatcagaaccaacggagtgagcttcagtgtgagtcaaaacctctcttcctctctttcaatctctctctctctttaccctccctctcgctctctctctctctctctctctgtctctcccctccctctctcttcctctctccctctctacctccgtcccaccccttcctcctctccctccctccctccctctcgctatccttgcccccctcccattcagcctcttcgggagggcagcgcatcccctgccccttccagagaagttccctctgccggttctcgtgtcaccttcacaggggtatggggtggggggccccttccactttccgggggatcaaaaagcaggcccaacaacccagaaaagccagacgaccgcgcgaagggaaccaactagtttccaggtccccgcaagtgttttagttggaggcagaggaacgccgggatctagcacatccccaggcggggagagccagggaggagggaccggcggggtgcggtggggggagggaggaggaaagagggggagagagacagagagagagacagagagagagagagagagagagagagagagagacagcgcgagccaccggtcattgacttagataaccagcaaaattaaaaaagaaaaaaaaaaattgtagcgcccaggcagagagcaacgtgattgcattcaagcgtccccactcgggctcggcgggcgccagagagacatgatgcagcatcctctgacgggggccacctgcgtggcgctccccaacgtgggcatgtgtccccagctttcgtgtgccttgacttttatgtacttacagcaggtaaggcgcgcgtctgccctcggtggctgctttcctggggctgggccagatgggtccccgcgcgtactgggctgcgcttcggtgccttatgtaggttctgaggagggggctcccgcgttgcgatggaaagggtggatggaagcctcctgctctctgtggagcccgggcacctcgcgctgagatgtttctgcacctgtccgaatactttaaaaccgcctgatgcccagcctgggcaccggaagtttgaaatggaaaactgccttttccttgctaccatcttccttgtgtcagtgcctttcgtggtgatctgagtctaagacccctttgatgctaagagtttgaatctttgtggaggcattccggtgcctgtagtgttaattcagctgatttaatagagagtggaaaggagaagtgtgtggtgtgtggtgtggtgtgtgtgtgtgtgtgtgtgtgtgtgtgtgtgtgtgtgtgtgttttcctaagtttgtgtggtgctatattcggtccgcatgggatcgcagcatttgaatttctggagtgtgtcagccccagtctgccttcaaactcactggcaatgctgtgaagaaggtgagctgtttaggatgttgtctttgttggcatgtgttagggtgtttgtgtgtgtgtgcgtgtgtgggtttttttttccctttcacttctccttagtggtcttgctgagggagtctgtgtttgctttattttccattcattgtgcacatttcagtcttttgacaccttactctctgtctttctcagggtgtttccttgggaccctctctgctctgtcattctttctttattggaagggttgcttcctgagttggttcctgggcttgggaaatagctcagcactgcccttgtagggtgacaggccagctctctgtcattgggcaggggcagtggatgtgaactgaagggctagaaggggttttgtcatgcagatgaaaatcctttctccctcccaggatctccatcctattctatgaaggtttacagtgattatactcattttatctgtttttccacggactcacttcaagagtaccatttgttaacatgagtgtgtgaacagaacttcctatgcaagagttgagagtggccctcttccccaagaccctcaatttcaacctgtgttaaaggaatgtatatttttataaaatgtcaggattctgttttgaacatttgggtgattttctatcaagttggttgactccagaaaatatttcttaggtgtattttctgttgcatgtctttttgagaacagtcttaaaaaaatcttgggaaccaatttgttcttttaaatattattttattacgttcattattgagtaaatcgtgccagaagacatttcccaagagagtattgataacatattatatgcttcatcttccacaatttctgtgcctttgctgtgggtgtgtgtgtaaatgtgtatgtgcatgtgcgttttataccagttatttccaccggaagaaaattctaatgagcatttctatagatgctaagcctcagttggatttatcaaattattactgagttgatcttttgccttttacatttacttctttcatgttatttattaatcaatttgaatatcatttacctagcaagtagaatgctataggtactcaatgttctccgttcctttgtgtggtggtgtttgtgtttttttcaaaaatacatccatgtttctgccttctagatttttaaattggcttactcatttgggcacaacttaggagagaagatagtgactttgagtgagaggttattcttgccatgagaagaacaaacatataagataaacacaaaggttctcagcatcttccaggcagtctctcccacgaggaaaaacacccctgctctggaaaggggaggcttgaagaaaacattggcagccacaacaaatatttagaagtgactaaatcagcatcatggttccatatgaagatagatggagggtggattttgaaatgtgctttggaatgcatctccccctcccctgaaaggacttgcactgctatctgtgaaagtgtttataatgtgatactatgacataatgtgggaatggtgtgcgtgtgtgtgtgtgtgtgtgtgtgtattttctctgagcttcactgaatacctgaagtataataaaggcagtcatttatttttgcctgtttcattcagaattaggttttctagcccttcctggaagctcaccgctagggtgtaagtgatatacctggagtcatctgtcctggccattactgtcgtgatagttcgtttaaaagtctcaagtcacttattttatttagcattccagacaatcggctgattaagagtgtgaaatagtttaatctccacatacataaatcatatcgataagtaatatcttgtacccagacaccactactatattttttatctgcctttaatctgtagctattattggatctctagctaattttggtgaacagaagggtaatctttgatctcaaagtaaattgatcaagtggacgaatcaggcaacatttatgataagtaacaccttcactgaaaacaattttattttataattgtttagaaataaacataattcagaagtctttgtcattgagatcaccaattacataagaaagtaatcaacccacattgatcttattttggagcatttatcattttgttttataaatccacaaactctgaccaccggccatcgagtcttccctgaagtatatttttctggaatgcagtttcatatggttatttcttatccaataactaaggaaaatgacttcattaaatgctttctttgtctcagcatgaacatccaacctttcctcctaaattctcacagatttatccataagacaactcataaaaacaaaaatcaattggggtgcctcagcatcggagtctactctgaatggccaagtgtaagtggcaacatatcacttttgccacgaataatttatttacttaggccaatgaagaagcaactttgatgtttacattatttgacttatcctgtttcacttatttgtatgtcccaataacttttatctagataagtgtttacttacagctacgatttcttttcttttctccttctcctcttttttcctccacatccaagatgttactacagtttagagctgcaaggtgggataatgctaaatagtttttttggcgtctagatatcagacccagtgatgtactcacataggaacacacaaatttgtatacatacacacagacacatatacacacacacctagtatagagcatatattttgtggttgtcaaccactttcagatggaacggacaagtagtccttggagcaactggcttcaatcttgctgtccagggaaagtccctgcctcaatctcctttcctgagtggcttcatgctgtgtcttctttgatggtgaatcttcttgaagctgaacttagaactcacatatccccaatacttaatcttccacgttccaaagtaagtactcatggaaccattcttgctttgaggaataattctgaatacaattccacattagggggtttgcagcaagctaggtcaaaagagaacctattttgttttcctgatagagaagaaatagaaaacagccacacacacatgcatggacacacaggacacagaaatctagagatggtttatttctattgtaagtaatagagggcaaaccttatagcacccatctcatggtaaggtatggtgaggcaacagacaggatggatgatgagattcgttttctgatgcaaactgcgtgtcagattccacccagagctgtttttttttttttccactgagtttaatgtcctgaaagaggatcagtagcatattaacttaattttctctgttcttacaccaccagcgtctctcagtactattctaagaaagcttcttatctgtcaagccctatccactgagaacctttttatcagcctaaatttaaaaatacgtcaaatgcttaaaatccacattagagggggcagaaaagagcctctaaagtgggccatgccactgtcaatattcgaagattggtaatttttcccacttaatgatgatccatgtggtttgttttaagtagtgaagtggtttgtacaaagggtaattcccagtaaatgaagccattgctcactgtggacatcttcagatcgaaagcaattgaactgaaacctgcatatcaaccctttctgtctttaattagaaagcgattctcagttcagggaatcacctggggaagatgggctctcgcgcgaaggctgcaggcgttggggagggtggccccatgcaccagccacggttataaattttggaaacattaggtaggtcataacaattatgactgtgtagaaaagttcaattctcattgcagttacttaccttgtgttactccatctgatgatttatagggggccaaatggaatttatcacattctttctttttggcttaatcccgtgttgatttattagatagtgctatggattgggggtggtcgatagtgtcagtaacgcagaaaagaattaggatagattagcttcatgtctgaattgtttaaaggaatttaagtggctggaatgagcacatttccaggcccaggtggctgcctgatagaagaaaggtccctcagtctctttctagagggatgtcttacgtcgtaaattggttaaccaatctttcttgtttctctgatcttttccgattaagagaaggcatgaaatgttaggctgttatcagccaggtaaggcccacatttcaggtgagctgggggtcatctgtgcttcccccctttggggaacctatggagggccgcgtgttgtggacatggactgcagggccacctgggctgcctctgctttaaaattacttaatccaacaatcacttctgaaaattgtaagcatctgttcatccacagaccaaagccttgtgccattcgcctgctctgcctgccattttgaggcagtttctgtgttataacatgcaactggccgctcctgcctttgcccggctggagaaagtctgtgttattagtgctcacccgccatctgttttccttacagctgacccttgagtaattctccagtagctgatggactgagggtagacagtcttttttagggttttctgattcatttaaccaggttctctgccccaagaggaaacataatgcttgtttattcatattggccgggtgaaaacagtgtagtttgtcaggcaaataatagtcctgtggaagggaacgaaattgcagcattgtaaacaaaatcaggttgctgactctgtgcctaagggggttgggtgatgagcagcacatgtcatcccgtgaaggaagcagagctgacaggtgtgggtgtaattgtcccatctgcagacccctttttaatggacggggagaagtgtcccaatgttctgtttaattcagttaagaaaagcaaagaaagttccattcatcaataaagtttcctattgccgggtgctgcccaagagaactctgccgggctgagcgttggcccgtggctgttggcatgatgcagcttgcctcacccagccctattgagggcggctgtgtcagatagggtcagctctcaggcacaatggcccagaagagccctggccctggccctttaaccatgctgaatacaggtgagctagccaaatgagcaatggacccgcaggccgcctctgctgggagacagagctggccagggttctctctgaaggatcctgaaatgcagttcctgagcctggcatacgatgaggaaagagcttgtgtggttggaatgtcctggctcctgagagggtttggggaaagaggcttttcatggttgtttctgatcttcctgtcatgctatagccctgatggattgatcccggctaaaaaagtgacagaatttggaaccagggttggtggggaggaggtagagagaaggagaagatgttgatcaaaactgtaaaaactgacgttaactgtggagcacccagagtcctgttggtatgttttatcaaaacttcatcaaggggcatacttattaacatggaaataattgtcatggtccagtatttctcaaacttcagacattcaggcaccacttcctaagtcctgccaatctacccattaccagagttgatatctacttaatattttttaaaattaacttacatattaaacatagacttgcccaaaccaaataaaacacagtcactgaatcacacctgtgatcacactttcccagcatacgtggaactaaatgtgtattcattcacctgtccatccacccattccatgttgatggaactcctgataggtttatggaactccagctgcccttctagactctcccagggagcaaagcaaaggcccctgtcctcacagatagtctgttacgttgttcatctctttgccatcttgtgaaccatgcatgcagtacaacgctttggaaaacttccgcttggcctgctggattgcctgggaatcctctgccgtgtccggtctggaattactccttccgctaccttgacccaatttgcaaggggcaaggctagagttaagttctttgtgatgcttttttttccatctgccagatcagcagccactagtgcacaataaaggaaaatagccatacattcaacgtctacatcccaaggagggctttgagatgatggagctgggactgggaaactgctgtggtccttagcactcagccaagctctagctgaagagcagtcctaccctgttttgatccttttctttatgtgtcttgaaacagaatcaaaattaggaaggggaactggagtggaaagcattcagaaggttagtgtgtgttcccagggatgcaatgactattttttttctccccttttgtggccatagaacaaagtagaagcaactgtaggatttaagtgactccaatttcccaggcctgatgagtaaatgcataaaaggtttagtcttgatgagccttttcttttttttttttttttttggcattcgatgtttgctcaggattcgcctcaatgactagattccccttatcaaaaacagtaacaaacatccccggtttttcccttccatagatcagcttcctcttgctctgcctgaagccaggcacggggcaagccctgctcttatggaaaggttgagagcaatattggtacctaaacccagaaggaacagcgaggtttacacactgcagtagccagctgtccatctcaagtgtctcacaaaattcagatgaaaaacccagatctatttagagccagttggtatcatggtatcagccttcccaaaagtacaggtttttttgaaaaacgatagtgtttctgaagttatatgtaggacagaagtcatgagctgaaggcttaatcccaactctgttattcaattagctgatccagctgaattgagcaagatagtttttttttgtttatttggggacttaattgctccttcagaaaaacagggattagaacaaccatttcatactgttctttgtgatattaagtaagatgcaaatgggaacacttagctcagtgcctggggtgcagtgagcagcctatagatgtttgataaagaaatgaaggaagggccgggcgcagtggcccacgcctgtaatcccagcactttaggaggcagaggcaggtggatcacttgaggtcaggagtttgagaccagcctggcctacatggtgaaaccctgtctctactaaaaatacaaaaattatctgagcgtggtggagcacacttgtaatcccagctacttaggaggctgaggcaggagaatcacttgaacccaggagacagaggtagcagtgagccgagatcgcggcgttgcactccagcctgggcaacaagagtgaaactctttctcaacagcagcaacaacaacaatgaaacaaaggaaggcaatatgttaaagaaacgtaggatttgtttattgaagctggacataaacttctcgtttccatttctctcaaattaacatgattaatacacccatggcctgccaaggacacagacacaagggacttgggtgtcactccgggtcttcttggttccactaccctgtttgggagctcttctctttcttcctccagtgagctgtcattcctgcttgtgtcactggattgtaatatggctacacagctcaattaatgctcagtgtcaggaggagggaaaataaaaattgtcttgctcttgtcagtagcgaagttatttactttcaaaagctgacagaatcacactgcagggccttcatttatttccattcagaacgtcattattctgtgatgccagagacttgggcacacgttgaagtttattcccataagctttaatatggcggggccctgctaaagtgtagatcgtcacccaggagagtctgggagagtctggcggagctctctgggggccccagggtgcctgggtgcttggcactgatgtctgggagggtaccctagtttcaggatggaccggggaagctgacacgtgcattttcatgccctggatctgttgtaggagaggcagcgtgttccccactgctgctcttccttctgaagcaaaagaaaggggtgtgggactcgtacttccacatcactcttcatccgggccactcctggaatttctggaaacacaaaagcgcctcctgaaagtggctttgctttggatctatctattgtctctgcttaaactcgttgacaggttccctcaaccaaataatctgtataaaactatgcaattttttgtttgtttgtttgctctctttctttcttccttttccccctaagggtttgcaatgagcagttaacacaggaaggggttgagtggagaaattctcttttcttcatggtgcagtggcagaaccttccactgggggtctccatttagagtacgtgactcaggattcctgaagactttcttttttcctttctttcttcttttttatctttttttttcttttcttgtctttttttttttaaggctctttggttccgttcaaaaaatgaggctctttcggacagcagtaggagaggcagcttgtaagaccatttaggtaacgagataagccagccttcttccacaatgatgatcataataataaaataattaaaataatgaaataatcaataacttttatggagtgctttgtgacaagcacacgaataagcacttttacatggattatcacatttaatcccccacaaaaaaagcctccagggagttgaaattaatggcttcatttttagatgcagaatccaaggcttaggtgggagagctgatatttaaaaccagacacttttgccccagaaccgacacttagaaccacgattctgcaccatccctatgtcctcctcctcactgtgccggccagtggctggttctgtatgatttacggagagacctctgccaggttcctgcgttggaagaatagctccaattgatggagtgggcctcttttcctttaaaggcaggacttgccaaaagaggaaagagttcaggcgacctgtcaactttgatgctcttcccgattttgttttttttaagtcattacgattttgtttaatgaattgcaacaaaccatgaggcttttggacttggggaggaggaagggagaggggaaagaacgaggctgtgagaatcatcagcactgagaatgatggagtgtatttctccgcaaccaattccaatccccaaatctctgttgtactggggagctctccaactaacagaggaaacgcagtcactgcccggcaccgtattaatgatttatacaccccgcaccactgcttttgttcacttgcggggcctggtcgtgttcataacggaatttcagggagtggggtcctgccttgccatgctgttttgctcagtgcagtgaagactgcttcataaatcaaaagaatttagtgctttacaaccttcctgagctctgagatggtgtgcgcctgtgtgcggttgtgtatgtgtgtgtgtttaatcagattcacttagacacattttcattgcctttctgtaaagaatgaatgaagaacgggatgcgatctgtcttaggtgtttcagggctgattggtttgtttcacagtggcatcacggtcctatttgtttcccatttggtgtttatgctttatggtgttgtctgtgaaaatgggctgacactcttttattagcataaagagattcagatcacattagaatcctccgtccttctatatcatcaaaaacaacaggcaggggagagggcgagttgactgtaagccgaatcaccatttgttcacgataagtcaacaggagcttgatgtgatctttaaacaaaggggtttttgagccttttaaaaatgattctttttcaatttttcactgaaaaagaatgcagcttcgttttgaatgttatcgaggacatttattttccggattgggaattctggatgtaggaaagtttcttctcttgagtaagccacagaaagctctaattttaacctccgcttttatttttttcctaattggaagaaaacaaatcataacctcatatattttatttggagccctcaatcaatctttcaagataccagcagagaaaagctctttttttttttttaatgaattgcacttgtacttgtgttttcttaattatgtcatgcatttcattttgtgtgtggtgatatttctttccctatagaactgagaactgaaaaccaacagaagacagagtaggagtttgagggggtaaaacagaatatttagaaaattagaatgatactttaaatattccagtcaacagtaatatttttgtctatgataaaatcttgattttaggaaatgctcttgagttaaaaaagaaagatacgtaaggcttttaggaaataaacatgtcattttagtagaattctgaagtgaatacatgaaggaataaatgcaaagacaaatgattaaagccctactctaccctacccccccccccatactgggggcttgaatttcttttacaaatgtgaaagttttagctatctggttcttattaacatttatgcttataaatttttttaactgtccagtatgcttgtcagtaatgatgaaattgaagcaaatattcattgtggaagatagtcttttatagccttcctgaaaagtggagaacagaatatatatatatatatatatggaacattacacacacttttcatcatgggacatatgatacagcattttggactcggaaagcaggtgtccagcaaatgcactttacatttatattgtactgatttttgtatttttgtttgttctctattatttgaattcgtgagtgtctcattgtttttaattatgtctacatggcacaagacagcagtcaacatctgctctattgtttacttggtttacatatatctttgatgggttactaaacaatctatttttcaaaccccaaacagaagaaacaagctgaacccatattacagcattttgtaaagacccattatgcaattagcacttgggatttgtgcaaatctggtgattcacccaaacaaacatccctttattctgatagttcttcctggctttgtgagaaatatcagtttccaaaaaaataaaatcacatttcctctttaatcatgcagcgtgccaagaagattatgtgtttatatgagggatggatcctccactttgtgtatcagagaaagatcaacttttcaaaataatgatgtctttaattcaaggcagcagttactatattacataagacaactatctgcttacacatagcagacttttgagagttacatggtactattggagaagagaaatgctatgtttttacctgtttgtataatcttcctaacattgcatgatctgtttacagaaggcatagctggtcatctcttgcaaggcatgtgaggcccagaatgattaagtcacctcaaatctgattatttctctgaagtcaatggttaataattaatttactcactcattcatgcagcacatccttatttagcctctgtctcagagattgggttggtcattgaagggatacagacaaggaaagcaggtctgcttttcttcatggaggttacaagtctgtgggagagagacagcccatgagcaagtgatcatcacataactgtgccttgccaggtgtgataaatgctctgaaggaaaagagtgggagttggattcaggggtgagggaagcttttttgaagaagtgacatcaaagctgagatggagtgggaggtaggcaaggaggtggggtcagggtggaagagaggattcacactaaggcatagagtgtgtgtagtgcctgttgcttgcctaggtgtctttaagatgctggaaaaacaaagggaccagggagccagtgagagaggggtaaagagacacataagggccagagacgactggagtttggaaatcttgacctagagttggattttttgccaagacgaatgaagaagacagaacacacacacacacacacacacaaacacacacacacacaataagagggtttaggcaggagttaaatgaccatatttagcctttttacaaaggccagtttggcttttctgcagagaatagagggagacaagatagaaagctgaggacgggggtgtcaagtaggaagtcactgcgatactactggtgcaagctgatggtcgcttggactaggagtggacagaaaagaaacggccaggagtaaaacgttttgaaaatcaagcctgagattcatccccgaagctgatgttcagccagaagagaagaaatgcaactccctgaagtcagacttcggcaggctttggtgaagtcaggtggcactgacctgggtggtatgcagcttcatggaagtgagtgacaggccagtctcagcatatcttaggccaaagctcccagagctcagaatttttcatctgaactctaccatcaccaccactatcaccactgtcaccaatccagtgctattatcaccaccactatcaccatcgccattaggaccatcaccatcacgaagcaactggtctcatgtatgagttggtagcagtcaccaaagacaaaggcactcaccagcttggtaaggtgctctgtagcatcccacttctaatatggtgggtgagaagtggggagtcatttttatgaaatgtccactgagcagtacctccacccgctgcctccagccacaggagtacaggagtgaagtgcattcacgggaatgtgaaacagaactgactttgagtctgaaacaaattacaaatcttatgggcctccaactagctctatgggcatgtttctcgacttctctgcagtttcatttctacatttacgaagtagaggtaacagcaagaccacaaagacatagcattgttaggagtatggcacgagctagtttgtatactaccccagtacagtacccagcaaacagaaggagctcaatacatacttctacttttgatgctggaggtgatggtggtgatggtggtggtgatagtggtggtgactgtggtggtgacggtagcgatgatggtgatgatgtgaaaatggtggtggtggtgattgtgaatggtgacggtggtagtagtggtgatgaaggtgatggtggtagtgctggtggtagtgacggtgctgatggtgatgtagtggtgataatggtggtaatggtagtgacggtggtaatgatggtgatggtgatagtgatggtgttgatagtggtgttggtggtgatggccatggtaatggagttgggatagtggtgatggcagtgatggtggatggtagtgttggtgatagtaatggtggtagtgctggtggtgctggtggctctggtggtggtagtgacagtgctgatggtggtagttgcagtggtggtggtggtggtgatgatgtttggtgatgagagtgattctggttagatgcagcgtggtagaatagtttcacacataagtacctggcttcagatttggttcaagtctaccacttaccacctttgcaccgttgggcaaattatttaacctttctttgttttaattgtctcatctgtgagatggggatggtgatattcattgtcattatgaagactaaattatttaatgtttgttaaaatcagaatagcgttcctataaacaaactcttagacatagagaacgtttgttaaataaagtgtcagtgcagaatacagcttttaacaaaaaggtacctagtggcttctggacttctgctatattcttgattttgctttttatagcaggctgaaaaggctgtctttgccttctctcaaccgccagacccaccccccatctctccatgtgttctgcgtagaacaggtgtgtggtgagccgaagttctggcagagcgcaacatgaaaaagactcccagtaattataaaaataacaacgaaggctgcttagcgaggtaggcagatgagcacaccactagccagaatgataaatagcgcctgcaaatgttaggtcccagtgggagtatgggaacatatgggatgaaccacactaaaagttgggcatcattggtaagttttagatggttaaggcaggctaactccagtgccaatttttttcttctttctttgtttttttatcctaattttaaatccttcagttcccttttgtccctttgttctattttggtcctaaaagaagcattcatctttgaggccagccagggaatctccaaggaagtgaggtctgtgccgtaatcctaaaaacaaatggccaccctggagtctgtgaatttccacgttgagctctattcaatattgttgggggagatgtaaatgaatgtggtaaatatttaatggaatgctgacatgttgagtccagacctatgataggtgggcgtgtagaaaaattagtgcctaaccagctcaataagtttacaagcatttgtagaagaggcaaacaattcttgtctgccaaacattatttaaaaagaagacgtggagggtggtaggttgatttcaggtcagtgtttgtatgtctgggtctgaatatagtttggagactgtacaatctgtttggcatggctctgcagcagtgggatttctctggaaggatattttggaattcttgttcaccacccaccatgcttttcctgggcctcagaagagatttcagcatcgaggcgagatttagaatgtgggcacctgagtgttggtgccagctccttagtagatttccagggttccttacttagcaattacatcaacatccttggtcatgtgaagcaggcagaggaaaggaagtaggatttgggatcgggcaggtgtggctttgactgccggccctccctgctcaagttgccatgaatgatgtaaggcctctgagttctaatatcctcatttgtagaatggggctattatgagtaccaataccatggacttgttaaaagactggatgagtcaaagtgttggagtgcttagaattgtgtttggcacatagtgagacctaggaaagggtttgttaaaaaattaagcagaacatatcttctaggactgccttttatgcaagtgtacgtgtatgtatgcattaatctgtttttttgaaagttaccttttcttaaaaaaattaattttattgtaagttgcaggatacatgtgcaggatgtgcaggtttatcacataggtaaacgtgtgccatggtggttgtctgcacccatcaacccatcagctaggtattaagccccatgttcatcagctatttatcctgatgctctcccttcccccaccaccccctacaggccccagtgtgtgttgtttccctccctgtatccatgtgttctcattgttcagctcccacttgtgagtgagaacatggagtgtctggttttctgttcttgtgttagtttactcaggttaatggcttccagctccatccatgtccctgcaaaagacatgatctcatccttttttatggctgcatagtattccatggtgggtatgtaccacattttctttatccagtctatctttgatgggcatttgtgttgattccatgtctttgctattgtgattagtgctgtatgcactaatcttacaaccacttttgtactagtccagaatctattagttttaatggacagctacccaaatcaaacttgcttaagcaaaaatggggatttgttgattcatgaaactgggataattgaaggtcagtcggtagtaagtgaatcatcatttaaacgctcagcactctaattgagatataaacagatgtgattgtaagaaacaccatgaataaagctcaaacacttacaaatgggtgcaagcccaaagaatattttaagtatgtggttatattacttagagcaaccgcacaacaaccctgtaaggggagtgttattgccccaaatttataagggaattaattgaggttcagaaagtttaagtaacttgcccagggaaaaacagccagggattttcagagcccaaatttggacccaaacttcttatggcttcaatagctgagttcctgatcaatatgatacattgctattacgataaaaataagtactttttattagtaaactggagaccagagaaattatctatctatctgtctatctatacgtatacatatacatatacatatacatatacatatacatatacatatacatatacttatacttatattgtttgttttttgagacggcgagatggtgttttgctctgctgcccaggctggagtgcagtggtgcgatctcatctcactgcaacctctggctcctgggttaaagcgattgtcctgcatcagcctcctaagtagctgggattacaggtgtgtgccaccatacccggctaattttttgtgttttttatagagacaggctttcaccatgttggtcaggctgttcttgaactcctgacctcaagtgatacaccctcctcggcctcccaaagtgctgggattacaggtgtgagccaccatacctgtcccagagaaatatgttttcaaaaaacaaacaaacatgaaatacgtggaaaggcagcataacatgggattatgtatggggccagatttacccttcacaagctgtgtgattttgggcaagttacttgaccactctgtgtcttgttttcctcacagtaatatgaagatagtcataggatttaccttataggatagttgtgaagattaagtgagttaatatacaaaggagttagaagatgtttggcaaataataaatggcatatatagtttattttaaaatattttaaaatagattgtcatgtaagagccagaaaggaaatgaggtcactcagagtggttcctcttttgatgtccccagggtgtcccacaaggacactgctaatctggggagttgaaaatcccacctgtcagaggctctctgttgccaccagctgcctggccatgacatcgcagagagaccatcttgcagcagtcagccccttggctaatcctctccaatgagaggttcagctgcacagcttggcacagcttggttctgggtccctcacatctctgtcttgtctgcaaaactaggctgtatagtctctgaaaacacagttttatctgctacctccttttctcctccagtgctgtatttggtgggttcccagtgatggctaatacccattcattggtctgataacatattttttcccctggtctgaagctggagaaaaaagcttcagcagagagaagccatctcctgttctgagatgactgctagttatcggacaagggaatgaaagatgtgttttgcacttcttaagcacagacttgcttttacaatatggggtgccttagcacctgccccatgttgtttgaccttcttgccaccttgaaaacctgccccctgccaagctgtggtgaatgctgactggcaggttcatagcgtcaaagtcacagtgctagtaaacacgtcaacgtgatttcacgtgaaaacagccatccaagctgttaatatgagcccgccttaagggattttgactttgcgcatgcctgcccttagtagaaagtacagcacatcttgctacctacttggaaatctgatggacagtcagaagctcctctggagtcctttggtgaatttcacaagagccatcaactctctacaatgatggggaatatttggggagttacatgcgcagttttctgggatgagggcacaattcagagtggtccaatttcagagtggttcatgcctcaaaaataagattgaggaaccgcagtttcacccttagaagaggctcaatggtatgggaaaaagccaaggagaaatcagcccttgaggtggagatgatgcctcagcttcacaaaaaaagggcaacctaataatctctttatctgtcctcctcctgcgttccttccccttctgttttctcctccagtggttattctttcctggtgttccctggtgattagcccatttccatgtacctctgactttctcttgcttgggaggcatttccccacttcctgaagactcagtggtgggtggtgtaggtcagctcttctccagccatcaaagtcttctcctcctctctctgctctttggatttgtattcctttacctctaaggactgttgggatggttgagattgactaaggggtggagagtaaaggagatgaagaaaccactcagattgagttaaaatgtccaagctaagactgggcacatggctcatgcctgtaatgccaggactttgggaggctgagttgggaggatcacttgatcccaggagtaccagacccgcctggcaacacagcgagacccccatctctgaaaaaaagtttaaaaattgccagacgtgctggtatgcacctgtagtcccaggttttcaggagtctgaggcaggaggattgtttgagcccaggagtcggaggctgcagtgagctatgatcatgccactgccttccagcctgggtgacagagtgagaccctgtctcaataaataaataaaataattttctaaaaacccaggccaccatttctcagagtatattaatccatatcgcattcaaaaaaaagaaagccttcttatagtattgagcacaagggagttttgtagttttgtagcctctcagttcatggggatagctctgtgtttgactaactctacggccttggccaattcacttcccctctcatggtctcagtgttcttgttactaatgtactagatggaacagactctacttcataggaatgaagaggggataaactgagataacagatacaatgaaatgagtactgtgtctggcacatagtaagcattgaataagtggtagtgactctgttagtgatgatgaagaagatgaagatgtaggaggaaggaatgaagaagagaagaagccaaaagcctagcacaggtctgatacataattctcaaaaagcagataatccaatagatagcaaaatgaatgatgagtggatgggtgggtagacggatgggtggatgatgagtgggtggatggatggatggtgtgttggtcatcaaatcagttttggaaagtctggatcaaacaagatccagcagttttttgttttgttttgttttgttttgttttcttctttacaggacttctcaggtgcttttatatgctaatagtcatcatgaattcccaagaggaagacagggcaagctgaatttctccaactcatttgtccgtggtgtcctttttacaatgagccatctgatgagccttctatccatgcaaagtatgccttgcaagatgccagtccagcacacttagcttctaaagagaaaataataggcagaaagctcaggtggttcagccagttcagcaactgaatggaattagtacaaaaatcctcatttaccagtcctggagacctgtgctgttaggagtggcctctgtgtccagctcctgtagggtcctggagcacagaaggcagaagatgtagagagtgcacaaagaaaagtccagcggagtagctgcatcctccccccttctgagaggcctcagggggtatttgtttgcctcaagcaaggtcaacaaattctcaaacccagttgtcattcatccccagacaggtcagaggtcggttcctgaggcattgttgatctcagcagagatgatgtgcagggttgatattcttagatttgctcattcagccagtcagtctggctttcagaggagaatcaggtcaggaagcgcttaatgaaccaagaggagcatggtgctgcctgaaccactggggatttgagtttgtaatgactatcagcaggctcctcacttacaaaacctactggaattttctttgtgcatctccataaccatttttagagatgtggttagtactgctggttagagtaacccagggtcctggattctttaagttacttctgatttaaaggtaccatcttcatcatccctaaaaaccataaattgaacttgatatcctttttactgttttggtttcaaaaattgcattttccatttacagaagccatatacctatcctttgttaattcctgggtcttagttttttgtttgggacatagaagaaggaggtaagctcttcaacaagaaggcacttcacaagttgcatttgttagcacgctttcatttgagcaattagcggttgaagggaggaagagttttgatatccctggcttgatcctccaaccagctgctaattctgttgtcactatgacaactatcaacagccatttactgagtgtttgctatgagcctctgagctaaacactgcagtatactgtacttatttaaatctctggaccactccatgtgttatggctactcgtgatattcttatttcgcagataataaatctgaggcacagagaggttaagtgatgtgcacgggaacacacagctgataactggtaggaactgggcttttaatgtggtctatgtggtttaatgtgagctcttaactactatactatggtgcttgcaacaagggagccaggcatggtaagaagttgccaggaggtgagagaatgtaatgccacaagaataacatatgcttagtacatacttgtcattctcataagaacttcccatggaacggctcatttgcatacactaactgaaagcagtctctaagtggggagatgtgacttctcttctccgggtgtctttttttgctagattagtcctccactgagatttccaatgggggtggttgtaatctggagagaggttggttgatggtctggtgtatcctgtccacagtctatggaagcttttcctatattcccatcttgataatttgatgcggttgtgacttgggtgtcacattgacaacccttttgtagccatcctctccttcactgggaattcatttgttagtccttggtattctaaatattatgtagcatctcagggaatttttcttgcggtccatgctaggtaatgcttttccatgttctcttctcacctacgctggatggagtttgagtgcatgtctggcagtgagtgtcatttctcagttctggttcaagctgataccctagtgtcatcattcttgatgactcagcaggtattacaggcatgtagggaaacctgactcttggtaactgaccaggcacacattctgttgtttaaccttggacaagtcacttggactccctgcgcctctgtctcatcccacaggtaacagatcattctcaaatacttattgagcaactactctgtgcccagtcctgggtgaatggcaggcaaacacagggattgaggaggtggtggaggggatagaatggaagcacacctgtgtgataatgccagctaggcctttaccatcccagggcaaatcactgctgatgtttcagaatctcagccccatagatcacgagtgctgggattggagcaggaggtagtgctgggaagacctggcatatgactgcttgtggaaggatgggatgtatatataagcagttttactggggggataatagaatggaagctcgaacagcaacatctgtatggggtgttggtggggcactgaagacagacagagctgccatgatgagcagagagatgaaaaaacaattttgaatgggtgcattgaaaacattctgaagaatgaattaaaattaactagcactttctggatgccttccaagcaccaggaacacccaccttcagcatgtcatttcactgctgtaatgcatttatgagagggtacaggtgttttgtaccatcttagccctgatgggagtagggctcaaggatgagtatatcgtccttaatcagaaacataaaagggcgacagagcccagatcccccagatccaaacccagcctctccaactttgaaacgcaggcttttcctactgttgtgatgccctcaggtcacttgtgatgaccttggaaacataggtagctctcagtggtctgggggcccctggcagcccctccaccttcctcacactttttcagtcagtcatttctggaaggatttgggaaaacttcatttgctagtggacattttagtcattgggtgagcaagaagaaatggcatacttccttatttgagccaatctgccttctcaaaagtgtgatcactattaaaagagtcatgatatggtgtgggcagtctctgaaccaaacacaatgctgaaatgactttcggacaaaggtgatggtgcacttagttctgtcttgggtggcagggacaactttgcagaagctgtcatggaacatttgacttaggccaacaagattgatctaaaaggaagaaaggaagagaggaaggaagggtatttctgcatagcaggcaagtttaaatggaaaagtggattcacagaggtatttggcaaagataatttgccagtgtggtttgaagaaaagagtgatctgtagaaaaacggaaaatttgtatcggaggatgaatttggacagggtaaagtgaggaatattatgaagggcctcagatgctgtaggaaattttccattacccacttttgtctggaaacaaagtgagtgattgtgtgagtaattacataatctgcacaaatctgtattttgaaataaacattgtcaatatccaaaagataagaaatgtgatgataggatcagggaaacactctgttttatgcattttgttttgttctgttttgatagtcaacaaatggcaactgacagcttctttttagatagctttttagaaagcaaagaatggttgggttgatcctacagtgagctcctgacctgtgggagaggcagctttttcgcagatatgattattggtacaaagaaatgtggctcaacatgcctagatcttccagtgtttcaagagatagcataaatctagattttatatgagatgcccccattaaacaatattacctttttttttttacactgtgcagacaaatcattatcatgatcatcatcatccccttctgtggactggacttggtccccacggctgcaggttgcgatgttgaccgacagaatccatgaggcaggagttggtcttctctagataccccctgtctctcatcttccagacacagccaacacttctgtttcttccttctctttcattgacgtctaaactttgagaggctaccactcagaagggccagtcacttatgttggctctctttgttagtctggtgtcaaactcctgggctcaagtgatcctgctgcctcagcctccagagtggcggagactcaggtgtgcaccactgtgcccagcttatgttagctgttaagatctgggaaaggaggttctgggcgcggtggctcatgcctgtaatcccagcactttgggaggctgcggcaggtagatcatgaggtcaggagttcaagacaatcctggccaacgtggtgaaaccctgtctctactaaaaatacaaaaattaggcaggtgtggtggcggatccctgtaatcccagctactcggcaggctgaagcagaagactagcttgaattcgggtggcagaggttgcagtgagctgagatcatgccattgcactctagcctgggacagagcgagactctgtctcaaaaaaaaaaaaaaaaaaaaaaagaagacctgggaagggagatgcagtatctgacagccagagctaaaatgcctttatctagaacaggaaaagaggagttaatacctaagaaggaaatgtcatcatggaaggtggagatagatggaagaattttttttttttttttttaggtggagggatgagattgaactatcaaagcctggctaagaaaaagcaaaatccttgatggaaatctctggcacagggaaaatgagcagaactggcaccaaggaagcattaggagagagaagaagatagtggggaagcagaaaggaacagcaaaggagcgagtatttgccattgtcttgaagtctgacttcttggataaaatacataccctagattaagggttagcaaaccatgggctgtgagcccaacctggaccattgcctgtttttgtataatcttcgaggtaagaatggtgtttgcatttataactggctggaaactttttttaaaaaaagaataatattttgtgacctgtaaaaatgataggaatttagtaaatacagtattacaggaacatggccacaatccttctttggtgtattgtcaacggatgctttttcacgctacaacagcagaattttgagcagttgcagcagagattgtaagttctgcaacacctaaaatatttattatctgagtgtttacagaaaaacatttaccattccctgcccgtgatgggcagagcagatggcaatacacggctctttatttgacttccgtatgtttcagggatctgcctgtttcttagccactaccagaactgccccactctcctttcaccttgctgtttcttccactatttaaagttcctgcattacaccgtgagcgtaataccacataatagatgttgagtagcccgacatttgccatgaaccatgtgcactgccactggggaatggaaagacacacgacatagtgtcgaccttctagaggaggctccaagaaggaagaatcacagctcagcaatactaggtgcttcccatttgggagagcagaacctatgttaagaaaaagaggttttgtttagtagttgttatttatttacaggctttatgattagtggaaggttttgaacgaggacgaagtcaatacaacttcaaaaacataagtaccgcaatcatacaggacaataatatataaatacaaaatcagaatcagagaatgtatgagtaatggtgatcgcgactggaggtgggagggacagcccttattttcacacaagataaggaagatatttgtaactcaagaacagcaaaaggttattgtatcatggcgttcttaagaagaaaacagaaaatatccccggcacaaggtataactatatatctctatcctgtatgtaatatatctcttatttctatcctactaaaatcagcagattcttttatatataagcatatatacacacagtcacgtgtcccttaacatttggcactgggtatgttctgagaaactggtcaggcaatcttgtactgaatactgtaggtgattgtatctaaacatagaaaaggtacagtaaagtataacattataatataatctgatgtgaccagcatgatatatccaatttgtcatggcctgaaatgccattatatatacagtcatccctcaatatggtgggagattggttccaggacctcccctcagataccaaaatctgcagatgctcagtccctgatataaaatggcctaggatttgcatataacctatgcacatcttcccgtatacatattaaatcgtctttagattacttctgaagcctaatacaatgtaaatgctgtgtaaatcattgttatactctattgtttaggaaataatgacaagaacaaacagtctgtatatgttcagtgcaggtgcagaggttttttttttttttttttttctgttttagatgatctgaggttggttgaatctatggatgtggaaccccagaatatggagagctctgtgtgtgtgtgtgtgtgtgtgtgtgtgtgtgtgtgtttgtgtgtgtgtgtgtagagagagagagagagagagagaaagttacataaatacaatggatcactatcttctctgcagtttccagctacctcttcctcaagtttgcttattgaagcattcttgattaagagtaaggggatatagttacctctcttctatgctcaggaaactaagagtctaaagctgtaaatttgttgcctgaatgatggaattaagtctcctgccttctggtccagtggtctttctattttacaacactaaagagacaatttgatctgacacaggccttacctaagtaagtaagagctctcccctcctgttgattgctaaaggaaagcagacgggagagacacgtccgtctcacagtgatgcttctgtcctccccggtaacttctcagaaatgtggtgttgaaagtcatcgtcaaaagctaaagttagaaacagtatcgggctgttgagtaagaggggtcagtgcgcagctgttatgggagctttttgaattgtacaacgtggccactttgatgcatgagaatcaattacagagaaaccttgtcaagatggccaaaattcagccttaaataattgaattctctgccaaaccctgtccgccgtcgttatctagaaatgcaattatgcagctaaatcaagcaactaaaattagtgtagtgtaaaaacaccttggctatctgaaagtggaggaattgacatttggatttagaaaacgccaatagttggatatgtttggcggtgtttgaagctctctcccagtttcaacaaaatctatatcaagtgtcctgtttagagtgagcagtggaatgtggccagtgaatgtttcattttgaaggtgattttcagtgattcctgggacttgggcattatttgagtggattcacttcatcagaacttcatattattgctttcaaaattgtggaactacacacacccacatgtctttctaataagaagattagaagactgacaatttgattgttatctgagccttcagtctcaggtcaaagccttcaatctgaaaccaaagatgtgtctgtaccaatcatcaggaaaacagggaatacatgataaaagtggctaatagctgccggtactgcacacatcatgttatggttctaggacttcatttaatgataacacagccttttgaagtagggactattattatctcagttttccaaatgagtgaacagggttcagagaggctaagtaacttgttcaagatcacacagctagtgattatactgacacccaagtcagtataattccaattatattaattaatatattaattcaattggaattaattccaattcatgtcatcccctaggaatttatctgctcctatgtaacatatcccaaatgattgcttgggtattttcaaacaccagaaagatttcaaatctgtgcttgaatgtattttttatccatagttttggtgcttgttagctatgccttgaaactctgagaacaagaagacatctcttgttaatgtattgcatattaatatatcacagatgaaagctcaaaataaagaatgtcgttaaaaacacaaaataaaaggcatagaaaatgttattacagactgaaatacagcagtgaaaacagtgttgtggttaggaatcgggctctggaatgtgtttgtagcttcgcactgccttgtacgagctatgtgaccatgagcaaaccatttaactagtatcagccctgtttcccatttgttatatgggactgataatagtactgacttcagagacttgttgtgagaatgaaattacataacacgtgtaaataatttaactctgtctctctgcgtagcacacattgtgcaaatacaagctggctggtagttttatcttatttacaaattgccactttaaatttgaaatcagagagagagcgggaggaaaactagactgaatatcttcttattttttttctatcagtgccaaacgttgcccacattaacctgctggatttgaattttaactcggaggcgataatcacattaatttacatttctcagtttatttttccctaaaaatcccatgtagaccccatcccttgctcttttggccaaattcagtaggatgagcttatatctcatagcctggttccctctgtcacttggtctcttggtctctctctctgtctctctctctctctgagaactaaattaatgaagagtatttggttagtcatgttaggcaagctgttcccaaaatagcaccttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcaggtaattcaaggcctctgccagccagcaacttaactccagagtgctcagagtaataattggaatttttatggttgagaaagcaaacacttttaatacaggaaaaagccctcgcgtagtcagtgagaagacagtaggaaatcaaaaagatggatcaccctaatctagctatcgacatctctcatggctgaataaatggtgtagttgagctatatttgcttgtattgatctgactgctatttaacattcatgtcttagcttcaggaggttgaccacggggcaaaggatttgctctccttctcagctttctgagggactcagtctcccagagcagatcatgagacaaagtaacttatcatgaggtgactcagttaagagctttaacccaggaaatgaaaggagcatgaaatatgcattaattcataggacgcctccacacggattgtctattttcagagaaggctctccccacctgaatttgagtggtggcactgaggcaagaaggaacactctattgatgggtaatttatgaagctcagagattattctaggaatcccttgccagatgtgtacatcttaatgatggcaagaaagtggagggttgatatgtgtgctggttttactttgaagtcttttaattctgtgcagagaggattaatctaccaataaacaattggggacctttttttttccccctcatcataaggttttctttgcaagcaggtattgccttccgcgtttatgtctgaagttctccgttgaaagctaacatctactagcgatagaacccacagatcatagaaatccaaggtggctttttgttgttataattagttttttgagtataatcatccctttgcaataaattctgtatctcctttctacagaaaaggaaaacaaaatatatttaggtacgtcctttcacctttactcctgtgcctccctctgtcccctccagcccctcatagttaaaaactatatgataccctagctcattaattacaatttctgggaaccattctggtcacttttccccctacctcttctgaactttgctgttaccttttgttaagtgtacgaacctgggtgattagagtcatctgggggtgattccaagtcacaacaaaacattctctctttctggatttatggccgttcctctgtttggaagcttttctctgtattacctgttataaacaaatgggtcatctggagaacggtcctttgcagcgtggaacttgttgcgtcttccctggtatacacaggccggtatgataaggttgccatttctgaagtagggctcagtggcaacttagaaagttaacaggcctgttgctgctactggaaacgtggggtgaaggtcggctgttggagctttgtcagaccctctgccgacccatctgataaataattacaggcaaatcgtggccttcactctatgctgattgatgctgaaattgcttttgaaagttctcataagttcctgttatagattaagtgccggtgtaggaaaaataacggcacccactgaaatgggtgaatgtaatcaggtttaatggactccagagcttgttgggaattaaataactatcgatttgttggaatgttgctgtcattacgaaatgccactctggacgtattaccccagtgatagatgagaagatgcaagggccagctgagaaattggggaggccctatttcttcctcctttgcagagcatttgagaaacatagccagttatttttggaaagaacaagtggtcttacttgtaaatcttagcctgatcatactgtgtttttccaagcgacacctctggtaactagttacccataagttaggagagcagtttagtgaggagcctctagaccagctgctgtgatatgtgttatctcctttctttctcactgctgtggaatgcactggaaagctaacacacagagagaaactggctttacttatggtttgctgagacagcccatgttatttaccctttggcatcaagtagctaaaatcaccccagtgcagtaatatttgcaaggggagaaagggcagtgcaaagggagaaaaaactgtatcactcacagatgctcagctctgagccgatgtttctgctgccagctgtcctgcattgctgcagactccacttgctcactagtttcttgaccttatgggtttcttcctcactcaggaggcaaagtatttcctctagggaattaaggttctatcaccacctaaatatgtcattggcaagatgttaaaatgagccaaaataaaccatgtgtactccatcactgggagtaatttctctgtgactggagatgttgaaacagagttcatagtgtccacttggaaggattgttgtattatagttggagattacttttcaaggtctttccaacctcaagagattttgtggcagagtgctcccttttcatattttcaagagtcattttgaaaattcagaccagcatcgccctgttttagttgcctcagataaagaaaaaaaaaaaaaaaaaaaaaaaaaccaagtgatttaccagtcatttggtgtgccagactttaagacggcatccacctaatcctgcaaaggcagtggatggaggtatttactgatagcttcaggaaagttactcatacaggatcttttattccaagcaataattgatagttatcatctgccctacccttcctcctttaggaaaatcagaatctttatcatattggatctcctgaacccattattttatgtctacacttgttgtgtgtagccaaatagagagtttttccctccagccaggtagagaatgacagaatgactatggagaattcagctgaacctgtctggactgtctcatgtgcagaaaaagcagagaggaaaggataagagtagtattcccaagtgcattgtacaaatattggctgctttcccccttgatagagatcccgatgttgatatctttggataagaagaaccaatgtactacttaacactacttatttctgaatttctagtgatgccttgaatgatcagtgaattgtctgacctggtaacacaggagcctcagtcacttgcccaagtcagcctcgagtccagaagctactcagaggtcttagccaagccatggaccatggccaaatgacataaccaaaacaacagctttgtaactggttaggctatttggttagtgtttgggtctaatgtgttggctctgggctgcaagtgtggaccctcacccctcaatctaggtatctacctcatagatatgcccttgggccatacatggccaagtcactttcactattggacaaatcgttcccatttcatccaggtctgacagatgatgagtcagcagattattttcctggatggttgatggtgtaaatagagccatattcacctcatcatgcatttgttccttcagttatccattcactgtatactcaacctataacaaaagtgacagtcatagccactgaactgtgggttcacaatctagtggaagaactagtaggtaaaccccaactataagactataatgaagtcagagggaggaaatgataggtaatgattgttgaacacaatattgtcatgtgccaggctctgtgctaaacacttagatttaggatctcaatttatttttataataaacgtaatgcaattgggcagtatttgtccaccttcctatatctgtaattgtaaattccaaaaagctctgaaaatcaatttcttttggaagttgggcaccaaagctcatttaggaacagaaacttgacctgaaatgatgtgtagctatttatagactttctttatcccagctaatgtaaatattcatgtattttgctgtaggaatatttatgtgtttgattttcagggtgttgtcctagaccctgctgagggctttacataatcagcatttccactgaaataactttctgaaaaagcccccaaaatctgattttcaaaatgctggtgactccaacgggtcttaggtaagaaattgcagtcatgcctttaattcccctttgcctatggagaacctaaaacctacacttagacaaagctaggtagcccaaggtcacaaagaatgcgagtggtatagctgggatttggactggatttgttgaaccagggtcttttatccaccaagctaccctctaggttgaggtattcaggcagggtggcttatgaaaacacaggaaaggaagtaacccagtgcctcttagagtcgggaagagggtggtttcaaaggaagggaactggtatttgagttgggc[450 bp omitted]agtaactgggattacaggcacgtgccaccacacccagctaatttttatatttttagtagagacagggtttcaccatgttggttaggctcatcttgaactcttgacctcatgatctgcccgccttggcctcccagagtactgggattacaggcatgagccaccatgcccagcctagggctggtgaatgtttaattttctgggtttgtgcatcatttaccattcctttctcttttaaagtattattttatttttgtaagttccagggtacatgtgcagggtgtgcaggtttgttacataggtaaaggagtgccatggttgtttgctgcacctattaacccatcaccgatgtatttagcccagggtgcattaactgttttccctaatgctctccccacccccacctaagcatggcaattatcatttaccgtttctatgccttcttttctctctgagatggtaagctctcagagggctgagatttttccagcctaaactttctatagctagacagtggcagaaaaatgccaatgtatgcctctctgacgtggatagcaatggtttaaagaaaccctatactccatgtttttatttttatttcttttagagaaagggtctcactctgtcactcagactggagtgcagtggtgcaatcatagctcactgtagcctcgaactcctggtctcaagtaatcctcagcctcctgagtagctggaactacagacatgtaccactatgctcagcttttttaaaaaaaattcttttgtagagatgaggtctcattatgttggccagcctggtctcaaactcctggtctcagacacacacactgtattttgaagcagaaaccagcgtatgtattttatgagacatctacatacctatatgtagtaacaatgcaaattatagaaacatcggccttaacaatggacagagagtaaccatccttatagaaagataaagaaatctataaagaacttacaagtaatttgggtaagtttctggttgaacttgaaaaacaacagcttgtttggctctgtggctggcatttcaggtcttgatattgctgccctgcgattttatctccatgtttggaatgtctgttgattgggaaagacatcagcatgcacacctgatataaatgctggtggcgtcatttactctgaggctgctccatcttagtcactaagcggacttttctgtactgccaaagaggccatgtcaacagcggactaaattaaagagtcagggaggtggcagagagaatttggagtcaaacaggtccaggttgatatataggctctggcatttactaagcctgtggcctgaggcttgtcaattaacctcaccaagcctcagttttctaggctgcaaaacaaaagcaggaaggcctagcttgcaaagtcactgtgagttttcagtgtgattcatcatgtgtttattcagcaattatctattgagcacctactgtgtgccaggctgtgaactaggactaggtgatgtggtagaatagaacacactctagatctcttccaacaggaagttgatattctaacacatgggaaaagctagcatataaagtatgtttattctgtattattctggagagagaaggagagaggaaagatatttatgtattattattattttgtgacggaatcttgctctgtagcccaggctgtagtgcagtggcatgatctcagctcactgcacctccacctgccaagttcaagtgattctcctgcttcagcctcctgagtatctgggaccgtgggcatgcaccaccacaaccagcttatttttgtatttttagtaaagacagggtttcaccatgttggctgggctggtcttgaactcctgacctcaggtgatccgcccacttcagcctcccaaaatgctgggattacaggtgcaagccactgtgcctggccagaaagatatttgttaagaattcttttgtctgcgatgaagaaaattctaagtcctattggttaaagggggaaaaaaagcatctagctccagcttcaggcactattgaattcaggaattttgacaagccaagggctgtcactctccacctctccacagtggttatctctacttgatcctcactcacaagcacaccatgtccaagtggtggaaaagatggttcttggcaactccaagcttacatctcatctccttttagaaattctcttcccaactattccagcaagaattccagattgcagtctcattggtagatcttatagtccatgcacatctccaaatcaatcatctaatctctggttgcccactttagagccagagggcagggtcagccccaagaaagctgcatagactatgaacggaggccagatcagggacctcttaccaaaatgtgttggtggataagcaaaatctaggttcttgttatcaacaacaattatagttaaagctgtcacagacattcaaacctgtgctttctcccccataactttgcacacaccatcccctggggagcaagtggtgggtttcagatcttaattatcctgatcacttgttgccattgatcatatttactaggtagttttattgccttccacttcacttggcttctccattcatgatcagatttgccaaaggcagggatggctgttttacctggtatcttctccgttgcactaattacagtcatgtcttccactcgtgtatttgggatattccaactctttttacagactagtaagtcacaacctagggaagtcaagacagtccaaccaggacatccaacaacacaataatcagtgcaagattgtgtttctcagattcatgatccatgcagccacaccacttctcttcacatcagtgatgcataaataaatatattaaaaagagcaaacagagccttccagttattaactttgtcatgacgtagacctcccatcattccaaagcactcgaagatgctagtgacttgtcctattctgttttatataaattcacttttttaaattaagagattaaagggacactgtcaatctcttctgattaatatcagtcctataaaaagggtgtcttgctgcagcagccatctgtcattttgatcattttaaaggcatgctatatcagcaactatgctttttataatacgttggcacagggcagggagggttggaagacctacggatttcacactctctgctgctgctttggtgttcggcaatgtgagcttttgatggtggagcagagtcccctccctgtcttttaaaggttgttttgggtaagtgcttttcctgggtgatttatgatggagatactcacccctatttatgtttttcccccgtctaaagatagacctctcacacacacatcccaccagcttgcaaggagccagcatgttcacttgattcactgctgagccctaagagatgcccagaaacattgaactcaatactctgaaggtcttttcctctgagcaaccgagaccattatcttcagcaatggtcactgtctagattgagcttttcaggcttgtaaaactaggaggcaaaggctccatgaaactcattcatttattaagataatgatttatcaatcatagatttcgtgactgttgtcttgcaagctctggaggtattgggatgatcaagtcccagtctccgtcctcagaggttgcgtaggggggccatgccattcgcagtagagtcagaggttaagcacaactgtttgaagatagaactcttgagtctccaccccactgaccgactcagtatgacgtcttcattgctgtcagtggtctgacactcaagacaggtttatgcacagtccaaagaagatggcttcctacagagagatactccaaatgacagagttcctgctacatttcagagaacaatggtcctaccttccttccttccttccttccttccctccctccctccctccttccctccctccctccctccttccctccttccctccctccctccttccttccttccttccttccttccttccttccttccttccttccttcctttttgaggtgggaagatgacagcaggagctcctgcccccggcccccttcccaccttgcatccaacttagactaaagtaatagagttcaacacacccactgctgtgggagaaggtgttgcttggccattccttctcttctgctctttaatctgtattggctcctggaggaggggagaattgcagtgaggagggggatcacttgttcattccacattgttctcaggaactgctctctgaagacctatttcttcttatttcctgaggcagcacagttaaatttgaaaagaacaggatttacaacaaggaaacctgagtctggccattactctctctgtgttactcttggtaagttgcttgacctctctgaacctccacttcctcatctgtaaaatgggagtaataccaagtgtactctactcacaaggcctttgcagtgtagtcatggtgtcattagggcagcaagacaggatgcctagggctgggcttccaactcagatcttcccactcagacgcatctgagttggcatcctggctcctgtgtgatgcggggcttcagctctctgagcacccatggtttcaacctgtctgcggggatggtcacatcgactgcagaagggagcaatccgatttgacaatcagctcattgtaccaacgccacaactgattgccagcagtgttgtcttggtttgttcatgatttctggagttattgaatgttcattttgataaatcgagatgctctaggttgggaaaggagaatgtttacacttctctgctcccattcttggtggagattcctggtgagcaaggacacatgtgtttggcctgcgtggacagtgcagagatacaactggggaggtggcgaaggagagggagagatgccaccatggagtttgacatcttggctcatggctctgggtggtgtgaaaccaccatcctctttccacatggctggtataaaagccaccatcctcttcccactccctaagccaatagcctgcatagttggaatgactaagtcccagcctctgtcctcagaggttgcatcagggggccatgtcattctcagtagagtcggaagttaattacaagaaacacgtgaaggagagttgatcagtttcaataatgttgaatccttgcccaaatctttgtccagaacatgctgggactggaactggagctgggttgcaggacggggagggtggactttgtagggggaagagaggcctgtcccctccgttccatgtggccatagccttctggggacagactctttaggaccacccacacccctgttccatgcagctctggcacaccgtgggcgcttaataaatgttaaataataagaatagctcccatctgtcagtgcccggtggcaaggaggatgtgtgagtgccagccgtcactgggcagcttatgggaagcctttcggggggaaattgtagctctgagtcgcttcgaagtcccgctgcatccagatgttcccccaaagctgctatggatcagtgtccaggcaagggaggagcatgggactccagaacatctgcatcagagtgacagggggcgggaccagagagatgagaatctgaccagcagtgggatttgggagctggtattgaccaacagtacaagggctttgttgaggtttaaaagggctagaggagctgccctctgagcacacagcagcataaattcatacttccgtcatattcttggaagcaaatgccaactgggacttttcagattttgttataataacaacagcagctgctgtttttaggcatttactatatatgaggctgtgtgtgaggggtttcacttgtcgtacctaattgaagtaatatatcttagggaggaaaaaacaggcaaacaggaggtggtatggagtagggtgtgagctctagagcagactgcctggttcatctgctgcaaccattgaggcctccacctctgggaccttggatgccatttgctacctgtgtgaccttggcacagtttttcccttctgggcagtagtcaccctctttgagtggttgttaaaggaaccaaatcatgtaaagtccacaatatagcacctggcacatagaaagtcctcaataaatgtatttacaagtttatttccaagcgtaaagcaataccaccacaaccaacaccaatgcaattaaataatagcctcaatcttgagtgttttctatatagggaagccaataccttctactggctaagagtatgagcccttgagccagactgcctgggttagaatctcagctttactttttttttttttttttttttttttaactcctaagctactctgaactgcagttttctcttcggtaaaatggcccatattaaaagtgcctaaattcaagcttcgctgtactcttctgtaggacagggataataccaaagtcatttctgaggatcaaatcaattaatactccctaagtacttaaaatagtaaatccaatatagtcagggctaaaaaaaactgatagaaataataattgttacatgattattttatattttatattatttgtattatgcattattcataagatataatgcaatatatatttcaataatatatgcaataatatgtattttatgtaacacatagttataaatatataaatatataactacataatgccatatagttataggataattatatataatgattagatgacacatatcattgtgtaatactgtataatagttacatagtaatgattatatgtaatataaatgataataataattattatttctactcttgctactatgacaagttactccattggggattttttcctaaataatttctaccactttgaagcattctggccagacttattttaaaaggaaactgaggctcagcaaagtggaacaatttgccctcattcttaggactggggaagggcagaccagccaggtgtctggctgcagagcccgtcctcccgcagaccacacaattctgcaaagctttggtgtctgtcgtctccccatcctccatggggaaatggccatgtctcttgcccgtacaaccgactctgagcagaaggctaatgcgatattgtgccgctgtcatttctgatcagtttttcccccactgtctcacagcgggctgtcaggaggccttgttccccatggaagcctggctcctcgtggagaagatcaaacctggaggttgtgtggtgacaaaggctgaggaagggcactgctgggactgggtcttgtggctctattttcaagacctttatttttggttatcagtgttgaaacctggaaatacactttctgttttccgtttaaacacaaatcaagcaacgttaccaacacacattctctgtcaaacatgtcagttactcccggggctgtggacagcttgcaagcgatgtcttctattgttactgtggtggtgtgttatttctccctctacagctctgcatttgttttggcgagcagtgtaaacactgaggggcctgctctcggggaggttttgacagaacatgtgaaattgacatggaccgtccgatgaccatcttaataaggctgttcgggcagccctgtatttgcctgtagcattttccatgaattttggtgggggcttaaggattctaatgagctgggttttgtttcacacctggtgttttggcagacagttcccactgtgacttagcagagggacttggcacggcttgccagagggcctaagatttgtgtgggcgcccagcagatgttggatgtgttcacccatcatacagaacgccagtcatcagccgccgagtcccctctctgtctacattgtaagggaccagagctcccacttgctgccggtgatggagccgtctggggatggataaaaagcctttcattactgaggataatgcagagcatatgggattcttatctgtccaaacagttgtgggatttgggttagagacgccgtctgcatgtgtattttctttttctttttttaattttaattttttgtttttatttttattatactttaagttctagggtacatgtgcacaacgtgcaggtttgttacatacatatacatgtgccatgttggtgtgctgcacccattaactcgtcatttacattaggtatatctcctaatgctatccctcccagctcctccaaccccacaacaggccccggtgtgtgatgttccccttcctgtgtccaagtgttctcattgttcaattcccacctgtgagtgagaacatgcggtgtttggttttttgtccttgcgatagtttgctgagaatgatggtttctagcttcatccgtgtccctacaaaggacatgaactcatccttttttatggatgcatagtattccatggtgtatatgtgcgacattttcttaatccagtctgtcattgatggacatttggtttggttccaagcaatgcccctgggccacatgggacacacacaccatgatgtgtcagcaacgagacgtctatagagtaaaccacgatggcagaggagcattctacccaagagggcagtgtattttctttagtatttggttctagcaagtaggagcttcattaaggagcattttgtacagttccttcctgggaatggacacgacacgcgtttgataatgtctctgctttctggcttcacaccttcctcccatgttagcattggttctaaactcccaagcacagatgttaccaagccactgccctcctgtgtagaatgctcctctgccatcctggtttactctatagaagtctcgttgctgacacatcatggtgtgtgtcccatgtggcccacgggcattgcttcgttcaagcctttgtgttcagatctgccctgttatcagagacaagttgatgtcaacttacctcttatctctgatcaataactgttgggcttcctgtgggttgactgaagacccataagattcatgagacccatacgatcatgtgggttgatgatctccaccattctgaatctcaagaaaccaaagatgattcttgaatgtgtgtttttgttaagatccctttggctgaaggaacagaactcaatcctgtctagcttcaaaaaaaacgagaggggcagcatttatatgtttactgtgttttgaggtgtagtgcatgaacaattgaatgcacagaaactcttggactcaaaagagaaagaaaaaagtcaagccaaggaaagcacaagaggtaagacaggcctagtgatctcagcaggcagaatttatggacatattttgcaggcaagtggttctcaatcaggggtgatttttggcttgtaaggacatttagcaatatctggacacattttttggttgtcgtaagtggatgggggttgctgctatcatcctacaatgcataggtgcattagtctgttttcatgctgctgataaagacataccggagactgggcaatttgcaaatgagagaggcttattgggcttacagttccaggtggctggggagccctcacaatcatgttggaaggtaaaagacatgtttcacatggatgacagcaggcaaagagagctcgtgcagggaaactcttgtttttaaaatcatcaggtttcatgagacttgttcattatcaggagaacagcacaggaaagacccgccccccaaattcagtcatttcccaccaggttcctgtcatgacacgtgggaatcgtgggagatacaattcaagatgagacttgggtgaggacacagccaaacgatatcaagtggacacctggaattatcgagcattatccagaattatcagtcacgccgagattgaaaaaccccactctaggctgtcacactactgtgactcagctacagagactatcagtctctgcaagtcttcattcaacttttgctttctcagctaggatctgatggacccaacctatcgtatgtctcaatctttatatcagtgaactatgcccgagacccccatgtatttgcagcccgttcaaagtattgctgagtagtcctgggaaagcaggagtaggatgtagctggttgtgagctgttagccattccgagacaggcgtcttgcagggtgtattgatagccttcagtgcaccctatcctgtggctgacactcattcatgctagtgccttccatgcagagctgtctgtttgtagaaagcaaggcccaccttggtgccagtcttaacgagcagtcaattgatttggttttcgatttaagctcgttgcctcctttgacttctgtttaacagaaaattcactttgcaaaactgttttaaaacattgttgcttacttttcttaccataaaattaatgtgggctaaacctaagttttcagaaacaaaaagcacaaacaaacatacagagatatatgcatataccacatagatacataaaccacaatccgctacccaaaaatgcctactacaaaccactctttatgtatcctggatttctttgtggtacatatattttcttccctaaataattcttatctactctcatcgtattcacaaagatttgtaaaacttgcaagcagctgggtttttaataggaacaccttttgaaataaaattaatgaattttttttttttacctcatgaatattttctgttaggtttttaagactaaggtgatgtcttaaacaaacacatattccgtgtcctttccacatgcccctttgctcttatccctctccttcagcccatggcaaggtcgtatatgatatcctaagtaaatagatcaccaaagaaatgacattactttagtcagttgggaaaagaagatagggacaaagaagagaaagtagcaaaacaatcctatagattacagaattacacaaaaggccggttgccgtggctcacgcctagaatcccagcactttgggaggctgaggatggcagatcacctgaggtcaggagttcaagaccaccctggccaacatgatgaaacttcatctctactaaaaatgccaaaattagccaggggtggtggcacgtgcttgtaatcccagccccttgggaggctcaggcaggagaatcccttgaacccaggaggcggaggtttcagtgagccaagattacgccactgcactccagcctgggtgacacagcgagactccacctcaaagaaaaaaagaatgaagagagaggcagagattgatcggctccagtcaaccgggtgagtaggaggcttctgctttcagattttcttgtaaatttcttgaaatggggacattgaaaaatgtgctagttttggagaaaataaaaatttcatgaccacgatggaggtgtggttgctcctatggttctcagaacacaaaaccatctcctagagacccactgaagttcatgctcattttaggactaaaacttgggttaaaaatcaggcggctcaagagatcaagatatcttcctggcagccttctatcacaagtggagactgggagaccaaccagacttgccttgtcagctctcatcactccttctctcaaaccaaacgcatgtctaaggcgcaagatcggttttcaatttaagtgacttcgctttctctcttaaaaactaaatcctcctcctaattcccctaagtcctcaaagtataacatttttcctttgtagattggagaaagaagtcatggatcgggcttgccaatggcattaggatgaggtctgccagccagtccttgtcagaatgtgcacagaaaatttaaaagacttttttttttccaatcagtagcttaccagttaatactcctccctttccgttttgatagctgaccctcagaatcaaaatgaggatggcgacataccacatccgcttgagaggctgaggagggttgggttcagaaagacggatggctgtggcttgctttccatatgtgttcaccgatttagtaaatatttattcaacattcagtgtgtgctagacaatacagttccaggtgtgagtaagaccacttatatcctattaacaggaaaaaataaagcagaaaataaccaggagaatatcagatgctgttagctgctaggaaggaaataaaataggttatgggccaggcacggtggctcatgcttgtaatcccaacactttgggaggccgaggtgggtggatcacttgaggtcaggagttcgagaccagcctgggcaacatggtgaaacctcatttctactgaaacatacaaaaattagctggcatgatggcgcatgcctgtagtttcagttccttgggtggctgaggtgggagaatcacttgaacttgggaggcagaggttgcagtgagccgagatcaggccactgtactccagcttgggcgacagagccaaattccatctaaaaaatttaaaaaaaaaatggttacatggtagtgactgaaagggttattttagatagttgaaacaggaattagagctcagatctgattgacaagtaggtgccagctgtgtacagtcgtggggtatgggaaagaggtctaaggggaggaaaaaagcaaaagtcctgagatggaatgaaatgggtatgtttgagaaatgaccggatggtcagtatggctgtgacacagtgggtaaagagggaggatgaaaaacacaaagtcaggtgtgcaatcagcagccaggtcccattccaccttgtagggcattgcaggcagtttagattttgatctaggggaaatggcaaacccctgcagaatttcaagtaggagaacactatgatctgattgtatcatgttaaaagattcctctggaaagtgggaggaggatggacaaataatctttagtgggacaagatgcaaaacagacaggacagctagtatgcatggtactggtgaagacgaccagtaccatgttatccacgattggctagtgaatatccatatttcatgctgccatttctttgatcttcattgaccggagaattctgccctaaaaagagggcccgtttcagggatgtggggtaacagaaaaatcacagtgttaatggaatgagaggtagaggaccagggagtatagaaatgtatctgtgtctgtgcctgaaggtctggtattttgtgtggcttcaggggactgtagtatgtgtgtttaattgttaatgacccaagaatgcatccaaaggggttacatgcaaacctgcctgagcatggaagatcagtcttgagtgctttattaagtctggctctatcaaagctgtaagcaacatatggtgtgccatgtgcccatggactaggttttccatcacaggacagttctgtcttcgggatggctggttttccttttattttagcagaagtagagaaggccccttgggactggatctctcacttttgcaagttatgaccacaggggacaacttgggagtttggattcagatggaccgaggttccagagccagcctcactcactgttagctgtgatcttgaacaggttcttttacctctctgagcctcagttcattcgtacctaaaatagagggaaacttttctatgtcaaagggtagtagaaaggttattacgcattgactggttagttcattcctttgataattctttagacatgtattaatcaccactacgtgcaaggcacgatggcaaacattaggaacgcaatgaagtcagctttgattctttttttagtggaatttatgttcttgtaggggaaggagacaaaacaaagaataactaccataatgtatatataaactgattaattttagattgaagtgagtgctatgaagaaaataatgtaagagggaagaaacagttaatgatggtgcggtggatcatgatactctgctcttgagctcacatcctttattgtcttgaaatttttcacccattagctcacttgttctctttttttcgcttcctgggtttgccttagagacacctggtactttactctcccatgccctaaatacccatgtccacagggagcagctgacttactgtggtacaaggaatgtgcttttccagattttaggagccacctgtttctgggagtgccatggaaacacacattctgcctctcaatcttcaggcccaggcaggaaattttcagctgtcagcagctgtctttctgatctgctgccaaggagtttccaaccccaaccccaggaaaagcccacagtgaccctcaccagggactttgatgccattttttggagctgaaaaggaaggaggggctcctgcagagtgattcgtgggctcagttcttgacttggggtggctgagagtttccccttaaataatatgtcacgctgtaggcatatggtcttgcaattgcggggtgtatcatttccacttgattgtcaaagcaccccacggcagaaacatactaaaggatctctgctccagatacagccatggctttgcagcatggcagatttgcagctttgaggtggaaaacatttttcagcctttcccaagaggtgaactggatacagctgtgcagtgtaacctaaatctttgcacgtgtctttaaacagggcagaaacaactggccctgtccttccactctgggcctgatgatgaccaagtcggagagaactgaagctatatatcctgttctcagaagttgaatttccccatcttggacagagtagtgtgctgttgtgggaatgcgtagctattgccttactcaggtgaatgtcatctgaagacgtggggtgggtaagaatctgtcaccactaaacgcttactccgggctgcccatcactgctgtttggtcagtccttttgttctagggccctttgcagccattctccaggaagagtcatcctggccttgccttcagaaacaagctcgctatatttcccatgtagttctagaaagaatcctggtgcagggattctgaaggatgcactcttgtcctggatctgcccctcaatgtctgtgtattaatgagcaaattattattattattattttgagacagggtctcactctgtcaccaaagctggagtgcagtggtgcgatcatggctcactgcagcttcgacctcttgggttcaggtgatcctcccacctcaacctcccaagtagctgggactacaggagcatgccaccatgaccagctaatttttgtattttttgtagagatgaaatttcaccatgttgcctacgctggtatcgaactgctaggcttcagtgatctgcttggcttggcctcccaaagtgctgagactgcaagtatgagccactgcacccagcccataccacttttccatatggcttcaggttacaggtttgtgcatgagttacatagtggaaccctaaagccatacctttgaccagttgtctaaagtttttagcaccactactactgtatagctaatattttctttgaatggattcaatttttgtagcctaaattgattcacaaaaaccatacttttcgtctctaatttaactggacattcaccatcactagccataaataaatggtacctattacaaatgcattgatgaccctagctagaatggctataataaaaaagatagacagcaagaagtgtcagcaaagatgcggagaaattggaatgcacatacattgctggcaggaatgtaaaattccgcagctacttagaaaaatagttgagtatttttcttaaaaaaattactcagttattatgacccagcaattctgctcctaggtatatattcaagataattaaaaacatatgtgtacacaaaaacgtgtgtaccagtgtttataatagcattattcatagtaaccaaagcatggaaacaggctaaatgttcatcaactaagaaatggataaacacgagatgatatagcatacaatgggatatgttcaggtataaaatgaaatgatgtcttacatgctgtagtgtggatgaaccttgagaatgttgtactaagtgagtgaagtcagatacaaaggactacatattgtatgattcgatttatatgaaatgttcagcataagcaaacctatagtagcttaaagtagattaatgattgctaagggctgaggggagagagtatgggaagcgatccttttatggatatggattttctttttgaggtgatgaaaatgttctggaattatctggaatgttctagaattgtacaactatcaccactttcatacacagttgtacagttttgtgaatatgttaaataacacagaattgtatattttattttattttatttttttggagacagactcttgctctgtcactcaggctggagtgcagtggcatgatctgggctcgctgcaacctctacctcccaggttcaagcgattctcctgcctcagcctcctgagtatctgggattacaggatctgccaccacgcccagctaatttttgtagttttagtagagaaagggtttcatcacattggtcagactggtctcaaactcctgacgtcaggtgatctgcccacctcggcctcccacactgctgcgattacaggtgtgagccaccatgcttggcccgaattgtatattttaaagtgtgaactttgtggaatatgaattattatttcaaaaaatatgttgaaaacaaagcaatgtcatcaaattctttctattacctgtgtttgttgaaggtgtttgctgtattcaaggcctgttttccctcaggaaataaaacagaggttggaaagtattaaagaggtgttgttaaacacggcctagcaccagctgagactgtccttcaagcagccagaaaaactgaatgagcttggaaaaaaaactacttcctaaaaccttctaaactcagcttttcaaaggccaccaatgtgaaatgcttaggatttcattcaatttaagcactattaccgtgcccaatttttgttagctgtgtttatgaggaaagaattaggatattttagctggggaagatagcactctctggaaacatactgtgcgatatgacggccactagtcacgtgtctctatttaaatttaattaaaattcagtagccctcaaaactgtgccattgacattttcagtgcctaggagctacatgtggtttgtgttggttgtactagacagtatgatataggacattcattttattgctaaaagttctgctggacagctctatgctaaaagattaaattaattgtattgctatcttgtggtctctttgctctgctttccctcatttaagcaaattcgaatgctgaaacatgacaaataatgattataataataaaaattaatagttaacgtttgtacttgccctgtaccagacagtgtgctaagcatttaacgcatgaggtcttagttaatcctcccaaaactctaacaggtagctaccgctatcacccaagctttgaatgtgagaaaactgagcatcagagatgtcaattgctgaagtcccagggcattgggaggcctggatttgaatccccatcagttggctttgtgctcctcgtccttctaacctctactttttccacaaatcccatcccaggcctcagccagcaactcagagtccctctgtcaaggtctctgagaaattttacttgtcacgttttatcatgaccgtattttctcaggacagtttcaagaaataagtcagaaagcagagtaaagtttgtggctctgcctactgccccctttctcctgtcctacctcccacccagagacaatacctgctaacgatttggagtgtgagtccgaaaccctcccatacttttcctatgtaattacatgcataggtatgtgtacaaggacaccatgcacgtgtgttaagcaagtgggatctcatcacccacatgattttgctcattgcttttatttatctaacagcatgttttggccatctccccatgtcagtctgtacaggtccactctatcattctatattgtgacggcacacaattctataaacagtaataccatgatttatttgcccttcagcaaatggctttgccaattcttacacacaaaaaagggtatgatggaccagtttcttgcatctgtgctcaaactggacatcatcaatcttttaagtttttgccaatctgttgggtgataatttcttttcctttcaaccttcagggtcatttgcagctccctccacctgctctgcccaggcttctagctgctgacagccaaaggcaatctgccggaggcaaaatgaggtcaaggccaaaaaccatattttctttcagtgagagagggcatttacttgggtaaatacggcccatgcactgtgctttattggtttgaaaaatgaagaagcaagctccaacgagttctctctaatggggctgcatgtctccaatacctggtgctccaatgcattgattgacgcattgtcatcacttataaggtcagtatgttcatccaatcctttattcatcacgtaactatcaggcattgattccatgctaggcagagttctaggcactgagaatacagcactgaatagtgagtcaagacccctgttttacgggacttagattctaatgggcaggatggaggcccacacaggcatcatcgttatagatctaagcaacaaaagactgaaatgagaggtatgccccaagacacagagggcccatcacagagaggacagtcaggtaaggcctctctgagcatgcacactaaagaaaagaactgaaagcaagaaggagcatcccactgagaagaaagtgactggagagtgttcaaaagaagccaggatggccagggccttgtgatggaggaggagcctggcaggaaatgatgtcgggtggtaggtggggggccgattgaggcagggccctgcacagcatgataatgagtttggatttttatagaggtgcagtaagaagccactggaaagttttaagcagggcagcagcagaatttggtttattcggtaagctttacgttaagggcatttgaagttctgaagtgcatgaatactttgctttttaaataagacaaatacgttaaagaagtgttaacagttttcttaaaacagggacactctcacatggcttctgcagtgccttttccagtgatggaaggaagggtttggagccaggtttagtggacttactattatgcgtagtctttcgtcttcagtatctgggtcacagcttataaccaaagcatggcaagaacctccagcaaggttgatgcaggggaaagaagattgagatcaagtcttgttgcctctagtttctgttctttgtgtgaatgctgagggcccctctgtgcttggccatttcacaccagcagaaagcttttgggctcaggaatccagggatctatctgccttggaacattctgcatcaaggtaaaccagtttggtccagtagtgtcatgaccagagatgggagaagaaactgtgtgctcgaggtgctggggctagcatgtaggaacacaaggattttgaattctgcaagcatacacgcagttttgaaatcatcctgataagagtcggcaggagaaatggaaaaaaaaaaaaaaatctcttggatggaggatatcagtcctgtgggtaagaaggttcttggttatcatcattatactcccatttttcactacaaaaacatttttagagaaactgatgatgaaaacaaaagattccaatgaatcagaagcattgattaagcttaacagagagcagagtggtggtgaggtgcatgaattgcagtggaaccatccaggttttttccactttctttggcctcacctttttgccctacaactgtcctgcttactgctgtttgaagaaatgaaatccaaccacctccacctcttttcatacttacccatcttgttttgctgcatacattttgagccctatatgtgcatttcacccatcttcctggactctgaactgagccttgtttctgagccattttcagtctcttgcgcaggacttttattcagtctcggttgcaatgtcagttttcttgccctgcccatgctcagaggagaccaggctagtggaggtgcttcctgtgaccaagtggtgctttaactctttattttaaataattttggagcattcagcattgctccttctccccttccttactttgttactctcctctaaggcttcttttccattcatggaagatatttcttcagtctagttttggttcctctttaatttttttcctctctgagggaaggagttgctgttttttactttttactgtctctgtcttaatagggagggttactttcatctgcctgagaatcacgttatcttccatgtgggctaatgactagtgcagcctgagacctgagctcgaaccagccttgtagaagcagaacagtgaataggctgatcttcgataggtaatttacaagacttccacttcttactgattaactttcataactcactccagaaaataaattgtgtatctgttatcatcctattggatatgcagaagctgtcctgagagggttgataaacctttgaaagaatacataaccaagtcagcctctgctgcaaataaaccgtgacagagaaagagggtggccgtgccaccgaaagggacaggtgacagtggcatcagagcaaataatttgcaaattgtttaataaataatgataaatctctaagcagctcctgcattttattcaaggaaaattaagacttaagtatttttgtgttttttgttttttgttttttgtttttttttgaggtggagttttgttctgtcgcccaggctggagtgcagcggcgcgatctcagctcactgcaacctccacctcccgggttcaagcaattctcttgcctcagcctccctagcagctggaattacaggagtctgccatcatgctagctaatttttgtattttttgtagagacagggtttcaccatgttggccaagctggtctcaaactcctggcctcaggtgatccacccacctcggcctcccaaagtgctgggattacaagcgtgaaccactgcgcccagtctcttaagtactttttatatgaataaagtagtcacaggtggtaggtggtacagcaatgtttgtatgacaaagcccagaaagtagcagagagaaggaaggttatatgtgctcacgatgacttatctacataatacgagagaagtaactttctaaggacaagacatgagacagtaagaccattctgcccttgactctctaagacttggaatttcggatccataaagtaaaacatttctccttttaatagacaattagattaatgatgtttttggaatgaaaaaatctaagattagttgagttctttgctgcctccaccttccttcaaccttgactcacttggtaattgtcagctacagcatagccatctaaggaggtacagaaaactgtgggtgagttaaacatgttggctttgggtccaattcctagccatccgtgcaaatgctgtgtgacctttggcatgtctcagaacctctcttatctgagccttggtttctaatccttacctctcagagggacgattatgagaaggaaatgaactatcataggatatgtaaaatagtatatagctgtatgtagcatgtagctacatagcatatgtaaaatgtttatcacatagtaagcacctgttatatgccatctaattgtgtgtatatctgtgtatatgtgtgcctctgtgtgtttgtgtgcacatgtgaatgtgtgatactagggaaaataatttaccttcattaaataactaaatgctttttactactccctgtggagcttgatatataaggttgctcaggaagggagcagtaatttggtgggaaatagtcacttgtgtgtgaatcatctgaagtacccatccttgtgtccggatttggggctcttgagttaaaccactgtttgcttcccctgtccacaatggcttgctgtctacagcacgtctctccatcagcaatgtcaaggatgttttgttgaatctcaaatttaaccactctggacctggcatggtggcttacccctgtaatcccagcactttgggaggctgaggtgggtggatcacaagttcaggagatcgagaccatcctggctaacatggtgaaaccccgtctctactgaaaatatgaaaaattagctgggcatggaggcatgcacctgtagtcccagctgctggggaggctgaggcaggggaatggtgtgaacccaggaggcggagcttgcagtgagccgagatcgcgccactgcactccagcctgggtgacagagcgagactctgtctcaaaaaaaaacaaaaaacaaacaaacaaaaaaaccactctggaaaatcactttttttaattacactatatagtctttctatagttgaaacaacttaaatattccctccccctatgatgaaaatgggattcaaccaaaagacagatggatggaactttatctcatgtatatactatttaatacgctacatgcattctgcatgtcacatgctatatatagcatggtattatgttgtaattacatttaataaacctagaaatgccccattttttcccaatagcctagaattcttagaatagactcaaaatgtgtcacatgttagccaaactgtggtcaactgaaaacagtgactctgagaagatcagaaatggtggctctgctgcttcatatgtggctgaaataaatgaagtggtctacagtgtgcctgtatgtatgatgtgggtgtgcacgtgtgtgaatattagcgagaatgggagaagcctttactaattcttgaaaaactcacataacccatcctagctacaaccttcctggtatcagaaaacccaggaaggtaacgggtggcctgaggaccaagcctgtgcctagggaagtgaggtgtttgaaaggacgtttcctgtaggccacaacaaaggcaaaggaattatccctccctatgatacaaagttcctctcccttgcttggaatgcctgtgtccctgggatctgttgtaaatcttctctggataatgctgtcaacacacagccaatgtcccacacactgggatctcttttttcctatctgtgttggccaagtcttcttttcactttgcctttcttcacacagtgccattaattaggcttgtacattccagccctgcctcccagagatttcccaggtcaccttgacatcttcgagtatctatttagagtccctgaatgtatccttatccttggagagtctcatccactgcgtatgagtttttcttctttcattccaaaggcaacctgagtcctcagcctctgtgtgccatgatgagaaagaatgaatgggaatcaacccaaccaggaagctggctttgtggcgtggtagatgtttgtaaactctgcctgctgggggtttcttggccattgttgaagaccacaagcccagggacagaaagtggacaccttcctccacctgccagccctctttccaagcttctgctcctaacctgggtatgaacctgctcagtgaagccagtttcgttttatgcaggttctgggctctgaaggcctgtttgtgtcattgcacactttgtagccattccgtctcgctgggcctgcctgtaatagcagtgcagcttctaggtggcacttagaggatgcctaaattgacttagaaagctttgcattaagcagatgtttgctcttggggaagattaaaaccattttgcatcaaagaacgaggctgcggcacttccctaaagcttgaaagaacggtttccttttacttggctgagggttacctggtcccctgcttgacaccctcctagtccgtgaaatggagtaaatccaggttagaccaggtgagtccgaaggtggcaggtggctaaggaggatatttcctttgtagctgttcccggccttgtttctacttatagggataactaaagcaaccaaacacacaccaaacaggtgggagacagcagggaaggatgcttggatatggctgagccacgttcctgcctggtagtatgagaattcgaagatgcttgaggcatgctggtgaaagtaggcaaaagcagagagactcgaggctgcatcaaggggcaaaccgtgtgtatgtttgtgtgtatgccagtgtgtgtatgtgtgttagtgtgtgtatgattatgtatatatgttttgtgtgtctgtgtgttagtgcgtgtgttttgtgtatatgttagtatgtgtatttttttgtgttagtttgcatatgtgtgttagtgtgtatgtgtgtgcatgttttgtgtgtatgtttgtgtgtatgccagtgtgtgtatgtgtgttagtgtgtgtatgattatgtatatatgttttgtgtgtacatgtgttagtgtgtgtgttttgtgtatatgttagtacgtgttttttggtgttagtttgcatatgtgtgttagtgtgtgtatgtgtgtggatgttttgtgtgtgtgttagtgtatgtgtgttagtgtatgttttgtatgcttgctagtgtgtgtgtgtgtttgtgtatgattgtgtttgttttttatgtgtttgtgtgttttgtgtgtgttagtatattttttgttagtatgtgtgttttgtgtgtatgttagtatgtgtatgtttttcgtgtgtttgcgtgtgtgtgtgtatgttttgtgtgtatgttagtgtatgtgtgtttgtgtgtatgctagtgtgtgtgtatgtgttaatgtgtgtgtgattgtgtgtatatgttttgtgtgtatgcgttagtgtgtgttctgcgtgtacgtagtatatatatgtttttgtgtgtgtttgtgtgttttgtgtatatgttagtatgtgcatgttttttgtgtgtttacatgtgtgtcagtgtgtagatgttagtgtgtggatgttttgtttgcatgttagtgtgtgtattagtgtgtggatgttcttgtgtatatgttttgcgtgtagtatgtgttttgtgcgtatcttagtatgtgtatgttttttatgttagtttgcatatgtgtgttagtgtgtgtatatttgtgtatgcatgctagtgtgtgcatgttcttgtatatatgttttgggtgtatgttagtgtatgtttctgtgcgtatatgtgtgtgtgtgcatttcaagtgttcactgccagagaagtggcttatcagtgggtcagaagacagcatgtacgttttataatgtaccagttaagagtccagatgtgagagtcagatattgctggagtcatttcctaactcagctctgcactagtgtgtgaccttggacaagtcacttagcctctctgagcttttgtttcctaatttttgaaaaataggatgagacccacatggaatgtctcctgaggcttaagcaggatggcctgtaaatcacccagtgtggggcctggatcattgagagcaatgggatgcgctgatggtggtggatactgctgctcttacgctgtgactgctggggctgttgttgctattttcattatgagaggctttgggagagacagaactgcacaacggattgccgtcagcctccatcctgagttcctggggtctgggttctttgtctgttgtgttactgggcggggggaaaacctccagataaacctgtcaagctgttgagaaatcctgtctcccatctaactacttgtgtgttacttacaacgtgtgagacttaatgacttcttctgtccaagggggtaaaacaaagccaattgcattaccttgccatgagcagccaatgaaatggctagcacagagccgttagaacagtgtctgagccagattcaatccttcctccgaggtcacccctggagctaataaaggaaaaaaaaaataagtaaaggccgggatcttgtgggcctctcagcctggcaaagtgcctggcataaaatgggtcgcctggcttttaaggcagtgtgccgagcagctggggaaaggtcatcatgagttcacagaacctttaaacacactgggacttaaagccatcagatcccttttgctggctccatttaagttgttttgttggaggacaaaacctttttgcttacggctaagtacattttatggagcatttaatgattcttctatagacgtttgagtagctgtgttttggtttcaggggccgaaaataagtgcccagaatctcccgtcagtcttcttgatgtttattatctgggtggagggggagggacggggctgcttagcacatgttggcttctgggcttcattgttggcacttcagcagaagtgggaagaggcatatggccttcctggtgtcttatggtgaggaaaagaggacatttgaggggaaatatttttgaacaggaagacagcaagatcgtatttgtaggtgcgatggaaaagtagaacagccagtcagctttgggactcccaagtcctattaaagctcacatcttttcaaagcattttaaagattaggaatccatctctccctgtctgttggtaatcgtggggtgcaggagtctacaacagctcagcttacgtctgacgagctcttgtctgttacatcagtaccttgggatgtgccgggctagcggctttcccatcttctaagcacttggctgccaggaaagacggaaccctttgaagtatgagatctgtttatcttgcagttactatggagaaagggccctggaattaattgtaggttattgaatttgtcctttttaagaggaaaaaaaatgactacattatggtgctaattcatagatcttgagatgctagcatttttttgtgcgtgtttaacatttcatttgaccattattagcagtatcaggttgggttgctgagtttcaagtactagaaatctacttggactatctttggcaagggagagcatttattgggaggatattgagtagctcacatgatatcaagaagaccaaaaaaaaaaaaaacaaaaaaaaaaaacttggatcccagaagagaattattcagccattagaggctggctgtagaatgaatgccttttcttctatctgaatgatcctctagtcactttttctatcatcagatctctctggttaaaatttgaagtcccagggcagggaatacttgctagttgtgttctctctctaaggtaatctgttggaagaagtcagaagaaatctttagagctcccattgtgagggcaacatacttgtttttctgcttactaacaaggaagagacaatttctgtaaaaggatatcaagatgctgttaggaaggtgtaatggatactagtgaatgtgtcaattagatgccaagcactctgactgttgatacattcttgagacctacaatgatcagatgattcttttggggaatctatctgtctgtctgtctatccatccgtccgtccgtctgtccgtcgtctatcaatcatctatctatcattcgtctatctatctatctatccatccatctatccatcccaatacaaaccatatacaacctcatgatggatagggtttcaagactactgtcacgatcatgggagactttttctttcctctttttaaccataaacatctttgtgagatataaatgtcattagaaaccagagaaacagatgatacactcaatggggtaataaatatgtaaaggaccttgccacttattttgtagcagggaagaatgtagagtatatctgagactgagaacctaaatcaggacttacctttttttatagtctcagtccatccaccaaaccatagccatagccaggcaggacaaaagaaccttgttagttattaatgttgaattgctgtattaaaattctttcagtgagtgattctcaagaaggagtgatttttttcccccccacagggaacattcggaaatgtgttaagacatttttggttgtctcaattgtgtagagtgatgctgctgacatctacgggatagaggccacggatgttgctaaacatttgccaaggcacagaatcttgtgctgatttacagcatcatctttgcaaacattaagatggcagggcacagtaaaggtactttacttcccacagtacagaattatagcacccaaaatatcaagagtgcagagatagagaaaccctgttttagtaagagatgtaaacacaactcaagtcagtgtatgcaaagtgatgactcaacagggaagatacaggtatctcttacgtgactacatccagggtagctgggacccagggaaaatattaataccctaagactctccttctttgtctcctttctttgtgtcagtttcacttccacaaactagcttcctgcacatggtgggaagtatggctgctaatagaaggtgggtgagaagactcatcctgtgatatcagaacagaaagactctgtgtcagaaactcccagggaaggttttgattggcctggcggaggtccagggctcatcactgagccaatcagctatggcctaggtgtagagctgggtcatgtggcacagacatggcagctgaccctctaaacagtgtattgaggcctttcccagcaagaccaggatgattttaagccaggctgccaccccattggtgtctgctgccattgcatgttctcttattgccaggacatttgtaaatccgatgttgtttccagcagagctgtgtcagagaatgtcacttagccattgccagatcgttgagcaccctggctgaaaatcacaaaggcacggcacctagagaggaaacgaaggctgtgcatgtttccagggaagctgcgccctgacatttatggctgagccgagtttggccttgaaaaaaatcatccggtccagccttctgcctccaggcttgtgaattgataaaccctccaggacagacaggctgttgaggcacagcctgagatgatttctgtccttcctccctggtccaaccatggaggctgccttagtcggcttgtgtcctagttgatatatttgttggaatgtatttgaaactctggtcagtttctctgatgatattgatagttttcttttttttttttcccacttagatgaaatttgtcaagcctgcattgtgctaagccctattaaaatggtgccagagacccaattatggcagctacaaagccgttcaagagtaagcagagaaaaacacataaagggattaaagatcaaaaatgggattccagtgaaagtacattaggagacatcaggcagagacacatgaaagaattagaatatgaagaagaaagcgcatagagcttttgggatgtccttacttttcatccccccaaatcatttaattttgagcatgtttactcttttaaaaatgaattgaaatgatcgattgtacttttgtcaggtggacatgtttttaactctggtgtgaaatgaattgcagatgggttttctggcttgattccctcccccaaaccccccagttttttttttctttttgtcttagacaatatggtgtcagtgaatcatgaaatactgccggtgagcccatttagtgagttgggaaagatggtctcctgggctaggtggtgttggcaatgacactctggggaatggctgaggcccccacccccatcttactgtttgcaaagacgagactgtaaatcagcacaaagtgtgcatttgagagttgctgttttgagataaagagtgcagttcagtttgtagtcatcatcatgttggttctgaagaagtcctgtcacaagcagagctgcacagaatcaggtgtaaatctgtcattttggctagtcttcctctggtccctctctcttcgatggattccatgacaagtccttaggcacatgtttgatttgcactctgttgtttgctatagaaatgtgtacgtggcctctcaggaaagagaagtgaccctctgcctatatcatcgtgaaacatctcttccaggtttgcattctggagttaatggaagagatggaaatctaatcagctcacaatagtctctaactccagactctgatgctcacaacattctgtatatgtgcatcagtcagttcaatgggaatagtggagaaacagagaacaaatgtcccatcccatctgttctatctaaaggaggcagcttctccttagctgcagtcatttttttcaatgcaatagtgcaggctctgcgttgtcagattttctgatatttcaaaagaaggtaaaaatccagatttttgtggggatattcattatgatgatatatatatatgcatatatatgtgcatgagcacgtgcacacatgcgtgcatacacacacacacacacacacacacacacagacactacacatgatcaaacacatcattagcccaagggtcaccagtttataatctttactctaaagagagagccaggcatggtgtcttatgcctgtaatcccagcattttgggaagccgaggatggtgaatcagctgaggtcaggggtttgagaccagcctggccaacgtaatgaaaccccatctttactaaaaatactaaaattaggtggacatggtggcacacaccagtagtcccagctacttgggaggctgaggcaggaggatcgcttgaacccgggaggtggaggttgcaataagccaagatcctgccactgcactccatcctgggccacagagtgagactgtctcgaaaaaaaaaaaaaagagagagaagaaaggccgtaagtatttttcaaattagtgtttgatagtctatccattttggggtttctttccctgtttatcttcaaaagtgccatattttgaaagtttacgtattaccagaaaaccagcatcattcatggagtctttatatgcttaaaaagttttcttggaggtctcgaaacacccttagtcttaattcactttaaaaaaaaattggagccgggaacagtggctcacacctgtaatcccagcactttgggaggccgaggtgggcagatcatgaggtcaggagatcaagaccatcctggctaacacggtgaaaccccctgtctactaaaaatacaaaaaaaattagccaggcgtggtggcgggcacctgtagtcccagctactcaggaggctgaggcaggagcatggcgtgaacctgggagacagagcttgcagtgagctgagatcacgcccctgcactccagcctgggtgacagagcgagactctgtctcaaaaaaaaaaaaaaaaataaaaataattggagtgtatgtccttctacagtttagggaattaatggtgagaaaagcaagccagacagttatcttcagattaagtaacaaagaaagtgccctctaatggcctgggaggtttcattcattttttgtggaatgagaagggaggtgaatctttcttttttttaacacaatgatcctgcagctgagcaagaagtgctagatgatcctcctggctcgaacaggatgatggtgaagagatagcatggtggtggtagaagtcgtaatgaaggtgaaagaggaatacagaaaagaaggaagaaggaggtttttcacaactcagcgtggattggggtatcccactccggtgggacccacagtctgcttaatataggagattgactccaagtcttgccaccttcccccagcccaatagtaaaaagcaaacacacccaaacaaacagaaaccacgatgttcctgcagctctcgggggctgaccatgtcttccagaggaagctcaaagcctgttgttgcatgcttcatccagcttttctgcaaagtggaggccctagcaagaagcaaaggcagacagatggtgtcccgcagactctccctcaagccctttcatctctcctctcactattaattcatctgtttggatggatatgttcacgcatggaaccaagatgaataataatgaggtttttaataactccctgcatttgcattcctagttactctttacatggttctagctgattaaaatgaatcatttacataattaacatatggttatagtgttggctttaatatgctgattatctcaatacttttgtctggagtcaattggattctaactgtaacaattgtttgaagtgagactagtttattcctgggaggatggaggggctatttgccatggtgtctgattagcaatagcatacctttccaacaagtttgttgtgcttctgttttgtaatgtgattgaaaaataagtaaataataataataattgcagtgatcataatagctcccattaattctgggacaagtactatcaatttcattatctcactttcttgcagccagcctgcaaaacagcaaggcttatccccactttacagaggaagaaattgaagcttggaaatgttaacgggcttgcttgaagccaccatgctattatgtgtcagagccttgagctaggctttctgatcccagaattcatactttttaattactctaagtcagcttctgaaccttgagactattgacattttcaagcttggcactatgactatggccagaaaattctgttgttgaagggtttccctgtgtactgtaggacaattggcagcaactctggactcctccctgtggataccagtagcaccccttccctcattatgacaaccaaacattgccattgtcccctggggaggggaatggggtaaagtggccattgattgagaactactgctctaagttattttcttggtacccattaagacaaaatactaagaagcagacatgttatctaggttggtctttcagtgatgggtaactagggcctaactgcagtaatggtatttggaggtacattgtgatgtgtgtgactcctgtaactgattctgaattttccaattatatctgccaggaatcactgtatttgtcaatcaaagcgatctttgttttttatcaacgcgggtaagttctgtctccctcactttcccttcttcccccacgctccctccccactctttttaactcctctaaagggcatgcttgatattttcagatgtgctgccttgcagagttgatagcatgcatttcaggataccattctctcattagcacatcctaggcatgggtgccatccgctatgatctgattatcttgctagttcatattgaatttgaaagggacttgtgaactagtggccagttttcctgtttaggtacccgaggttttggaatgtgagtgctttctgaacattcatgcatatttgaaacgcatttttgctaattgcaggactgttgtccacaattagtctttggtaggcatgattaattgcaaagaacactgacatttatgcataaaatgcttgaggtcaaaaagaaatggagagaaatggtgactgcagccagggtgagtggaatactgatgcatggtgaccccagaagcaaagccccaatcaggaaattgtagcatcagcaggacaggtattttattgggatggatgtgtctgtatttttgacttgcctgtattttgttctcctctcctctaagcacctttagttttacgcaggttttcagaagcctgtctgatgttttcataaatgccaaggcctgccttttactctccttctgcccttctccctcccaaactggccccatcacttgaagctcataatttacttctttaacataacatttgtgtgttgtatgtgtcccaggaagaatcaagaagtaaacaaatgtgccacagtcctaccactgagattaaccagtaaacttttttttctgcttaaagtggtacgtgcctgtgattaataattcaaatgatgctagtaacggaagacgggaaatgaagcccatctccaaatcttggatcttactaaagctaatcagtatcagcggccattaggagaaagaaaaaagcaccattgtgtatagatatgcacatatatggccaggtgcggtggctcacgcctgtaatcccagaactctgggaggatgaggcaggcggataacctgaggtcaggagatcgagaccagcctggccaacatggtgaaaccctgtctctactaaaaatacaaaaattagctgggtgtggtggcaggcgcctataatcccagctactcaggatactgaggcaggagaatcgcttgaacccatggggcggaggttgcagtgagctgagatcacgccactgcactccagcctgggcgacaagagcaaaactctatctgcaaaaaagaaaaaaagatatgtagatatatgatacatacatgtgcatacagatatatgttgttttcacatactgacaaaaaaagccacatcagtctaaatgccctgtgtgactttatcttgcttaatttcacttgatgatatgccatggagcctccttcagtttttctacactaggtggctgtgacataccttatttaagtcattcccttaattcctttttttttccattataaacattactgctacacatgcatacactgagttatctgatagagatatttaaataaaacatatatatgggccctgattactttttactgccatgttaatttcctagcagtgtgattgttgggtccaaaagttggtgtctcataacttccatttaaagatgtgattcaaaacttacctcctactatatataatgctattcaattcacatcactttctcaccatcagtgcagacatcctatttgggcctcggagctggagttcacgtaaggatgagtaaccacttcatacttcagatcccatgagagcgggatcatgtcggtactagcaggctctaaaggacacagtgttcaccctgcttaggatcagacaactgcctagtctgtgccaggcatctgatacttgccttggtaataggattttgcttgaagttctccttatgcctctttatttcttttatttatttgtgctgacaagttagagtgtaagctcattgaagcctgtggccatgtacagaaagagaggtcacatcttctgccaaccctgattgattagtagtggctgttaggagctctgtctggagaaggattgcatctgacttaggaagaaggagtttcagaatcaattagtaatgtctgctaagtgcacagaatggtggaggggcagcctgtgtccccagtattctttttccattcttccataataaattaggattattattatggttattgagggcttacagaaaatttttgaatcaatataaaaagcagcaatgggaaaaggagaagagagggagaaagggagggaggaagagaaggaggaaaagagaagagcaggagacagagagagagaagttatactcaaatatacgaagaatatcttgcttctaggtggctttatatttgagcttttctatagttttgaaatttataggaatttaaaaacatagaaattgcatttttttttttttgagatggagtcttgctctgttgcccaggctggagtgcagtggtgcattcttggctcactgcaagctccgtctcccaggctgtagccattctcttgcctcagcctcccgagtagctgggactacaggtgcctgccaccatgcgtggctaatttttttgtattttttagtgagacggtgtttcaccgtgttagccaggatggttatcgctctcctgaccttgtgatctacctgccttggcctcccaaagtgctgggattacaggtgtgagccaccgcgtctggctgaaattgcattacttttaattctaaaacaacaattagttttgcaccaacctaaggaacatacgttacatttgaatttagaacataaagatcacaatacatgttatagtaaagacagtcttttgaagcaaagctacaggtactattaagaggcacagtgatcctgagatgggaaatggagggcagttctctgtcgttctgcagtttcttggttttgtgagaccactaagtgatgtccgttctctcctggcagaatagatggtgttaatctccagtcccttgtaataaatgctggactgtgaacaggagatggctaaaagagagtgcccgggcaagcctttatctttaataaggtccacagccagtctataattgtcagaaatgacagaggaaacagggcttctgctattttgctcagaataagaagtggtgtctgacctgtgttggcagcaataattgcaatggtcagttattgaagttgatcattgcaatagttgatacaggggcccagctctttgcgctgatattgaggaagccaccaggccccacactttggggtctggaaacattcacagagcaacttttttcaagaagatggacacattcacgttttaaagatgctcagcttctcgtgagagagagtttaggtacattctcattccactcaaatcttagcttataacttaggctcctcgtagcagccctttgcaatgaaactgtatcacttttgaagcttagcagatgggaattgtcataaatgatattttagtcacagatatgagccataaaacttgaaagataaagtatctttctgagacacacatggagaggcagatagacccagatacagcgtgagcttttctgcagctctgatggtgtggaacgaagggccaccaataggtactttattgcaggtgacagggtttgcagatgatgtggaatagtgggaatggcatggagcatgaattttggggattcaatatggggtcaaatatttaccatcccgtggaatcacatttcttatctttttctgaggctccgtgttttcgctgtgtaaggggaatagcggaatgtccttcttaaggtgtttggcacaatacagataaacactaaataaatattcctgtctgtcctccctacagcattcccctcaaatgaatgtgttgcttattgctagttatgctggattattctgctcagttgaataattcattagggcttgagttccaagatatggtgtaactgtatccagcagactctagccttaagccaatatgtatattaatgctttttactcaaggaatctacctggctcttagcaatcctaaccccacccccacatttttaacctgacaggaagattaatctgcatgagatgaagggtgattgtcatgtccaaactaaaaacaaaaaaattaaaaataaaaaatgacagaaatcttctagaaatacctaaacattccctcttttgtcttcaacacgtactcggtccccttcttgtgctcccaggagtcttttaatgcctttgttttcacagcatcaagatatcctggcaacctagagttaccgccatgaggtttggccaccttatctcaaacaactgcgtattttgaaataggtggtgatagcatgcttttcattccatccagaaagtgtctcttccatgacctgccagcactagtatttcaagacctctgcacttacaaatttaaacggagcctggagtaatttaaattaatgtgtacaacatctgtcttggtgagaggagatgtagagatattctccgtttatgcccatctggctttgttagagtagataggcgtatgtttcaggaggagaaagaacattttttatttctgctatgtttcagacattatgctagccattacgcattatcctgcttaatcttttcagtaacgttggtagattaatatcattatccctaccctatgataaagattctgaagatcagagaagtacatcgtttcagtgaccaagtcactgttaaatgacacagtctgtattcaaagacaggacagcctgattccaaaactacttctatgccatcttattagtctcaaggtaatacaagtctaatgtgtttttgcttctgataattatagcagtaactacttagggtaaattaaaatggaatatccaggaaccccattatggtggtaagagtataaagacaaattagcggctatggaatctcaatccaggaaagagagacctgcattgggctcccatgtgttacgagaggttttgtttttttgttttttttttttttaatcatcagatgttttgggtgttcccagctgtgcttgagtgcatttgagaaatgggtttatactcttctcgatcccctagttcttcccaaaaggtagataaggggactcacataaacagtaactgaaagtcattctgtgtgacaattctgtattccttgttgttttagtaaagtttgtcctgagagcaccttgcctataaataaatacagtgacaaataaaatgaatgatttttctgggttcctttcctactctctctccccccatgctttaatgaataattttaatctactttgtaattaagacactagcaataattttattatttggtactacttgggaaaagtaatctttgatatgagatactttgcaaagggaagaccttgtgcccacgtcctgccttaaatgcgaagtaaaggggaaacctggattcaagaactagagccattggtaggccaaacccctatcccacaagccagggaatgggatcttttaccagacactcagacatgaggtttggttttattttttattgttctgaaaagtacattgtaaaaaagggagtgtacatttctaaggcacttttctaaaacaacaagaaataatacaaatatttagtaagcaagggatgattgcatttttggaacatatatgtttatgagctatgtcaatatatatgttgatgtgataccatgaaagctgttttagatgaaattctgataaacagggcattatattgccacttacttgctcttaattcgattctattagcagctcagctttattaaaatttctcaaatgtattccatgtgaaatcattttatttcatatcgctaatgtatgactcaacgcagcatcgcctttgaggtgatccaggactttcatccccatttcacagatgagcactggagataagaacaggttaagtgatttttgcctgaggtcaaacatgctgggagaaagattagaagttggtgagtgtttaccacagctctgtgtctgtgataagtccctaaattcagattttccaacctccgagttttctgggttagacctccagctaactaccaggggatgtcatgttatgtaattaattacaactgtaattatcttggtttctgggtcatttgaagatcatcggtgctttttgttttcatggttcatgcagcagaggaattttttttccaaagtacaagtataattaatccaggttttagactcttaaataaccggaaagttaaaacgtcagtgcagaaactgagttcatcttggctgatgtcccttgcagtagagatggggagaattcagagctgttaaaagtcgtggtcatctctcttgaaacataaaacttccctaccagtgtctggatttcctaggaggtacccagtgcatagacccatgttgtatgaatgactggcctcatacaagaggtaaacatagtatccttgtatgtccctaagtgtcaggtggttgcttggaaaagcagtgatttccataggtccctgtaaagatttcttcaaaactgatggaaggtataaatgtttaaaattagctttcagtttccacttctttttcatgatatcttacatgaaggtaatctattgaggaaattaccttttatatcagtttaaatgaacttatttagataaaataccagtttaaggcattcttgactttgttctattccattcatggagatttgcttgacaggaagtgctctggcatatgtcagtgacctccaatgctcctggagcagatgatactgggacacaggtggtccgtatcacccacgtgaggtggtggcatgtatttatgtgctgaaccaatcggaagacatctcattcagaagaaccaggcctgtttaccttattcgtatgtcattataggtgacacacaggaagagtttctgaagaatcatttcatcattaagatatattcaatatgacagcttggctaacacatcaatcatttggaaaaaaaatactgtagtaacagcctaaggagaatttaaacccttgtgctctggaatctgtatttgcagggcaggaaaaaatgttttagatttgtctatggcattattctttatcagtataactttatagcgcttgaatgtctgaaagatgactcattcatttatttgtgtattcattaattcattccacatatatttgtagagaacctatctgggatctaagaacaatttcaggcaccagagacacaggggtaaacaagacgtctaggcccctgctgtctcagaacttaaatttagtgggacagataggtggtaaacaaataagaaggaattgagagtaacaagcacagtgaagtgaaatatgccaggtgatgaaatagcaaataggagattgatgctcccatagtttggagactcagagaagttttaaggaggtgatgttttagctgggacaggaaagaagacagccagggaggtatggagaggaagagcacggggaacagaatgtgcaaagtctctaaagttagaataagcttgacatgtctgaagaagagcaaagagactccggtggctagaggattctaatggagaagtaggaggcagaaaagaataattgagaagtagatcagtcagatggaggaggactttgatgggcggcagagtaaggcagtatgagctttatcgttgctgagccggaagttgttatgttatgcaggaagctgcgatgagtgtgtacacaaaccatctcctgatctcgagccttttcctcctgagggcaaggaggatcgggaggcaagggaaacgtagtggtgatgacgaagcttctatctttcagggtctacggtttagggattgagagtatgtgtttgctagcgagacctcacgaaaccaagccccctggagagtccctgacaaggacgaggtgcaacactgttagcggaatccatttcatcgcagaactgctgtcttccaagccttctgagccggctggtacttgtgtaacatttctgtcttgggtgatttccaactggatatgtcatttctaccaagccagtggcaactccagcctagggatgcatttaatctgggacatggtggtgggagaagcattaggcacattgtttttcttccttttttttgaagaatgcttggtacaaattcagttttgacctcccaatgtaggcttttatttcccaggcacttcctttttccctgcatccgccaaaccctggtgagctttctgctgcttttctcaatggctgatctaagtactgcagaacacggacactcttgggcacactgcaaagtcagcctggctccttggccattcctcttgcagggcacaaaaggaccttccaaagaggtggggtagtgtattattaagtggcaataacgaaggacttctttagattatcactgtttcaccagaagacacaacaggagagcacacagaccttgaaggaaatcccaccactgacatttagaatctggtggactgcaagcttagatatctactctctaaatgcagttactttatctatgacctggcaatattaacagtacttatctcatagaaatgtagtactgggtatgtttctggccagtcataaacatttaataatggtagccaatgtcatcacttgttgttaatagtggggatagcagtaaactctctttcctctcaaggttaaggggagtgtttggaagagaaaaaaaagctgagactgaatgacgtttagctttttgatttcaccataaactaaagagtttcattggtaactgtgccctgcctctttctgtccaaaagagtatcttatttttagactgttttaaaataataacagtattatctgatggaggagacaaaaatacttcagtaatagcctaattggagcgaataagaaaatagaacacttgtgtgcaatggaatactagaaagcagtgggaatgaatgaattggagctttatataagaagaatggcttctgccattatgactgtggataatttactaaaaaatttaaaatacactggagttttagtactttctgctgtccagaaatgcatacatatgtggtaaatatatatagacaataaagaaactcaaaattcaggatattgtctgttgtagaggtgaggcagagggctacatctcaggagggttttagacagggtatttagccacactgaaattatttcttaagctgggtagtaactacaggaattccttccttccttcctttctgcctgcctgcttgcctgcctgcctgcctgccttcctgccttccgtcctgcctgcctgcctccctgcctgcctgcctccctccctccctcctcttccttcccttccttcctcttttctcttccttttctttctttctagatagagtcttgcctttatcacccacctgaggtgcaatggcaccatcatatctcaccccacagccttggcctcctgggttcaagcacaatcctcctgcctccttctccaaagttaggactaaaggcacacaccaccaaaccttgcttattttttaaagaaaatttttagagaagagtgtcttgctatgtttcctgggctggtctggaactcttggcctcaagtagtcctctgacctcagcttcccaaaacactgagactacaggtgtgagctgtgcctggccagtatttatgttttgctgtataccttttggtatgtctgaactatatcacatcatgattttagagtcagaaatgctcagagtttagaaaataaccatcttcaccacatagaatcgtataaaataaaaaatgttttttctccttccctttcttcctcccccatcatttaataattgtttagtacatacctttgcagatattttgtgcatattaaaaatatacacatttagaacatatatgcttaatataaatgactttatgtctatgactctgttaccacttaaaaatagtgtacaggcttttcaatgttggcacatataaattatgtacttcagtcttaacatctgtctggtaatcatctttcagtgtactgtaatttaaacaaccagtttccctattgatagacatttgtatttaaaaaacaaaacaaaacaaaaaccagtttccaaactctggtctgctttcaattcagacgctggcagcagctcacaccgctgatcatccaaatgttttgtctttgctaggacgataacccagtcgtttcatacaactgttttcgtttgcacctgaatattccatggctatagccacagctagaaatccattctctaggggaaaataagaaatgtaataataaacttaaaatccctaatgagaaattcagatttcatagaagcaggggtcttctccctcttgctaaccttcttttccaagatgttagtgtttttcaagaatcgcaggctttttaaatgtcctccgtaaagtgtaaaggggaaaatggagagaaagaacagtattttgaatctccagagttctcagtgaaagtagacaggtctatcctagtgttctgtcttgcatgaaacactttcttggtattttgtctacatgagtgtttaatatttaggtcatagtttgtgaatacactggagatgttatgcgtcaaacaaacccagtgttctggcttcacagcagagtaaacagacacagatagttctagatgcttgaacttctcccacgttaaacttaaaacagcctctcatctcagggcttccatcaaagggattgaggccgtgtctctcaaacccaggtgcaagtggaaatttttatgggccctgacttttcttgttgtccttgttggctcataatattgccttattgtgcaagtaatgcatataacttgtgggaaaaggtatagtactataagtaattagaaagaaaaccatatttgaaatttaaaatccttaaacacatacctaattcctactcttcctttctgaaattcctgttttctcaatgatctgttagtaaaatatatagactacaaaaatgggttcatacatcgttcccccccgccttttttttttattttattaacagcttcacagtgttctgttgcatgaatataccctaaaaagaggatttgttttggcattggtgcctgttctttttcagtgttattcattattttgggatgttgcttttattatttttcatattttattttatttggtaggaaaaatgcaaatgtcccaccgtatggatttgggatttgcaagtcaggaacagtgggcacactttcccttaatggttggcgtaggcatttggatactgaatttactgtttatatcacggtttctccaccttggcagtgtggacgctgggctggatcattctctatgtggggactgctgagtgctttgttgggcatttggtggcatctctagcctctcctgactaaatgccaactgtagttctccccacactgtgatgcccaaagatgtctctagacttggctcactgtcccctgggggatgaaatgtttctccctttgagaatcctgcttttacgcgattggattcttaagttgtctgaaggatgatcttttcttgtagcatttataaatcagttggaagttggttctggattactgcctaaaataaaattcaacctattctgagaaaacaatatatttgagtagggactaattacctcttttttatttcaagtgacaaaagccaatatatcacacttagccactatgaagactccatttcagtaaactaattaaactaatcctatctggactcattattctcagttccactaaatattttaacagttgagatttatctcatttcataaattatatcatacttaaagctatccacagccctcaagagtttattttggacttttaaaaaatgtgactttaagctgctctggaatgtatatttttcatatcttttctagataatcattcaccttgattatgactaattattaaacatgatatatggctttaattaaatgaaagtacttggtttcttgttagcgcttattaaatactgacagtgttacaaagatagtgcagcagaggaaatggcataactcaccgaattgattccattttcttgctgtaagccagtgaagatacacattttaagagactgattaatgcgcaagatggcaagaacagtgtttttcatagttaaaaggaattaaaatctgtgtccatcctggattcattttctaacagaggatagtcacctaattaaaacgttaatacacatcccgctatttgtatgtacgttccaaagccagcatacattaaatagaaatttatcccaagtgcttcatggagaagccaagaggaataatgcctaagtaccacttcagagtaaattgctccctacttataatcgtgtaatgcaattaaattgaggagctgtaagctgcctacatcaagtatgtttagtttagatatttgcctttagacatctccctgtaaagggttccacattgaagagaaaagaaggaacatctagccaatgagctgttcattaaacttgacatatggtaagcaaggccagaaaatgcctaaagagtagagaattttctttggtatctaaagaaaaaaaaatgcaatatccagttgatcttagattctgattctagcaggtgttcatggtacagtcttgttctgtgcttcattcaagaatgggaaattcttgtttatcccgttgtccatgatgtgcttatttctcatggcatgcctgtatcaaaacatctcatgtatcccataaacatacacacctactacgtacccataaaaattaaaaaaaaaaaaaacgtaaaatgcaacaacactaggcacgcattttataatataacttctctgcttggacaaaattaggctccccagtggaggcaaaaacaaaaaaagcagatggcaaatatgttagtgacattgttttaagtgtttgaggtcatggagtcttcacattgaaataatctcttgaattatctgagttttaggctagccagggccaaggtgccagctgaattaatgaaacttggaattcatcttttgagttcccagtgaacatcaggaaatactttcctgacatattgacctccttattatccatttcccattctccatgttgaaaaccatttcatatttgagagctgagaatatgacaccttcatgataaatttaaaaataagatgcaatattattccagaattgccttaagttcccattctgtatattaaacgcctattcaaagggtattcagatccaagttacatcatacaaagtatgttaaagtatcccaagtatggcctggcgaggtggctcaagcctgtaatccccgtactttgggaggccgaggcgggcagatcacaaggtcagaagatcgagactatcctggctaacatggtgaaataccatctactaaaaatacaaaaaattagctgggcatggtggcatgtgcctgtagtcccagctacttgggaggctgaggcaggagaatcacttgaacccagtaggtggaggttgcagtgagcagagatcgtgccgttgcaccccagcctgggcaacagagtgagactccatctcaaaaaaaaaaaaaaagtatcccaagtatgagaaacatcagtataaatagtgagaaaacatatatacatatgttcttcttatatttacgggagagatatgtatgcttatctgtgcttttcatatatatatgaaacatatatgaaatatatatgaaacatatatgaaatatatatatgaatatgaaaagcaaggagtatgaaacttatatatgaaatatatatgtatgaatatgaaaagcagggaaaaggggacagtcatttagtgttgctgctgaaaatttcaatatgaaaaacgaggaatatatagctcaggtgcaacaggcacctttatatttataccattacaaaaacatggctctcctggtattttggttcttgaatttaggcttggagctgatattgaagagctgcttattgcagtgggttttcatgccaaacatagctgagtttgaatgacatttctgttactctggctacagaatcttgggcagtatcatttatctatccatctgggctttatttttcccatggggaaataggagggagaggggtcatggagtgaacagctttgcaggccatgccaactttggaattagtggagagaatataaggtaaataagaccatcctgtaatgacaacctagacttagacttgcacgaaatagagatgtaagtcaggatgagtctctcattcactcaacaaatatttattgaatgccaacccttctcagccgctgggtattcagtggtatagagtgtgaacaaaatgctgctggcatagagcttatattctagttgaaaggaggcaaacaataaataactgtgtaaattaatatatggttagtgacaggtgcaagtcagataattaaaacagagagtggtggggagctctagaaaggctcctatgaagaggtaagttgacatttaagctgagctcgcaatggcaaatcatgccaaggcagagagaaagaacattccaggaaaataccctaagaggagaggaccttggaatttttgaaagatgaacagatccctggaaaatagagagaggggcaccagagaggtctgagaattgggcaaaggccaggtcatacaggattttgttaaccacgataatgaatataagttttatatgaattacggatgcagagatttgcatttcacaaagatgactgcttgccacgtgaaacatagaccagtggggcccaggagaagaaggcaggagagcagttaggaagctgtctgggagtccaggcaaggggtcatagtggtttgaactggaaggtggttctgaaatggaaggtgaaggaaatggaagtaccgttgtagaaaattaacaggcagatctgggaaaacccagtggaggtgaagggagtgaattaaaatgattccaggatggagaggtcggggcttgggtgaatggtgccatggaaagtaatggaggtatctcaaatagaaagtagtgagtgggaagagcaggagtgagcttgcagaagttctagcagaaatgtgaaaggccatggttatttgccaagatggaagatagattaggtggtggtcatctcatttgggcgttgaaacttgttttcaaaacctgtacctggttttgatttctacacagggatgcaactggcagatgacatctcaagaggtgggtttgtcatggtggttattattgtacatgtgagacttttagcttttaaggtttttggtttttttcgagatagagtctcgctgtgtcacccaggctggagtgcagtggtgcgacctcggctcactgcaacctccgcctcctgggttcaagcagtttttctgcttcagcctctgagtaggtgggattacaggcacatgccaccatgcccagttacttatttatttatttatttatttatttatttatttatttattttttatttttagtagagacggagtttcaccatgttggccaggctggtctcgaactcctgacctcgtgaaccacacggctcagcctcccaaagtgctgggattgcaggtgtgagccaccatgcccagccagcttttaaggttttgccacacgctaaacaaggcatggtgaggactcttgggtttgagatcccaacagcctcagagatatcagatgtagggcaaagcgggtatctgcatcccccaagttctttccttctcactaaagtgcttgaagtactggtcctttatgatactttcagttctggagtacatgtgcagaatgtgcaggtttgttacatagctatacatgtgccatggtggttgctgcacccatcaccccgtcatctacattagatatttctcctaaagctataccccccagcccccaccccccaacaggccccagtgtgtgatgttcccctccctgtgtccatgtattctcattgttcacctcccacttatgagaacatgtggcgtttgattttctgttcttgtgttagtttgatgagaatgatggtttccaccttcatccatgtccctgcaaaggacatgatctcatgtttttttatggctgcatagtattccatggtgtatatgtgccacattttctttattcagtctttatcattgatgggcatttgggttggttccaagtcttttttattgtgaacagtgccacagtaatcatacgtgtgcatgtatctttatagtagcatgatttataatcctttgggtatatatccagtaatgggattgctgggtctaatggtatttctagttctatatccttgaggaatcgccacactgtcttccacaatggttgaactaatttacactcctaccaacagtgtaaaagtgttcctatttctccacatcctctccagcatctgttgttttctgactttttaatgatctccattctgactgccatgagatgttatctcattgtggttttgatttgcatttctctaatgaccagtgataaagagcatttattcatatgtttgttggctgcataaatgtcttctcttgagaagtgtctgttcatatcctttgcccactttttgatggggttgtttttttcttgtaaatttgtttaatgtatttgtagattctggatattagccctttgtcagatgaatagatggtaaaaattttgtcccattctgtaggttgctgaaacaggcagttttttgagtgcttgccacacaccaaccattgtgcaaagtacctaccatgcattatcttgctaaattagtataggattagtaataaattctatgagctatgttctatttttatcctcattttatagataagaaaactgagacccaggtatttgattaatttcacacagctgataaagagaggatgtggattctctaagtccagaattgaggccgtcagtcactggatcgtactgacatgatattcattcatatacccctgtcttccaaatgcatagatgtacaatagctgtcaggattgtatctccctgggtctcgtttcttatcaaaattgcacatttgctggcaagaagagagtggcacattgatctcaaactgtgaaataaatccatacgccttcagagaggttcttcgaatgtatggtcaagcattgcaaaagccgctgtgtgtttggaagaaaggtgaaactggaaggtctttggctcagggtgccattaggagtggtgtcggtggcagctgtgggccatcatggtacacatcctgcgtcaactccaggcctccccacaatcccatgaacagcaaagcccctcatcttttgaatgctggagaaagctccgtacgtgtagggcttcgccatcagtttaaaacgtctctggaattctttgattattttaatgtgctaatttcttgagctttgtttttgtgctgtctttgattttccactttcgcctttattttacgccattgttggaagggtcaaagcatcccagagcttaatggctctcttgttcagctattgtggggggaaaaagagcaaagcaaacaaaacaaaacaaaatatccttttttttgttttgctttttttttaatttaaaggcatccaaaaaattgtttcttttgcctttgatcaagatcatataaacataatcagtgtttattgtgtttgcataatcgaaaatagcaggaaactgatctcagattgcatggagctagaaaagattaagcctttccttcttggcagagttctacagacacacaaggttggtgtgatggatgcagcactcggtatccatgatgtgttcgggaaaatcctcagaagaaacttgcattgctttctggggaaattcctgaatacaagtggcaatgagatgcatgaaaattattttcagctgatgaatactgtctgaacataactattgctggggtgtataatttaaaatctgtagagtgaagtgtgcaatatatgggctttgggatacaacaaatatggatttaaattctactcctcctttttatcatctctctgcccgggataacttgtttcatccccttccctgagcttaagccccctcaactgtaaaagaaagataacaacccttacctcatatggttctagggaggacaacatgagataatacacatccaggcagtccccaacttaaaagtggtttcacttactttttttttttttttttttttttttgacattatgaatgacgtgaaacctttctgttttttcacatttggtatggtattcaatgaattccacgagatattcaatactattataaaattagctttgtgttagatgagtttgtccaaatgtaggctaatataagtgttttgagcttctttaaggtagagaagacaaagctatgatgttcagtaggttaggtgtatggaatgcaattttgatagaatattttcaactcacgatgagtttatagggacataaccatatcataagtcaaggaaagcatgtacgcagagcttaatagagtgcctaatacagagtaagtgcttaaaacatttttttaaagtgtgatacaagttctttggagagcctgaatgaattgggggtatggccatatgtaatatgttcagtgcagcaccattctttaataaattacaagttggtctatttctttgttcctttttatttttatttttatttttggaggcagagtctcactgtgtcacccaggctggaatgcagtggtgtgatcacagctcatggcagctttgatctctccaggcttagatgatcctgtacctcagcctcctgaatagctggcagcacaggtgtgtgtcaccacgcccagctaattttagtatttttggtagagacgaggtcttgccatgtagcccaggctggtcttaaacccctgggctcaggtagtcctcccacctcagcctcccaaagcacttggattacaggcatgagccacagtgcccagccagatgtaactatttaatgaaatgttgattggggtgtgcttgcttcccctgaagcctgattcttgatctttgttctggactccaggaccaaagatatcattgcttaatcttgcgaacaactctggaagatccttacagaatgacttgctttagccaaatcctatggtaaggcaaaacactacctaaaaacaataataagcataattgtcatccagatatgttgggaccctacagagaaattcagaagacaatctggctggagtttacagtatgtacaacagcagtcttggttaggccatggtattataattcagcaacaacaccaataataatattggtggttaaaatttcttgagtatatagaatgttccttctagtatgcttaaggcttgatatgcatacaatctttatggcaccctgcaaaatccatgagtccactgctgttttccaaataagaagatgggggttgtagtagtccattctcatactgttataaagagatacctgagtctgggtaatttataaaggaaagaggtttaattggctcacagttctgtgggttgtacaggctctgcttctggggaggcctcaggaaacttataatcatggcagaaggtgaaaacgaagcaagcacatcctcacatggccagcaggagagaggaagacagaaaaacagagcgagaagggagaggggctacatactttcaaacaaacagctcttgtgaaaactctatcaaaagaacagcaagggggatgtttgctcccattattctgtcatctcgcaccagacccctcctccaacactgagaactacagctggacatgagatttggggagggacacacagccaaaccatatcaggggtctagaaaggtaaaccaattttcccataacaatagagagaatacattataataagtaggacttgatccaaatctgagagacacccaaactcatgttcttaactatgagatttcgatacttggagtcagaagacttgggtttaagtttcagttgcagggaccttactcacatcttctaacctctcaaagccttgccatatcatctgttcaaaagaataccttcttcacaaaattgtaaagactgaatgagaaaatgcacctaaagcatctttgcacatcgcagagattatgcaagtataaggtgctatatttcgcattaacacctgagcatagatcattttcggattgtgtgagggatggtgaatttataaatttggtgatttttgatgaaaagaatcaatatgctgtctctttacagaggaattagtggttataagaactgacaatgcatttagagatttgtttttttcaataggacagaaagagactattttctttccatttataagaatatgaatgtgcttaagggaggacagattccaacaatcgagttgtttgctgtgatttgtacgccctggggatatggagagttgggaatgtagaaaaattacaattatggaataaaaaaagatccagggagaaggattttttttactgcctgttttgcttgtgtggcttggaacagggagtttcctggagggtgtggggtcttccttgctgaccctcgtgctttttggaggctcattggtaagccttgttgtgcctgttccttctgctcctagtccttaagaacatagctcttatccttaactgaccttttgcactgaatatgtgacagttaatccactggaaggttttagataggcagcatgtccagacactgccccctgcacgtgactggccccacctccgtcccaccttggtgttaatcccatggggtggattttctaggccagtctctttttagaatagcatttgctgatgtccctctaagagagtttttgggcatgtgccctggtttgtaaaagaagggccctcatggaggtagaggaaagaagtttcgcgtcccaagatctccaaggataccaattataggggtagctgggtacctgcctccctctgctcttcgtttctcaccgcaagagctctgctatgattttctccacatctggacttctttcctccctttcttgcatagctaacacccatgtgtgcttttggaccagtttccttgtcccgttcacaaaattaaaacttccttgacctcactgacttggttaagtacctttactgtatcactttataacttcagtaccttcatttgtagcttgcatcatcatttcagttttacaactttttatgtaatgatttggtttatgatactcttcccccaaaagactgtaaaggccatgcagatgaggaccaaatgtgttttttcttcctacgcatcctcagcatatgtgccttttatacagtaggcttttaacagtgactaaaaggaagagtgagtcggtggatggatggagaaatgaatgaatgaatgaatgggttacacaaccagcctgtccagacactgattcttttacgtaggctgagattcctgaggtaagggacaaggatatcaacttgcgttagtttaccttatgcactccatcgcagcctaaactgtcactgattacttgctgcccttagaatacaagctctctctgtcttccttcccctcctgccttttgcaatctcatttcatgctttgctcatttgccaccacaatacttaagccaggccagaattattttcagtgtttgaaagttgcacacccacttctcccttgcagattctgtacacgcttttcctccatcaaaaatgttttattctgcctcttcaaacattgcattttcataatcattttcagacctctgcctacatgtccctttttcatggaagccctccctccctgaatcctctaggttggacaactttcccctgtagtccccttgtatagcaccttgcatttccctccagatcacgtcccaaaattataatgaatatatgtttgcatttggacaatggcctgtttcctccactcaggagtaatagctacttgaggaaatgccttggtcatcaaaaagtgtctggctcctagtaggtactccacaagcagttatcaaataaaattgtaaaacccaggcactctttatggtcctaccaaaaccagtgacttgaatgggagatatttagggtcaaggaagaaagaaggcaggcatgttcatatttatttacctcctgtgggtttgtgatggcccctccttcttcttgggctagagtcagagccactttctcctaatcccctataggttaagctgagtaggtgataaagcccaagtcatagtagcataagcacaaggaattctgattatgttaagaaactgaaaacttcaggagtggttttggctattggtcattgctgaatctaagggtttgcataattactgtagggatgtcctcagtccgtggattgttttgactctctttggtgtcttggttttttgttgttttggtttggtttggtttgtttgtttgtttgtttgtttgtttgtttgttttgagacagagtcttgctgtgtcccccaagctggagtgcagtggcatgatctcggctcactgcaacctccgcctcccaggttccagtgattttcctgcttcagcctcccgtatagctgggactacaggcccatgccaccacacctggctaatttttgcatttctagtagagacagggtttcaccatgttggccaggctggtctggaactcctgacctcaggtgatctgcctgcctcagcctcctaaagtggtgggattacaggtgtgagccaccgcaccccacctggtgtcttgatttttattgctccttgcatatagtcaatggttctgagatctgacaggaaatgcctgatggaagagctatggcccatgcaggatctcacttcagaccttaatccttaagtttgtgtctgggaagatggggtacttgattggcaagatgctcgtcacttcttgctcacctctggatgtcaatccacaagttttctttggtatcttcactgtatgaaaaacccaactataatattacactcaagtacacacttataggagcacactttttatatagtttctatataattttcctaccccatctgtcttaggtcagatttcctagggataatgccatgcctgagatgggtgcaagtggtgaattgaaggaatgctctctggacaatgctatagggggtggtggtaatgaatcaggataaggcagaggaaggtatggtttcagggggaaacatagcctcagcctgatcttgtaagaagatctggattattcattgtgccaaggattatttcactgagtcttatccccaccccgtttcatccatctgtctttggccacaaggtgtcccccaggaaggggtggtagccgccttaccccttacctccacctttactccaggcatctctggctaaggtgaatcatgccagccaagtccaaacattcagagaagaattcaggttgtcagcagttagctgcaaacacccacgtcagcaggaagatggttcatcaagctagggaggatggctgaggcaccagctttaaggagtcatagaatggcctggtgtggtggctcacacctgtaatcctagccctttgggagtccaaggtgggcagatcacctgaggtcaggagttggagaccatcctggccacaatggtgaaaccccatctctacgaaaaataccaaaattagccgggtgtcctggtgcgtgcctgtaatcctagctactctggaggctgaggcaggagaattgcttgaacccaggaggcagaggttgtagtgagccaagatcgtgctactgcactctagcctgggcaacagagcaagactccgcatcaaaaaaaaaaaaaaaaaaaaaaaaaaaaagagagaaagaaataaaaaatagtcatagaatgagaaaaaaatctgaaattagagggattgctgtataaataatgacctctgcttgtattttctgagtagttccaattttacccagtcccttctgtctccttagtcttcagcctgaatctcttgcttacctcccctaatggccatatggggaacaggattttattaaggaaacctcgaaagggttgacacaagagtcaaacccccacacctttagatgcataggcagtgaaaccaacctgtacttcccatcttcttgcgtttccatttatccattcctcttggggtccagggtcatagcctctctactgtacctccaacgggtgccactacagtgtctggattctcgatcaccacctcccttttcagtttactgatcaggcagtttcggagaccacgccagggtttcatgtgccccggttgaggcatgaataacagcagtttgaattctcctttgtaattctcatccaggcaagtcactcttttttcctggtataaatgatcagatcgctgctgcagactcatccaggattcctctgccttattgtttttcaatccgtctacttccacgatcctctcttcccaccctccttgccgtcccctgcagccttcatgtctgtgcatacataaataaggctgttatgcacgcatgtgagaatatatacccatcatggtactgtgtgagcctgtgtacgtgctgaggaaatgtaatgggctgtggttgtgtgtttgtaggtgtataataagtttgccgcagactagggggataaatagagccatttgttgattcaaaccaatttttttttctcttgagttagtatccaatctgtagctaagaactgctgactacagcatatttccaagtgtggattttttttttttttccctgacagccaagacctaactcttgcctgatctatgtagatgcattgttcaaattacaaagcttaggtgacagaattgctctttttactgggagcccccaacacacctgtcatcagatagaagggagaatgcagaagtcatcactttacttagaaactcagcagatgattgaaattatttcttactactaattccccttttagtggagataagccgctttgttcagctgtaaatgaaacattagggtattaactgtggagccagaagtattggggaagctaagattttatctgcagtaagaacattttgggcaataaattgttttgttggacggaatactaaatctcttgagttacaaagaagcagagctcattaaggggaatgcttaaagcagaaaacaaggcgagacaaaagcttattacctttgttgtggggattgagggggtgtttgcaggttctcatgtatatgtagcatggaagacttatgcagtacagttattaaatagatgtgtctatagacttgcaaatgctctatgaatatgtccaagggacaaatacatttctgaaatatcaatagcaatctgcaataagttatgaattttggcgtacatatttaccctcaaagactagatttttgtttcctgcgggtgaaattttcccgtctctttgccacatccttcagattaattgactggcatggttacataaatgtttgtaatagagaagagtaagtgccagggttatccaaaatattgtcgcaaaatacacacctaaattaagataattatgtgttgggagcatctatcggcagggcttggcaaggaggggagctttctcttgatggagaggaggctctttctgggacactgaattcatgaatggtgggttctggattccccagggtgctctcagcttgtaagtgtcaggggaggggattgagggctgttcttttgccaataaccagggcggaaggaggacgagaggaagaagacagtgccttcttttccctggagttagcaaccctctgctgtgtctccaagagcaaggctgtggcagtacaactgtctacctgtctacaccggctgctccttcttgcctttggacagaagatgacactcacaaactgtggcccctgagcaacagtgtaaacgggcatacctcagttacaagcggattcaaatgtaatgagaacaatttcagagctatgcattttattcttctgtttttctccctggatgactcagggcatcttttcacagactcccaccctgaaggtttttattgccatttctgcgcttccctacacgtcctgattcataagtggatgctcaggacacagtcactcagagtagcttaatactctgcggacctcacgtgctgagttctcattctggacttaacgttactttaagctcagtttgtacctttccttggttctgtcaatggaaataaggacaacacttctcaaaacacagcaggtgggctgagagtggtgacttacacctgtaatcccagcactttgggaggctgaggtgggtggatcacttgaggtcagaagttcaagaacagccttgccaacactatgaaactgcatctctactaaaaatacaatcaattagccaggtttggtggtgtgctcctgtaatcccagctactctggaggctgaggcatgggaatcacttaaacccaggagacagaggttgcagtgagcctagaagatgccactgcactccggcctgggctatagggtgagactgtcaaaaagaaaaataaaagaaaaaaagaaacatagcaggaaggtagcagtggacaaatgaagtattggaaacacatagcctacacattcatgtgagctttaggagaacgtgaggtctaacttgcttaaagaaaacttagcacatgaaaaatgaaaactatttttttcagtgcatgagtgatcatgatctctttaattaaaagtgcactgaattgtaagatcttttaccaaaatgttaccatctttatcttctatctctggtgctgagtgtagtaacaggaagagatttcgaagtgaagactttagtaagatagaattgtgtgtattgtgtttaaatctggggtgtatttaaaatgtaattgaaatcacaagatatttaacatgctattcactttgcaagtgacttttcaggaccacttatctgcagactgtaggacaccagtctatgaacgttggcttataggagcaccaggtctccagttgagttaattcctcatacttgtcacatagggggcatactaagtcttcctgagatgagtagaaacatagatccacataaaaatgaaaagaacccactggtgacagagggtctcagagcctccagtttttttctgaactttgaaagtcagtaccaaagagtcagaactgaatggaaggacactaaaatcaatacttttcaatgtaacatcacaagcgttgggactctgaagaacttgatgacacatgattcagaagcaaagtgatatttacataggaagactgtcctcgccctctggaatgattttgacatgtgtattcactcttagttttggctcttagagtttaagtaatagatttacggtggtatgaacacaggtgttaaagagttctgggttcaagtcttgtccacgtcccaagctgtggaactctgaataaacctcttagtctattggaaccttagttttctcatctgtaaaacagatgaaactacctgattttttaggccctacttggctcttaaatttctcggctcagtgaacaatgcaagctttatgttataaaccaccaagacatctaagcttcttcccttacggccgttagtggattaagcgatatcctcagagcaactgtttggtgatttaacctcccccagttgctctatttcctgggttgttcatgagtaattgataaagaatttgcaacactaggattccacatggaagaaggaaatgcctcttttggacccatttcaaacaagcattggtaggagatgcctcagacgcttatgcttaaagcatcagtatcattgcctgacagcttatcacagtggcaggagcatagggttgaatcttatgtttttctttccctctgggtgacacttacaggatgcttaagtttgctggacctcactttcttcatctgtaagatggggacagagaactatctcagtgttacagaaaatttgaagatgaggctgaagatgtaagattttgttaatgtctacagtgttaaagaatctcaatatatggtggctatgattattgctattcttatattaacttggtgataggcatcagtggttgaattatctggagaacccagaaaacagaacagatcttgcaaattcagtcgcttacccagatgttagttgtttgatccccagtgtgacaaatgccaccttcaatctctctaacatttctaggcaagaaattattctctcaggagactgccagagaggcaattttgagcttgaaacttattgatgtgatgggctatgaccaggcaacttccgtagtcggggcatgtgctgagtctgactacagtctgactacaaatcccagctctagccccatgtggctgggggccagctattttcattgtggggttagactccctggagggaataattctgagatgacccttttaaaatgtaatccttgtactaaagtggggctagagggttccctattcattcatacggctactgtaacaaatgcccacaaacttggtagctttataacaatagaaatttactctcttccaattgggaggcaaaaagtttgatgtcaaggtgtcaacggaaatagtagacactaggaactacttggggcaagtgttgagtgactgttgggtactctgctcactttgtacctcaaacctcagcatcacgtaatatactcatgtaacaaagctgcacttgtacccccgaatccaacatgaaagttgaaattatatttttaaaaagcaatgtcgggccaggtgcggtagctcacgcctgttatcccaacattttgggaggccgaagcaggtggattacctgaggtcagtagtttgagaccagcttgaccaacacggagaaaccccatctctactaaaaatacaaaattagccaagtgcgatggcgcatgcctgtaatcgcagctacgtgggaggctgaagcaggagaattgctttaacctgggaggcagaggttgcagtgagccgggatcagactgttgcactccagcctgggtaacaagagcagaactctgtctcaaataaataaataaatgaataaataaataaaaataaaaatgcaatgtcagcagattggctccttatggagactttggatactttgagggaaaatccataccctggctctcttttagcctctggtggtgtctgtcaatacctgacatttctgggcttgtagatgcatctcgtccatttctgcctccatcttcatatggcattcccctctatgtcttctgttctgtgtgtcttctaagaatttgtcgatggatttagggctcacttaagtttaagatgaccccatatcaagatcttttaacttgattacatctgcaaagaccctcttcccaaataaggtcatagtcacaggcacgaggggttaagacttagacatacctgttgtggggacaaaattcaatctactgccattttattgtgaactatccttgcatggagaaacagttcattttaacttagaatattcaacaacacaaagctaacacttttctgtgggcgatgactatgtaccaggcattgtgctaattgataaagggcattatattttaaagttttatcttaacaattatatgaggtagggattatggccttctctgatttattgatgagaaaattgaccctcaggaggggaagaccatttttcttagtcacccaactaagaaagtggcacagttggtatcctaatccggaattttctgattctgccatttatgctttgaacaattatgctagaagttctcaaattttgtcatgcataagaatctcctggggttgttaaaattgcaccttccccaaagctcccatctctacagagattccgattctgtaggtagaggggaggggcaaggataggcattaaaaataactgcattatgcaattctgccccctctctcctcccactgaacccatctttaaggaaactgcaacctcagcacaggggctagcagacatattcagatcatctctgaagacagaaatcctcaaaagtgaaaaaacacaagaaagtccaggttgcttttttttaatttaaatttatagtgaaagctaccttggcccacagctttctccctcctggtcccttacaaatatattcctttccggattcttcaagaacacagtttgtattaccatctcccagcaagaagaaatttggaaataggtggtattgctcctaaccccttcctaaatttgagtctgctcattcttcagccatttggaggttttccacttggatgatgtccacagagctaggggaggaaaaattcttctgcaaagcacagtggatgaaccatcagtctgcagtaatccagtcaattaaaaatggatttcagttcccagcagcatggtggtgatgttaggaggagtcagtgtccacaatgctgttggtgcgcttgcccattaagtgatatttaggggatcttctgccatagcagaaaacagtgcggttgatgatctttgcaactaaagaagcaaaattgaagtctcacataccaccacggtattttatttctaatatgttaccctgccaaccttggaaccccgcatgaaactcaggaatgtgaagggacagaagtatgatatattgcccgatgcagctgattcgagagggggtatccaaaatacagtcccaagacatccaggagaatttgcctgaagagagggaacatgtaatggtattagaaaatccagaagatctaagctgcctgatgaagctattttttaaaaaatgtatcttcattgcatttatttttcatcacacagtagttggcgtaaaaccattctctctgtgaaagaagtcaaactacaaataactatgcaaaaatatatagagaaaaaggtgaagcttttcatattttaaatagcatctgaattacattgcttctttcaaggaggtaaactttgttgagtatttagcagttgttccagacttttctctgataaactttcaacttcaacataaaataatgataggtgttttgggaagccatagatgggatggctgtatggatcgatagctagatggctaaatatgttgatagaccctcaaacagattaggtaggtaaaaaatagaaaaataaaaagatagaaaaatagttaacaatgcaagcctctgggcagaagaaatttttccctatgttgtttatgctctgtgtgattctggcaataggtaaatgcattgattagcttctttgaacccacttttcattatctatcaagtagaggaaaacagtgtctttgttgcttgcctccagaattgaggatgacagtgaggtaatgaggaaatgtatttgaaaatattatggactcaacagacatattggcacaactcaggagatgtcataggcccagcttctataagatgatataacctagcacaggaggccaaaagagtttccaaattgcataaaggaaacttgattgtcctttaaaaatggctctggagaaattttatacccaggctcatgtcatctctcagtgaggttaaatctccaaaagaggaatgtcatctgttaataatacatcaagcatgcagcaggtagatgttcttttccttccctttaaaaagttatttttattttattttcatttttaatgtatattttaatgatgcagagtgtcatgttcctcagagtcagactgtatcctaaagtaatggtttggttaaaatatagaatggatttttgccaaattgaaaaatatatatattgtgttataaaactcgagctgtgatgagcaactctttgaaaatacatttaagtactcactgagtcttgtctgaagactcacctgtaagggagggtcaactaagttattcagtcccggacgttgttaactgccctgaaagtggtggctaataatttccttttgaagtgaaaagtagtaagtatgttcctgaactccattatcaatctttaataatttcagattaaggcattgtacttctatacaaaggaatatcatctttgaaaagtggtcttaaataaaatttcacaaataatagtatcccatcctcttgcatttgagaatttctgccgagagataggagaaaataaagactccttgctgctgtcaggaggtcatcgttgggaacagacttcaaagtatgtgaactttggtagtggaaagatgattattccttggtttccagatccttatgcataatttgaatatgagtggctttcaatgctaagtatatgagactcccctctgttaattatgctgtttcagatgagcctaattggacagccactggcacctaatatggtaaatatttcatataacgtgactttgagaagaagggtgcccccctccttaatcccatttgataggatggtgtaacctcaacagcagggatagcttaactctagaaagagttgttatttatctgagggcacctgtaagggggacatcacctaactcattcagtcctagacattgatgcctaaagtataaactgtggtctatagatgtaggaaggcttggaggcaattctagaaacactgcagaaaatttgcagtttctcctccaatctgatcttgaaggaggaggtgaacctggaactccccgttcacgatgcagttgtggaataaaatgaggcttgatttctcctggattatctgaccacttctttttattttcccccggctctatgggggtacaattaacaaatataaattatgtacatttaaggtataccatttgatattttgatatatgtatacattatgcagtgaccaccactctgaatccagtgaaggtatctatcagctcagagttccgttttttggtgagatcacttagaatctagtctctcagcaaacttcaagtatacaatacagtatcattaattgtagtcaccgtgctatacattagacgtctagaattcagtcatcttggataactgaaattttgtattctttgactaacatctccccattccctgctcccttcagcctctggcaaccactcttctcctgtctgtctattcctacgaatttgagtgttttagatcctgcatgtaagtgagatcttacagcgtttgtctttctgtgtctggtttattttctctagcataatgtcctccaggttcacccatattattgcaaatgagagaatccccccccccccactttttttttgcccagtctggagtgcaatggcacaatctcaggtcagggcaacctccgcctcccaagttcaagtgattctcctgcctcagcctcctgaatagctgggattacaggcacctgccactactccatgtgaattttgtatttttagtagagacagggtttcaccatgttggccaggttggtctcgaactcctgacctcaggtgaaccacacacctcagcctcccaaagtgctgggattataggcgtgagccaccatgccggggctccttgttttcttaatagatgaataatattctagtacgtacataaattttaattaaatattattcttttatatatatatataacctttttaattcattcatttgttaatgggtgcttaagttgtttttattattgtgaatatgccgcagtgaacatgggagtgcatatcctgatttcatttccttttattttattttattttattttattttattttattttattgagacggagtctcactctgtcacccaggctagagtgcagtgactcattctcggctcactgctacctccacctcccaggttcaagcgattctcctgcctcagcctcctgagtagctgtgattacacgtgtgagaccccatacttggctaagttttgtatttttagtacagacggggtttcaccatgttagtcaggctggtctctaactcctgacctcaggtgatctgcctgcctcagcctcccaaagtgctgggattccaggcataagccaccgtgcccagccgacataggaatttatttagtgtcaccttgtaggtcactgacctatcagggacaggcctccaagcttctgacatccagtgatagcttcttagaggtgaatgatgacggctcctgttaacattttctggcaggcactgcgtgaagcacttggcataaatgacctccatagataggtgctattatcatttctgcttcacagttcaaaaagtaaaggcttaaagaatgtaaataatttacacctgagtgaccagtacctacacctcagaagagaccctgtctctcagtcatgctgtgctgccagcgttggaaataggtagcaagtctgtggatattaaaagaatgctttttcagaaaaaacaaacaaacaaacaaacaaaaccgaatgcactttttaattatctgattccttgttgtcacgtctttatcaggtagaatgcacaataggttatcattcccttttcactgacgcagaaacagatgtgggctctcctggaatgtgttatgaattgggtgaggggtgccgttcaggatggcgttcctgggtcaatggattttatttccagtgagtagatatgtgggcgtaggtcctcgtttctcatgtctactccctctagtagagatgattttactccacagcaggaaagatgcctgctacaccacaaagggtattatttcggttacggtaataacgcataagggtgtgttttcaaagctgggcagtgcatgcttgccaggttgcagggtgattcttgagagctttctgggcccatcctagagaaaaatctccagtgaggctgcagttgcaatttatttcctcattctagcaagaaagctcttgacgatacagcagtgtttgttttctgcttggtaaagtagaaaggaaaacagcagaaattagcacggcgcagcgctgatgccagcccagaggcagggcctctcctggtagcccccccgctgcaaacctttgccgctggaaagccttcagctgcgatgagattagcagatgcagcagttcactccaaggcgctgtgcagttttttccctgttccaccaggtgttgccagagaacattgagcggagctgagctccgggcgaagtgtgttcccagctgctctggaacactcgggctgttctgaaggcagcaattaaatgagttatgctgaccggagcaaccctcttccttgcacgtttaaatatgcctcccgtgtgcgcctcatgcctcacatttcaaataaacacatttttgatgtgcctttggatctgctcacacattgttatattggaggaatcagagcaagcaaggctgtgcggatccaggctgcaactcaggtcccagctgcacctgtggtcagccttccctgttaccagaaagtggacagtaagcttggatgacacagagggggttctcagtgctagggtttttgcctggtaagtaaaggtagttccttctaacacctgtttcctttccactcttccatacctggagcattgagatcacagtcctaggtctgtgattctcaggcagttgtggctctgtgtccccagggtgcatttggccatgtccagagacatttttagttgtcacgactgggcagttgagggatgcaactgacatcgagtaggtagagcctgagatgctgcaattgatcctgcaacacacagagcatatcccccacaacaaagaattacctggtttgaaatattggcaatagtgaagggaaggggagaaaccccattctggaggtgaaggctttcttggcaagatacccgcattgcccaaaacacagagtacaatctttgaaactgtggtttttccagaaaacctcatctagatcatgacacctaaacatcatgcctcaccaaggtaacatccccaccaaggattaaagaagagttgccatatgccatgggcctactatgtgccaaataccttgttcatacggtttctaatccttacagaaataatgttgagtgggattactgcactgcgttatagaagagtaaaccgaggcccagagctcttgctttccttgttcagaatacctggctactacgtatgggagccttgttttcatccagtcccttccttttactgtgtcaccctgtggcccagagggtggatggatgtgggtttccaaaagaaaacctactttcgaatcttgcttttgagtggacagtaaattagagagtgatgcaaaaacatttagaaggaaaaacaattaaaaaatacaaactttccggaatccagtgttggcctgcctctaaaactctctgccttccaaagtgaccacgcacccacatggcagattgttacctgacaccttctgagtcccttttcagttactgctttggcaaattactacaaattccgtggcttacaacatcacagagtgactctcttagcgttccagaggcaaaaagactgaagtaggtcttactgtactaaacttgaggcttctgcagggctgtttcttctggaaatctaggggaaagtccatttccttgcattttctagtttctagaggccacctgctttccttggctcatggccccttcctccgtctccaatgctatcagtgtagcattttcaaatctctctctgtctctgcctctgcgtttgtatgtcctgtgatctcttaaggacccaagtgagtatgctgactaaccctaagataatcaaagataatctccccatctcgagaccctgatcttaatgttttttattttcataggtttttgggggaacgggtggtatttggttacatgagtcacctttagtggtgatttgtgcgattttggtgtgcccatcaccagagcagtatacactgaatctgatttgtagtctttgaatcacatccataaactccctcttgccaggtaaagtgaggattaggacatgagcatgtttgggagaaggatgttactctggctaccacaggtagtttagagctgccactgctagggataatgggaataaagtaaaggaaaagcatagaattttgacttcaagggatttgtatgggtgtgtgtgtgtgtgtgtgtgtgtgtgtgtgtatgtgtgtggtgcagagaagaatggcacacagcaaaaagaagccatgatactaattattctcagacaggtatgattatcatcaatcatatgcatctttgtatccccagaggctgctatgttgcctggtaagtggggtggtaggggcacagtttgtatttcctgtgttagtttttgtagggaaggtaagagcagtgttcaatagaaatacagaagaaagactgcttattatagcaaccaaaatatggcagcatacctattatcttaattgccgttaacattcaccttaatacaatgctggttgatatgcagaataataacctagagactgtgcaagtcttcacagtgccttctgtatcttcatagattcagtctattccattacactctggtgttgtacaggttttcatatttcactgggggtgggaaaactatggccctgggacctaatctggcctgcggactattttcctagacagaacattatgggaacacagccatgcccatttgtttaccaatcgtgggtggctgcttttgggccgcaatggcagaattgaataatcacaatgaatgtatggcccacagtgcctaaaatatttattccgtggctctttacagaaaaaaagaaactgataacccttgctttacacaactggatgctggcaagctcccttagggaggacagaaaggttgattaaccagaacacaacactctcacaacatgggggtcagaacatacacattctttgaattacagtatttgtgacaacctcctattgaacgtcttactgcaaataataaaagtctcaagttaagggagactgacactcaaatcatttagatttttttttctcagctatgtttagtgagataaattgtgcttcactgcagtgacttgtagatgacaatacagcagaagaacttttaatacggcgactgtattcattttgaaattttaaaaaatgttagactgtgtctgagcacagtaaaccattcaaaactgtcactgcacagagatgaatgggagaaacagtgcatctctgaaaatattccgtaaatatccttaaattataacgtctgtttgatctgctgagaagtagctaattcccgacacttttcatctctctagactgcccatcgattgtcctgagtattgcgattgctgttcctgataactgacttgataatttaatttaataagaccttatcttggtctagaggagcaatcaaggctgctatctcctacagcacgtttctccaccattgacattttaggccgaacatgtacttttttgttataggtagacatcccatgcattgtaggatattgaacagcatccctggcctcctatccactttatgccagtagcatcccctccctccttgttgtgttgttactaccgaaaatgtctccagatactgccattgtccctaaggcatgggggcaggggggtggttaacatattccccagataagaaccattgttctagaggtatggtgttggaagcgcttggcacctttcatgtaaatcattgcatgttgtcatcccaggtgaacttttcttcttttctttttgcatccccgcccgtcaattcttcccctactttctcctgggctgggcttttcttcatgtctaaatgcactgcaaagacgagattgccttgaactcctccagcttttcccgataaccctgagctgcgctgtcgctctaagccagatcagcagaatccggcctgtgatcaggttccgggagctggaggacctctccgtctcaggctgctgtgatcagagagtctggagaatgagaatctctctgatgtggtcttatcaggctgagcctaatgtcaaccctgttagaggagctttgtccgatctgcctgtagctttgttctgaaccgttcagtaacagttcactggagcagaaagagccctgtgaattgatattataaacccacatgcctgttttattcattgtggaggcaacagaatataacacaagtatttatttttagtggttggagaatggcatttctttccccgtccccattgtcacagaatgcagaaaacagcacagggctcctgaacacaattctattagaaagctgttgccagttgttcctggtttcgattattttgcactatcctaagcagtgtatgtctgtgcattgaatatgtatgtgtgcgtaatacatattacgttcgtttggatggtcttaataaggagccacataccatcagatgtaatccaatcactataggccagaccttctatccttggctattcccttaaccccatcaccaccttgatttcgttggaagttagattttctagaaaaattcatgaaacttcaacatgcttcattcattccttgctctgggcattccttgctgaaggtcaggagctgtgaaatttctctttagtcccattgctttgatatggcagaggctgggcaatgaagaaattgaagtgtggaaaaatggagttccggcaatgtcttaaatgaggggaggggtcttatcgaggaggctgtgcctgtggtctgagctgacatttctctaacagtgagaccaggaagaggaccaggggacacagctggatggctgcaataccagggtcccttcagctgcaattaaagctgcatcttacattggagtcttcagtgatgatgatgatgatgatagtagtagattgaacataggaaattgctgtcatttgacaattgttaacctacataaatgtcactttcctacagcgcaacttaataattgtacacataatagctcatctgcgctgggtgaccgctatggtccaggcacagtgctgtaggcactgcatatgtgttggctccttagaccaacacagccactgtctattacagatactgttattgctctcacttgacaaataaggatgctgagctgtgggaataatttgcccaatgacactaaatggcaaaactgggattaaaacccaggaccttaagactgcagcctcggctgagcgtgatggctcacgcctgtaatcccagcactttgggaggccaaggtgggtggattacatgaggttgggagttcgagaccagcctgaccaacatggagaaacccggtctctactaaaaatacaaaattagctgggagtggtggtgcgtgcctgtaatcccagtaaggaggctgaggcagcagaatcacttgaacccagaaggcagaggttgcagtgagccaagattgtgccattgcactccagcctggacaacaagagcaaaactctatcccaaaaacaaaacaaaacaacaaaaaaacaaactgaggtctcttctgttaacccctatcctcctctcttggttggataacagttttagactgatgctcctaattcccacagaggggcctgcattttcatcaggcttgaggatcatgagttttcacgtgtgtgtgtgtgtgtgtgtgtgtgtgtgtgtgtgtgtaaatcaccctaattgtggggagtactaataagttccatcgatctactcttcacctagtaatcaacttgaattatttatttatttatttatttttcgagacagagtctcactctgtcacccaggttggagtacagtggtgtgatcttggctcactgcaccctctgcctcttgagtttaagcaattcttgtgcctcagcgtaccgagtagctgggactacaggcgtgagccaccatgcctgaccaatttttgtatttttagtagagacggggttttgtcatgttggccaggttggtcttgaactcttgacctcaggtgatctgcccttctcagcctcccaaagtgctgggattacagccaccacacctggccaatcaactttgaattctaagaatgggtgacaaagaactttgtcttgagggttgtgtgttaagcaagagccatcaggtctcatcctcctcagtttagccacaattccacattagtttccccgacagtgtatggaatttcagttctacactcttccttctctaaatttcacccggtctttcagagaggagacagggccctaacagacttagcaaagatgttgaacacatgaaaatgggaagtactgtttaaaaatggaataactcttttcttcccccaaatctataaccccagtctaattgtaagaaaaacatcagtcaacttccagttgagggacatcgtgcaaaatatctgactgtcaaggtgatcaaagacggggaatgtcaggccaggcgtggtggctcacacctgtaatcccagcactttgggtggccaaggtgggtggatcacctgaggttgggagtttgagaccagcctgaccaacatggagaaaccccgtctctattaaaatgcaaaaattagctgggcgtggtggcgcatgcctgtaattccagctacgtgggaggctgaggcaggagaatcacttgaacccaggaagcagtggttgtggtgagccaagatcatgccattgcattccagcctggacaacaagagcaaaactcctttcaaaaaaaaaaaaaaaaaaaaaagatagggaaaatctgagaaactatcacagacaagaagaaacttcagagtcacggccgcccagatgccatgtggtgtctcagatgggatcctggagccgaaaaaggacattagatgaaaactaaagcaatcgaagtataggctgtagttaatcgtgatgtattcatagtggttccttagttgtgaacatgtaccatgctactgtaagatgttaataatagtgaaaattggctggacaccgtcgctcacggctgtaatcccagtactttggaggactacctgaggagttccagactagcctggccaacatggtgaaaccccatctctactaaaaatacaaaaattagccaggcgtggtggcgtgtgcctgtaatctcagctcctcatgaggctgaggcaggagaatcacttgaacctaggagctagaggttgcagggagccgagatcgcaccagtgcactccaggctgggcaacagagtgacattctgccaaaaaaaaaaaaaaaagttaataataggggaaattgtggagtacatggaaattctctgtacaaacttcacaacatttctgtaaatcgaaaagtatgctgcaattaaaattttatttttaaaaagggaaaataaacataagcccacacaaaaaatatggactaatcaaatactttctagatttcgtgtttatagcgtttctcacttagtaatacaaagcattctatcttagatttctcccatgtctgttagactcccaaaggcttttaccccatggtaaacagcataaacaaatttgtatggcttttttaaattcagattttcccaggctgatttaatcatggaattacgactgggcatggtggctcacgcctgtgatcccagagctctgggaggccgaggcaggcggactgcgaggtcaggagatcgagaccatcctggctaacacggtgaaaccccgtctctactacaaatataaaaaattggccaggcgccatggtgggcgcctgcagtcccagctactcgggaggctgaggcaggagaatggcgtgaacccgggaggcggagcttgcagtgagccaagatcacgccactgcactccagcccgggcgaaagagcgagactccgtctcaaaacaaaataaaaataaataaaaataaaaataaaataaaaaataaaaaaataaattatggaattattttacttgagaagcagtgatggggaaaaaaaatgtaggtcacaagcctccctgatgacaattcctttcataacaccagcttttcccaggacacaccattgagacaccttgacatcactacccagaagcattggtaacctctttgtgcctcaacactgattctcgcctgtaaaccattcctctcccctggccaccctcctgcatctgaccccctgcctcccttccccagtcttcctctgtagcaatgggtcccacacatccctgaatcacttgttaaaacctagatgtccagccttgacccccagagttcctgattcactgggtctgggatggggcccagaaactttgcatttctcacaagatccaaggtgaggtcaacactaccagcctggggaccacactttgcaagccactgagatgccctctgtctccttgtaaggctgccatccattccgccatagattccacgctttgctgccacccccctgccccctgcctgcccctttgcttgtcctcttgctattcccaggcactggttgcctgttttctaacataaatgtcaaaaaagtattcctcagcgggtgtggcattcagaaatggataggattcaaacaagcaaagggggttacttggtttaagagctcagtttaatgacaagagtattttccttgtagctttgtagagctggatcccaggtacctctcatgaagcccatgaacttggtttctaccctataaattgaggttgatgagactcatcactttggcttttgcgaggattaattggatttgcattcgttaagtgcagagcctggcacattgtaacagctcattagtaattactttccaaactccaaggagatggttctcagatgttggtgactatcatcacctcctgcagagatgtggaggtgcagagtcctgaccctgcctccaaagactcttactcatcaaatttgggagtgagataagaatctgtacatgttacaaagaaaccagaaaatcccaattcaaggggtctacagacaatccattcattcgttcttcacttagttatccaacaagtgtttcacatacacttccatgcaccaagatgggattgcaggtggtagggatacagaaatggacaaaaccgagtgctcaccttggtggagatgattggcagcctgccttacacaaggaactctatgttcactggccaggttatgggaagtggtacaaagttggagtaaaagtaaggtaagaagatagattggtggtcaaaagtctttctgagaagattacatgagaggaaagatggaataaaggaagaaaaatattgaaaaatcttcaattaaaatgtgattctttctaatgtgagccacagaatttaacacagatctgtagtagtcatcttgagtgtttttcttttgatagaaaagtgtgactttccaaccaatatagtaggaacttgttgaaggtctaccatatcccaaacacaatgtttttcaaatattgtttttattttattttatttatttatttattttgagatcaaagctcactctgtcacccaggctggagtgtggtgatgcgatctcagttcactgcaacctccgcctcccgggttcaagcgattcttgtgcctcagcctccagagtagctgggattacaggcgtgtgccaccatgactggccaatttttgtatgtttagtagagatggggttttgccatgttagccaggctggtcttgaactcctgacctcaggtgatccgtttccttcagccttctaaaatgctgggattacaggtggtgagccacggcgcccagcccttatttctaatccctgtaacagattatgcaagggaaggtgtttcatcccaacattacagatgaggggagttgtgaggagcttatatgatcacatagtgaatggccaaagatggctctttctatactctacagcctctgacatacaaagattcagacttcatttccaaagtcattagcagtaccaactgtaatcctcttaaggaactaattattttgttaccattttctgtatttattatattgccatgccccatggcttacaatcctggctgtgccttcaaatgtcccagaggcaggaactgagtgtctggggtattaaggttttctcagatgatgcatctgatatgcatccaatgacaggtaccactggctagcattataatccaagataaatccatatcttctgcctgtggaaccagatggagttctggtatcaaaatacagatctagagggtagctctgagccagtgcacttgaagtttgtggtcatgatgaacttcaagctcatgtaagagattactgaatttcccagcaatgagtaacggaccaacctatggagaaggcagacagaatggcaatgtggaataagcacaggccctggcatccaaactgggtttgaaacccacctgtccacttttctggctttgtgatttggggtgacacacaaaatttataatatacgtaatattattaagaacacagtaggttcccagcattgtattctctgttctctctcttaaaagtgccaccctctaccaagaagcactagttgaattccaagaaggcaagaaaagggctaccatttcttctctacccagcaatggttacgttaattttccagtgcaggaaagtggaagaaaataagagtatatatatatctttccaggcccttctttccaaagttatttgactctaaacttagcatcctctcccgggaagatggaactgtcctttttgtgcatttgctgtgataactttgggcccagttacgcttgctacgaagcttgggctggtagtggtttaggagaaaaaaaaatcaagtgaaacttaggactgtcttctctcttctttcccgaacttcatctttgcagagatgatctcctctttgacatgcagagtactcaggcctctttttctcttcttgtcctttctttcttattaaacctccagccccccaatctgaaacgattgctcccattttgtattccatggagctgtaatatttgcccaatgatgagctccattcagcagtttgttaactgaaatgggaagtgacagattcaataaaaggaaatctctgtgccaaggaaacagatattatttctcccctcgctctccctttctgtgtctctcagactactctgtgcccggaatccagagactctgagcttacggacaagtcaaagctttctgttgatccatgcccaactaatttgatcagaatagaggtttttattccctgtagttcttctctctcatgcttactgatatgattgagtgcctgggagtcacccccaacctctgctgattgttagagggaggaagtgatgtacaggaaagtgggtacatggtgtgctgggaggggggccttgtagacaagatggggacaattgtaaacagaagatcggggctaatgtaaaagtgcaagatcctcttctggggacagccttcttgtcttcatggatagtgcatatagaaaagcacccacgattcccagtcattgaaaaccagaggaccccagtggcaatggatacccatttaatctctgagaaaatattaatgagtaaaaggcaagcgactttagggatgtttttttttctttccacatatatgtggacactagttgtgaataataatgacaatgacgatagtgagtagatatcatgtatcaactccctactaaatgccaaggtttggtctatgcacgtaacacatattatctcattcaatccccgacaacaaccctctgaaggaggtgtccttattatccacattttatagcagaaaactggggcttagagaagtaatgtgtccaagaactcatagctggcaggtaggagccctgagattccagtgtggggctcgtaaacttacactttgcctaaattttttttaaatgattgagttcattgttcatttatatttaattttaagaaatagcacaaagagtccgggcatggtggctcacacctgtaatcccagcactttgggaggcggaggcgggtggatcatctgaggtcaggagtttgagaccatcctggccaacatggtgaaaccccatctctactaaaaatacaaaaaatactggctgggcgtggtggtgtgtgcctgtaaccacagctacttaggaaactgagacaggggaatcacttgaacctgggaggtggaggttgcagtgaggtgagattgttccactgcattccagcctgggcaacagagcgagactctgtgtcaaagaaaaaaaaaaaaaagagatgaccccatatcctgttcccccagtttccccagtggtaacatcttatataaccaaagtacaccaccaccaccaggaaactgaccttgatccaatgcatccgccttattcggatttcaccagcttcacatggtattgtgtgtgtgtgtgtgtgtgtgtgtgtgtgtgttcacttctctgcaatgtctcacccatgtagcctcctgtgatagccaccatagccaacatacatcatagctccatcacaaagatcctaggctctactctttcgtccctgcagtgacctccctccctgctccatatctcaggaaaccttaatgtgttctccatctttataattttgtcatttcaagaatgctatataaaaagtatgtgaaaggcttcatgttggtcaccctctgtgcatgtgtgtggttgcagaattagtcctcacacagagcttgattgtctacttcacttcttgacgcactttcgttcctctgtcatctcccatctcccttttcctgcagatgtattgggttgagacttctggattaggtaccctgttggccctagtatgcagcctatcacccaatcaccacaaccaccctcatcccacagatgggctccagatgtcactgtgtggaggtcctctatagattttcagatcacattcagtcactggaggccaagacactccctgtcactctctgcccaaccctccattcctaacctcacctctcccccacggccaacctaggtccattagccatgctgagcttgaggataagaggactagtttccattgctggtccatagtttccaccccagaagcctccatgccccatactggttaaaaagttattgcagaagaggtttgccagaggtaaaccaggtcttccagagtataccagaaaggactgcatgttgtctgtttgagtgggggacttcatgcccaattttcacagggcaaagcatctcctggtgtcttgtgtggcaaacagctttgatacttgcccatgtcccatggtgtccaggagacttttcattaaatgaggtgaccactgcccctttagggcgtgagccaggcatctgagatggagattacgcattctgtgtctctgcctgacacaacatttctgttttcctgatggcttatctgatgccattaaagtctctacctgtaaatagtcagtagacattgggtatgaaagacccaaacaatatttggctgaactgttcgttgccacagagtattattagattagattggatcttagatattgaagaatttttactcccttacttttgcaaacctggaaaaaaaattgatgctatctgctctctagaactaatactttatggtcttatcctcttttctcctctctctcactgtgtctgtgtctctatctctgtctttctctgtcttcctctgtctctctcacctcttttttctcttctctcctctaaaggaaggcattgactcttccagagccactaagagtcgaggtttttttttgttgttgtttctgtttgttttgttttgtttttgagaaagggtctcagtctgtcacccaggttggagtgcagtggcacaatcagagctcactgcacccttgacctcccgggctcatgctttcctcacacttcagcccctggagtagctgggactacaggtgttcgtcaccacgcccagatagttttttttgtatttttactagagacagggtttcgccatgtttcccaggctggtctggaactcctgggctcaagcagttcacccaccgtggcctcccaaagtgctgggattacaagcgtgagcaccaccaccgtcccccacccccagccaagagttgtttttatcatgtccttagtcttgttggttgctgccttgtccctttacctgttgttcctcttcaatcattgcaacagtgacactccccttagctgggcatcaaacacagacagaagcatattcaattccaggagtctccactgtctctcatctgaatttaagctggacacctcgcttgtgaatgcagaggggccagcatcccactcccgccttggcgcaatgcaaccggcacctttgagggggcagattgtattgtgccttgtcaggcccaccacggcttttgttttcctgcgcatttgaataatacatctgattaccatggcaaatgttgcggcatatgcaagcttggacctcctgcctaattagctgttgataacagggccccctgccctttcccctctccgcagccctcagggacatgacagttcttttatctttcttcaaaattgacttgctctcccgaccctccagtagttcctgttttgtctgtttacctctcctgcattttgcaagactgttaattttccgtggcacctcctatctggttgtaattaacacatcgcacactgaagaaatagttctgctttttccagatgcctaatggaggcatgtccttttttttcttttctccactaattataccactgtattttagcaacctgcattgacctaaaaggatctgttttctttctttcttcctttttttttttttttttttaattgttttggttggaagaataagtatggttttagaacccagtttgggcagaaactgggaagagaatgaaatcattagtgatatatgttgtcactgtttcttttcatagcctttaaagtaacaaatgagggtacatttgttgtcagccttcctgttcagcgtttgacaactctttgttagatgtgggtaacgtttgctttggatatatgctctctctccagtctaaatattctgccgtggtaattatacagatggggcacatgacctattccgtagagtgtggaaattctcagcagattgtaaatagcctctcgtcctattagattttaaggaagctaagcccttgcctcccaaacatgagacatggaatctgtttatcatcttatgcttaggcttaagatttaagctgtaatgaatactggttcaaagagattgaggtataagaaggaggttggtagttacagcaataaaaacaggagcaaaaagagcagcttttgtgaaggactccggctggaataatgatgatagaattgtctaaatcgatacatctcttgtcagactcatgtctgatgtttgaatcaaccaggccttttctgcaagagctttcctcaagaatattgaattatttattatttgtatctttttttttctttccctttctgatgattttttttccttctgacttagtgaaatttgtttttcatgctgccaggttgaatgttgtctactctttgataaatagcagtaattgggcatatagcaggggtcatgtacaaatgtatgacttcaattacatctagagcatttttttctttatattgatcttttttttttcttataagatctgttctctatagcctgtggtactgagtactttaaagaattattctttgtccatgtatgtcagcatgcactttcaaatctatatatcttttaaaatatatatatatatacacacatatatatacatatatatatatacacatatatatatacacacacacacacacacacacatatatatatatatgtagtcctgcgctttcctgaggctgtacagacgtgggaggcgaaattgtgacgcctccacttgatgaaccatacctgactcttttgctcatcttgcagtcttgtggcggtgtcatttctacggttggcttttcttgctacaggttgggccaaggtggagaaggcactggtattgaccaggaaagttgtatgtaatagaaattgtagagcacagtaggagaagaaaagtgaaatgaagtagacatgggaggcagaaagacaaagagagagagaacaacctatgttgtaattgaagcttaagaaaataccatccttggacactttcttgtttctgattttatctaagtatcttctggttgattcttaaactgcatgtatttatggcacatgtatttgccagtttaatggacacttttccatctaggactgtttatattcaggcacccatacgtacacatatttccaagggtaaataaacaccagcctgaatgtttggtgagattagctttggcaatagtgacatttcccaggcacagccaggttttctaaggcaggaatctgaggtctgatgatattactgctctgagcgtacctaacctacagtttgaggaaataaaaggtaggttggaagactgccgaggcccccagttggctgctgcttccagagactgcaggcttactcagtgcttactgtcccatttccactggcctggagatggcctttgccaaagggcagtcatagaaataacaactccacatcattccttgtttggttctgcgtttctgtaccatggcatcgtgctgtcgtcagcagttttctgacatgcaaaataatgatggggcactgaattatattttgtaagggcatgcaaatagagagtgttcatttcttcagcctttttgaaggagaagtgagcccttaaaagtcattttcgggtaggaagtgtacacacattattttatgtcatgcccagtccctaaagccatatctgttccatatttttcagagggagaaaatagaataaaaaccctcagaggctctgagtgataaaggaaacacagtctcagttattatgctgtaggagatgaagctgggacttaaatagacaaagagaaatggagttggctttggtcgagcctgtgattctgggccacatcgtatttctgtgtgtatgtttgtgtacgtgtgcgtgtgtgtgcgtgtgcttgtgcgagtgagaaacacttggatagaactgcctctcccaccagtaggctgttaggcacggcactcagaaacagccctattgttttagatttcctttcatatcatgtaggcgtctataccatgccacccacacaggagagcaagtgagctgtgaaatatattcattgttagagtactggggaaatggcggcaagcaatcggaggtaataatgtccgacaggcaagggaggctgccaacattacctgcattatttcggttgcctttttcattataggttcgggaaataggcagcaattcgattatggcatgatttggggtggaattgcttgcactccgtgaccccgtcactgggggatcaaatgagaagtcaaatcaaataaagttcatagtgcattaaccggatggagcagtgccttacccactcagcacgatttttcatcttccaggggtttgtgactgcagcctagatatctctgcaccttaaggcatggggaggattggctgagatgtataggagtgaggagaggcggccaatagtgtgcaaacccctcccctcccatgtgtagcgccgagtttctctgcagcttgagcaaagcagtgtgattaataacaaggaggaaacctgcttgttggattattaatttcccatcccctttgccttattttttttctttgccatattcctgatgctttttcttctgcctcttttctttttgccatttgctaaagcctctccacccctccttttccctcctgtggcccacacttttgcccatggagatatccactagtcctttacactgacacctggccacccaacctcgtgccggctggcttcacacctggggtgagtttatctcttcccttcggggattctgtctctgaaactaggagagagagaatgagggagaaagagagagagagagagagagagagagagagagagagaatatgaatatgggtccagtggtgttggagccctgctgtattttaatcatagacttggccttcttttaggagtgacccaaaaagcaagaccagttcgtggggtacctgtatccaaccccatttcagctgctgtgtggaaaagtaggatttctcatagttaactgattaggtattttctcaccagttctaaacacaaagagtgcatcttgcaaaaatataaaaagttgtggggggtgggggtgcaggcaggggagataatgactggtaattgcaagctgtcatactaaaagatatttggggtgcaagagttacttctgccagcagaatggtagaatggaggaagggggagatttggaaggctttggggtagcttgtgaggggaggtactttgcattaaaacttctgtcaccatctgtactttcgatttcacagtcctaccctcacactactggaaaggagagtttcatactgactgtgggcacaggggagtggtttgcaattgcagcttgtgctgtttatatggtgcatgtgatttggggaccttctgggttctgattcgctgacctgcccagaggaggaggctgggccactttcttttccacattatgtattgcacacctctgttctgtgtctctcctcacctgctttgaaggatttctttccctctctgcaaatctctcccctcccgtaaatcagcatgattaaatagcagaagggtggaggtggcgccatgcattatgcacatgagctgtctttaccagcctgtccatatgtctgaaggaaaccttgtgttttaatcccaagaagtcaccttttttgaagattaccttgaagcatccaaaagctaataggatggagaactaaaggcatttgacattaattgttctgtctatttatataacttaagcacaaggcagcgaaaatcttccaagctgattatttctttggtttattctgagtctcttttttaagcattcagagcttcttaagtaatgaatttttaggaaaaagagccatgcaatgataaagtgactccagtagcagatttttgtcattttttttaaaagaagtgctcaaatagggcagccatgaattttatttgtgtaatttacacttgaatatgaatatatatatatacatatatatgggggtgggggtctagctctgtcacccaggctggagtgcagtgatgcaatcttttctgactgcaacctctgcatcccaggttcaagcgatgctcctgcctcagcctcccgagtagctgggaatacagaagggcatcatcacacccagctactttttgtatttttagtagagacagggttgcgccacgttggccaggcaggtcttgaactcctggcctcatgtgatccacccacctcggcttccaaaagtgccgggattacaggtgtgaaccacctcacctggccatacgcttgaatatgttttattaaatatgagattactggtaaggacttgatgtttacatcatagctgttcacaaggtacataatgcatttattttgtttcttatgtagtgcccaggataagaaggaaatgaaagaacctatggaaggggatacaatttcagctttgacagtttgggatcatagtattatcctaaaagcaagcaaacaaacaaacaaacagtgccagctgaaacaatcacataatcacctttctagttattttttcttcaggttctgggtctccctctggaaataacaggtgttattttgactgaatgaccccctactgaggtaaaatttggagcagaatataatacaaattatattccaaaggtgataagatacttgggagtttgagcaccaagaagaatgttatcttagagatggtatgagtataatacaagttggcattattattattttgacataaaagggggaaattattgtaaatctcagtgtgttgtctgtatcaagtactcattttttaaaatatgttttttttccagggaaaggcttatactgttgggaaataatttcttttagacatttagagaaaaaaatgtgaaaattatgttttgaagtgcatttttgctgtagaatgctagaagtccattgttgtttaatgcttcatttacagcatgcggatttacaacacactgaatgagagaagtggggtttaattttttcactatgacttcttataaacccgcaaggggtctatttgatgagtaatagttgagttgacttttacctacgagttaccttctccacgtcttcattgcttcatttttccctcaaccggatcatgtaatagaaaacttcctcaaaacctgttcctacttgagaaatttcaaaggatggaaacccttctttgaaggacttaaaattacatttatatcaggatgaatcatgtttcgactttaaatatcaccttatttctggcggtctcttttgtttccaagtggcaaatgttccttctgaaattacatagtttcctcttgctcattctgtttctaaacttctctggataaatgtgtgaaaataaatgaaattgttaagccctgagaataagcttggaaaatagaagttatcctacctgggcaaaagctccaaacattctaggggggatagagacccctcctccctcttttaacaaatcctcccttgaactggggagagaaaggatcgccttccaggattttttttccctgacgtgtaacagttcttaaaatactgccttgttaatttgtttctattttacatgagcattatacaaacagtgataaacgaaatgtatcattttttccccataaagcctcctcccagattctcctcagtgtttacagaaatgtgctgtatccatgagctcagatcaattgtttatacacattggtgttcatttgttcaaggcggcatctgggcctcggatgtcgggagagacccactgaggcaaagcactattaatagaaaggcttatctcgtttaagggagtaatcattttaatatactcaggaaaaagccagcgtgcaggctcttggcccacccttgcctaggcagggtctacaccttccagaagcaaacacagccgaaaagagctcttaaagaagtgattacagagtcatgattgctctacaaattgagtcttttttctgcttgacagtgatcctggcatcgtctccccgcttaatccttactagcaatttgcctatagttgcagctaacaagaggtgattagaggggagttgccagtcaccacttaacacccagctctgggggcaccatgggcacaggctgccgaattgggcctgttttcttattaactccccacctctgaatgcattagcccagctcttagctaatgatagttttcaagcaacagcgtgagttcctgagcagcatggtgatctgactctccagcatgcagctaggaaaattaggaaggagagggagaaagcatgttgttcttcaaaccaaatagatgcgccaagggagaggatctcccccaataaaattaggcgcacgctgtgctgcgtggctgtcttggtcttggaggttgtgggttgacacaagaaggggacatgatgcgttgcatattttatctgtcctgtggaaggtcctgagaataccaacagcagtggatcttgggttagaagctagagtgaagtggtctgcagacaggagactacacctacaggggtgtaagcagagaggcaaggcaggctgtctgggggacaggtccttggttatcatacatgagggtgcatcagcattcctgcacggcttgttaaaacctctgagtctgtggcagatacacaccatggaatactatgcagccataaaaaaggatgagttcatgtcctttgtagggacatggatgaagctggaaaccatcattctcagcaaactattgaaaggacagaaaaccaaacactgcgtgttctcactcataggtgggaactgaacaatgagaacacttggacacaaggtggggaacatcgtgtgaccggggcctgtcatgcagtggggggagcggagagggatagcattaggagaaatacctaatgtaaatgacgagttaatgggtgcagcacaccaacatggcacatgtatacatatgtaacaaacctgcatgttgtgcacatgtaccctagaacttaaagtataataaaaattaataaaataaaataaaacctcgagtttctgattctgtaggatgtaggacggggccaagtaatttgcattctaacaaatttccaagagatgctgatgctgctggtctgagaacccccaagtttgagagcccctgctgaagttggacaggcttggttttgcaaaaatgcgaaacgtaccaaatgtaccctccggtgacttgcttaacaactgtgtgtagctctcccagtgcagaagaaaatccccagtctctaaccaacttctgagacattaggccatcctttcccctccaattttaccttcccttgcccaagctaatttaactctttctttcttttcttttctttttcttcttctttttatttttttttatttttatttatttattttttttgagatggagtctctctctgtttcccaggctagagtgcatggagtgcaatggctggatctcacctcactgcaaactccacctcccgggttctagtgattcttgtgcctcagcctcccgagtagctgggattacaggcatgtgctaccacgcccagttagttttcatatttttagtagagatggggtttgaacatgtttcccagcttggtctcaaacccctgacctcagatgatctgcctgccttggcctcctaaagtgctcagccaccatgcacagtcttaatttagctgtttcttgaacatactccgtgcccccatatcagatatctttttacattccaagaatgtttctccctcctatttgctcatcctaaaagttcttacctgtcttttaagttgtggctcaagtattgcctcctccaggaggccccagctgcatttgtcatttcctccaaatctgaactccttatatgctgttatgtgatggatgtatcacgttgcatgatagtgcttacgtatcttttcccctgaagtcaggaatcccttttattcatttagtttctccaacacctagcattgctattggcatatcgtcactgcagtcaactttttttgttgaataagttttgtatgagatatatttgacctatgagaattaatatctttttttttttttttttttttgagacggagttttgctctgttgctcaggctggagtgcaatggcatgatctcggttcactgcaacttttgcctcctgggttctagtgattctcctgcctcagccccctgagtagctgggattacaggcatccactaccactcctggctattttattattattattattattattattattattattattattattatttgtagttttagtagagacagggttttgccatgttggccaggctggtatcaaactcctgacctcaggtgatccacctgccttggcctcccatagtgctgggattacaggtgtgagtcactgcacctgaccagagaattaatatctaataagcgaagaccaaacattggagtcagacagcttacatttgagtgttcacacaatgatatatgtggatttttctttctttctcttttattttggctttgagggcaattcacttcccctctctgagactcagtcttactcatctttataatgggaataatgataatgataacagtagtagaagtagcagcagcagcaacagtagtagtgagtgacactactcacatctgcacatgtaggtcgtaaagtacaacacagtacaatgcctggcgctctgcaaagaaaaaaagtgtatcaacagacaggaggatttctattgttgtccttgattctactgtgagacgtccacactggtggaaaggtgacctgtcttgtggaaatgaatgtgtggaagtggagaggacccgactccagagctggtgggaaatcgagcggcataaggcttttctgacatctcctgatgtgaacactgtgaatataatcttgtgaaccagagcaagtggaggggacatctactggacagaggcacagcaacatcctctctctggtcaccccttccctgctcacccatccccggccatgctggcttcttcctcctgctgaagcactcagggatctcaaggacttggcacaagccatcctgcctctccttccctcacccccttttcattcatcagctgttgattttggtgtcaccgtcctctgagaagccttccctggctagcccatcaaaagtgatcctgcccagccaacttttattctctctgccagcacactgtacttttccttcatcacattcatagctgtctgcaatgatattaccttgaattttagtttacagtaagcttcaagagaacaggaagccacctattttgtcctctcatacacccagagcctagaatctagaggaggtgagcagaaaatagtcgtcaggtggatgaatacaggatgggaggaactgataaaaactgccatataaccatcatgggacatggcaaaggtagataatatatcttttcccttgggaatttacaatttttattgggaaaagtgcatgggtagagtatcactcagatatttctttctgtgcttccatagaccctattatttccctaacagcaaactctgcctttccattcttcattactccaactaataattattgagatatactatgtattgcacactcttctagaagctgcagaatgtatcagtaaacaaaatacacaaaaatctctgcctttgtgggacttgtgacagtgttgcattgacctacttactttctccctgcaatcattgagtttctcttggtctagggccatttgtcatcatagtttttccccagctcctaacatgattcttcacagagagtacatgctcaaaacaaattggcggaatgaattgatttttaaaaacttgttctactttcttgccactaagtctataatccaaccaaatgagcttatcattaatctagcacatttaaatatttttggataaataatgttccattggcccacagtaactattccagcctcatgtcttcactcatagccattccctatttcgaaaattatttattgttttgttgtggtggtggtttatgcaattcccaaaagcaaagctgcagcatcttactgctgataatattttgaaacaacttccttctttgaattaaaaatggtacccacctaggctgggcgcagtggctcatgcctgtaatcccagcacttcgggaggctgaggcaggcagatcacaaggtgaggaaatcaagaccatcctggctaacaaggtgaaaccccgtctttactaaaaatacaaaaaaattagccagccgtggtggcacgtgcctgtagtcccagctactcgagaggctgaggcagaagaattg[136 bp omitted]atggcatggaatagtacattggacttcaagttcagtggccagggtccacacaggaagcctggtcgtcttgctacctggatggccaagtgcaagtcacttaactttttataatctaagcatccttattcataggaagggggcttggttatcatgaatattaaataacgtgtatgatgtgactggaaaagaaccagacgtagggatatgccaaagaatgtttgtttgctagtttcttagactcagaaaaatagaagcacgtgtacttgaatctatgttgtatggtagttttgctttcacaatcatcaaacaggagtctaagcccaccctggtcctctggctttctactaaggcacaggcagcaccagcttttccataacaacaacctcaaacccaaactgactaattatctactgtgtgccatgcactgtgctagtgttttgcgtgattatctcgtttgattccttaccttaactctaacaagggatcctattttttacatgtcttttattattattgttgttgttattttgagtaggactctcactgtgttggccaggctggagggcagtggtgcaatcatagagctcactgcagcctcaagcttgtgggctcaaggaattctcctgcctcagcctcctaagtagctggggctacaggtctgcaccaacatgcgcagttaattttttaattttgtgtgtgtgtgtgtgtgtgtagatgggttcttactgtgttgcccagactggtctcaagctcctgaactcaagtgatccttccactttggcctcccaaagtgtgggattatgggcgtgagccaccgcgccactgtgcccggcttaatatgtcttttatttttaaaaaatgctggtaaaatacacgtaacataaaatgtgtcatcggtgatatttaatgcaaccgccatcactgtccagtttcagaacatttttattacttcaaaaggaaccccatatccattaagctgtccctctccattctgtcctctccttagcctctggcaattgctacagaacaaagacatggagaggttaagtggcctgctttagacccacattactgagtggcaaaactagtatttgaggctgggaagtctgctaccctagtgcagaacacttaactgttaaggtaattagctccccattagaaagacctttcccccaccatccagttcacaggaggcaggggcttgtttctagctaacacaaaagatgattttctctgaggcctcattacgggatgccaagcattcccaccagtgggcagcctgtggcacctagaaggtccgctccttccacttgctttccttacacccagcccagtgggaaggagggtgtcacttcagcagtgggggcagatgggtcttcagatcccacaggatgcccccacactgtgctggtcatccaactcattgtcaggtcagcaggggtgcctgctggcacccagagcttttgcctggggcggaaatgtggctgtctgacttttcttagttttcatccttgtcttaaaggtaggatgagtctcccaaggtgggatagaatgctgggagagaagtgaactttgggattttggtaaaattctctgcacaaataactcccagagagaagggtaatctgctaccccactcatctttactctttgaaaaatttaggatcccaatcccagaagagaagctttttgtgaattctcctaatgcaatcgttgtgcttactgaggctgcttggagagactgtcactcaggttgcattgcaccttaaagacataggatttcttgtcttaacaacaggtatgcacaaacattttttttataaaggaccagagagtaacacttttaagctttgtgggccatctggtctctgtcacaactactcagctctgccattttagtgtgaaagcagtcacagacaatacataaacacatgggggtaactgtgttctaataaaactttatttaccaaaacagatggttggctgaatctggcctatgggccatagtttgagagccctgtcctagactccagctgatggccttttctgtgatgtgtggaatctcccccaagcattctgttgattcctggaactatggctcctttgctctctctgctgcttcccagcttgtgaatttgcattcatggtcatctctgttttcaggccatcataacacagaatcaacagccttatggtgttgccccagaggattcaatgtgtcaagtggcattttcgaactgtgtagaagacttctctgcagcttctgtggagggaaacagggaaggaggtttatatcttgtagcccccagcaaatgccacgcaaaattcccgcataatcttgttttcccaggattctttctcagcagccttggaagtgggatagttggggttggtgtgcccattgaattcccccaaccaagtactcaaacttgctgatcctcccttctttccttctgggacttcttaggaggaagtctataaaatctcttgtctttaatatgcaaaaaggttttcttgcctcttctagtaaaaacacatagtgggcagagacggtgagtaagggtccagttctaattcaaaccctaagctcttagtttgcattctccacaataaaggcagtagtctctctaaaggaaattctcactgatactttttctcctccccacgtcatcatagagacatggcatggcctttgttctaaggaacttcaagtctaataggggataatgaatgttccatgtagagcagatacaaaacagtggactgagtccataatgctgtgttggagtacagacaaatgcgcggtgaaatcttgctgaaagactgcatggaggaggaggcatctgaattgagtcttaaggggttcatgtcacacaggtgaagcacactgacttcacgtgtttgaagagttgtctgggagataggttaccaatttagtttctacagtatcagagatagaaaaattcatccatcccttctaccatccttctgtccatccatctgttcatccacccatccacccaaccacccatccatctaattatccagtcatctaactatccatccagccagccagccagacagctagccagccagcctttctaaaaatacttatttaacacctgtgtgtgccatggagtaagccaaatgacagggagagaaaggtaaatgaggccatctccaaaggagttcagagaaaggtggtagataggtatgttagacaattcatttataagctgaatagttaagtgcaattttgagtatttgtgagaacgatgagagggaacagttaatactattggaaactgctcttggaggagtcaagcctgaatgatcagaaagacactaaaagatgtaaagcaggtaaaaaggaagaaagatcagggctgattttggagagcacggagtaaagtttcataaaccaggtaagagcttaggagatgacagacatgtggtggtataagagatgaaggaggggcggggcgcggtggctcacggctataatccccgcattttgggacgccaaggcaggcagatcacgacttcagaagatcgagaccatcctggctaacacggtgaaaccccgtctctactaaaaatacaaaaaaattagctgggcacagtggcgggcgccagtagtcccagctactctgaaggctgaggcaggagaatggcatcaacccgggaggcggagcttgcagtgagccgagatagcaccactgcactccagcccgggcgacagagcaagactctgtctcgttaaaataaataaataaataaaaataaaaataaaaaaaatcatcaggagatgaggagatggactgggaaataagacagaggcccaaacactaagaccaccatgacctactggactgcatcctttagaagccctaaggggatcctaaagtttagaattctaaataaacattttattttagaatacttttacatttacagaaaagttgtaaagacagtccagagagttcccatctacccagcgtctagtttgccctcttgttaacattttttttttttttctttcctgagattgagcctcgctggatcagccaggctggagtgcagtggtgtgatctctgctcactgcaacctctgcctcccagactcaagtgattctctagcctcagcctcctgggtagatgggattacagacatgcaccaccacactgggctaatttttgtatttttagtagagatggggtttcaccgtgttggtgaggccggtcttgaactgttgaccttcagtgatccgcctgccttggcctcccaaagtgctgtcttgttcacattttgcatttatcatattttacatatggtacgtttatcacaactaatgaaccaatattgatacattattgttaactaatgtctacattttattcagatttccttagtttttacctcgttcttttctgttccaggatgtcacattacaattaattgccatgtcttcttctccccttctggtctgtgactgtttcttagactctgcttgtatttaacgaccttgtcttttttggagtactaagcaggtgttttgtagtgtgtccctccactgaggagtttgtctgatggtgagactggagttatgggttacggagaggaagaccacagagacagcgtgccatttgtatcacaccatgtcagtggtacatattatgaaaatgacttatcgctgttgatgttcaccttggtcatctggctgaggcagtgcctgtctcatttttcctctctttgcatactgtgctctttggaaggaaatcactatgagcagttgacacttacgggtgaggtgtttgttaggcttcacctccttgaagcagcagcatctacatccatgaggcttttcagcaggacctgggtaaaggaccatcaggtggaaaatgcaagatgaactattgcaagccacattgaaggagaatttggctcactaccaggaacattgcctgcccccgaagctatttagctgtaggttttggccttcaggtgggcttagttgcagggctaaataattttctttaaagagcttcatcatccaggcaaacatcacagccacagtgccagatcctgtgtcaaagaaattaaaggctcattcctccatgcactaagttgtgtcataactgtaggagttggcctgctggggtatgtgtgtgtgtgttttcccatggaaatgaccaaagcaggcagcacttgttgaagtacgtcaacattactgcagcacgtcattccttttatgacatagcgacctcttttcttttctctgcgctgtgatcttcagttaatttttagggagggtggggcatgaaagctccctgaacatcgtgagaatttctttccacagatgcaaacaactctgttatggagagtgtaactcaagatagcctttttggaggacagattggaagtacatttccagttctcacattcctctcttttgaccgaggaatttatattttttcagtagaagtcattctattcttattgtttttgtttttatttttctatttgacaatgaatcgtgagcatctttcctatgggtggatgtttatgttatttccggttggttttcccatcctctttcattgtatgccaaattactgtggtaggcaaacttggacaaacgtgtttgaacacatatagtgcgtgtcatatattttgtaataactggaatttcctgttcaaaggttggggatgtgtgaaatttggacagtgtccatcagatcactgtcaaacacaggtggagacatgtgtcttcacaacccagtgcaacagcatggcgttatgcctcatccatccaacaactctagggggcaggcataagtagtcccattttaaagatgcataaactgaggctccatgaggttaaaggattggcgctgggttaactctttctttgctatcaggcatttgcggaggatcactcaggaacctttgaggatgagatgtcctgagctccagctcctggtgtctgacctcccatctcagtgaaatagctagaaaattatttggtctccttgctgagattttcttaacatattttaaaatctcagcctggtgcagtggctcatacctgcaatcccagcactttgggagaccaaggcaggcggatcatcctaagttaggagtttgagaccagcctggcaaatatggcgaagccccatcactactaaaaatacaaaaaaataaataaataaataaaaatagctggtcatggtgatacgcgcctgtaatccgagctactcaggaagctgaggtaggagaatctcttaaacccaggaggtggagattgcagtaagccaagatcacaccactgcactccagcctgggtgacagagcgagactctgtctcaaaaaatctcctgacaccagaaagccacagagcagaagcatcacagggctctctgatttgccataggatcgtttaatctgttttatgatactgtgctagtagaattttccaagttcacaatcacaaacaaacatactatcctcaactgtgctagaattaaattatctttgccccccccccctttctgttatattaaattagtatccttcttctccaaacaggcagctcccactttgagggtgggggaggagtacttgtccatcaaacatggggaaaatgactcctacttccatcgcacagtgaatcataggctctcccatgtcagattctgtggaaaggatgttaatagagacaaaaggacactgttggcgcgttattaatgttaaaaattgttgacgttccatgcagtgtgtttttctaattagagccaagctgcagagtaccatttccataatcaacatgggaacggaaactcagcaaaatttcatgtatttgcaatgaaactgctccccggcaacataaaaatggcttttataacataaaggctgtaattagaataagtcaaatcagttggaaacgattaaggccggagtaggcaaagctgccttctaaatatttgtctggagattagcctactcctgcagctctgagaagcatctttgatttacttatactgctcgacgtggcaaagataatcttgtggaaggcaaacgaatacagatttagatgtgctggtcggccccttctgcaacttgacaggaggcagtccattggaagcaaagtcagaaaaaaaaaatgaatatagggtcatattagacaaattgcttaaaaaaaaaaaaagcacaccgcgatcatcaatttaaattcttttaaaatgtgctaggtctttgaagcttttaggatgcactttagaagtccacgtggaataatccctgcatgtcagtgcgacagttgatgtgcgtctcattgtatttaaaattatagttctgagatgggacttgctccgcgatgcttgtctgacatcagctattaaaatacaagtaaatcttggcaggtgggaatttaaaaaagaaaagattatataagaaaaatcagaatggttaatgttaatttactaaccagggtacagtggctacagagagttcttcatgtcctctctctattaagatgctgatgcgagaaacaccttatgtttgccagggatggggatggagattgtaaagtggatgtgagggggtaaagagtgctactttggatgtcagtccatggtttgggtcctctggggccacggtgagcatgatggtgagacaggttcattttattaaattcagattagccgttttgccctgtcctgggagggcagaagaaggtaatcaaggagagatggcgggacaataactgctctggggatcagactggaacatccacggactccagccttcctttagaagggcgtaattcgtcctcacagactcctcactcatttgtaaacctctctgaatcccaaacttgtgtgcgtgtctgcatttagccattgaaaatataatcaggctaatgcattctcttactgaattttaaaccagcccattaaaactcctttaacgtgctaaagtcggcttcagagagggtttccatttcatctttattgagctgaggctatggttcattctccctttgcaccacagtgagcgcctgtcaataattcaatagcgtagccttgatgggcccaggcccaacctagactttcaaccacgccaagcagcttgtcaaagcctgatgctctgtcaatggctgagtgatctatactgcatgaatcccccccttcagctcttgatgtgtccctgggaataaaaagaaagccatttcagaagtcagcccagtgagaagcacctgtatgtagagaatctttaatgagggcaggtcgcgctgtggtggagcagagttcagcggaaaccaccgcactttgttttgttgagccaacgcagagtctctctgtgcactctcagtgtgcacagaggagcatggtcctcgcgctggcaaatggatgcccttgtccttctgcttaagtcttctttacgcaggccttcgcgctgtgtcgtcttcaccattgcaggaggccttgaactcagaaaatccagtgcaaggagcaaaacatctgaatcatatgatcatgccccagtggctcttcttcaggtgccagtgacggtgatttgaaccttcatgtccctcttttcatggaacgtcatgagtctgtactggctaaagagtgctgtgaaaggcagattaaaaaaaaaaaaaaatccagcctcacctttctttctgggtggaggaaaaggcatccattcactttaagaagaaaacaaatcatttgtattcttcttgtctggacacaatttttaacccagaattatccacctagttcctcccatctccaggccttgtaagtcgataggagatttgcaaatatctcccttaaagaaaggcaacgaggagagcatttaatccatgctttaaatgcaaaatgtcttgagtcccaacgctgctcagtttttcctgaagataaattttagctggattaaataactgttttaaaggcactattcatgcaagtgctgtctcatttgtgactgtatctgcattgctaatggatgtgtcttttcctcatgcatattctttcctgagcatctaccgccaaatttacagattgcttgcttgtcaaattgggatggggtttgaggaagaggtgacaatgatctaggtggaaaagagaagtgccagtgtgttcaaagctaatagaaaattgttgctttgtattagcagtcaaggctccaggtttcctgaaccacaaaacaaccaaatcttttctttcttttttttttttttttttttgagacagggtctcattctgtcactcaggctgcagtgcagtggtgagatcacagctcacagcagcctccatctcccgggttcaggtgatcctcccacctcagcccctcaagttgctggggttttgccgtgtcgcctaggctggtctcgaactcctgggctcaagagacctgcctgcctcagcctcccaaactgctaggattacagatgtgagacactgtgtctggccccaaatgttttatggtaacataaattcatgccactgtggcctgctggtcttcccaattaaacagcagagagtttgttatcccagccacagcatattagggtggagccaggtaggtatgtgaactaacactgtgaaaaaacaagattgtttttaaggtaagctttcgaggagggggaaaggaggtagaaaatgaatatggtgatttcagagaagaaaatctctcccaagcctatgtccctttgtatgtccacaaccccagttaatgatgggtatggcttatgaaggcactgagagcccaaggaatgtggccagcattaggcggcatttgagctgggtcagtgaatcctcaggcgtataggcaattaggacttagagatcctgttgtgattttcatacttttaatctggagagttgcttaatgaatttattaattcatttatttttagcctcacaggttttgctccaagactcaggtgaatgagtaacacagtactgataaagttgagcttttctgtttagggctggggaggagggaagaaggaaaggaaatgaaacccagggctttgcatcttcctcttcaacttcatcccttcctctctattcctcacatttagcagccctcaagggggctacaaggaatttttcagggtccagcgtggcctaatatgccaacttctgatatagtacagctcaattagcctggcatggttgtgcacaaatgtagtcctagctgctttggaggcagaggtgagaggatcagttaagcccgcccagagtttgacgttgcgctgagctaggatcatgccactgtgcttcagcatgggtgacagaggacccatttcttaaaaaccaaagaaaaaaaaaagacagctgttattttcctaagatatcctctttaaagagaaatggaacaagtgacctgccttcctctatatgaggtggggctcacaccagggttctcctgctcaccattggcccaggaaactcaggaaattaatgctgcatgcgcatgacttggcgattcgacctctgaaagctctgcaaggctaggaatttatgctttaagaacaatcagcatcaaaggccttggcagtggtggagctgttagcatattagttccatttgagatggtgaaatgccttggaaactaaaaaccctacctaataaagtttattttcaaaggattagaggtagagttttgctctgagagatgatgttgcctaagcctcccattacagaagagcagagatgggactctagggattcatggatgtgccagcgtcactgggtagtggtaaaaactaaaactggtatctgtttctctcctactataatatctttttcacgtcagggcttgtaaacctgaaatctacactttagtttcacccatatgatttgtttttgcttttttcccccctgttattagctgccaacatttagatatgtaaagattacatttaaaatcgaaatttttggcttcttgcaaaaaaatcagacgatctggcatattgagcaacatccgcacacttcacccaccagctggagctctgtagcacctgcacacctcagtgtggagatgagctttccactcccaggtcaacacagaccctcttactcaggactcaccttcgcccagcctgcttcacgatccactggctgtcacaggcatttgcctccgtagtgctctcctcccacccttccacaaataaacgtgcccagagatgctggcagcctggaagctttgcatctgcattggggctgcccgttctttgctgccatgcctgaagatttcagtagctctttgtcagcacaaatgagcttttcccctagttcatggggagaatgggatcctggcacatagcagaaaacatctggtaatgaatccattaggcaggctgttgctcagcctccaggtgcccaggggtctgagtgctgggctgaacatgatgcatgaacgggaccccagagattttaccttttggccttcgttctgccagagctccggcttggtcctaaggggtctcctgactactccaatgccaggtgttctccccagccatccccaagcgagaagctggccagccttctggattccctcctctgccttctccagcagcagtccgtctcccagcacagccttccttaggcacacaaaggagaagacagagatcatttttggcagacgtaaggagcagcatttgtcgaactctgggccctgcaactctgtgaacagacctgcatgctgtacaaaattattagaagccctgtgtctcagggctcaaggaggttgggcagggaggtgagagtgaataaaaatgaggaggccgcaaactgcttttgcccaagggctggttttaatgagcttgtccctaatgagttgtccctgcaactagcttcaggcctaaacagatgaggcagggattctgctaaatttttgataggatttgcactggttttatgagaaagcaagcagtagagagtgcaaagttgggtcatgaatcttttacgagggtggatggttgtccgtcttgtcaaccggaacgagaaagacctggttgctaatagaaaccatggcctcagacgtcgatcgtcacccaccagatcagctaatttggtcagggtggctgggtgatttgttttttttctgattcaggacctggcctatggcccctgagaaggatttatctgaaaactccatcaaggagatgatttgagccattgcctgttcctgactaatgatcttttgtggaactcaagccatattggggatttatacctttctcccatagtgcactgggaaggaaacaccatcaaacactttaattaacatcctttttactttgggcagccccattcgtatcaaaaccacaaaccttacccttcagttgcacgagaacactcttaccaaggataaaatgtgattttcgattcctatggagatgtttctaatgtttctaacacccgtcaattctaggatcgcgtggtacaggagatttcatgtactaccaccttttttttaaatattaaaagctgccaacaaatgcatttctccagtttgattcatataccaaaaggcaattttcttggtggcttagaaggttacagaaaatgcttgatcagcagcctttactgtgctgagtgaattcctaccccatccccctcctgtctcacacactctctttcacattaatcatgtaattgatttaataagctctggcttcaagagctccccctcccctctttctttgccccctccccctctcttataagatttcagttcagcgtttgactggtaggctaagaaccttgaatcctgccagatatgaacccaacaaccttgttggtgtaataagtatcctcatcttatatttctgtggctccttgaaacataatttttaagccatttcattaatagagttcaatgtaataatgtaaaaaagtgcagcgtatttctatatatgtctgtagatgtagacttctgtatatatctacttttcacaaacttgaaatcatttcacatgtgttgtcttattcaaacctctctaaaccgaaaactttgagagttgcccagaagagatccgttgctcctattttatacattacaaaaccgaagtacagacagatgaactattttaagaccttgaggctaattagggatgcacgtggcgtgaaaattttgggcgtctgaacttcctacaatagggcactactgattctgtattcctttgttgcctgaggcattcctttctctgggagaaaccaaagctgtacatatttatcttcaagagaaacttccactttgcctatgaagaaatagttagaattgttttctgtggttgcctcaagttagaggtgctaatatacatggaagttaaacaagaccacacatgtgcaaaactcttgatgaatcacgttattatactaaaccaacgttatactaaaccaacattagctagggttattagttcagattatagttatgcaggtcttccgtgttaagtctcatgtaaatatcttctggagcttacatgtgtagttatctatgttctaacctgtttcctaatgggtcatccagaaaacgtgggtgtggtctggctggaacagagtccctaggattgtgtcagagtcattgtcgtaagatatacctattcagaagttagttatctagatgttagagtctagagatggggcttcaatgagggatgtcaatggcagtatggggaaaagagaacagagttgaagactgaacagcctagggggagagcagaaagcaaaggcagctttataaataataaagatgttctgcaaaaattcctctgactgggttctgattggcttgggtagcctttttttttgagacagggttttgctgtgtctcccaagctagactgcagtggcatgatcctagctcactgcagcctcaacctcccaggctcaagtgatccttctacctttgtctcccaagtagctgtaccataggtgcacaccaccacacctggctaatttttacattatttgtagaggtgagggctccctacgttgcccaggctggtcctgaacccctgggctcaagtgatcctcccacctcagccttccaaagtgttggggttacaggcataagccaccgtgccccactgacattttactcttaatcctggcctgtatttaaagggtctgggtgaatgcagatagatagacagttactacgcgtaacagcttaccatgaattctaagtctcaacaaatccgtaatcatggtgtgtcatatgaagaacatgttctaactcttattgctgagcctgactttgaagtgtttgtttttttttttcttctttttttcttttgggaataagaaaaagcaacgttcttgactgcccggaaaaatactgtcttgtcagctggggatgcttggtgctgatgaggaatgtggtacagggtggggatagtcccttttaaagggctcagcatgtgcctgggcagttagcaaggattaaacaaaggaaagttggtaatattactgctagtatgagtatgagtaaaatgaacagtggaaagaaattaataataggaaattagtgatactatgtgtttaatatgcatagagcctctgtaatcttagcttctgaacaatagcactccccgctactcctctcttaatctggaggcccatgggtctccagtacccttatgcaccagctccatttgaggaaatgaaagtaggaatcacaatatttgccctggatctgcataactaggacaagcttttgaaagtggaagaggcccataaatgaacttctcaaaatgcacttgatacagcatcaaataggagtgacaggtccataaatcaagggattggggtcatttgattcaaatgtaaattgtcccctgcccagaaaactcattgccatgaaaccctgcacagaatccagagaacattttcttctggtctcttagaaattcaaaatacaagatctacatggtaccacagtttttgttgctgttactgttgttgttgtgtggtttttgttgttgttgtttttgttttgtcttttcacgcgggtgacgtttggagatgcccaaagactgatatcccaaaagtacctaatctacaacaacaaatatttatagaacctttatctcaatatttgctcattgaagtgggttaataaatgtctgttgaatgctctcaattggatggtgagtattttccattttagtttagctgtgaagcttcgctttccctcctatgccttttgttttcttgcctaaagaagcccatttcaagagtcggggatcttctctttctaatctcagcctgcccaacaatttgtagcatggtcttgctacagccgctttgctcccctgctactccatcttgtctgagatctgggttaactgggacttaactccttgtcaaagatgctgtgtgaaatgactaattaacaccagagaaggaaagagcattgtcattgacaaatagggcttttaataaccagcagttctcctggttattaaagttggctcttgagtctccccagacccatgcgaattgacaggaaggaggatattttagttccttctatgattgagttgcttgtcacttgagtttgtaatctcaggagtcactttatccatgttgtcccaggaatgaaaatggtgtgaatctaatttcagaagttgaggagaagtagaacaaggaggccatgattttctagtataactagacaattattttcagcaagttctccctcactgttgtggggtgagtgctcacatttgcctgccgctgagctatgttttaatgaggttggaagaagcaagaaggttgggaagattgatgttaattgcatttctaccatacactaagcagtgagcagatttaggatgactagtgtcctatagttctctttcaagatcagatcaagcttcctgaaccacatgagcctgtcttctctttacaccagcagcctcagtaactccctgttgggcaaccccatagagcaaacaccagaaaccccagaatttttctcttactaaagaagaccctccactgtcaacttaagctcacgttttcctatttctcaagccaaggtaggtctaggtattttttttttttttttttttttttttttttttgagacagtgtctcactctgtcacccaggctgcagtgcaggagtgtgatctcggctcactgcaaactccacctcctgggttcacagcattctcctgtctcagcctcccaagtagctgggactacaggtgcccgccaccacacctggctaatattttgtatttttagtagagaatgggtttcaccatgttagccaggatggtcttgatctcatgaccttgtgatctacccgccttagcctcccaaagtgctgggattacaggcgtgagccactgtcctcggcctcaaggtaggtctgggttttatgagatgtgacacttacagaatttgggagccctccgtaagaaaaacattcacactttgggaggccaaggctggcagattaattgaggtcaggagttcgagaccagcctggccaacatggggaaacccccatctctactaaaaatacaaaaattagccagctgtggtggcacacacctgttatcctagctacttgggaggctgaggcagaagaattgcttgagcctgggagacggaggttgcagtgagctgagatcatgccactgcactccaggctggccaaccgagtgagtctatctcaaaaaaaaaaaaaaaaaaaagagagattccaatgagattcaaaattactagtgcagagttgcagagttaggggtagcataaaaacacattgcctgaagtgatggtctctgaagcctaagcccagtcaccttctcattatccatttctgttcccagttgaaactttgcagtaataaagctgattttataaagtggtcaagagctgtatcccaaacttttccttgcatcttcagctcttcctgtctatgaacctctgcctctgttggcctagtctctcactatcctcttcttttattaagcaattaagtattgattaaaagccaagtctagtgagagctaaatgcatttgttgaaggttataggtcttgttatgggaaagcaggagtggaatgtagttgaattaacctagcctagaacagatttttctgtgtgttctatgaattagctgtatcagcatcaaccccctggaggggaggggccaacaggcatctgcgttaaatatgtacattcctaggtcccttccaaagtactgaatcaggatctctggggttgggatgtagggatttccactctttagaaacacccaccctcctttcttctgaagcatgtgaaagttgtaaaacaactgactaatctaagggccactgaaagctactcttaagatgcagcatttacttgagactcaaaggatgaatggcagctgccaagtgtattaatttcctaccccttccatagcaaattactgcaaacagagcggcttaaaataacagaaacttattctcttagttctggaagttggaagtcgtaaatcaaggtgtaggcaaggtggattccttctgagaactctaaggaaggatgtattagttgattctgatgctgctaataaagacatacctgaaactggaaaatttacaaagaaaaagaggttcagtggcctcacagttccacattgctggggagacctcacaatcatggtggaaggcaaaggaggtgcaaagacacgttttacatggcggcaggcaagagagtgtatgcagggcagcttcccttaataaaaccatcagctctcataagactaactgactatggtgagaacagcatggggaagacccacctctatgattcagttacctccaaccgggtccctcccatgacacatgggaattatgggagctacaatttaagacgagatttggctgggggcacagcataactgtagcaaaggatttgttctttgtttctctcctggctcctggtggctccccagcaatcctgggtgatccttagcttgtggctgcattactccaatctctgcctgcattgtcacacatacattttccttctatgtttgtctgtcttcacctaatcttcttgtaagggcaccagccattggatttagggcccactttaatccggtataatctcatcttaactaaatacatctgcaacaaataaggtcatattccagtgttcttggtagacatttttctttcccctgtttttttttttttttttttgagatggagttttgctcttgttgcccaggctggagtgcaatggcgcgatatcggctcaccacaacctccacctcccgggttcaaacgatttttctgcgtcagtctccggagtagctgggattacaggcatgcaccagcatgcccggctaactttgtatttttagtagagacggggtttctccatgttggtcaggctggtctcgaactcccgacttcaggtgatccacctgccctagcctcccaaagtgctgggattacaggcgtgagccaccatgcccagcctgacatttttcaaataaggtcatattctaaagttctaggtggacatttttaaaataatgtctcattacaaagtcctaggtggacatcttttttggcagggggacactcttcaacccaccatgccaagtgaaagtagtcagtgggggagaatggcagtgaaaatagatggatgaattcagaatgaatagaaaacttgaagaggtttggcaggagtgagccctgcttagttatcatccaggtttcactaacgcgccccttgccaacatgcagtagctctgagtcatgatctatcatattgccctgttttgtaattttgcattgtttgtttacttgtttaggaccatctctttaacctcgttagacttgaaatctctactcaattcaagcctgcacatccccagtgcctgaaaccatggctgttacatagtaggtcttggtgataatttgtcagttggataattttagctggagaaaaagaaacatgtatgtgtgtgtgtgtgtggggggggggggttgttttgttttgtttttgtttttgtttttttcacccatcctgcagaaaacactgcttctgtgacataaagagaacaccttcacagggtaaagtgttcttcccatgaggtctaagaggagtctcaaatgcgaggggcttgaagacatttgtgaagggacactatgaaacatatgagagcagtgagaagtggagagttgtctctctgactgcagtagaaggatggcgaaacatcagggagggagaagggcactccgggccagtattcaggaggagagccttgtggcagcttttctgggtgtggatttcagagcctgtcatcatagaaagaaaagaaggaactcaatctaaagtataaataaaaggagagacttggccgaatgcggtggctcatgcctgtaattccagcacttcgggagatggaggtgggtggatcacaaggtcaggggatcgagatcatcctggccaatgtggtgaaaccccatctgtaataaaaatacaaaaattagctgggcatggtgacatacgcctgtaatcccagctacttgggaggctgaggcaggagaattgcctgaaccagggagtcggaggttgcagtgagccgcaatcgcgccattgcactccagcctggcgacagagcaagactctgtctcaaaaaaaaaaaaaaaaaaaaaaggagaaacttacagaaagcaagttcaaaaaggagggactgtggatgataaattctataccactgtgaatgttaactcgtaaggatttgaagataacggcccccgactcccacttaggttacagatgaagatactatggcccagggatgctgcgtgagtgtcttaaggaggaaaagagcgttaatgtgacatctgggattccaggctcctttccagacctctcccctttttcacttttccgcctgatttaaagtgaaaagaagggtgttggcatctattaatcacctactgggcgccaggcatggatgctaatggttaggtcttcaggttgctgagtgggtgttgaggaggaggaaccagtgaccccagtagacattgaagaggctcaatgacagcaggaggattcaggggtctggtggggtggatggcatgcgacgggcccagcatcagcagtgagagggtaggagaatggtgagtttcagggcatgcatccacagcgtaggttggtaactaaaaggccagcccaggaagaggcctctgcacatgaaacatagaagtggctgcctccttcaatcactgttctgattagataagacctgggcttcgcttctgagtggtaaactcagaggcagctgggagtccctgagtgacaaggaggagactggcatgccaggtagggcaggctgagggttaaggctctggagggagaagaatcgtactcagaaaacatccagctttctgggggatgaggttgtgcagtctgggtgagggacatcggatttctatggaggctttttggatgggacctgatataatcatataatattgaattcagttctatgagcttttgctatgtacttattctgtgcaaattctgcaagggatgtcttgaacggatggttctttcttgcattgaatgcaaatagtaatttattttgattgagatagttttggaaatttcggagcagtgaaatccaagtatttcaacctggcaggttgaggcaataggtaagttaacttgggcgggctcacttttctatacattttgtgctcgggaccgtaatgcaagcccactgcaaatggcaacttcatgtatcaacttataagcagtggtggaggagatctcaaccctacactcattgctccctctggctcttagagactggcttctaaattcctggtgagttgcaaatattcttagattggactatgctaacattttgaaattaaacctacctgtctttaaatgagttgttggctgcccctccccccgccccgtattctctttgtgaagtagaggcttccagcacttttctgaaggagaaaacatttatttctcattttgtagaggcaagaccaaatttgtgtcagcttcagctgagaccactggccagccctccttctcacctcccagttccctaatctaatttatctcagtggggtttgtgggggttcatttaagcagcagaagctctgctataattgttgcatgtgccagcaacgatttgtaccatctgggtatggaatgaggtggggtaaggtggtttggaaagagaaaggaacagagagagacaaagagactagtacgaccaaagagaaagattcttattccatgaccaaagcaatatcattcaaaaatggctacaaagcaattggatactaaggaatgagaagcaatgtagttagagtaaaatgtcaaagtataatgaaacagaggaacatcactactttatgatccagccaagttacaggcaggtggcagctgtaaatacgcatataaataacaatatggatgaaatgtcagacctttcagctggcttggttaaagcactttagtaatagtctatttagggtaacaatgtagcttgacaatttccatgaaaaatacatcattggagaatgagtcagcccgcgttagcgtgtaggtgatgtgcattgtgctaagagcttagaacaacacacggtgcctggtgcatcccccacctgcctagaatggccagttgcttcatattccatgaggttacgttggttttctggcattgggttgcaaatgcttgtctttcccattacagaaagtaccttttctctcttatcagtaacacaggaaaataaataaatgatcaatgcctcagatccggggtcttacctgtggaaaggtgtggattgatatctttatttattcatgcatgaaatgtatcaggcacttgctgtggtgccaaggatctaaaaaagtgaacaaaaagatgtataggctcagacttcatgaattttaggctacactgcttaaaacctttaatgattccctattcttaggataaagtcataactcctgatcatggctgccaagaccatgtagattacttagagtctggtgaaagaagaaataactgaataaaatggtcacaaaaggtaaatgtaaaattgcagtagtgaggccaggcacagtggctcatgcccagaatcccagcattttgggaggtcgtggtgggtggatcacttgaggccaggagttagagaacagcctggccaacatggtgaaaaaccatctccactaaaaatacaaaaattagcagggcatggtggtgcatgcctgtaattgcagctactaggggggctgaggcaggagaatctcttgaacccgggaggtggaggttgcagtgagctgagatcgcaccactgcactccaggctggatgacagagagaggctttgtctcaaaaaaaaaaaaaaaaaaaattgcaatcatgatacatgctacattgtttggtagccaggatggcttcctgaaggaacaggtgctagacttgtgatcgaaggggtaggaggttaaacagagaggtatgagagtagcattccaggctgtgggattggcatgtatgaagatcctgtggtaggaaggacattagtgagtatgaggaatggaagagatcattgtcctcatagttgagctagggaggtggagagtggcccaagtcaggtggggataagtaggcaggagcctacatggtcttgccggccatgatcgggagttatgactttatcctaagaatagggattcattaaaggttttaagcattgtagccttaaaaggacgagcaggggctggtcctttagaaggcattgtgttcatagtgtatgacagtaagccaggagctctgagaaaacaaatggcactttgatgagcaggcactgtatatagtttcatacacatgttaaagcgtgtatagaggatgtgtaaaacatccacttcatgccaagcactggtcaaggtactgagggtgcctgagtgtaagacagcatccttgcctctgagcaatgcacagactaaggagatggaagtcatagaaaccactgactgaagtgttgggcaccctgatgagattatgaagcacggaggagcaccttcagccttaagatggcattcctagagttcatgtcctctaaacagagtcttcaccaaaggctagaagttgtcctcgcaaagaaggagtggaggaagtgttggtcttctggtagggggattaagaaagccatagccagctgggcacaatggctcatgcctgaaatctcagcagtttgggaggccaagacgggtggattgcctgaggtcaggagttccagaccagcctcaccaacatggtgaaaccccgtctctactaaaaatacaaaaattagctgagtgtggtggcccatgcctgtaatcccagctactcaggaggctaaggcaggagaatcgcttgaactcaggaggctgaggtcccagtgagccgaaatcatgccacggcactccagcctgggcaggagggcgagactccgtcccccaccaacccccccaaaaaaagtcatagccaatgtcttcccaggaagtcaaggaagcaaggaagatgcccaggatcggtagacagaatgctggtgaagtagatgggggtgggccctcttgaccagtgtcttgccagattttcttaaaactgtaccatatcaaaggcagattgtctcccaagttatcaagtcaaactcgtgttctagccctgcagctcaccctgttttccatcatatgtgtgttataggctattatagatatgatcaagttgagtttataaggtccagaattcccatgcatgtgagaaagtgtaaactgaagccacctgttgggttatgtcccctaccttggtgcatgaaggaaaactacacaaagatgtgtggtatcaactcatggagacaagactctatctacaggatagcaaacatttggatagaacttgagaaggaatatggtggaggaatgagtttttatctaagccaagatccaaccatctctcgatgtatacattttctaccatgaacatgtgcaattgcccatctgtgttttctttcccttttgagattcctcttgaccttctgggtcctggggaagtcctcaggacaaggatggacctaggcgagttacatcaggtaccacagtgttaaagagtgattatcacagtttgctcctcacactttatatttggccagccctgggccaaccccttttcccagccctgggccatacccttttccaataataaagcccattttttatgattttgctcatgggttcatttattgatttgttcaaacacaatagggcactacctatgtgtcaggtaccatgctaggcacaacggattcgatagcaaaccagaccattgtattttctgccatcttgaagcctcagattgcatctggaatgaatattattagaagcagctagattttgattggaaattctctcttctgaatcctttagcctaccaaatgctttggttctagctaaataagtggtggttttatttcctttgtaatacctgaatatgtattccttggatacatcaccctccctatattgagaagtttcacgtttcagcagcctcattctttctcatccttgtggaatgcatgtgcatgtatgtctctgtgcacatgcatgataggtttctatccagccttactctccatgcaagaatataacagctcccagagttgtttgcaagaaaatattaaatatttacatagatatggacattttgtggggataatataagaaatcttattcacacttggccgggcaccgtggctcatgcctgtaatcctagcacattgagaggccgaggagggcagatttctttagttcaagagttcgagaccagcctaggcaacgtggtgaaatcccatctctactgaaatacaaaaaaaaaaattagccaggcgtggttgtagtcccagctactcaggaggctgaggtgggagaattgcttgacctcaggaggtagaggttgcaatgagccgagattgtgccattgcactccagcctgggaacagaatgagactccatctcaaaaaaaaaaaaaaaagaaaaaaaagaaaaaaaaaactgattcacatttcaatcaatgatagtcactgacattgaaacttactatgagccactgtgatgtctaagattcattctctgtttttattcttacagcacccctattaggtaaatattattaatgtcccctgtttggaaatgtcaagttcaatcccttttattaagggcagggccagctttaagggcacattccctgcatggtcatgcagggccccaggctttgaagagccccgcatgtggtcttatgctatagctggaattcttaatgatttttgaacaagcgttcctacattgcccttttgcactgcccccagaaattatgtggccaatcctgattaaggggcagggcagggctctgtggagggttgatgtacccacagcatccatccctttaacagttcctccacgttaggaccctcctctcaacattgcctatcctagagggacccccccttatacaaatacagaaggtacctggttcattcttcaagctgtgtgtggattctcattgtgaagtgaatcaccttttaatgtatagtcacccaagtacatctgctatgttgatatatcacttgttttatgggccgggattaattccaaagtaaacactaagtactcagctgaaaagctgtaaacacaagacaggacgtgcctctccaactcccagcattgtttgccaaggttgcaagtccctctatgctttatcctgtttggcgtaacaaaatcttcgtgtaatttggtctcagcagtcatttcaaattgattttaagagttgcaggcaagggggtattgtggttgggagaacacaccttcacgtgcattttgcctccctttcttgcctcagcatcacccaacggtcttcctgggatgttcaccttcctgagcttgatgggtgcccgtagaatcgccacctatggctgtgctctgtgcaagcaggcctgcagtggtagcaattgcaggaggcagtctactccaagccttctattcaagccctgagccctggagcagggctgtatcagcttggaggaaagggcatattttgggtattcttccactcggaaggtgtactttttttctttttttttttgaaacggagtttcgctcttgttgcccaggctgagtgcaatggcgcgatcccggctcactgcaacctctgcctcctggatccaagcaattctgcctcagcctcccaagtagctgggattgcaggcacgcaccaccacgcccggctaattttgtatttttagtagagacggggtttctccgtgttggtcaggctggtctcgaactcctgacctcaggagatccgcctgcctcagcctcccaaagtgctaggattacaggtgtgagccaccgcgcctggccttgggtatgcatttttatcactcatacagcgggtccatgaatgcaagcagtggctccagatatccaggaggtcacacagttgactgttgtgtcatggaatagcaaacactatcttccgatctgtgtcctgggtgctgggcctcctgacattggtgacccagttctgaattccagaatgacagttttaacattagattttgttagtttgtccatcttatttttatggcattagtgttgcgtggattgaaaatcacacgtacacggacacatctatttacgtataaatatgccttgccttgcattcttctatcttctttacttaagtggtgagatgtttgggtttcttcatgcagtgactttggggaagtccctggagctctttgatgctctgttccttcttcttcaagctgtatttgattgtgaatgttccttgtgaagtgttttaaatcacaggtatcaaatcccctttgcttggtttgagggatttgcctctgttgccctcatattttcagcctaagagggccctccccattcctcccagggacatctaaaaacgtttatcttcttgtgtgcagtctggaaggttcttcttacgagcatctagcctcacaccaagcagccaaagttgtcttaaaaaaaaaatagcatctttgatatgatccacttggccacagcagcttcatcaccccctccccaatactctaatgtccagttaacgtatattctcagtccctccaacaagcatgatctttgtgccccaggacatttgcacatgctgtttcctgaaaggctacattccacagttcctaccctggtgcctgcttggttggtatattcagccttgctcagcttggacatctcctctttaaggacatacttcctgattcaccttccaaatcagaacaaagcttcctgttctttgccgtattccagtaagttgccaactcactggacattttctcatggtgtgcaccacacgtctatactgccagagccatatgcattacaaagacagggaccttgtctctctggagccctaagtgtgtccttaaggtttgcaaaggaccagcgtctaatgaccatgtgaatgcaggaattatgtgattgtgtgtctctctgccttcccctaagtctgccgtgtccctgggccagtccactttgtgcccagatgctcactttcccatgctgtcctggagcatgtgctcctcaaatctctccttgttcatgttctgagaaagaaaatagctcatgctaagctttccaagtagacagaaaatgagccatgcctctctagctgctgttttttaaaattttattttactgttgcttattttttgtcattgttaaaggaaaaaaacattgacttctctgacctacttccctagcattctttccctttcctcttggcccctttgcaagcccttgaatatcataggaatatattccccttaaggtctttttgaccactatgtcttttgtctagaatgcaatttttttcaagttcttacctagttcactccctctcctccttctcagcttagctcattaccttttcagataagacctccttgactcctccattaaaatcagaccccctcttcactcccacacaccctgtgttcctttcctagctgacttttgccatattgcttatcaccatttgacatactatgtattttatgtttcatttgtgtctgtctttctgcactagcatgtaagctccaaccgggtagatattttagcatgttttgtttgttgctatatccttgcagtgcctttcacaaagtaggtactcattgaatatttgttgaatgattaaacctatgaatggatgggtgaatggatggatgaatgatggatggatggatgaatgcaatagatggatgggtgagtggatggatggatgatgggcagatgaatggatgtaacagttgggtgggtgagtggatggatgaatgacgggtagatgtatggactgaataggtgggtgggtggatggatgggcaaaagaaagaatttggccttgggttttaacatcagtagtaatctctactttctagacattgagttttaggatggataccaacaattattatgttttgagacacactttctggagaaagtccagagatccttttaactcacttggcatgggcaattgttaccttgcacttgccattttgtacaaaagtatgtttggttccgtgccttccttccttctctggcaaattgaaaattatgatggaaataagaatttccaaaaacctgtggaggtgaaagaagacataaaaacaaagccacagattattgtacatttcctgttgccagattaaagccttgcatccactgtgtggaacaatttaaaatttcatctgttaattggaaaagttacagatattgcagccattcaccttatattgcggggggacagttctagtttaaaatattctactatgctgtgtctgtaaatcacagaaattacctagaaattgcaccattttggcatttcaaaatattgcttgcacctggaaatagcaccagaaaatctttcccagatgcagtttgatttggaaaatataataaatgtagttttgggatttaacttttattctggtccatcttcttttagatgcttacgggccaccatacatacacatttattactacttttaccctacccacttggtaaaagttttgtattttatttttttaactgacaacttgttaaagacagaaattatgttttaatagtttattggttggatacttttagcaacaagtaattgaaaatggaaataaaattagtttaaacaagagaaacaggtatgatttcacaagaatgttagcaagaattcaagggatgaggcagacttagggttagataattcagttaattcatcaattcgaaaatatcattaaggtttcaggtttttgcaatatttctcctatgctagtctgattgtatttgcttatcctcttaggctgtcattcctcctgtttctattatagctgccattgctccagacatcatgtggaaactgcaacacccagaagaagaacaaaaaatatccctgtttaattttcctttttaggaaaatctccctagccagcccacgtatctcttccacagacttctggtatttcattggccagattatatgatttgccttaatcatttagcaaaatatatatatatatatatatgtgtgtgtgtgtgtgtgtgtgtgtgtgtatatacatatgtgtgtgtatatatgtatgtgtgtatatacatatctaatatatatctaattatgtatgccttatatataatatatacatatatatatctaatatacatatatattagaggggaacaacacacagtggggtctaccagagggtggaaggtaggaggatggaaaggatcaagaaaaaataactatgggtactaggcttaatatctgagtgatgaaataatctgcacaacaaaccaccatgacacacgtttacctgtgtaacaatcctgcacatgtacccttgaacttaaaaaattttaaacaatgagatatctaaatgaatgaatgaatagataaataaataaaagctattgtgttgaagaaaaagaaattattaggttcccaaaactgcatttccagcctccctcccaaaatttctgatttgatatgtcttgggcagagtctgatattctgcaagttttacaagttccctagtgatatgaaaatggctggttcttggaccacattttgagacccatcaacatggaataatcaagattgatctccttgacattgtggagaagctcgactcccttgaaggacaaggaagccatgtagtgagtgaggtctttaggtttctgttagccagataattatcttttgtttagttagctaagaataactgatacagctgacaacttatggcaataacattatatttcacgtggttgataagaattgactgaggatgaaaaaacaaaggcaaaacaatttttttttttttgagacagtctcaccctgtccccaggctggagtgcagtggcactatctcggctcactgcaacctccacctcccaggttcaagcgattctcctgcctcagcctcccaagtagctgggattacagatatgtgccaccacacccggctaatttttgtatttttagtgaagatggggtttcaccatgttggccaggatggtgtccatctgttgacctcgtgatccgctcaccttagcctcccaaagtgctgggattacaggcatgagtcactgtgcccggccaaagtaatttttaaataaaattttatagaataattgaggatgaatgtagaatttaagtctgagttgtggttaagtgtatttcagataccctccaagaacttagaattgacattcagctctacgcagtattccaggtcatttgtgtgtctgtttttgcatttccaaaagccgtacgttttcttggaattcataacaaccccattcactgggttgagcaaatattactggaagatgatatgataatccacatccagcaggagaaagctggggctcacagaggttaagagtttcccagccctcggaggtagtgagtgttggcattagagcttacagcagcatcctctcatatctcttagcgacttctgggatgtgagggggcacaggcattttgcagtgactgtgagagccctcagtatcagaccatccttggtacccactccagagagacttctaccctcccatttgttcttgtcttttaatttttcagcctcctgtgaggtgaacggatgtcaaggaggattaaagaatgaaacatgcttattttctctccttacgtgcctgaggacaggccagtgagctgtggggacaatagaactgtgaaaatcttctcctggggttcttttcttggtatttggcctgacataccagggaagctactacctctgtgaagttgtggagggctcctgcccagccttcggagggaaacagcgggtcacaaagagagttttccatatttacatgattgcatttgttgctgttttaatggctgctgtaacaaatcaccacaaatttaacagagtaaaagaaacacccggggtcaggagttcaaaactagcctggccaatatggtgaaacctcatctctactaaaaacacaaaaatttgcctggtatgatggtgggctcctttaatcccagctactcagggggctgaggagaatcacttaaacccaggaggcagagattgcagtgagccaagatcgtgccattgcacgccagcctgggcaacacagcaaaactctgtttcaaaacaaaaacaaaacaaacaaaaaaacccgccatgtattatctcacagctctgtgggttagaagtgtaacttcggcatgactcaactgggtcctctgtttagagattcacaagacggaaaggcagaagttagcagggctttgtttcttactaggggttgtgagaatgaatccacttccaagctcactcagctttgcctggttcagtccctggcagtggtgagactgaggccctcaaagctttgctggctgtcagcagggagatagccctggccttcagaagctgcccgtattccttctcctgctgtccagcgacagctactcgagtctctttttgctttgaatctctccatgtttctcttttgccacatcactctgactctagttggagaaagttgtccaccttgaaaggctcattccatgagactgggcccacccaggtagttcagctcttctcctgatctcaagatctgtaacttgaattacatctgcaaagtccttgtcttagcctgcttgggctgccataactaaatgccaaaaactggttggcttatcaacaacagaaattcattgctcacagttctagatgctggcaagtccaagatcagggtagagtgaatgtcaggtaagggcccactttttggcttatagaagattccctcttgctatgccctcagatggtagaagggacttgcaggctctctggagtgtcttttaaaagggcatgaatctagccaggcatgctggctcacccctgtaatcccagcactttgggaggccatggtgtgtggatcacttgaagtcaggagttcaagaccagcatgggcaacatggtgtaaccacatttctactaaaaatacaaaaattagctgggtgtgattgtgggtgcctgtaatctccgatactcgggaggctgacacaggataatcacttgaacccgggacgtaggggttgcagtgagccaagattgcgtcactgcgttgcagcctgggcgacagagtgagacttggtctcaaaaaaacaaaaaaaggtacaaatccccatcaacagagtcctacccttatgatgtaatcacctccttaaggccccgtcttctaataccatcaccttggtgttaagatttcaccatatgaattaggggtgagaggacttaaacattcaaaccatagcagtcacctttgccatgtaaggtaacatatttatagattccagagattagggcatgggaatatttggggggccgttctgcctactacaatgatctcatcacaatgataaatgttagcagacattgctctgataacgacaacagctgctattttttaaatgtcactctataccagccactgagatagatacttcaaattgattggatcatttaatccccatcacagaagagcaaagtagagactattattcatctcattttacatgtatattttttaaaaagccaagacattgaatgctttggtgtcttgccctgggtgactcagaaggaaagtgtgaagctgagaccctagccaggaggtctgactccaaagccttggctgctaatctttttgcataacccatgtcttccttgtatctatgccatctttatgatctgcttacttgtacattgccactcccttctggtgctcaatggctctgatttccttaagatagggttacattattcacccattacagaccactccaagacatgtgttttgctcaatgattgtgtgtgcacctgtgcacctatgcacatgtatataatggtggacagtttagccattggagctccccagtaggagccagtgacattagtcacatccagaaacacagtaaaatgatcaccatcgcaggtgaacgctgactcttttccaaaggaatatcgcagaagctggtaaaacagtcgcatccaagatcaaacaagacatcggccactggaggatggtggtcacttctgcaaaatggatcaggaggatttagaaagtcattatggcagaatgggatttggggttgccaaggcctattggacctcttttctagtaatttcacccctttcagggacatctacaagctattgttaaaaatccctgagtgtttggctctccatttcgtcttctgttaaatgaggcaatatctacaatgtcctctctaggcttttaattggatcccccctccccgcccgaaatacttcttgtattgtctgtcttttttttttttttttttttttttttgagacagagtcttgctctgtcgcccaggctggagtgcagtcgcgtgatctcggctcacttcaagctccgcctcccaggttcacgccattctcctgcctcagcctcccgagtagctgggactgcaggcgcccgccaccacgcctggctaatttttttgtatttttagtagagacggggtttcaccgtgttagccaggatggtctccatttcttgacctcgtgatcagtccacctcggcctcccaaagtgctgcgattacagggatgagccaccgagcccagctattgtctctcttctatcccttggaattgccttaagctagcatgttacctcttccagggcatggcacgcctcctgctgtctcttacccggtgtctgctaagctcatccttagaaccccaagttattttctacgtcaggggctttgcatattttactttttccacctagaatcctccttttgacattctttacaaacctagctcaatcttgtcagcaaactctcagctcacatgtcacttccttagaggatcctctgataagcccaattgaagtacacactcattacaacttgtaattaattgattttctggcctgccttctcgtgttgggtgggatcctctacaaatctgtaggcgccataagggcggagaccttggctgcttcatttgttcttgtgtctcagtgcctcagctgtacatgtaagtgaaataggtgtttgtggaatgacttgggagcagcaccgtcatctctactttcctataaggagtcttgtgcatggcctagcacatattctgtccccaagtccatggaaagcactgcctgccaggctatttgtgtcatttcaggaaaataagacaaagttaatagtggtggtaatacttcactagcttccaagatttgtcaggaatatgctgtctgcttttctaaagcccactctttactggagtcttagagtataccctggggatcctttgcttctgggtcaataggagcactcattaaatgcagatttgtgggtccctcttcaagccgatgaatcagaatcactaatgctgaaccccaggaatatgcatttataacaggcaacccaggtaattcttgtctacaccgaagtgctggaataactgatgtcgagtgtttgatattaactgttatctgttcatacatacatttttttgccccaaagcatctcatggtgcttctctaagcaattttgttgcttaaaagaatgacagactggataactggaagcagacatctctctaacagatctcatcgttccagttttaagtagaaagtgcatcatctgtgttttctgatcctgagcttaggttggagtaaacctgctcagagactttctccaggattagctagccctggggcacaggggaaaagatgcctggttttaggcaacagtgaacaccatctgggtcagcaataggattcaactgccaaaaagctagcacagttgtaatttgcatctaataaaaggagatttatagaacaacaatccttacagctctactctgaagtattgtacgtacagttaatgtcattgctgtttatggttttaccagacctatactatttaatagagataataaaggttaagttaagtgaatgcttatttcatgccaagctagcgcttctaactgcattatctcattaaattcataccacttcccagtgaggcaggtactcatgtttccattttaaggataagaaaagaggggcttagtagctcggttttaaaaagtcaccccaggtcctagggtggttaatggagcccagatgtgaagtttgcttcaactccacgatgtcctgccttcatctgagcctccccaggaagacagggctcggaatattcaggaaatgtcattgatctggatcccagctctgcactcactagctgtgtgtccttagcaaggcatgttactttctgaatctcagtgtccacatctgtaaaatggcaacagtgacgcttacctgcatgaattattcagtgatgatgcccaggtatccacatcattcctaggtgtgtgcaatcaagggagttatttgattaaacaagctgctctgattatatacacaatgctaggttggggacaccatacttccaaaggaataaggacaaattagagcaggaagagaccaaaatggtagaatgaccaggaatggtctctatgaatttgaggattttcagccacaggagagactgatttaatcaacacatatttacagagcacccactctgctccagggccctgtgttaggcacctggaaaacagaggcgaaccaaacagatatgtctcttatctctatgtagcttcagaatatttagcaaacactgcatataaatatgtacatattttaaattgcgatatgaaggataagtaacacaagcatctaacagaggtaactgatagagtatcttctagagaggaaatcagacttctttgcatccctatgtgctaatataagaattctgagttaagcataatgacacggagaactttccaatgagtctcctaggcgacctctcaatagggaacaagtgctaaagacagacagctgctgggtatggctgttgcagggggtctcatacataccaagtcttatagacttggcagtctttaaggtcaaccagattttatctgtctgccttctagggttttcttgaagacgtgcactttgaacaaagaggacattgggatgtaacaaccacagtggttgaaaaaccccaaatgcccagagagaacattcaacccttagaatgttagagagggcagtataatataatgggtgagaacatggattttggaatgaaataaacgtgggttcaaatcccagctctgtcatttagtagctgtgggactttgggcagataattcaactgtaaaattgtggtatgataataagagtgaccttgctagggtgtctgaggattaaataagattgtatacctacagaaaagtggggatataaactcggatctgtctactgggacaccccttatcttcccatggtgcacatgcaacgtcttccccacttccacttcatctctttggaaattacttttgccctgcctgacttcagtctttacagagtccttctttgtttcctgagagctcaatctatagccaaagtaatgagcctgatctgattcagcccaagaactctggtcattgaacttgacttggtatgtccatcatttgtacattttggataacaggttattgctaagagggaaaacctttagctgaatccaatacattcactgcaagtgaagcagaaggaaaatgcctaattccgacttgttagccgctgaacttctgagaacagaatcagcttagctgcttgcaaataagcgagcatcacagaacttggttgagctggcaagaaggtaacaagctgtgtgtgaaaaccctggcattaaatctccacagtaaagttgcttggtacacaggatcaaaagagctgaaaagggtaaggagacaatgagcaagctcctttctgcatacccgcccgacctttaccattgggaacaccccaaagagtgtatgctctggcaccttatcaaaaaataagactgtgctttagattataattaaaacaataaattcttctcccctgcgtgtatcccgattagattgttgacactgtgtcaagctgttagggagataaactcacgctgctacttgcactcaacatgccgcttatttttgagtcactcggagggtgtttttttttttttttttcctggtgacaacttggaaataacccattggagtttccttccttctatttctctatgaagttattaacactgatacacatggaacttcggaaatgggacagcttccatcttggtgttgatgtaggtcccagaatgagccttttaggaatctggggaacttatgtgttggtgaaaatgccagaggacacatgcatgcataggatgctttaaagtcttctgaagataggttgtttaaactgtggcaggaggtctggggtcagcctctgagcagggatttaggagattgtctggctcctcacccttgtttctccaagcatcaagagcaaactctttcttttgggtggatgccactgatggctgaccaagagtcaagggtggggaggttgcgaggatcacagggtcccgtccaaatgacctgattcaggaatttcgggtcttgagccatggtcccagcaaggctgagtaattttttttttttgaggcagagtctcattctgtcacccaggctggagtgcagtgttgccatctcggctcgctgcaagctccaccgcccaggttcacaccattttcctgcctcagcctcctgagtagctggggctacaggtgcccagcaccatgcccggctaatttttttgaatttttagtagagacggggtttgaccgtgttagccaggatggtctcaatctcctgacctcatgatctacccgacttggcctcccaaaatgctgggattacaagcgtgagccacctaattttttttttaattcttagtagagacagggtttcaccatgtcggtcaggctggtctcgaacccctgacctcatgatctgcccgcctcggcctcccaaagtgctgggattataggcgtgagccaccgcacctggccccagcctgagtgatttttaattcctaaacctatgaggctatgtttgtctcatcttcagacctttgcctatgaggttttgtcacttgcaatgaccttacaatggcacgcttttcttgggccacctcagctcatccttcatatctcagcttgcatgtggcatcctccataaagctttttaaaataatgcatattttattttgaaatagttttagatttattgaaaagttgtgatatagccctgagttcccatgcacccacactccgtttcctctcttcttaatgtctcacatcattatggtacatttgtcacaatgaataaaccacattgaacatggaaatttccccttttaaatatttttagtgtacaattcagtagcattaagtatatttatattgttgtgcaattactaccattgatctccagaactttttcatcttgtgaaactgaaattctgtccccattaaacactaatttcatccgtcctgctcgcagcccctggctactttctactttctgtctctctgagtttgactacgctaagtacctcatataaatggaatcatacattatttgtctttttgtgactggcttatttctcttagcataacgtcttcaaggtacattgatgtgttcaaggtgctacagcatgggtcagttttttttttttttcacttttaacattgcataatattccattgtgtgtatataacacatgttatctgttcatatgtcaatggacatttaggttgtttacactttttgattagtgcaaataatgttgctcagaaagcctttcttaatctgactgtataccccaggtgcacccttgggtcatctctatcatagaacttatctcacagagtataagagctgatttctgtgtctgcctctcacactagacttccacatccttagtgcaggtgccctgccagtaagttgttcaccattgtttccctatgatgtagaagagttcctggttcatgtgacatgctcagcaaatatttgaaatgagtgattgtaggaggaatgaatggatagttggttggttggatggatggatagagggatggttggatgaatgagtgggtgggtggatgagtggatggatggatggatggatagttgaatggatggaagaatggttggatggatggagggatggttgggtagatgagtgggtggatgggtgagtggtaggcagatgaggtgatggatggatggatggatgggcggatggatggatggatggttggatggttaggtgggtgaatgagtgagtggatagacggatgagtgtacgtatgtatgtatggttagatggaagagtggatgaatatatagatggggggaaagatgaatatatccagaggatgagcccaagcagattcctcaaggagtagaatttgatttatgccattgatctcactggggtggtcatgtgatgataaacaagagttcagggcaaagaaaacacaccaggttaaagtagcattgagcatagaaagagtagatctcagggcgggatgggggagtataatttgctttactttttttttttaacctaaaaatatttttatttagtgtttcagtaaattaaatcaatgacagtcttttccatgatcctactgccaagatagattttattgaacttttaagtataaaaatagtgcacagacagataataataggagaaaataaggaataaaatgaaaatgttcttcccaaccagtctctctataaagataaccacagtaactacgtcttgtttatttgccattattcttggggggattttctatgatttgtgaatatgtgtctgccatgctcttttttaacgagtgcctgtttgttcattgcataaagttaacaccacttaactgttcctcactgagggggacatttagctttaggctatttccaacagaactgcaatctctttaaaataccttgtgagtatatccataaggtaaattatttgaaggaaaactgctgggctaattttttttaatgtacatacacttatacattttggtagatgttcccagatgcccttccccaaagtttgcaccacctgatgttaccatgactcatttttattgctgtcagtcatttagtgtgggtgaggcacccttgttaaaagacataaggttggagcacatagtccagtttacttctgaacatcagtaggacatttcaaaaaaaatgagtcctgctattccctaatttataataaattctgagacgggggtggagatggcttctttacccatgagctatgcacattagatcaaaaaatgggggagaatccagagatgttgaactcaagcgtgatttgaaattctgtccattttcttgccctcagtggatgtttttaaagtagaagagacaggaaaggttaagactttcagtctctttcccttaagagtgatgtgtgattctctactgtctgggagctccagggcctgacccacagattggctgtcactaatgctgggaagaggtgtcactagtttagcaacccttcattctatgccatttcctgcttccatgggtcaaatgtcagcaccgttcaacacgggctgaagaagctgacaaaaaaggtgcttgggactggatctttcacagagtacaaatgaggtagtagtggaacaattggtgaacacactttagtatatatttgacacaatttagctgctatgcctggcatctctccttcagcatatcctgcctggtagttatcattaaaaaatcgaagaatatataacatgtttataatttcttctttttatccatagttcaaagggagaagcatagcttctcttttaagagatagaaagatatagacatagacttagatgtatgtcattattctcctttaggataaaaggtggctagggctttataaaatttcagtgtaaatacatggagtaccatgtatttaccaaattaccaaatagtaatttggaggaggggatcttcgtcaacaacataaactttccattaacagtaataccctcttgcagtgtcacacacgagtctttataacttaactcatttggaagtcaattctttccagtgtggctgaactataagtctgaaaccagtgttatgaaacttgcaaagaaaagattaagttattctgatatgaaaatctttattttagaatgcgatatttatgcagtacacagtgcaaatatacaacatagcgtttactgtgaaacgactccttccacttctgtccccagcaattcagttcttctcctccgagactgcactgtagctatttttgagcattaatccagaggcagtcaattaataaacaagcatattcacacaaatagtagcatgtgatcatatgacaggaaaaccaagttcccagactgtggcaaaattgtttcactaaggataaaagttacagaaagtatacttgtttggcagagtttattagataatattattagataaaagtgttagcaggataggatgaattcatggaaatgtgggatttctcttatgtatgtattgctttattaagagcaaacgcaatattaatatcacaggtttagacgtctgaaaaacatacagggatttggctatgcctttcataggctgtgtgatgtcagcaagctctccattcctctcaacctcacagtccttatattcaaaaagcagaagaatgtctctgtccaagggttgatacaaacgatgaatagcattagattaaaaggatctccgctaggtgcagtggctcatgcctgtaatctcagccctttgggaggctgaggtgggtgaattgctttaagcccaggagtttgagaccagcctgggagcatggcaaaacgccatttctactaaaaacacaaaaactagctgggcatggtggcgggtgcctgtaatcccagctactcaggaggctgaggcatgagaattgcttgaactcaggaggcggaggttgtagtgagccaagatcacaccactgcactagaacctgggtgacagagagagacttggtctctcatatatacatatatatatatttatatataatgttatatatacatagtatataatatatattttatacattatgtattcaaggtcctttatacataatatatatgtatatatgtttatatatgtacatatgtattatatatataatatatataaaggaccttgactatagtagtatttagcgaaagcagtttgcttgttttcctctttacctgctacccatattatgagttacaggagcagctcctcaaacagtaatatcttgttgtgctttatatggctaaatttaatggttaaaaaagaaagagagagaatgtggtggaatcaaagagtagtttcttctgatttactagtatgctccctccccaacctccacttcttggctgtgttcatacatgaatggagtgtgtagacattcattctcatctactaattgctttcttcatagacaattctagtgattacagggacattgattctaggggatgtgccaaattacctaagtgccatccagctctcaaactttttgtaacctccctcaagcaccttttgaactctacctattaactggcaagcaatcgagacgttatttaaaaatcaatattatcttttcattaaaaacagccccccggccgggcatggtggctcacgcctgtggtcccagcactttgggaggctgaggagggcggatcacgaggtcaggagtttgagaccagtctggccaatacggtgaaactctgtctctactaaaaatacaaaaattagccaggcatggtggcgcatgcctgtagttccagctactcagggggctgaggcagcagagtcgcttgaacatgggaggcggaagttgcagtgagccgagatcgcgccattgcactccagcctgggtgacagggcgagactccatctcatgaaaaacagaaaacaaacaaacaaaaagcagccccccatctctctcagctgttatgctgctgagtaaatggcctcttctcacctttttgtgttccccagtgcacttcaccttcactgtgaaggtcatgtattcatgcttctaatgttttacaattaaggataacatctccactttggtgaatttaatgagacttggcagtgaccccagtgacctggtgaacagccaactatttaggttggtgcaaaagcaattacggtttttgcctttttatttttaaaatggcaaaattaaagtggcaggaccgcaattacttttgcaccaagctaatattaaggagcctggctctaaagtcggactggctttcatcccttattacttgtgtaactctgggtaagttacgaatatgctttccctttccagttcttaatttttcttctgtaaaatgggcataatcgtagaactggacttctagaatgtctggtgaggattagatgagtataaagcgttcaccatgagggttctaatcatttagccacagtaagcattctttgtgtgttggctgttactgtgaatgccatttagttacctgaatccattcatccacttcgtctcatatattttccaatatttatggagtgcctgtgttggtcaaagcaccaatgcagagccgccatctttccctttgatttttgaatgtcccaggatggtactctagatggttccacacaatccagctgttgataacaaagacaggttgttcaccaaatcagagagtctttgagagttcagaagagtttaaaagagacagatgggtgcctctttcatggccccgagcttttctgtagaggttgtctttcacgtggagacatctctgttccttttattttctgttgactcatagcaactcgggagggagattattgaagaacaaaagggaggagtgtgtagttctgttttcaacactccttcaaagggaggagtgtgcagctaccgattaatagatttgaaggatgggcattcttttttttttttttttttctttctagatggagtctcgctctgtcacccaggctggagtgcagtggcgcgatctcggctcactgcaacttctgcctcccgggttcaagcaattctcctgcgtcagcctcctgagtagctgggactgcaggcgcatgccaccacacctggctaactttttgtatttttagtagagacggcgtttcaccgtgttaggcatgatagtcttgatctcctgacctcgtgatcacccaccttggcctcccaaagtgctgggattacaggtgtgagccacacacccagctaggatgggcattcttgtagagagagatagctaagatcatgtttctggcatccaagctcttggttataactctgggtttgctgcttgccacatgaatggcctcggacaagttattgaacctatctgggcctcagattccccatatgagaatttgattgtgttaaagtattagggtagctaacagagcacctgaaagttattaatttgaatatatgttggtaacagattataaagttgtgaggtagcatttatttggtgcttactatgtcccaggaagtggggtaagaagttcacatcatgtctggcagtgtagtaacctgcagaagagcca[131 bp omitted]ctcccacctcagcatcctgagtagctgggaccactagcacacatcaccacacccagcaaatttttgtagtttttgtagatactagagatgctgttttgccatgttgcccaggctggtcttgaactgctgggctcaaatgatcctcccacctaggcctcccaaagtgctgaaattacaggcatgagccataacttctggcctagtcagaatatttgtttgaattcttaccctcacaattacaagctgtggccttaatccctttccttaatgctttcttgtcttcagatcctccatctggaatacgtgaagatttaatgagatgatatctatataacacgctttgaaaaatgcctgacacgtaaagatcacttaataaatgttggttattcttactgtattaaacatcccaattattagatggtataacttgcccaggttcacacaactcagaagatacaagaggaaaacttgagttggttttgtcagctcttctgcagacgtagggggctaaatgagtaacattctgaaatgaagtcttcggcatctccaagggataaggatgcctggaaatttcacctttggggcacattctataaactgtacaaaattaaatccctcacttcatttccccagaaagacccctctgaagcattgctctgtatccttgcaaatctgtaccacgagacaaggggatgtcagtaggatttggtctccccacaaaatccctgcaaagatgtatgaggctgcatataaattgcattgaatgggctaacattgcttttatgctgaatatcggcaaaaagtatgaaatggagattacattttcaattctggctttttcccccaaagctttaccaagctgccctcatcctcacccctccatcatagtgcaattgcattggtgtggagtcctagctctcctttccttgctgggaagtgtacctaacacttgctgtcaggctggaaccgtgggtaacatgttccttaacagcaagtttctttattttccttcccccacatctctgtcctttttttctcactactttttgttgttaagacctgtcacacatgagaatcacaaaaccaactacaaataaatggcattcttgtggatgctaaaatcggtatatctgtctcttgggttgttcagggtagaaataagacatcgatgcaaatatggttcatccaccggcaatgagacacaggcttattatttcttcctgaaatacatatattcatatcatctatttcagtttgtatctccaaacagccctaaatcattgtgaggacctgggctccagtttgggtctatgaaaagagggtttacccgtggggggtcggggggtggttgtgcatctggttttacatcagcattaattccgatatttcaacagccccttcctgcccacattccttgcctctcccttctgccccctgaatattattgcctggctgactccccaaagagaaaatgtactaagcgaacttgacagattccggctggctccatatggcatggcctgagtttcgtgttcctgggacccccaagctgctctcaccttattacgatggtagtaactacatgcaagtcaagtccactgcattggttttaattccttgggccctggggactagcctcagacttcaaggtggcattggatgcaacatcatccactgcaaatatgacctttcccttctcttcccataaccacacagctggggggaaggtaggtggaaaatagaccctgagtctaggaaaatcttcgaaaaatgcagagataatatcagagggctttgctagggctggcagcagagtctaacaaagacatcttaaagcatcttgttgtttattgcttgatctgaacctttgcactcccacacataattgagactttgactttgattcataagtatataatttgaattcctccttctctctacactgttttaaagccatggagaaaattaactccaaatcgaataagtgcatttcaaatggataagcacttgcaacccgatgattaaggagtgcagttgaatcccatatgtttttaaataatcagaatttgttagaatgcatctgtaaaagaaagttttttgacagcttttcacttcacccagagtatatagaaaatgttgctaccttcatgtaatgtagtcttccatattctgacagaactatcattgcgtagaatgaagagaacacaaagagggcagagagtcaccttgttcaaatagctaaaagggatagcaagaggaagatagactttactccaggtggcccaagggaaaaaaatacatctaaagggaaagattttttaagggagtgaggagtgggaggagagttagagaaatagtgtagcaatctgagctgctgaagagaaagtgctttagtgttcacagtaggggctgcagtttgcagaggctagagagggggagtccctggtaccatgtctgaagttccttctaaccctgaggtccttgatgctgggcattggcacacctcacagtgagatgatttctgacacaaactggattggtcaccattataaatgattcaacttatttcagaagccacttttgccagctttccgctatatgcaacaaaaacctcaacctctgaatatgaaaaattcaatccatttgctttccttttagctaaaaggaacccaaaactgactccgcttattgctggatttgtatgctacttgctaaataaatggatctagtctagatgccaacaataccctgaggatgtagaaaacctcctttgcttgagtcgagcgccttgaaatagctctgttgcatcttgaacggggctagtttgttaattcgatgagtaaaggggagagtaccatcatttcgtttgttcccgtgcggaccgaacacggtattagcctctctgcagatacaatctcacttagacgtaccagccactgtgagagtgtagaagagtttatcccgaatccacaaacaggaaagtggagtcataggcaggaatgcactcaggttgtggtgggaagtggatcaaaacccagttttgtttttttttttttaattttaattttagggacagggtctcggtctgttgcctaggctggagcgcagtggtgtgatctcggctcagtgcaacttctgcctcccgagttgaggcaactctcctgcctcagcctcccgagtcgctgggattacaggcatgcaccaccacactggctaatttattgtattgtatagttttgtagagatgggggtctcactttgttgcccaggctagtcttgaactcctgggctcagtgtatcctctggcttggcctcccaaagtgctgggattacaggtatgagccggggtgcctggcccaaacccaggtattttactctacaatgcttgcccttttctcagcccttccttgcttgcaggacacctgaagtcccttgagctgctgtctatgggaaaggactcaagagcctgccttttcccgggtgaaggtagctggttgggcctggggtgtgaagcatgaaacaggtactgtgcatctcaccacagctcagagatggaaggatgcagcttcttctgcttttgttccacttcaagtctagcccctcttggggctgcttctctccgaggggaagtggggcacctggagggggggcaggtgtaggtgattggagctggaatttctctagtgtgatagtggcatcagctccacattctccccagcatgtcgaatttgtaacaaagctagatgtgaagagtcttccccagaacatccctcaataatttgttttaataatagacattttcagcttaaatgtgagtttttatcggagatttcccccttcccaatttgtgtcagcaaccgttattaaattcctaggaaaaggcaaatgttggggcttggtcagaagtgaggccgacgtataggtgccagttccagcctgatgttccccaccgatgtccatgtgctgactcagtaaacaactgcctttcttctgaatggtctatgtgagctgttgattatcatgttcttaaagaaggctgaatatcttgtgcctttcttgttaagcctgtgtgtcttgggacagctacacacactctctaagttacagttttctgagctttgggtgaggggatgttcgtctttttctgcctgcagcactgggcctcgggaagcaacttagggttttggctagagcaaggacagatctgacatctagtccttcttctgtgttttctgtcaatcccagtttccctctctttcaacctgagctggtagcactatccttttactgtttagagggttaagagagataacacctagtatatagtagctgctcagaaaatttctcgtttccacaaatgagaaagtgaatgcaatagacatttgagaacagtaaatgtgtaatagaattattagttctttgttctaattgtcaccggctccgtttaaaaaaatacatatatggtatttactttgggaaagctgcaagccctgtctccatcacctccttttttcaagcgtggactcattttcatctgcggattccctcttgcctgaaggccttggtgccgcatgagcaagtgcagtgctgagagctgtgtatggagctggaagcacaggccactttctgctgccgagaaatcttctgccctccgagggcacaggcttgactgcaaggggatgtgggaagccatttgtgagaagtcgtaattaatgatctgctgggccttggcacttatggaggaagcagaaagcagctgggaattgaaacagcctcttggataaaagttgtcctcctggggctgcttccctctgaggggatgcgagggacctgggagggaggggcaggggtaggggtctctgtagtgcgaattactcaatgctactgtcttttccacagcttatagggctgctacctgccatgcatgatatccaagtgatatggccaaagaaccctagctcttgagacaaaacatcctgggcttgaattctagctcttcctattgctccttacatctggacagttgccctccatctctgagcctatttttttcatttgttcaatgaggatggtgctacatactccgcaaggctgtctggattagaaactgagtaacataaatggaacagagtaaggactcagaagtacttgggataaaatatacagcaagaaacatagagcccccgtcttcagggtgcttacggttttgtggataatagaaatcgcattatctatataatgtgtaaacttgtggatatttctgtagatattgctgtagaatgtatgcacatatgtcaggtgatattagatataaattgctgctaaattattcagatacttctcataatataaattgttcttctttggtggaatattgggatgcctctgtagtgcaaattactctcttttggtgagttagcaagaatctatcataccttaatttgatcttacttgctgctaggctgatttgaaagttaacttacccttcagatgactaagggctattaaatccctgaaggaatcttgcagataactacagcaaataacaatatcttctattgaaaacatatttggtattccttgtaccaaccttataagaatgctttgagtatgacatgaactacagatactccttgacttaggatgggatcatactgcaataaacccatcataagtagaaaacataataagtcaaaaatgcacttaacacccctcacctactcaacatcacagcttagcctagcctgccttaaaagttctcagaacacttatattagtctgtagtttggcaaaccatctaacacagaggctatcttacaataaagtgttgaatatctcatgtaataattgaatgcattactgaaagtgaaaaacagtatggttattatgagaacgcgagatacggtttctcctgaatgatttcactttcacaccattgtaaagtcgaaaagtcttgagtcggggcgatctgtattgcctacaaatcaagccgtgcagcgtccacacctagcaagggctagtgatggttatcatagcaacaagtcctcctgctctatagtcataacaataatattttgtagcatctattccattgtgttgcatgaagggttacagaatctaatatatgcagaacgctgggcacagtgcctggtgcattgcattgtaagagctcaaacagtgtcagctgcaatcatcctcattaattctatcttcgcagtaactctgtgaagtgctttagggaggcgttacagtcccactttaccggtgagaaaaatgaggctcaaagaggcttgttcagtccgcacagctgacagtgattgctgcgtcagggccagctgtagccttattcctgaatttctccttatacctcttcagcccctccttccatttcatcccagttgttgttgttgttgttgttgttgtttcttaaatcaagagtttgcatgcatcttccctttgattgcctgggattttttttttttttttttttttttttggaaagcagtcatgaagatattgcctagcctcgggtacacaaattctggatctgctttccaagagaacccaggaggaagaagatgctgtgacaggcatttcttatcagggagaggctcccctgcttgcacttcgaatccacaatgatgaaggaattttccttcctgggcgtatttgcttatgttcttggatgtgctggtaagcccctgcctacccacctctatgtaaatgagtcctcccacaagctcgggatgttctgtccccaaatcctgaacaccatgtacaggagatgggcttagatgttgcagaagcaaagactgagaggggggcagcttttggctgcaattaactccctttttgactttatcctgggttggaaaagaccttcacctggctaggagatctgaaaatgtgcctatgattgtcagctgattttcccaggtcatgaacctgggcccctcagcctggaacaccgtgggaggagagggaagccaccctcgtcactaaaaggtgctacccttttattcaccttcctcaagttagaagaactgtttctccagctgtaccaaggctgtgctggaattgggatcgcagagcagtgcagaatatttattaaccacctactatgtgactgcggaaatagactcatcaaactattttgggtccctcctggatgctgtgagagacctaaagtaaatcgttgcaatacttgggttcttgacgaagagcgttggcttcacaatctggcagacctgttgtcctatcccagatcagacttactgaacctgtgaattggggcaagttatttatctcttctagattcatttcccttacttgtgaaagatggtaataatgtgtgtcatgtaaaaatatgaggatattagataagcactttgtggtgtcttggacctaaaaagcagttagtgtgtggtggacattgtatatctttaatatccagacctttcctgggatgccaaccttgttatctacagacatactgcctgagggtggaggtttgaattgaggatacagataggacagtgttcttattggggtggctgataatagaataattgcttatttatcttataggttgggaaatattggtattttaaaggtgggttttccagagttgggtataagttcagctacccaagacaacaggttactggggctgtatggctttgcatccagagttaaaagccaggcctgggaataattaaaatacttttcatcctgggaaattctgctttaactggtttatagcagaggctgcgcatcagatgttttcaaaattaagtgatggtttatgtacaatctaattcatccgcttaagtgtacagtttgaattttgatgattatatacaatctcacagtctccactacagttccttgaccttaagtttccttacgctttattttcagtctattctgcccccccattccctaacccctggcaagtattaatcagctttctgtccctgttgttttgaatttcataataaatggaatcatactgtgcagagtcttttttgtttgagtcctttccctgagcataaagtttttgagattcagccataattgttgcacatattaacattttgttccttttcattgctgagtggtacgtcacggtaggaatataccaagatgtgtttatccattcaccagaccaattaatggacatttgtttctagtttttggctattaagaatgctgtggaatttgagtacatgtctttatgtggacacatgtcttcattttggggagataaatccttcaaagtagaaatgctgggagacatggtaagttcagatttaacattctaggataccattattgttgttatccaaagtggctgtgccattttgcttttccactggcattgtagcattgggtatttatttattttttagacagagtctcactctgtcacccaggctgtagtgcactggcacgatctcagctcactgcaacttttgcctcctgagttcaagcaattctcctacctcagcctcttgagtagctgcgactacaggcgcccactaccagagctggctaattttttgtatttttagtagagacaaggtttcaccatgttggtcaggctggtcttgaactcctggcctcaggtgatccgctcgcttcagcctcccaaagttctgggatgacaggcataagccacagtgcctggctggcattgggtatttttcgcacagctcccagatgtttatattgttatgtatctaactagcatggatatcctctgggctctgttttttctgatttaatggccacctttgggctatcagatgaataaggatattgtcagtatcaggaaagtaaagaagacatttgtcccaacccatatgccccaagttgttcaaaactattgaggaaagagatactgtctgggttttcataactcagttgcatttttatgtcttgcatatcaaaatttgtatgcagggttacgttccccaacattaatccacttttttttttttttaataacagaggacttgacttagataaagagaagtcttattccctcaggtaggaagttgtttccacctgctatagacacattagttaataatcaagggacaggtgtgttcactgacctacctgttattttgttttacaactataatgactagttctgtttatgcatgcacacacagctgcaccctcgcgtgttgcttttccctcatgtttccaggcagaccacgcagtgactatttaatgctttgccttgctatgcgctgttgcttatacatttctggaagacattttcccatcctctgcagtttaccttgtacttttattttctccttgttgaattacaaatagattaacacgctcaataggttttccttgaatccagctgaatgcttcaacctcccacatgtgctttttttagttttgtaacatgacagggaatgaggtgaatgagctgaggatgtggcctttgtcttgggctgaagcagttctcaacccccagatggcttgtccctactcccccaggcaagagcccatacctcaagattataaagagaggttttaaatagaagattgttctatctaaacatgtgcctaactgacatctattttgttattatgtgaaacacatccatatataatgtatatgtatccataatgtatgtacatatatgtatttcccaactctctcatgtctgaatattacatcccttgactatcttctgtggctctccgagtccacttggcatttggttatcagcttatacttaacagcaagtgtcggtctgcaggcccatcacctatttttgtaaataaagttttattggcacatagccacacccatttatttacatattgttcatggttgctgttttgctacaactgtgaagttgagttgtgtcaacagaaatgtatgccccatagagctgaaagtgtttcctgtctggctctttacaggaaaacacaatttctgatccttcttctgtgctaccacttggtgtgtttgcaacttcactgtgctgtctgtgggtatttgtgtgtttgtgtctttttttttttttttttttttttgagatggagtcttgctttgttggccaggctggagtgcagtggcgtgatctcagctcgctgcaacctctgactcccgggttcaagtgattctcctgcctcagcctcctgagtagctggcattacagtcctcctgagaacctgccaccacgcctggttcatttttgttttttttggtagagatgcggtttcaccatgttggccaggctggtctcgaacacctgacctcgagtgatccaccctgtcccccggcttcccaaaagtgctgggattataggtgtgagccatggtacccggccttgtgtcttttctacgtggacagttagatttgtccagttaatcttaccttgggccagtcacttaacttctctcggttttatgtctacatccataacttgggcataataacagcatctcccctgtagagtggcttgaggattcaggggaaggcgagcaaagcacctggcattcacagtgtccagttcacatgacgagctcatttaatggcacccaggcttgatagaaggtatgtgttatgatctgggtggtatctcctgccattttggagcagatgctaagaagcaagtcattcagctgaggtctaggggaatagacagagatccaggccgttactaggagacaagctatgcaatagtcagggttccaacattgcctgcctcttccagcatccgtcacctcctgtttttgttcagcctccttgccactctgcagttagttcaaacacaattctcacttcaaggcatttgtttttgtctttttgaaatggagtcttgctctgtcacccagtctggagtacagtggcacaatctcggctcactgcaacctctgcctcccgggttcaagcagttctcctgtctcagcctcccgagtagctgagcttacaggtacctgccatcatgcccagctaatttttgtaattttagtagagatgaggtttctccatgttgggcaagctgatctcgaacacctgacctcaggtgatttacccgcctcggcctccaaaagtgctgggattacacgtgtgagccactgcgccttaaccactttcaggcatttgaacttgcagttcccactgcctcaccttgtttcctccaagacatccacatggtatactccttcctcaactactttatctcaaatagcggccccatcactgtcttgctccacgccctcatactcatcacatgtatgggtcattgtacttcatatcaatgtgtttatgtgtcagtgtcctgtctcctgtactgaaaggcactccccatgcagttgagaaattcatcttgttatatgcccagcacagtgaatttcacctgcgtgaaataggggagcactaaatattagttgagtaaatgcatgaatggatgaacattccttaaagtgggaatgtctttccatgtttcagaattctcatctgccatctctcttcccatgcatgaagataagcagtagactatccactcctgcacctgttcatatacatatagaaacacgcactgagaccgagcaccacacgcacagacactcacacacacacatgcattcaaacctctccatgcagacacattctctggagcagtctggatgcagcttgtaaaagtgcctcctcattcagcacttggacaacctaagagcctcttcagtaagatcctgatagctttattggagaggtcttgggtagaaaaaaagctgcagcttaatgaaggccttttaacagtcaatctcaattccaaggaaaagcaaatctattaccagcgtccgataatttctgctcagggattcccactcttggaatggatttttttttccagggcctcttttctaattaactctggagcgtagattacaagaggccggccttgtgaatgaagggggcacctcggcggaagtaatcactggaggtgatgtttaattaaagagatgctgttagagggaaaagacctgagcaggctggagtgctaatcctcttgccgtgctagtgtgtccctgcgtgattgtgattgatgagctggtcctgctcacatcttcatctgcagcgtgctcatccctgcaggaggggcttcagctccctccacatacatgcttagcctggtgttgttctggcatggtgaaagggatggctgtgcagtttccctttctcactctgcatttttctccttttctttttctcctttattatagctagatagttggatagatacacatttagatatacaactatgtacagatatatatggacctctatatctatctactgtctgcctgtctatctgctatcattctttcgttgtttgtctatcattctatcactctgtacattcatacattcattatccatatatacattcatccattgtctacctatctactatctacctgtcattctgtctatacatacatcaatccatcatatgtttatccattctgacatcgtctatctatacgttcatccgttacacacctatctactatttacctatcactctatttgtctgtacgtacatcaatctgtccatcatctatccatctatctatacattctcacatcccttatctagctatacattcatctattatccacctatctactatctacctatcactttatttgtatatgtatacatctatctatacatatccatacattaatctatccatccatctatccatctatacattctcacatccattatctatctatacattcatcccctacttatctactgtcattttatcattatgtttgtctatacgttcatcaatccatcagtctgtatacttcacatgtccactatctatgtatacattcatccattatctatgcctctaatctctctattgctctgtcattatatctacctacctatgcatctatctctatctttataaaatcttgctgtgaatctcagcgtgtctgtctccccatgtctgtgtctggctttgtcttcatttttctcattctgtccaaatctctctgtttctctgcctctgtctgtctctgtttcactgtttgtccttttgtttctcctaggtctgccctattaggtaattttagggaacgtgtaactgatacctttttttaaattcaagagtattaatggttgagtaatgtaaaagcaagtttttggttaagcatttactaaatgacaggaactgcctgaggtaccttttggcaagtatttcataattgttcttaaaatagcaaatattaatctcttaatatgtgccaggtcctaatgccaagtactttatgtattaatcccatttaatcttcaaaatagtcttatgttgtagcttcttttgctgttcctattttggagattaaaaaactgaggcttggagagagaattattattattattttttttttgagatagagtcttgctctgtcactctgctgcccaggctggaatgcggtggtaccatcatagctcactgcagcctcgaactcccggactcaagaaatcctccaacgtcagtctcccgagtagctgggattacaggcacacaccactatgcccagaaaattgttttttattttttgtagagaccgttttttttttttatgttgttccggctgatcttcaactcctggcctcaagtgatcctcccaactcagccttccagagcactgggattacaggtgtgagccaccacgcccagctaagttatgcatattatctttaatccacactttcgcacaccaagataacattttatttccaccttttaatgatgcatgtacaatggttttaaaagttaaggtgaattttccttggtcagagtttttaaagaatgtcattctagggatcttacttcagatgtgtctctctccaaaatgctccttttgaatggacagaaaggtagacctgtgtctccccatgtttctctgtgattgctccccctttaaatctgtgtcccagctacatttagtgaacatctttgccatgtggcttctgaatggaggaggctgcagaacttccttcagtcttctgagccataataaattggcagaaatgtctgatttgacgttttcccccccttgttcaaggcagatgcttttctcattactgagaaaagaatgacactttgtctctccaagagctcaggcgttcataatagataagtgtgcagtttctgatcttggagctgctagctctgctagactaggggaggctcagctctatcagggctctatccctggcgagattaggtttgcagaatctctactggagcttgtagctactcactagagtggattggtctatgattctagtttcactgtttatagttcaaaattttccagccagccaggctgtcttcttaattagaggggttgagtctgacatggaaggagtggataatgtacctttactccccattttcatctatcaatggaaaagaattaaaataaattcaactgtgacttgtttaactcccacattaacttgggttagcaaattctactttgtggaaggaaccatgaggaagaaaacagattgtaactatggtctgtgctagttcataagtccaagttcaactctggttgaggtgggggtgttgatagctttcactaaacctcaaattgttcattatcttctagtcttggtgaaacaagctttcccatgtctcaaaaagacccacctaataaatataatcaagtcccatcttacccagaaacagcacctgctgttactctctgattctcattgttttgctctgacattagggtgtctttatcagcctaaggatacatagattcttagacagtttcaatctcttatcttctttaggtggcctaaaatctaacactggagatctcttcatcatagcacccttggaaaactctgaaagctgtcataggtctagaaatccatcaactccagattctaaagagacaaccaaatggctcacacttcttaccgtacctgcacccacaaatctggctcttaaataaagtcatcagccctctaattatactaagatattcaaatcatgagattcgctctgaagccaattcttcaaccacccacttacccatctttgctttccgggcattgccacatccctttttcttggggtttcctccgcaggaacactccttatctgcgactttggttgactgtaaatcttgtactgttgctttgctatttaatgcaacttgtcatcttgtttttggccttgatttgatatcctagtaagggactcttcttgggttttgctttaagattcagtctgctgaagggctgtgactccattgtgagcagaagcagcctgggaaggcaggactagacacaccaaacatcagccagacaggtgatgtgatccctctgattttcagaattcctttgagagatcacttggcccttccctgctgatctttgggctggagtcaaggcaatcttttgaattagttctgtctctctctaaattatttgctttatgtaataggaacatgcctcatttgggctctttattttatctattttatttgaaacagggtcttgctctgtcacccaggctggagtgcaagtacatgattgtggctcacagcagcctcaaactcctgggctcaagcaatcctcctgcttcagccccctgagtagctaggaccgcaggcacatgccaccatgcccagctaattaatatatatatatttaaaaacatgtccttgtatttaacagaattttaaggaagaatttgatttttagtaatttacaacttctctggccaatcttccaaatctggctaattttcattgtaccactccgtgtgttccttttttgtcattctgaatattgatgattatagtctatgttcctaacgcctaggctgataacactctactcagcctactttgttcacatttccagcatcagaatcctgtgttccatgcttgtatgttgtggaacgagctcaattttcagcattaaatttaccatgccaaaaggtggaaaaagactctgcaataaacagactacttagcatgattttgtctgccttctgcatttggaattcccaacataacctaagcaggcataaaattcagttctttaagattcgtttaccaataagaatgttgtaaaaattcaaataaaaggaatgcagattagcagagagaatgctaagcaagttttttgtttctgtccttggtgctgaaaaaaatgggggtcaacttttctaccttagtgaatttaatgatgtggtgattgtatttaaatgactatgtgacaagggatcagatacttccctataatcattctttagtttcctagaactgtagaagcttggtggcataatgagagctgcctgtcacctaccctagaactgtcctgtctcatatgacagccactagccacatgtagctacttaaaacgacactaaataaaattaaaattcagtttcttagtgatatcatttagatattgtcccatctaaatctcatgtcaaattgtaatccccagtgttggacttagggcctggtgggaggtgattggaccatgaaggcagatttttttatgagtggtttagtgccatacccttggtggtagtggcatgatagtgaattgttgtgaaagctgactgtttaaaagcggttggcatcttccccttcactctctcttgccccgactctcaccatgtgacatgcctgcttctgcttcaccttccaccgtgagtaaaagctccctgagacctccccagaagccaaactgatgctggcaccaaccatgagctaattaagcctctcttttttgagacgtcccccaggctggagtgcagtggtgcgatctcagctcactgcaacctccgcctcccaggttcaagcgattctcctgcctcagcctgccgagtagctgggattacaggtgcctgccaccacacccggctaatctttgtagttttagtagagatggggtttcactatgttggtcaggctggtctcaaactcctgaccttaggggattcgcccgcctctgcctcccaaagtgctgggattacaggcgtgaagccactgtgcgcagccttaagccccttttctttgtaaaatacccattctcagggatttcaagaacagactaacacactcagtcagactgtctacctttcaggcgctcaacagccacacgtggctagagtttcctgtgttagacagtacagatatggaatatttctgtcatctcagcaagttttattggacagtcttcccctagaatcattgcaatagactcagtaacgcccacaaatctgtccacatcataatcactggaacctgcgagtgttactgtatatggaaaaaggacctatgcagacagatttaagtaaggagaattatttcttttgaattggagagattattctatagtatccagatgagtccagtgtaatcacaacagtacttacaagggggaacacagaggtgtagagtcagagtcagagaggaagaaaatgtaataacagaatcagaaactggagtaatgcattttgaagttggagaaagagaccacaaggtaaggaattaaggtggtcattagaagctcaaaaatggcaaagaaaccgatgatcctctcagagcctccagagccctggtgacaccttgactttacgtcagttgagaaatcagaactaaaagagaatatgtttgcattgtgtgaagccacaatgtttctggtaatttgttataacaacaatagaacgctgataaaatcatcattatcattgtcatcatcattatcgtcatctcagtaggtgcttggttttagtttgggttcttataattttgcattctcaaatagaaagtcaaaacaatttcttagttatttgaagaaccacactgataagcaatggcaccttttattttttgagattttcttattggcttgtgaatgatttcttctccgagagtggttatggaggcttaaacagtatgtcatgagttagcaatgtctagtgggggagctataatagataaaggtgagaagagataattcacatggccccactttctgatttttttggactgggatgtttgtcaattgcaattctcgttttgagcatggtggtcagatgagattggccttgctgaagcacaggcaagcatcccattaaatgcttttaggtgattcagaaccaaagctcaattcagtattttaaaggcgccctttggggagaccatctctggccttcctaccattggcggctagtgtgttattttccaagcccgctgtgtgatgatgggtgtgatgtgtcacactccttctctgctccctcaacatgctcctttcctcccaggctgggtttgatggattattttttctggaaaattttcctaaccccctgcacactgccatccaagtcacttcgcttaaataacaataacagcaataatagcacagagatgttcagcatagtgataagaaatttactttcatgacctaatttattgtagaaataatcctatgaagggtatgcagtttttatctctcttatgacagagaggagccaacactcaaaaaggtcatgatacttactcaaagccatatacctggtaagaggcaaagccagcatttgaacaacaggccttctgagtctggaagtggctttcattccgaaactcagcagaagtttctccttcccaaatgcttgagctccttaatatcaggaactgtgttacctactttttttttttttttttttgcactataaaatcttcattctttattttagatacaggaggtacatgtgtaggattgttacatgggtatattggaccaaggtaatgagcatagaagccaacaggtagttttttactccattccttcctgccattttagtagtcccccgtgtctgttgttcccttatttatgaccgtgtgtgcttgatgtttagctcccacttataaatgaaaacatgtgatactcgttttctgttcctgcattaattcagttaagataattgcctccagctgcatccatgttgctgcaaagacatgatttcattctgttttatggctgcatagtattccatggtgtagatataccacattttctttatccagtccaccgctgatacacacctaggctaattccatgtctctgctgttgtgaatattacagtgattaacatacttgtgcaggtgtctttctgagataacaatttcttttcctttgggtatttccccagtcatgggattgctggattgaagagtagctctgttttaagttctttgagaaatactcaaacagctttccacagtggctgaactaattttacacacccaccaaaagtgtatcagccatcctttttctctgcagcctcaccagcatctattgttttttgactttttactaataggcattttgactggtgcgagatggtatctcactgtggtttagatgggcacatatttccctgatgatgattataagcattttttcgtatgtttgttgactgtgtttatatcttcttttgagaaatgtctgtttgtgacctttgtccatttttttgcatgtgcagaatttattcaagttttaatataattccatctttaagtctcagaaacctttttacatttattttaagactacacattgggtacagtacacactgcttgggtaacgggtgcaccaaaatctcagaaatccgcactagagaacttattcatgtaagcaaacatcacctgttccccaaaaaccaattgaaataaaaaataaattactttttttcttctccattcaaagatactagactattttttttgaaaatcagcagaatttcattgaagttcctcatttaaatttatgtttgaatcctgtagattcttaataagtacttccatacagagaagaagctaataagaacgttccagagagatcctacagaacgtggtgtggtgggaagatactaggctgggtccacattctgtctctatcagcagtgagtcagtgcacacatcctaccttctgggcatcagtttcctcacctttttattttattttgttttacttttgaagtagggtcttgctctgtctcccaggttggagtacagtggcatgatctcagctcactgcaacctccatctcccagttcaagtgattctcttgcctcagcctcccaagtagctggaattacaggcatgtgccaccacatctgtctaatttttgtatttttagtagggatggggtttcatcatgttgaccaggctggtcttgaactcttgacctcaagtgatccacctgccttggcctcccaaagtgttgggattagaggggtgagccactgtgcctggccaagtttccttatctttcaaatggggatagtgatatctaactcagagcccttatggggatgtaatgaggtaatagatgtcagtcacttagggtgtatacatgagtttaatcatcatcatcatcatcattaataccatttctgtacccccaaagtgtgtgttcaagtacttgtccacattcagtggtcatagcaaggcctcagtttacttgaatgtatttacattccaacaatgtaaaccttaacaaagactttttttttttaaatttgaccactgcagtgttctcatagaaaagactacagaacagaaaaaaaaaaaacagtttgcattgtgtaattgctccaaattgtattttcttttagaaaataaaaaataaatcactagaatcctatttaaatacaagtttaaaaattaattattttgcactagacacagaatggactgaaaaaattaggattagagtcattggtacccatacagatgtgaagaagttgtcctgagagtgagcctctggtttcatctgtgcttctctgtctccacttggctttgtcacgtctcccataaatgaccacagtcattttattgcctctctccatgtccccaccttttcctgtctccagcctaccagccatttagtggccagcgtggtctttctaagacaaacctgaccatgtgaatcccatgcctggaactcttcaatggcctcccgttacttaaaggatcaaatacaaactactttatgtgtcattttctgattctcttcctatgcccacaaccttattttctagccccagttcctgctaaatcttcaccacacctatactccagccatattatcctgttttctgtgttcttttatgccctgatgctgagtgtgtgcttttcctcttccttgaatttgcacctaactcactccatcatctcctcaagattcctctcaactgctacatcctttaagaagcatttgatacctcctgtctctgaattgagagctttcttctttgccccctataataatttatacttataaaatccatgacacttgctttgatcatcgattttttggtatctctctttatccagatcttaatctgcatgagagcaggactattttcttatctctgaatgtattttatattaatgcaaaaacaaatgcttattgtgaacctactggggaccagacacagtggataaaggtacctctagtgcatttctaaacatagtcaaaaactacatttcgaatgaattaatgaatgcaagatatccttccatgtgtcactgagacttttaaaaagaactagtttctttctgatcaaattcaatggataaccttgcagagcaagatctaactcagaatgtctacggatgccttaagcattctgcatactggagcgttttcaagagcccttctctgacctcacacacagcgaatgtctgagctctgtaggctatttgtagagagtttatttcatctttgcagaaagctgcccagtataaatattagtcagttgatttcacacagagtaaaaacaagcttttaaaagcttttacctctcctgtccccaaataggtgctttagacagattctctgagccttgggagctttgttggatttggtaaagtgaaagttatgttctgttccgaagcagccttctgtgaaggctgtcttggggttgatgctgtaattgtgcagaaaggtaaaatgaagaataacaaaggtggcgtgtggggtgggatggagatcaagcttccctgttctggatatatctccataagtccatttcaaaaaatgttcacgtttggtgccaaggtggtcacttggtattgtaaaggagtggtggcttcaaatttaaatagtctaagttcaatcttagctctattaatgaactagctaatggtgtacatgggtctcactcagcctctatgacacctgaaccaatgagtatagctagcattgtccaacagaaatataaccatggtcacaaatatgaatcacatatgtagtgggtttttttttatactttctggtagccatattaaggcaaaacaaaatgcgtgattttaatttcaatattttattcaagcagatatatcccaatatataaccaagcataattttatttacccagtatatccaaagtgttaccattcaacatgtaatcaaactgacactactaaagagatatgttgcattctttctcttgtatgacgtctctgaaatctggcgtgcagttgccatgtacagtacgcgtcatttcagaccagccacatttcaacacccaatgaccacacatggctagtggctaccatgttaggacagcaaggtgaaactacaatgcttaagctgatctagcaagctcttaaagctctctgactaggattacaatatctgcttcacagagagcaaatgagatcgcatgaaaattgtcatgcgccccaactttctcctctgaagtgttagtgtataagcaacagattaagaggataaggtgtcacaacatccttagctgtttacctaattgttgcatttctatcactggacctcaaactccatgaagtagacagtgacatcactcaatactaggtcttccgtgactagcacgtaatagatgtattaatttcccagggctacgaaaacaaagaaccacaaactgggtgacttgaaatagaaatttactggctcacagttctggaggcctgaagtctgagacaaaggtgtggataggactggttccttctgagtgctgggaggacaatctgccccatgctgctctcctatcttctggaagtttactgacaatctttggcatcccttgagttgtagaagcatcacccattcatcttcagatggtatgcatatctgtgtccacactttcccattttataagacacagtcatatggattcagaagcccaccctgctcgctactcaggcatgacctcatcttaactaattacatctgcagtgaccccattcccagattaggttacattctgagatactgggagctgggactttagtattggaatttgaaaataagacaattcaaccaataacagtatgtgttcaataaattcaagtcagatatatgaaaaaataaaaattgagtataaagataatttttggctacattgactggattccaagaatcttccattctgtctaaagaagatagacacgttaaaaatcaaacgagaaaaaacagtaagtgaagaggatgaatgcagccagtgggtagttagactatgcaaaaacaagtgcgccagaatcacaactcaacatatattaaggctttcatttggtggtgttttgaattagaaatatttaatgtcgatcagcctcagtttccttagcattatctacttcgcagttgttgagacaattaactacaatatcctaagttgcacacaattattgggccagacttctacactgtgagtatctgcaaaaaaaagaaaaaaaaaaaacattgttcactgctgtgcttcttccctctgatttaccaataagggaaacatcttccatatttccaaaaacccctggttttccttgagtacaccttgacatcatgcaaaacctcttcttcctcaagtcagccaggccctgctgtactctaagctgcaacccactgggctcagcattcaatcaggcagacgtccttaaaagatcacacattcttagctacggaagaataatatttatgcactgcttaatcatgtgaagaagcacagactctccagtctcaagtggagacattgggtgatgtataggcttagagatcctcatattgggaaagagtcagttactgatcttggctcttcacttgccaagatggaactgtttggtttcaattctgtgaacatacttacaaagtagtaggaacttcaatactgtgtgcttctgcttagttgggttgtactgaatttgtaagtccagtgaggttgtattttccctttgttctgatgagaggtctagccactttgtgtttcaactgttataatgtccatattcagttttcttattcccccataaaagttcatgagatagaaatggaggaaacgtagatatgcatcatgcatctaagcctattgttgtagctagacttgtcgggtcatatggatgaaaatatcttagggaacagtttgatgcattggaaatacctctagggttcatatcactagatatgatttgggcatttcactgagttacctggctctcagcttcttccactaaatagatgtgaatgatacccattctgactttctttcaatattgtatgtaaggcttaaaacgattatgtttaaatgctcccaataacctttacaacctatcccatgatatggtttgtcagtgtccccactcaaatctcatcttgaactctagttcccataatccccatgtctcgtgagagggacccggtgggaggtaattgaatgatggggacagttacctccatgctgttcttgtaatagtgagtgacttctcatgagatctgatgggtttatatgaggctttccccctgctttgctcggcccttgtccttcctgctgccatgtgaagaaggacatatttgcttccccttccaccatgattgtaagtttcctgaggcctctccagccaggctgaactgtgagtcaacctctttcctttataaattacccagcctcagatatgtctttacttgcagtgtgagaacagactaatataacccagctgagatattttgatgatggtgatggagaagagaatgatcatttgtcctatttacctaaagtgactacttgtttcctctgcttatttcttctatttcaagcactagagttacttccattgagaaggtaatgtcaaaatgtagcttaaattatcagctctctctctgttcttacccttcctctttccttccattcataagacaaaggaatgcataagacagctttatcttggcatgtatcattgttgcatttactctttgatttaatcaaatcgtgtttgatcattcactctgtgcttgccattccaatagtgctggggatatgctgtcctataagacagacataggtctctgcttttgagagctttacaatccagtagcctccaggtcttcagcccagctctatattttataggtcctatgtctctgtgaaaatgtcctcattgctttgttctactttgttttctttgattctgccactcagactatcagatattctgtcctaacatttagcattacaattggcctttctacatattgttttgtcagtctgtatcctaccacctggctgcttcctgctcttcaagaacatcaggttagacatcagttcttctggaaaaccttacctgataaatcattttgtttcttaaatttatcttctctgggcacataccctattgcactgtaaatctctaggctattctatgactcctgccagcctgtagctatagaggtacctgggctatgtctaccttattcaccactgtagcccccaaacatagcacagtccctgacatccaacagatactcaatacctaactcctgaaacaattgcgtgagtatcatgctcttgcccatttggacagttcattgcccttgctttctggcaatctctcctaatttcatttcttccaagtccgactatcattcattttatgacagccttttttttttcagctggcaaactatgagaggctaaaacttatgcaacacacaatgaaagacaaggtcatattttatcgtctttgcctgttgcagtaaccagattagacatctttctacaagtgaggcgaatgcaagccaaccgatatctatcatgtcaaacacctgattactatgtgcggaagaaaaagagggaaccattaaagatacatggacaagcacctgcccttaaggagcttacaacattgtgggaggtctctggtttcatgtaagaaaatcgaataattaaaaatacaggcagatgcttggctttgtgcattctttataaacaatgtaggggtggcaggtggttgctaagttttcaccatatcatgcctccacaaagccattgggttgtttagactatgtttacgtacccagctttgaaaaggggctgaagaagaaatagaagatatgttgattcatggtagtgaggcataaacttttttgtttgtttgtttgttttgtttttttaattatactttaagttttagggtacatgtgcacattgtgcaggttagttacatacgtatacatgtggtgaggcataaacttttatgatgggtagaaaactttataatgtgttataagaagaaatgattctgaattggctgggagtactggctcatgcctgtaatcccagaactttgaaaggccaagatgggcagatcatctgaggtcagggtttgagaccagcctggccaacatggtgaaactccctgtctactaaaaatacaaaaattagccaagtgtggtggcaggtgcctgtaatcctagctactcgggagcctgaggcaggagagtcgcttgaatctgggacactgaggttgcagtgagctgaggtcacaccactgcactccagcctgggtgacagagcaagactctgtctcaaaaaaaataaataaattattctaaatttatccatgtccaagattatggcgtccactccttgcactactttttatctagaatgtttatttttctcttcactagaacattctgtcatctgtaacctaatcccattggggagagtatttgattatcctttcgttagtgtgacttaatgctgccaattttccaaatctagcaagagatccttggtgacattcttagtgggataccgtagtcagcaacgttcacggcagagttgctgtctctctaagcgatttggttttctttgtatgtataaggacttcctctcttacaaagaaagttgtgtcacattcgatcgatcaatttcctcctttagaagcaggcagagaatactctggacagctatgatggaataagtcacacagcgatattatctcaaattatatctgtagggtaactgcaagtcaggtatttaaggggacagaatccatccttctccccttgtggatttggttaaatgtagtagtattagcaatggcacaagtcatctaaatttatcttgaatgtgaatttgacactgatgttactctggtggtagtagcaagaacttttccccctttagaaaaagtgggctggtgaaaggagatggattatgaaagtctgttcaggattgaggcttcccgcatacccaggaggtggagaatccctattgaattaaaattcaaaatgcatctgtctgttctttcccttacaaaaattcacttttgccaatgtttatttgcatggtttgattttctgcttgtccatatgcccttctgtccatacaagtatatctgtgacagtgatgggcagccccatctgtcactcaggaatggatggcagtggtgatggttggttggtattgatagccaagtacttactacagctgagctttctggtcttgactgtgtattatagttatgcaagaggttatcacggggaaaaatggatgaacggtgcccaagatcaccttctacattttttgaaactttctgtataattatatctctatgattatttgaaaataaaaaattaacaataatggcagtcataggctaggctctgggttcagaattgggttggtacaaatttcttcatggaaccatcatgacctgagataattttcttagcgtctcagagcctattatttatgaaatgaagataaagtcggtgcccgtatcatcgggctgtgggttgcattgatggaagttctatttatagaacatttagggcagtggcaagcatgtggtttaagcccttctaattgtattattgttattatcaagaatgttataagtaacactatcatcattaacgtgattaatctacctgggttctggatcttagggtggcaggaacatggtcttgtgcctttttgacaacctctaattttgcctaggatactaaaagactttgtcagaatgtctcaaaaatattttatggtgaattgttccaccataactctcacaaatatcacctcttatctcagcccacaaaaaaaggtcaattatagataaaggaaaggacctcattgttgccgaaagacttagatatgaggtctggatttgcacttattcacttcaagactttatgtttccttatctgtgaagtgggtgtgctgaaaatgagtttattactctagctcctgtggagatgaagtgagattatatatatatatatatatatatatatatatatatatatatatatttatatatatatatatttatatatatatatatttatatatatatatatttatatatatatatatagtgactaacattgtctgatacttagaaggtgctggaagaataccagctgttctggctgttagtttgtattaataacaggcaataatacggcatttgaagcaatttcgcaaacagacaggtgaagccctacgcagcatgcctttccagcgcgaaatgcttcagtgcaatgttaggatattctaatggggaaacttttttcagtaatgcagggcaacggtggatggttttgaccttgctctcagtgccccgaggtgctgagtgagtcagaacatgtctcagtactactaaaaatgaagagactagcttgggattcattttttattcaacaaaacattttgaatgcttttgtacatgtgtgtgtgtgctcgcatgtgtgtgcacctcagacactctttgagatgattgaggcaacagtgatggaccaaaaaaaaaaaaaaaaggaaaccagacaaggttcctatactcatagagttcacagtccagttggagatggacaccaaaatgtgtatataatgtcatactttgacagaggttttcagtggcaagacagggtcctctgagaccctggaaaagtgagaaactccatcttcctaagtgcttgatgccgttggttgggaacttcacttgttctggatgtcgctcattttttaagggctaagcacatatttccctttggaattatcacctcagaagtggccatatccaggtctctgacttgtacagagtaccataaatattttattgtcagtgacttttaaagagttgagaaaaacagcctctccattgccttctgtaactccaaatggaaaatcaggatggaacattttgcaaacatgacacctcctcactgcaagtcgaccgcccactcggttggcttgtgtttctgaggctggtgtttgtcagccatggcaagatggcttccatcctctctctgtgcttccctactgagccggagaagtgaaatgagacaagtagctttgctggaatctgtaacatggattctgtcatctttgttgtttgttggattttatgaattatggcttcagcacaactttagagttctttgttcaagagataattttctggccaggtgcagtggctcatgcctgtaatccgagcactttgggaggctgaggtgagtggatcacaaggtcaggaggttgagaccatcctgtctaacatggtgaaacaccatctctgctaaaaatacaaaaagatagccgggcatggtgacgggtacctgtagtcccagctacttgggaggctgaggcaggagaactgcttgaacccaggaggcggagtttgcagtgagcagagatcgccccactgcactccagcctgggtgacagagcaagactctgtctcaaaaaaaaaaaaaaaaaaaaaaaaaaaaaaaaatttctgtaagctggcatagttaccagaacaaaagtttatatgtttatctaaatgaggtcagatctgaattcatctccaagtatttaagaatatacaatgtaggattctgacagatttgggtacctggcactaacaagttgtgtgagcatgagcaagtaatcccacctagcttgaaaaagaagataaaaatatgcggtgtgttggattcttgttaaatgaggtaatgtaggcaaagctactttattgaattttgtatgcttggtgcttagaacaataatcagttcataattggtgtgcaagaaaagatttcttttcctcgttaccagacatcgtcatcaccatcaccattattaccatcaccttcatcatcatcatcatcatcatcatcaccaccaccaccatctttgcttttatcttcttatggattcagtaacaagaattcttcaataagactcataataagattgtgttaaaattcgggttctttcccttactaatgtacgagatccatgtgttggaaagtgttttccatttgtttagcacctcagttttcttatctgccaaaggtaccataatgaggtatgtgatctgccaaaggtaccataatgagtttagtattcactgaagtaggttagagtccaacacacatcccttcttcctgggttctccagaggaagaacttcactggactggaaggaggatcagttttatccccacagtgggacatatgtgcatacaggactttctagattataaaatacattccagtagatttttccctctaaagcatcgtaagagtctcactgtgaagaataatatatattactatttatattttatgaataaggaaactgggtcacataaaggttgaatgacttgccaatagtttcaccattatgctcttgatgcctcaatatttgactttgatttcatagtcacagcattaaaaggttagatagtaacactagaaattacctggcctatcatagtgtttttccatttatttatttttaccccaattcataaaagattttacactctgaacccattcctccacataaagttttcatgaaacaatataaactcttaactattttattcttctctcatgtgtgtagattatttcatttaaagaatgttggtatgatgatcccctacatgggtcttacagcctaagagatcagactgacagaataaaaaacacagaacatttttctccaggattgtgtatcagaactatctggggcaacttttgacagtgcccatccctggatcccaccctcagagattctgaggcagtaggtctggtgtgaaggccttggaacgtgattttttttttctttctttcttttttttttttttttgagacggagtcttgctgtgtcacccaggctggagtgcagtggcgcgatcttggctcgctgcaagctccgcctcccgggttcacgccattcttctgcctcaacctcccaagtagctgggactacaggcgcccaccaccacgcctggctaattgttggtaattttagtagagacgcggtttcaccgtgttagccaggacggtctcgatgtcctgacgtcgtgatccgcccgcctcggtcttccaaagtgctgggattacaggcatgagccacggcgcccggccggaatctgttatttttaaaagaatacataaggagctcatgctccactgactaaggacccatgttctgttgcatctatctgattgtttccagctgaaactctttaactctttgtctatttaagtttttttttcttttctttttgagatggagtctcaccctatcacccaggctggagtgcagtgatgcaatcttggatcactgcacactccacctcccgggttcaagcgattctcgtgcctcagcctccaaagtagctgggattacaggcacctgccacaatgcctggataatttttgtatttttcgtagagatggagttttagcaggttggcctcaaagtcctgacctcaagcgatccgcacgcctcggccttcctaagtgctgggattacaagcgtgagccaccgcgcccggccagttgttttgttgttgtttgtttttgagtattttctgcgttattccctaggacattaatgctttcaccagggaattgtccgtcttggtcttgtctctctttccaaggttgaaggacagaagttggcctctcagttgaggacaagagcttatggtttgtgcgaatggctgctgtcctcgcatactgagctggagtcttgtgagacagggcctcttgtcctctgtgtttatgtggttagagaggggagctgacacatccttttaaagaaactgaaagggctgcttgttttaactctcactctgtgatgcattgcagagatccccaaggtatgattggaaatggaaacgtaaggacgggcacaaatactatgtatccagattttctttccaaccttgtagagctgggaattaaaaagaaaaacctcgcccaggggccacctgaactagaacctgcaaaacagacaagcagaaaggttgaattcttccaggcggtctcttccaccctcacctcctcctctgttatacaatttaattacaactttattcacttcagaaaccccatccattccttccagtaggggaagatctctctttccatagcaaggagccttggtgataagcagctatctgtaggaacggtgcatgggactctcaaaacctctcccttgacaagcaagaaagacatgagcaaataataactgaaattattttgacatttcactctggttgttgtagttttcataataaaggaagaacaaagtacttgcagctttaaataaagaggctgcctttggcattgatgtgggatttcactggggaattttttgtatgagttcttgtttttgctcactgggagagaaaagaaaacgataagccatgaaaagacaaaagtccaaggaaaggagaaagcaagacccctgtactttttcttgatagcatttgtcacccctggaatattgcggtcatcttagtatttattttttgtttcttgaagtctgctgctgcacttgactgtaaggtctatagggacaaagatggttttggattttgcttaccgttgcattaaatgtgaatgaatgaattcgtttacataatgtgtactaggagccaagccctgtgtgtgtgtgtgtgtgtgtgtgtgtgtgtgtgtgtgtgtctgtgtctgtgtctgtgtgtggtttttggtgatgtgatttttaattagatccttacaataatatggtgaagctactcatcattggtcccattaaacagaagcaaaaactagtgcttggagtatcacaataacttgtctaagattacacagccagtctgcaaaagagctggatttcaaaatcttccaagtcatcatcagttatggtatttttaagatcgatttgcagttaaccacacagctttattacaaattcatgctctcttgatgtactcacagtatttttcaaaatttacctattgctatctctctatctctttaaacttttttcatccatcctctgtctcttcccttttatccctgaatgtttgccctcccctcttaagaaaaaataagatagtagcaagctccctgctggattttataactttgcataccatatatttagtttagtaatgaaaaattccagctccaggcgatgcatagaatcgcatttctaatgttttttaaacagctattaatgtggtcgagcagtgggttttttttttttttcccttcctcctctatataatcatctgctcagtggtgcgctgtgaaactgagagtaggagccagaggaggagcaagctgtgattgatgggccaggccttcctggcagaaaaagtgccatctgggttggttttgggagcagtcagatgttgagggggaggtcagccaggcggcctcagccccccaccttcctcaacaccccgatcatccacacattgcacagcgcgcacaccctcgctcgtaattgaggcgtgcttggggcagatgctttgtggtgtgggacaagaacagctgctaagtttatggaggagaaaggaagcaggatggtgcagcaggtatttttgtttttttttccatttaatctttcactcaaaattgcgatttgaatgaagctgaaagcttttcttgtgttaagtccgtgctgtcggtgacacgtagcttgctgcttgaatcatgcccggggaaaggagaggagttttggtgaagagagtgtgtgtgtgtatgtgtgtctgtgtgtgtgtgtgtgtgtgtgtgggcgcgcgcgcacgcgcgcacgcgcgctttctgcttgatgtgtggaactgagctgatcttagaaccagcaggttaatggtgtccttttgcatttttcttctttgtttgaatgcccctagggcatgatgcagtttagctcaattcacttctgcacaagagggtttctctgaatatgcgcgatttcttgccagagaagtggtgtagaccatgctcctaaactaaagtaaaacaaactgtcagcaagactgaaaactgcaagcaaccatcaagaatggatagttttcctccagtgagtccatgctggtggggggtcccactgcaggagccgctgctttcctgggctgtgtgggcatatgtgatcagctggcttattaggttttgacaattcctgtgcatgtcttcattataagggttgagttaaggccagaggaggttctccacagcaggaaataaactggggacaagtaaattccagatgcagaaagggagggtgtgctcaagaagtttgactataaaggtggggaaatacaggtgtgtgagtgtgcacacacacatacccacacaggaaaatgcttgcctattttaaagtccacctggacggctacgaaagctggtactttgccttctcagtgaaagtcaggtagttacatggaaaagaatagacccatttcctgttcggccacttaaagattctttttcagttgaaatacggtttaccttcaattttgagccaaaaggttttgcaaaccctgactggctaccactcttgtttctcttgttagtttctcaaaactactttattaaaccactcagggcaacgaatgggagaagggcaatgtcttggggaaaaaacaacgacaacaacaaaactctctcatcttattttctctctgactctgtctcctgagtccacttcagagagaaaattcagggttcaggatatttcagggaccaaagaaattctctgagcatcagaagagtggccctcttattgcatgcatacaagagtcaacacactatgctaatagtcagattacagtgtttgtcttaaaatagcaatgatagccaggctatttcatgcttcagtaaaatatttaaattgaaatgacttttttttttgcttttatgaatcagacttggttgcattttaataatccttttgctcttggtaactggagtgaaagctacacgttggggtgtcttaagtaatgacaggtttccatcatcctgctgtcgttgagttgctctcgttgactgagaggtttggtgactgaggacaaggaagtttcttctctgtttatcctaataaatgttgtttatttcaagcttctagtcagttgtgcagcagcaatagtgggtcttaaagcgtgagatcttggccttctttcatcctccttttgtgtattgagcaacaactcaagaaagtccaggcactgaaattaaacgttaagtttgcaaaagctcctgaagcatttgcttgatgatgtggggaacacttgtgaggcagatcatcctgctcatcaactaggaacacccacaagcaccctgactctgcagatatcagaagctctctctgatcattccacttatttagggaaaggtgggggtttggcattggagtagaagaaagaaggcagcttctgcaaatgagggaatgtctagccagaatgctccaaataattttgcctgtcactgtcccctacatgaagttggcttcagcttccaacccaggagcctgttcgcgtgcctaggatttgctgtgacctggagtggaaaaggtgcccttaatgtcagtgtatttttccagaaaatacatttcagccaagctaagaatccaggaatgtcactagggaggaaacaaagacatctctggagccatttgaaggtgaaaaataattccataggaagtacaatggtcttaattaaatattagctgtaattagcctaaagtgcaaatgttgggaatattaattagggtctctctggaacggctgtcagtgttaataagtaactgtagggggtcccaccaacatctgtttgagaactccaggtacaggatgaaatctggagtcccatgttcctggatgctaactgcaggctccttggctaccatggactcagtccctagagcatggtgctctgtgtttgccagaattgcacaactcatggtagaggtgggtggcttgctttggcaccagtggtgcccccagctggcccttgcctttcctcggatagcctcaaggcatttcaaagtcaggcgtcaggcttgaggtagtgcagaagtttcccaggctgctgccccactcctttcgaatggtcacccacccaacctggccattggaattgctggcatatttgaatcaaataccctagtccctggcttcctcacagggagtaacacaccaacagctaaacacaggtccatggtgtgtgtgatagagagggaactgcttatttaaaaatgggaagtggacaggcgcggtggctcatgtctgtaatcccagcactttgggaggacaaggcagatggatcacttgaggccagcagttcgggaccagcctggccaacagtaaaacgccgtctctactaaaaatacaaaaaattagccagtcatcatggcgggtgcctgtaatcctagctactcaggaggctgaggcaggagaatcacttgaacctcggaggcggaggttgcagtgagccgagagcctaccattgcactccagcttgggtaacaggagcaaaactctgtgtcaaaaaaataaaaataaaaataatgaatgaatgaatgaatgaatgaagtgaactccccaccaggtgattctcttgctagatgagaaatgccttggtttaactcttggcttccctaacaactacctgtgactgtggcctcgaataattatttcccagctttggtctgcagcatctttgatgacaaggtaaattgagattagagatgcattgcatgaaaagtagggattctggaccttggcactattaacatttggggcgggacagtcttttgtggttcaaggtagtcgtatactctgtaagatgtttagcagcattcctggcctccacccactagatggcagtagcacatcctccctcatttgtgacaaaactgtctccagtcattgcctaatgtcctgtggggagcaatcacacctctgtaagaactaccggtatgaggcgcccagcacagtgcctgccacctattaggttttcttctgaggaccagtgaggagaaggggctgcttttcatggaagtctgaggccatcatgaaccttctgctcataagcccacttatgcagatttaaagcctgtgtgcctgtgagtttacaggtcaaagatctgcggatggaaagtaaattccccaaaagattctgacccactgtttttgcaccattttcaatattgccagtctccaagtctagctatcacccctctttggtttggagagtatacaggccctttctctctctttctacttcactgcctgctttatttcctgcccaaactacttatgcaataatggcttcttaactggtgatcccatatctaatgacattctgccacagctattagaaaacattttccacaaaggaccagatgatagatcattcagtcttggtgggctgggcagtctctgtcacagctatccaactctgcctttgtagtacaaaagcggctacagacagtaaacaaatgagcatgggtgtgttccaataaaactttatttacaaaaacaaaatttgggccaggtttgcctcatgagtcgtttgctaggtcctctcttcatccccctaccctatctcctgctgccagactaggctttacagagcccagaggtcatttttccagcacatattcacttggcaaacatttataaatgtccactttgcagctagtatgctgttggaccatggagatgggacagggaatgtggcacagtgtcctgttttcagggagctcacagacaaataatcaggctgtggcagtgcttggtgctgtgtgagctgtggccaccagctgcagtggagcagaggggatgggcaactgaccaggtttcagcatcaaggaaagcctgctggaggagggactcttgatgcggactgaaggaagagtaaggactagttgggcaagggggtaggtgaggctttccaagctgaggggcagtaaatgtgaagacttgatggggttgagaggatggagctcttctcccttaactgaccataagcttctggaaggcatgacccttctctcttcaatacagagatagctcgaagtctacaaggagccttagctcttttgcaagaactagtaggaatgggccacttttcctgagcttgctctgcactgatgaaaagccccagggttatatatgttcctggtgaaagtatattctgctggaggtggaggagggaaacctttgtcttcatatgatcattgtctgtaccactgcttatgtggttattctgtgcttccctgtaagagtttacacaagtctacctttcacttcagagatgggccaggtagaaggttggggaggcagaaacagatctttgagcagaagctgcctctggcacagtgaatttctcatcagatgattcccaagatcccaacatttctggggcttttcatcacccatagagaagtggcatcgctatgaaatttctgtacagaaggatatgttccttgaacagcccagaaaaagaaaagatgctagtttagttataaaacagcagaagtttttttttttttttaattagtcaagacccttttggttgtaagtaacagaaaaagtagcttaaaaaatgagacaaagggtacaaagtgtcagttttgcaagacagatacattctggagatttaagtacagcatggaaacaagagttaaaaatactgtattatatactggaagtgtgctaagaggatagatcttaaattaaatctctccacacacacatacacacacacacacacacacacacaaatggagatcatgtagaagtgatggatatgctaattacctggaatgtggtcacttcacaatgtatacatatgtcaaaacatcaagttatacaccttacatgtataatttttatgttaatggtatcttagtaaagctgttaaaatatgggacatttactgacttgtgtaactacaacaaacagggatggtgctgactgcgggtaaagctggattcaacacttcaaatgacgtcactgggactcagtagaaacctctctgttcctcagtttcttctcttcattttcctctaggttggcctcacgtgtagggaggtccccttcaagtggcagttcgttgttgttgttgttgttgttgttgttgagacggaatcttgctctgtggcccaggctggagtgcagtggtgcactctcagctcactgcaacttccacctcccacattcaagtggttctcctgcctcagtctccggagtagctaagattacaggcatgtgccaccatgcccggctaatttttgtatttttagtagaggcagggtttcaccatgttgcccagtctggtctcgaactcctgacctcaagtgatccacccaccttggcctcccaaagtgctggaattacaggcatgaggcaacatgcccaccctaagtgtcagttcttggcagctccaggcttatgatgtttttacagctgcccatcaccgtggaaagagaacttcttccccaaaactacagcaaaatcccagggtgactgggactcagtggtgtgactagggcttaacgcactaacggactcactagatagatgtgcatgaacgcaaatccatgggactatctcagtgggaccatctgattggccaggctgatgtcctatggctcatctcgtagcgactgggagctgggttcaactgtatctgcaccatacaggctgaaagtgggactgtcccccaaaaggaaactggggctttgttgaagaaacaggagtggagacagaccagcagtatcactgcatgtcttctttggcttcccaaggatggacaaggttaactgctcatggatagcaactcagcctcaacataggcacaccctccatggccccagtgctatgggaaaatgttagaaagagaaagaaatgctcgtgcccttttgtttccagtggcacagacatttggcgaaatttgtctggaggagggaagagcctgatgggaatgatttacttgtaaaatgtttaaacttatcctaagcttagttctcttccaagtgtcatctttaacattctaattaaggtcccttctaaacaaatgcaccagctccgtgtgctgctctgagaacaaactttttttttttcctctcttctttctgtcatcatgtttttgctgcactcaaattgctttagagaaagaggatttcggatgttggtggcaagtactgaagagataaggagaaattctgatatttttgccctagtatcattatatgagggccaaagtcacatctaattgaccacagacaataggagaggcagctatttggtgtgcctaattgctaagtttttttcctcgctctgtctttctgactgtgtgatcccatctcctgagaccatggaaagtttagacctttgggttacaatttcttatgccgtgtgtgtgtgtgtgtgtgtgtgtgtgtgtgtgtgtgtgtgtgtgtgtgttgtggtagaactgtggaggaggaggtaaagagagagagctgtttcctgaaatggaagcatttgtattcaggtttttgttgtgtgtgtttttaaaattcttctgagttggctgtaattgtcacactgcctgttttgcctagatctgaagaatgaattgttatataatactctgtgctcataaaaaaataaggcagggagggagaggcattgactaatgagactgagagttaaatccaatatttttcagaaatgcttaaaatggggatgtcagagaggacagtctttgtccaaattaggccctgaatttgtatcagctgcttcattttggcactggggacatcatacacgcatacacacacacagacacacacacacacacacacacaacataacacacaaccacacagacactgggaccattaaaaggatactccctattcccattatgtgagccaagtcacataaaactttgattaaattcaaatgcttacataaattgtctctcctctcaagaacacacacgttcaatttagtctctcttggcactttaagtatcaaatcaaggttctgctgtcactgcagacaactaaatgctcacagcttccaaaatgggaatgaaataaaaaggatctgccaaaaaaaaaaaaaaatcaatctagtaaagccacagaccctcatgtctttgaatattaggctgggtggcttggaaaaagcgactttatctttatctttccaagcctcggtttctgcatctgtaaaatggggagaagtgatggttactgtttccttatagggtctggtgaagatgacctgagattggtccatctcaggctggtggcaccatggtgacccctagaaagtacgcggggcacgatcgtcctgggatctgggaggaaggtttctgcatggtggctcctcatgacgttctctccctctctgcacctttttgatttttcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacagtaagtggacgtgtttgctacgggtgggaggttatggggaggcgcccccagccctggtaatggcagcgggggtgcacccccatctacccagggactctgggaaacagatcagtccctaagcccaccctcatcataccagcttcctgaagtttacctcatttccatgcattcattcttagcgttcatttaaatcaacggattattaattaatttcatttatttgtaaaggggcacatttatcaattttctattcctatagttttgcctttctagaatgtcatcccaatgaaatctcatttttttggaaaaaaaaaatttgatgtaagataatttttcttcaagtcttacggaggctgggtgtggtggctcatgcctgtgatcccagcactttgggaggccgagatgggagagtcgtttgaagacaggagttcgagaatagcctgggcaacaaagtgagacctcatctctacaagaaatttaaaatttagctgagtgtcatggtgcatgcctgtagtcccagctacttgggagactgaggtgggaggatggcttggggccaggagtttgaggctgcagtgagctaagattgctccactgaactccagcctaggtcacagagtgaaactctgtctctaaataaacaaaaataaagtctttgtggaattataatttacataccttaaaattagtatatttttaggtgtacagttcactgatttttagcatatttacggagttgtgcgatgattgccggatgcatctaatttcggaacatttccatcagcctaaatacaaatcttgtgcccctttgcagccactcctcattcatacctcagagctctgaacctcgcttctttaccttagcctaatacatttgagattcatccaggttgcggtgtttgtccctggtttcttcatttttattgctggaccaaagggcaggggctagaaagaggcagggtgagagaattttgatgaataagggaactgtcctgtatcttaatggtgacggttacatgactttatacgccataaagagtaaattttattgcgtacaaatgatgaaatggattagaaacaggcatgtaaacagaaacattttatcatcactgtaaatgaaaactggtgttttgatcattaatcaaatataactctaaatgaaaatatttatcataaaattaaataatgttcatttgtgtgccacctaaagtaatcatgcataccacaaaacctgtatggaacatgcatttgggaacctttttctgcagaattctttagaagcttgggaaccccaatcctgtcgtctggaacattttttgagtgtaaggcaattctgcctcttcgtcctgtcccaagacctcaggaaagcaagtatttgtgaaggagtttatggctttgaagcatgatacatttcctgtgataaaagaaaacactgactaactttgctacttgccacctcattcatttggaggctagttttgacgttttgtttttgtttttgtttttgtttttttgagatggggtctcactctgttgcccaggctggagtgcggtggcgcgatctcggctcactgcaagctccacctcccaggttcacgccattctcctgcctcagtctcccgagtagctgggactacaggcacccgccaccatgtccggctaattttttgtatttttggtagagacgggatttcactgtgttatccaggatgatctcaatctcctgacctcgcgatctgcctgtctcggcctcccaaagtgctgggattacaggcgtgagccaccgcgcccggcctagttttgaagattttttaaaaaaatggtatacattctgaaatttttagttgccttcctccctttttaatttattgtggtaaaatacatataacataaaacttaaccattttaatcctgtacacatttcaatagcattcagtgtattcacaatgtagtgcaaaaccaccaccattatctagtttgagaatgttcctagcaccccaaaaggaaaccccatacccactaagcagacactccccattctccctctccccggcccctggcaaccaccaatctgccttggagatagctttttgtgtctggcttctttctcttaacacgatgttgtctaggttcattcatgtggagtaccccactgtatggatagaccgtgtttatttattcattagtccattgatggatatttgggttgtctccacattctggttcttctgaacactcctgctgccgacttttttgtatttagttgctgtgccttaggcatgggccttttaaatgagtttgctggttcagcaggtgtttgttgcttttgcgctgactaccaggtagtagtgatggggatgttgtttactgtttgttggctattttgtgacaattaatagtagtaatgcctggataggttattttcagattttgaaaaaagatccaatcagacattatttattaagctaactgctgtggaaattttacgtattcatttatttattcacaaatatttattaagcttctattagggccaggattcatactagctgccatggttgaacaaaacaaaatgatctttacctcttgtaacttagtatgagaggcagaaactgagcatgtggcaaatagcatgtgtgatagatgtcttaaggaaaatatgggtaccgtaggaaaattaaaaaagaacagaggtgctacctgcaaacgtgtagtctgagagcatttcttcaaggagatgatgcttaaggtggtaagacaaagcagcccaggcagagggaataccacagtcagaggtcttaaagttggaaagatctgggctcactcaaagtcctaagaagaggccagtatgttttgggcatgatgaaggggatttggaggtgatgtggcaaaagatgaaccgggaggaattagcagggatttgacatcctacagacctggtgggtccaataaggagttgaaattccacgttataagcaatgggaaaccattaaaaagagtttaagccagaagagttatgaaatgagacataaaaagaaagggttagtgatgcctagcttaaaggaaatttaatctagttggggagctgagatgctccacatctttgccctgcaaaaagaacactttagagatcaacacaattgaatttaaatagcgtgttgggtgtccacagtgccccaggcactgcagcaagataatctgatgtgcagacaagctctctttccttggagagccttaggagaatataggatttgttttctgttaattatgataacgtgccaaattctagcatatagattttcacaggttttatctatcataatgacagtaggagaaaacattttcaaaatcatagtcagagggttatacctttcagagacttctggttacaggaaagagaaaactcagtaggaagcatgttggcccatacaataaaaagtccaggcggagggtggacacagcctggtttttggaacgtgtccatcagcttctaatgggaaaccatcctgagttggcttcctcgtcctcacctcagctctctggctctgtcctgcaagttcaggctccagtcaccacctgtgaaaagctcttggattcatcccatataagccctctcgtgggaatcaatctccattcctggcttgtgtggtgttatcttcattcagtggctgaggctggtactgagtgtcccagccctggggtcactgaggagcttcatatccaaatacatggaatgaagaccatttcatcagagttcatgatgagatgccttcagaataaatcattaaagaaacgaagtagacagaatcttgtccgagctaaaggtagcatggtgaaccttttgtacaaagaagcttgaattggtgttaatcaagagtagggagtgaagagaaagacaaggacagaacattggagagctcacggggtggggtttgaaggaagaggaactattgagtaagacatcaatgggatgttcagattgggcattcaaccagttgaatgttgggctatacagcctggagggtataaactgagaagacattattgaagtgacagtttggatgtctttaaagacctagaagacaatagttttgctagagtagtggagagagatgcagaagggacaagagttgaggaataactgtgatatgttggagtgggtgggcattgcccgttataaatatttggagtgatgaggagaaagaagagattgcatctgagaagcaaagaagtcagagaaagcagttggtaggatagttgatttagattcaactaatttatgccaacaaggtccctacgtggggcacaaaagacaggaagcaagagatagggaataatggtgcaggaaagaaagtgatgaagtgttttataggcgataagaaggaataggatcaagagtattcagaaatagtaggtagtctaggaaaaaagaaaccactttttaacagctttgttgacatacaataaactgtatatatttaaagtatacactttgatacatttttacaaatgtacctgcatgcacaaccattactgctatccagataatgaatctgtccattatctcaaagtcttttcttgctcttttttgatcctcccctcctcctccttgcctcatccccagggaaccagtgggtctgcttcttttgctatagcttaatttgcagtttctagaattttatatcagtaacctcaaacattatgtgctctctttgtctggcttcttttactcagtatcattatttttagattcatccatattgttgcatgtggttgtagctccttccttttcattgctgagtactgtttctgcatggatatgccacagtttatttctccatttacctacacatgggcatttgggttgtttttcattttgggtaatggagaaataaatctgctgacatttggaagtacttcaattttgaaacagaagagaaggaagggtgaatgtgtgaggatgcagagaaattttcaagtcaagagataatgtgaggagttccatctacattgccttcattttttccatgaatggaggcagcatcatcaaaggaaggattcctgaacttgggcaaacatgtcagaaatctgccttagataattcctagagtatttgaatggcaatggatgcccgaatttggagaatgtaaatgtatggtggaccggttagctgtctactctgtcttctccagcaatgtttggatggtacacactcttagaggtaggattttaaaggaaagacagccattaggggctgaagcaggtgggctttggggctgatcctgaaggaagttttaagacttatattctgaactggtattgggtaagtgcgggaatcataaaggggctgtctcgttttttgttacaaacaattacatctgtatactcatctctctttggccaaaaaggagatgtgacttttcagttatcctttcctgatctacaccagcagaacgtggtctatgacaagtttacttcaaattgtctctgcctcctcctacatttatggggtgtaccttgtcttcactccaggttctgaatttcctgtggaacgaatttaacctcaaagtgggtcagaactatggttctccccaccctatatccatgaccctgtatttgcacaaaaagttactattgtgagatacctaggtcattccccataggatagtgctgtacctggaatagctctaactcttctttgacatatgtatccacgatgcttaatatcattctaaggacatcgtagaggccattatttctttgagaaactaagtacttttgggtaagagaaaccagccatccatctggtggcctccaagaacatctaatatatgcacatgatttaacacaaagtgcagaatctgtaaaagggaaggaggatgcacccagagctcccaaccagagctcagtaaaatgcagacagaaaagacttaccaggtcatccttttagttccccacaggctgagatgagtccctgcaggcctttttttctgctgaatttctatttcatgtaggcctccaaacatatcacggatcacattgctgacagagccaatactgtattatgttagatactgttcctgacaaggtattttactcttgacatattatcattagagatttgcaagtggtgaattctccatgtatctccaacagcaacttaacttctatttttaacgcttctgcagtctgttgaaacggctcccaccactttcccactagctctaggccctgattggagaaggaatgtgggtgccccagctaggttcctgagctggaggctctactgacagggaaaagaactatttagagagccaggttcttctttggcctcagccgcttcccactgaagtgttaactgcgcctccaaatttccttaatacttttaggaagataaggtattggttggtgatggtgtcctgttcttaaccctttccatgccagttctgattttgaagctgatggaatcactaaggtataggaaaaacttgttcagggcattccttttgactaactagctattattattatcatcatcaaagcaattcaggcttggggtttaaaaagccagacattggaaaaggatataaaatgaaaactaacatgtcctaatacccacaacccaaattcttagtctctgtgccagaaatgagttactaataccttatatttccttccagaagtgttttatgcaaatgcaagcatatgcctgcttgtcctctatctctatctttatctccctctatctctatcatctgtctctaattcaatctttatatcttataagtactcactatttccattctcaaaattacagaattgaaatctaaacacctactttggcacctgctttatatctcagagattattctgtatcatatttaggggttcagtcattattttgtgtgtgtgtgtgtgtgcatttttatgtacagaagtatcctaatgatggaatttaggttgtctctgggtttaatcttgcactgttgatatttaccatcaggctacagtacagagctaggtacaaagattgctctccatctctgtttgcctctgggtgtgaatggctaaaaggtacatggacttaagatgtggacattgatcaattaccctacagagagcttgcaccgatttgcaccctcatggacagaacctaagaaggcctgacacccacacccttgcccaacccaatgtgctagccaactcttggctcatgtccctgcggactctgtgtgtttgggtgtggctttccccctctctgacaaaagaaagtacttttagaattgttgggtgtcctggagaagaaaaattgaggtgtgctgccattgcttgaggcctcctgtggtccaaagatcatgctaggccctcttttggtcgccatcttgttttgttacatcaaccttttgaatgctgttagaatcccaccaataaagggagaaagaggttgaagatgttttgagttgggaatggtgcagttgaggtcgtcacccacatcttgtctgcctgatgttaaagtccaggctgtttccccagtctccagctgtcttctaaaataggggtacccaactcccaggccacagatcagtactggtctgtagcctgttgggaactgagctgcacagcaaaaggtgagtggtggatgagtgagcattaccactttagctctgcctcctgtcagatcaacaatggcattagattctcagagaagcgtgaaccctattgtgaactgtacatgcgagggatctagattgtgtgctccttatgagaatctaatgcttgattatctgaggtgcaaccatttcatcctgaaaccatcctccctgccccactgtgtccatggaaaaattgtcttccacaaaactggtaccaaaaattttggggactgctgccctagaggatctcttgaccaatggcttagaattctcatgaagattggtttcttcgtggctgccctctagcttagacaaacaggtcagttaaggcctggcctctggacttgacaagatttgaccctccattctgcttacaagcggaaggagctcaagctgaccattgaacctctctgctcttattttttctataactcccttcctcagctgtgacccttctccagatctcctcccttttttcttctaaacaactatcagacgatggattacagaacaacagagttcttttcctttgaggagggtttacgcctcatgtacttacattgaaagtttggcaaaataattgaaggttgccgtctaaaaatagggtgaatagttacatcgaaatgagaatcaggaaaaagtctcaaaaatcataacttttgctcattgactgtcagactatattttaagcactttccatgcacaatctcaactaatcttggccctccccaccacgtatgaagtgttatcgtcccatgttacagaagcagaatctaaggcaaatcacttactgaaggtcactgtggctgagaagcaggagtcagagctcaaaaacaggcatgtcagaccaaaattcttaagggctggaagcccagaaggcatcccccaggcatgcccagccacactggcctcttttctaaataggttgctgttgcagaaaggaattactcatttcaccctggggagggccccagcagacccaagcctgtgcaacattacagacttcgagtgtgctcttgtttgagacctgcgccttgagcaaactccaataacatgtttcggtggcttcaaaattgtcttttcggatgacagtgtgactgagctgttttgtcaataccagttctattttcctaaaattcacatttaatttgaagacatgggtactgtctcttgtttccttaggagcctgagcactatgcttctcactcccatgtattctctgcaatacatggcccttggctttcaggataaactaaagacctttattacccaatactgtgcctgttttattattttaaagaccctggtcatcaaaaactgtctagtcctggagagccaaaatgaatgatttatcccaacttaggataacttggccaggaacaggatatctctgagcatcaaagacccatgtgtttgacgttcttttttggactggggtttcagcctcggattttggcagaattggaggttgttatgacaggtgaaaaaaaatggcgttggttaaatatctttagatattatcgggagaagcagagtagaatctaggtacagagcttgacattttcattcccattctgtctgacccagagtgggaccataggcacgttacataacttctctgagcctgttcttttttatatgtgaggcttagagttgttgtgaaatcctaatacagtaatgtctatgaaggtcttagcacaatgacaaacacatagtaaacattctaccagatcgaccatcctaattatgaaataattacagtacccataatgagaaatcagagcggtctccttggttccgagttcttcattaaaaatgttttatccaggagaatacattcatcataagaattgtgaaatttcccgtttcaagtgccaaactaaaactccaattccgagatttattttaaaggtaattttgtatttaatgatttatagacaaatggttttcaatcactcatgttttagtacaaactatcagtacaagctgttcttggtctaagtctaggtcgtgggcaaacaaagtgagattcattagagaaggaaatgactgaagttttgtttttaagacccaaggacatcttgcttttgctaaatgaggaatgctcaggcatattctaagggtttgatttaatgtttccttagggggcttcactggcttatttccattgcaaatattagagccatctgacaagtttcatcgtgactttgtcctcatttggtgctttgtgcttattcacacctgtatttattgtcatcagtttacccactcaggatgactaagcagtctctatctttatttttggttaggtccttcaaacacccaaatccatcctttctgtagctcatagagactgctagacaaaggactgatgtaagtgtttgaaggacctaattccctctgcatagctgattgccccattaagcaattttattttatttatttatttatgtgagagaggggtctcactccatcacccaggctggagtgctatggcaccatcttagttcactgcagcctgaaactcctggggctccagtgatcctcctgcctcaatagcagggtactgagctcagtagctcagtactgcctcctgagtagctgggactacaggtgttttccagtgaacttagaaataggcattaatctattttgtgggcagtatttgggtcatgcattagtcaacagtcattttatgcccttaattcatggtcatatagtctttaggtgcatagtaagttcctatgaattccatgcaatttttgaattcaaggctggaaaaagaagttggctattctctgttgacagaagtttcaggaatggctcagccagaaccttgcaatgctagagctgggagagccaaagagttcatctacgctatcttctcgttgcacatatttaaaaagatcacataagttatgggttggaaacggaaggccaggcacagtggctcacatctgtaatcccagcactttgggaggccaaagcagatggatcacttgaggccagtgattcaagaccagcctggtcaacatggtgaaaccctgtctcgacacaaaaagtacaaaaattagccaggcgtggtggcgggcacttgtcatccccactgctcgggaggctgaggcagaagaattgcttgaacctgggaggcggagcttacagtgagctgagatcatgccaccacactccaccctgagtgacagaatcagactctgtctcaaaaacaacaacaacaagaagaaaaagaaaactcaaatactttcacatccaggcaagtaacatccatgcttagagagattaacttatgttggagacattggcaaaataaatttttagttttctccattaaggtaggcattacaaaattacaagcgtgatggtatgcaaccctttggtggggaccctgtagtaatttagcaaacaaatttcctgtccacaggatgtggtccctatccatccatccaatcattgctattttggattgttaaaccactattataatttcattgacatatttccactgcaaatgtttagatttctttcttcttaagaatagcagcaatttttatttttctgggttctcctgttcactactattttattcatttttgttatctgtccagcctctgaagatactgaatttacaacttctgacttaatcttggaaactcaagaggtgaatttaggctgggcatggtagctcacgcatgtaatcccagcactttgggaggctgagacgggcagatcacttgaggtcaggagttcgagaccagcctagtcaacctagtgaaaccccgtctctcctaaaaatacaaaaattagccaggcatggtggcgggcacctgtaatcccagctacttgggaggcggaggcaggagaatcacttgaatgcaggaggcggaggttgcagtgagctgagatcatgccactgcactctagcctggaaaacagagtcagactccatctcaaaaaaaaaaaaaaaagtgaatttaggaacctgaaccctttaagggagactgtatttcaggttcataaaagagacagcttggatgcttcagtgtgacagtgcagagattcatagaatgttagagcttgagatgactatcttatcttcctgcttcatttacgaatgatgctcaggttcagagacagaaagtgacctgcctgagtcacacagtgagtatcacagcagaacccaatgtaaggatgtcctaagagaaaactcccactgtaccatgcccttcctctgtccatctcctggattctacagccatttttaaaatacacatacccggggttatctctgcattgaaatagacaaagtcccaatgacactgcctttagaagcacgctgagctgtacactgtaagtctctgtttctctttgctatcctattttggttcctagccagaggtttcagccacaagtgggccttattctcacaaagacttccagacttcttaaaaaaaaaaaaaaagtcttcattttatctagttctctcctgctgctcctggtggttgtatcaatgggtctgtgtgaattcagcaatgtcatgcgttcctgccagctccagtcccaatcattacttctgggtcaggacactaaccagggggtctgggtttcttcctttgtatccccgaagaatgtggagcctgccaaattgtcaaattatagcatttgatgtagagctaggtccaagtgactgtacaatctctgcaggagttcagaagctggcttctgcccctggtagaaacataaccagactctcaagagacagtaagccagacagtctggagatccagggagatgctcatgggttctctggcttctgggccatggggagaaagtcatcaccacccagaaaataagccttcaccctgacagcagcagcagaatgtacctgggcttgaggacctgacttgcatgccatctcagtgtccttaggacagaagttccacgggcaagttctttcagcagtaaaccaaggttttcagcctgtaccactcaaaacaaaccagaccatcaggaccagttaatgtgaaggcttaaatgttgcagatttgttttgaaagtgaaaaggcaattttcttgtaaaaataaaaaaaaatatgtagagttgcaaatcatacaatccaaacaatatgggctgccctgatcttttaaaagggagaaatgtaaatgcccattctgattgtcagatgaggaacatcaaatagaaacttcttgggctgaaaggaagttacaaaagaggaagcagcgatcatttatggataacgtatggtaatgatcactagcatttagtgagctcatactgggtacccagtggaaatggtactaccagctttctgtggacaatcagattgaatttttacagcatccagaagaggcagggactataattaaccccttatggcctagatgagaaaaccagaacatagagaaatcaaggatgttgcccaaggtcacaaggctgataagggcagagatgggattcaaaggcagccacggtccactgtcttacccagtccatgctggggtcttccatgagccatgcactatgttgtgtatttcattgacataactcatcaagaaataggtgtgatcataccacgattacggatgagggaactgaggcacaggtatgaagcaaatgtaaacataggcctggcagattccaaaacccattttgtgtgattaccccgttagtagtttattttacctaaatgacattccctgctaactatttcaattatgataatatcattacaggcaaatatcttaacaatcctgcaagtctgtagagctctcaactccctcaatttatacaactaaacccacacacatccttcccatccctaacccatccccttccccagtggcatccagtggccccatagagtgaaagaggccttcataccatttggcaagctcacaagaggaagcctggatttcccagagaaacttgctacaaggaaattgctataattataacccaaattgtatttgacttctgcatttttgctttatattgttacactataatttaaatagattgttctctggccttttttagggggagaaactagctaccttttttttttttttcactaagaaaagcaacggtaggtgtagcattccaatgacaggaggtgggtttcgtcccccctcttccctctaattggcttgcaagtgggagttgggttagcagttatgccgggagttgcctggggttccaggcggtgacattcatctggtggctccacaaaaggggaagagacaacagtgggtggcgccagcttcggggagatgagccccagagagtttctgtgactccagaaggcagatgttggggacgaggggagatagggtatattaatcattggatttgggaatttttcctcttttgagacattgaagctcttgacagagaagaccagaggggacctaggaaaagggaggacgtgagttggatgcgcaccctggaatacagggcgttggccatctttctccttgcctagtctagctgtggatggggcccagagccccttagcagctcttccttttctctcttctctccagccttctccaggcttttaacatcagcagaagtagcaaggctaggagttggcaaactgtagctcgtgggccgattcctgcctgcgatgtttttgtcaataaagttttattggaacacagtcacactaactggttcacatattgcctatggctgcttttgcatgatgacagcaactttgagtaattgtgacagagctcgatggcccacagagccaaaattatgcttattgtttgaccctcaacagaaaaagtttggcaacccccgatctaggccaaagtgtacatattgttggcctgctggctgcattcaggcatcgggccattttattggactcacattaattaattgcctgcattgtaaaatggaagttttcacaaaataagctggctttgattaaaaaatggaaaaatctaacaaaacatggcagctaatgttggggatgtgtcatccgtcccctctgactatttgtcatagtcgccagcactgcctgtagggttttaccaagtgtacccttttacctgcatggactggtcctcataggcacttgagtatgatactctttcaggtcgtctgggttgtttttaataaaagatttggtatttcttactggactgatgaattacattttaaaaattctttccatcaaactggacttccctgtggaactccagaaagaaaatgaaaaatgtgtttgtgtaatgccagaatttagtgactgccagagttgttatatcagaaatacaacattttcttccaccttgaaacacccatacacatacacacagccctgcattttttaaaaaaaaaatcctttaaaattgagacctatgtcactgcagatgcttcttgacttatgatggggctatgtcccaataaatccatcacaagttgaaaatgcatttaatacacttcccctactgaacatcatcacttagcctagcacaacttaaagatacacagaacacttgtatgagcctacagatgggcaaaatcatctaacacaaagcctcttttatactgaagtgtcaaatatctcatgcactttattatgtactgtactgaaaggaaaaacagaatggttgtatgggcactcaaagcatgatttctactgaatgtgtattgtttccacatcattaagttgaaatatcgtaagttaggaatcatctgtactgaccttgatttaaacaaaagcaggattagtaaatactacattcttcttcagtcaaagaatgagtttctcagttgttattattaatagagcaagtaataatggtgttgggcaatatattaatgatttaagtcaattaattctaaaaccaatggtgggcgatgttacctcattttaaagataaggaaaagagactctaaacggttgtgtaaattgttccaaatagtggcaccaggaagtgatagacatggaactcagatccagccctgattcatgtcaaaggtcccaacgttttttttcttttttttttttttttggacatgcagtttcactcttgttgcccaggctggagtgcagtggctcgatctcggctcactgcagcctccacctcccaggttcaggcgattctcctgcctcagcctcctgaatagctgggattacaggcacccatcaccacacccagttaatttttttttttgtatttttagtagagatggggtttcaccatgttagccaggctggtctcgaactcctggcctcaggtgatccgcccgtctcagcctaccaaagtgctgggattacaggcatgaaccacagtgcacggccaccacagcaactctttaaacactgaggacacacaatagagccaatgattaactaaaataggcaactgatgcctttctctgaagcttacgtgtagaatacggtaagccccaggataacttcccctgtagctagaataactgatcccaggaagagcccctggaagcccgattcgatccactgaaagtcagttttgggtaaagtcgttagtgcgtcttctgttgttctcagcaaatcttcagacaattttttcaccaggctcagcagagggagaactaagtctaatgtatttagccgggggaatgacaggtttccttttcacagtaagggttcctaggataggagactatccactcgtagcagaagaaaatcctaatgagcaggatccaggttttagggggcccttaattctaacacacagttcaccctgggctgctcaaacgtcttgacttgccccgctatgtgtgtgtgtggctttaggaagccctgcgattttccttctttagctcgaatgtcaagcgctgcaggctttctgagaattcagtgtcctgacactggggctgagcccttggtaatgacactgtagacacgaggtaattacagctctgttaactcccaagtcaggctaagtggacctctgattattattctgagtataataggagcataactaacattgaagggaaattgtacttctctcttttattaaccgcttttatattcccttgtgcatggctatgatgctatgaaatctccttaaatgtgatattcctcaatataatacaataataatgcacacaccgtaatgtattggattactttgcaaacagcccttatgaaattgcatttcccatcatttccctgggccagctcagggctgctgggcttacgggccctttctgtagctgggagcctggaatctgccttcacggtcacttagggtttcatggatgtgagcaattggtccacaccatttttattcacagcgaggatgttggccaaccaagtttccagacatctcgctggacattgcgactcagagatgcaaacagtgtttgatacctcagcatagtttgaaaataaactgggctagatggtgtcaggaaggaagctagatacagggaagggaggccttccatgctggaattaaattgtgaagtcttttccactgactttgctggagagtctatcagatctttgttcctttgtaaactctttcctgacaccacctcaaaactagagttggttcttcctttgtatgttttatatgttttgaaaatccacccttagtttggcatcccaaaatacttactgaactcctactatgtatcacacatacattaatctactaaatacacatgaacaattttacaaccacttaaaatttaatatttggcataaagctataaactttttgagggtaccactgtgccttattcatcacttttattctcagtgttaggcaaagtgcctggaacaaagtagatactcaataattgtgtattgttcatttattcctgaatatttcttgggttcttactatttgagaggcgcagaactgggccttggagatacaagagtgaataagacagacatagcttctccttcaaggaatgtacagtctaccgtaacacagaatacacacacacgtcactcacacagttgaatgcagccagccatctgtatccaccaggttcgacatcccatggaaataagaaaacactgtttcttccatctgcaattggttgaatctgtggatgtggatctcgtggaaaggagagctgactgtaattacatttgcaaaaacttctgtgaaggaaaggtagagggtgatgtgcaaacaagcaacagggagacataaatcaaagcggagatgcattcaagacttccttaaagaagtgacttttaacatgaaaattagaggctgggcgcggtggctcatgcctgtattcccagtactttgggaggccaaggtgggtggatctcttgaggcaaggagttcaagaccagcctggccaaaatggtaaaaccctgtgtctactaaaaatacaaaaattagccaggtgtggtgctgcacacctgtaatctcagctactcaggaggctgagacaagagaatcgcttgaactcaggaggcggaggttgcagtgagccaagatggcaccactgcactccagcctgggcaacacagtgagacttcgtctcaaaaaaataataataattaataaataaaagaaagacatgcagagaaaggtgggtggatgtcctgggtaggacagacagcagatgtggaaacaagatgcaggggcgtgtggaagccagctcttaatggcctgtgattgtcgattgtatatgtctctttccaacaggacagggatgccatggtagtagcttgttacctccagggtgagagtatttacactatgggcattggcaatgctacagatgagggcttttctgtctgcttttctggagagctggttgttgatcagttaccagcactccagtgacagaaaggaagttggcatattcctgtgacaggatgaatatcagtgtagctgtgtggacgggcagggggatggtggcccaagttgaggataaacaggtgagcaagaaacactcatacagagccctgctggcctcatctgggggctttgtaccatgggaggccattgaaggattttaagcagaaagaatcccatcattaggtttgattttgggaatgatctgaccaccatgtggacagtggattggagaaaagcaataatggtgttgggaagtggcagaaaggactgccagtaagctcttgccatgggctggatgagagatgttgataggaactagaatggtctggaacatgggttggagtcaatatcaaatgaccaaataatctgccagagctctctgtaatatacagtattcacacctgtggacttttgtgacaatttgggacggtatagtcccttgtaatttaattctgagagtgaccattgaggatgtgatgatgctctctttacagtgaggaaactgaggcgtggtcagttgatgtgactcagtgtgttccctgaggtcatagctgaacaagtctgacttagtaatatgtctgactctagacctacacttataaccacaacttcacactctttttgctgccaccttcttctaaggggctggaagaatggagatgccactgagctgggggtgaagacatcgtaaaaagatctacctggttctatgagatgcatccatcctgaccttgccaagggaagtaggaatcaggaaatggtggcttctaacgtgatttcatccaggcccttatgcttgggtccatctcaggaatagtgtttggaattaacgcaggagccagagactaagcaaaccccgcctccaccccagtgcagatttcagttgaatgcagactagagcctttgaaaattatgcattggaaaacaattctggataaattaatttccatcatacataatgcatgaggggaaatccgtggtatttttaaacaatggaaatgagagaatctgccttttgggcattgatcccaattaaatttatttcagcaaacatttatcaacacctactgtgtgccaggttcttactggaaaacagagatgagtcagacattgtctgtgcccggaaagagtgagaaatcaatggaggtacccgcagagtgatcagctctgggttagaccttgagactgggagacaaagagttgtgagtattgccctggagggacatacatcctagtagaggagaacgaggacctgccagaagatctgagagtgagagtttgttgaggaaggctatctcgtgcctgggcttcacttgaatggttttctttcatgagtccttccgccatcaataagatccttatttaaagcctcctattgtccagcaatggtatgtgctgtccatctgccccattagcccatagctgctactattatgctacttttcctatggtgtccactgttattactgccacaactacctcaacttactgttgaggaaaatgtaattctcctcaacttctattactattatagtgttgctgttattttatttaatgatagatcatacattcgaaattatttgttgagtgcttactgtgtaactggcaccgaagattgaggaacagataaaaaatagctatggtttcttcgtttagaatgttatcttgtaggagagagagatggaaacaaataaacaatgtaactaaataattacaaattgtaatgtttgcttcagttatgcattgctgcctaacaaactaccccaaacaaacattttatttacttacaattctatgcttcaggtatttgggtgaagtttagctgtagagatcagcttggtacatataccacttggaactggggagtaagttccaaggtttcccacagatgtctggaacttggtgattgtctgtacaacacatctcctcccccgcacccccacccccaccccgccactcaatctctccacaagactagcttgagcttcctcacagcatggagttctatggtcaatgagactttcatatgggcatcatcttggcatgtacacacttcagtggtggctgaattcgaaaaaggtgtgtctcaagaaatgagagtagaagctgcatatctgataaagctcagccttggcatttgctatgtgctatgtctgcctcagtctgttgattaaaataaggtcatctcagattcaaggagaggggaaaagactccacctttgactaggagatatgacaaagaatgtgaaaccgtcttgagtccaccatgatactttttgaagaaaacacatattaggttgaaaaagagaagattaaggagggagggacatgagatcagggaagccttctctgaggaagggtcggttaagctgtgttctgaaggatgggagagtccagcaagagaagacagtgggagcagcattccaggaagagtgaagagtatgtgcaaagccaggtgtccctcatctctctctattcccagtgcagcttcctcaccactccccaaccaaataggagtctcttcttgtaggtggaacacgggataatataaagagcgtatttttgcacatctgagaagcccaggtgacatattgtccatgatctgaagcaacagataatgtgtttcctcatgtatttcccaatgggatcacccaaagtaacatgcttaaatggatgagttgtaatcttctacatagaggtgatgccaccaggcattggtgatccagataaatgaaatgcaggaataaggataccgagactgtttctggccacaaaggaccaggcagagtagtctattgcttggcgaccaagtgcatgatagcactgggcttcctgcttctgccctccccagtgaacttcagatgaggcttgggagatgaaagacgagagaggagtcattatcagaatggtaagaatatagcatccagatagatgagaagagacaaaaagataactccgtccccatactggcttatttctcctttatggagaaggcagccccttggaggtaggcatttcctgggttcaaatcccaacgttgccctttattcactgcatgactttgggaaagctattgaacctcactaagccctaaagcatagaaggtgccctataaattgtagctgccactacttctattattatcatgtatgtcattattgctactgctttgcagaaagacatgtgcctcattggtggtgggattcttctaacccccgtctcctcctttcaaaggctcactctgctactttagagttatcttttatagtgtactcccaagcttgcgatgttgcttccctgcctgtaccattttgttttctccagatctcgctgtttccctcgctggaaactccttggtctctgactgtagcaatatgtttaataactcaaggtacctgaaaataatgcaatatggcaccatgtcggcaatgtggctgagagagtggctcctgtacagattgcctgacttcacatccaggctccctcaggtgttacccatgcaagacttggcaagtaacacaactactctgtgttatttatcatcagttatacaattaggataattaaagtgtttgtcacagagggtagttatgaagacaacacatgtcaatgattgcagagttcttagcctggtgccaggtttatacaacacatctgatgatcactgactgctctgtctctgctgtctctatggttgttgtcatggacataaaagatgtccgtaaacctgctcatgatagtcatgacctcttcaggcttaaccgttagtacttctggttgtctcttcttgaatgagaaataaggagatcaataattaaacacctatgagattcttcaccgaagggagttcatgttgtcatcccagcactcatgctaggcttgtaggaatgtttctgttttgcagatttaagaaacctaaggctcagagaagtcttatcactttccttaaaccctaaactcctcatgtggccaaggctggattcatcccaacaccatttaccactaaaacctgtgtcttctagggaccttagtttgatgaccctggttaattcagtgcattgaaggtttagctctctcagaggttcaagtgagagacacattagatacctccctgcccaagacccagaatgtttccttttagaagcacccctaaccacacacctggaaatccaaggcttgtgcagtttatagacgctgcttttcgcccctgactgctgtatgtaccttgagcagcaagataattcactctaattactcagaatacatatttaaggacaagcacaaagaactcttagtgaggcttaaaaataagccattcagcaaaattgcacaaggtgcattccctcagaaggaagagtttattgcttctaaaagtgagtgtctaccctttgttggctgcaaatgtgaggcaaaggaccagctccacgtgaagcagcattttcctctttcagatttacctccagaaggagctccactgataggagattgctcctttctgctatgacatcttctgcgtcaaaggatctcattagtgtttgtttttatcaggtttttttttttcccgacttttatctcactcagagtgaattcagtgttcactgtcatttacaggataggaaatatatgtccgtttgcattgaaaatcctgcttattccatctagactgtcccagataccactgtattcatgtaggtttggtgttttgtctttcatctatttctgaaatcaaaattttgttaaaaatgtttcgggaaagctcaaaagaattggcccattggaatggagtgaatgcaggctttctccatgcaagcagccatgctttcctagtcattaaccacctgggccttgggcctgtcatgttttttgagtctctgtttcttcctctggcaaatgattttgatgggtgtcatgaggatgaagtgggatgatgtgaaggacttggggtgcttaagaaatctcccaggccattcacaagccacatgcctgcaaagaagtcttgggtgagcagatgccaagtttcccagcaaagagatttctaaggtgcagtgcttcagcttgacattagagagatggccttggccggcagctgaggttttccttctcttttgacctgagctgggaagaagtgtgggtactggcagctttcgtgggggtacctctaaaatagagcagcagttccctgttaggaatggcagatgagattgtgatgaatgcaacaagggctggagcacagaacattctgaacggactattactccctcaaccctatgggctacctgggccagagagatatacacagagaagactggtcaaaggggaaagaaaataattccttttaaatatctaggcaagcagccaacctcctctgatacagggacctgtgacaaagacagacttggagcatgtaacttgtgtttgaaagcatacgccagacccgtaacttcctcttgactttccaccccacctcttctggattacccgggtctgcaggtgaaattccagttgatttacccaaacgggtgcaagtgcagaggaaggagaacatggggaaagaggcaaaataaattttaaaaacagagagatagaaagaaagagaagacatgaagggcgaaggaaggggaaagagaaacagaaaaaggagatagaaatagagggatggggccgggtgcagtggctcacacctgtaatcccagcactttgggaggccaaggcgggtggatcacttgaagccaggagtttgagactagcctggccaacatggtgaaaccctgtctctactaaaaatgaaaaaaaaaaaaaaaaaaaaagccaggcatggtggcacgcacctgtaatcccagctactcgggtggctgaggcatgagaatcaattgaacctgggaggcaagactgtctgaggaaaaaaaaaatagaggaacagaggggagagagaaggagagggagaaagagggaaagggaaggatctagctaggcacacataattgttgtcttcctaaaaacaccaccaccaccccacacatacaaacaagaaaggcaagtgacattacaactataggtactgacatttgaggctgtgtggccctgtccaccgctctaggttgcatctcagtgaatgttccaggttctgaacaatcctataggtgggggaaagaggttaggtggaccaagcatggtactgtggcagcacctccttctcctactgtttctgcaccccgccatgcatttaaatcactcagggttggtgtttaacagacacaactcctgagctactgaatcaaagccttagggaatggccaatgggaatatggttttaacaagtattttaggcaagtcttacaaatctggcctgacacatgacttcacataaaggtttgagaactgagagtctcaccactcacatagaatgaagggtgtcagattctgggagatatttgagatctgatagaaattacaagacttttttacaggcctggtaatgatcatggagatgccagcagctatcactgccaaggactgggtgggttctaggcacctgtcccttgtaacacctgaattggaaaactcctggataaaggtgactttcccattttcagaggagacaatggaatctcagagaagttgaaatgtgtgtgtacccctgtggtgacacaactgattgaatccagtcttaggcatattaaaattgagaaccattgcttaaggatttcttaacagctgtattttattgagagtctgcaccatgctgggcagtatctgtgtgtgtgtgtgtgtgtgtgtgtgtgtgtgtgtgtgtgtgtgtgtgtgtgtttattttttatatatttatttttttcaaatggactctgttgtcaggctggagtgcagtggcacgatcttggctcactgcaacctctacctccttggttcaagtgattctcctgcctcactctcccgagtagctgggattataggcacgcaccaccacgcccagctaatttttgtatttttagtagagacagagtttcaccatgttggccaggatggtctcgatctcctaacttcatgacccacctgccttggtttcccaaagtgctgggattataggcgtaagccaccactcccagccatgtctgtgtattctaaggtgtttatttccatttgtcttcccaatgactttataaagtgagagagaatcctcattctatggagagggggaataagaccaggaaagcctgaattgaaaccaacgcttactcctaaagactgggctttgagttgctacattatatttcacacctctgtcctttggaggtgaaagttacttgatggtgatgtctttagggaaattatgacaaaggagaagtgaacgttggagtcaggtcattgtgtgtctgattacttactggctatgtcacctggtttataaaatgggcttgatttaatgtactgagtgaattagtgtccccccaaatttatgtccacttggaaccttaggaggagatctcatttgaaagtagagcctttgtagatataattaaattagatgaggttatactggattagggtgggccctgaattcaatgagtgttgtccttgtaagaaaaccatgtcaagacgcacaaaggtaagaagtccaaggggcatcaaagacagattggactaataccagggacaccaaggattgccaggagctaccaggatctaggaaagaagcaaggacggactctccttgagagccttcagatggagcatggtttaggcaacaccttgattttgaacttctggcctctggaactgtgagagattacctttcttttattttagtcacctagctggtcataatatgttatggcagtcctaggaaagtaatagcacatgagatattttttcttgtttgttgttgttgtttttgtttttgttttttcctttatagcacttattgtaactagtaattttctttgtttgcttaccaattctggacatactggaatgtcagcaccatactgcattttgttcatcatccccgtatctgtgatgcttcactccaatagcagctcagttacgatgtgtgaacggaatgtatgaatgaatgaatgagtgaacagagctgttgtgaggactaagccgagcagtacagtgaaattgcatcaaacagtgtctactaagagcaagcatgcagaataaaagctatcatgattatcattcgaggcaggaattatctttttttcctagggtccctctgccttgctgagcatcaaggtgaacttgagtagttactagttacgtggactgggagaacacggttaaagtaaaggttgtttttgtggagattgacaggcaagagcccctgcctttcctttcctgaaacagcagttttcctttgagacacgaagcccaccactgagagaggcagggtgcgggtcatgggggtggaggtggcggcattgtttgcaatcctcttggccccttgctcacagccaggcctctgcctttatattcttcggggggctttgatctcacctccctgtccaacagatgcacattagtcagtaattctaggagacatcaaaaccccagccctggcaccccccgaccttccctgcagccttcacaagccgctagctgtgttaataggcgccagacaggactgtgctatttcttagagcttaggtagaatgctactgcggctgttttactgaaccccagctcagtctccacttctttccacctctgacccagtacgtttagaattagagccaaatgctctgagtgaagagttgcccgacacggtgacttgatttacctaaggctgctatattctttccgaatgttctttccagacagaggtggagggcaaggaactgggtcccaggagctagaaaacgtggtcttgggtctcagctctgccattctgacactgaataaccatcatcaagtcacagacatcctcagagcctctgtctctgcatcgggggagcagaaccaggaatgctggtcctgcctacctgacagaactgttttgagagtcacgtgcaaaatcagatgtgagcatgccttagaaattggaaagtgtcgtaaaactagaagcacttattactattattctgtgactctgagcttataaaaaaaaaaaaaaaagaaaaagaaaatcaggccaggcacagtggctcatgtcagtaatcccagcactttgggggacagaggcaggtggatcacctgaggtcaggagttcgagaccagcctggccaacatggtgaaaccctgtctctactaaaaatataaaaatcagccaggcatggtggcacgggccagtaatcccaggtacttaggagcctgaggtgggagaatcgtttgaacccggagggtggaggttgcagtgagctgagatcacaccactgcactctagcctgggcaaaagggtaaaactccacctcaaaaaataaaataaaataaaataaaataaaataaaataaaataaaataaaataataaaataaaattggttacttaccttgtgtcagctgttgcagatcaagaaactaatacaacgcaatcccttatggtgtgcttaaacccatattcaatatagaaaatatagtatatccagataaataataataagcatagttatttcatcacctcgttgaccacctggttgtttatcttttgagaggctttgcaatgtttgacaaaaaattagaaaatagataaaaatgcaaagatgatacctgctatactgttttgtggatttctctttaacttaaaataccatacatacaattccgagtcattattcaatgactattcagattttaactttttgttttctctgatggcttctttgtgtctcattgcctgggatcatttggattggacatagtttatttagccaatcccttgtagttggacacttaaattttttcccatttttcactgtgacaaatatcaccttgatgaatttctttctgcaaatctctgcacactaccgtgattgtttctgtaggataaattcccacaagtagaacttctgggtcaaagagtaaaaatgcacattttttaaggcttttgatagtcagataaaactaaaacaaaatcaccctctagaaagatcataccaatttaaactcccaccaagactgcacggcagtgtcctgtctcctgcactcacaccagtatcaagcattatctcagagtgatttaaaatgcctgaagaaaggagtgataatggtttctaaacagcactggctaacgcacagccctgcatattggctttcagcttgataaatactttcttataaggccataaatattggtggtaccaaaggttaacgtagtgtgcaatgctgtaaaatccagcaggcaacctgctagctcataatgatgcattagcacctttcgatatgaagtgtgatgacttacaaagtctgtttgtaagtggccactaactcaacaagtgtataattgtgtcagttggcaccacagtttctgcaaacataatttattaagtgagcaccttgccttctgttatatgccaaaaatgagaagaaaagacaagagaaggggaaagaagaaaatgatcatctgactggggcatttagtcccttctgcaagctagggttacttaaaagaccaacatactttattgaagaaaaaacaaagcaaataatcctttccatattttaatagtcagttgaccacactgctggcagtgttagaatcaggattgaggcaggcatgacaaatagctgcaccattaaaaggcatgtgcatttgcaaattagacttttaaatattttattttcgtgtttttaagtttgcaactcaggcaccttgctcctaccattttatttttgcaggtggaaacagttgtatagttctttgctattgttctgggatgggctagcatgaaggtgaaacctgttttgtgattaatgaacatggaggttgtgtgtatttaacagcagaagagtaatctatcctgataggagacaaaacagaatggataccaccagccgtgttcccgtttggctttgctccttggtaatggaggaaatccaggtattaaggatagactttagtaggcccatctcagcatttgcccgtgtgtagtgcctgttttggattgctgtaaagaggacactctgtaaacagaaaataagctagacaggcacattttgagctacttattctgttcattttcagtgactgttcaccctgtgcaatattttgaaacaaaccgaggagttattcacgtcatattctttcttactcgtttttcatattttatttttacttttgagacagagagtcccatctgtcacccaggctggagtacagtggtgtgatcttggctcactgcaatctctgactcctgggttcacgtgcctcctgaatagctggaactacaggtgcctgccactatgtccggctaatttttgtagttttagtagagacagggtttcaccatattggctaggctggtcttgaactcccaacctcaggtgatccaccggctgcgccacccaaagtgctgggattacaggtatgagccactgcgcctggcctcgtattagttgttctttaaacatttacatttgacactgagcactgggaatacagaggtgaatggcacctactccatccctcaaggaactcatcctagtctagagctgtgaaccaatgcaaggggcaaatgcacacacatgcggttgcacggatgagcaggatgctctggggcaggagcgggggggcagtcaaacaagtccaaagcttctcgcctccagccagtttcggctgctgttcacccatatctcccatcgcctgggagcaaagacagctttgctcagagttttcttctccacttgaggccgccatgtttgcctctgtctggagttgtcagcctggctactgactggtagaaatcagagaggaaattccaggcatgatggcatgttcctgcctattagttagggacccacttcattatgaatgacatagtcactatgaagacctgacctctctggcttctggaagaatgttgaacatgcagaccaaggaaaagccaccatcccagagctcacattccagggatccgaagaaacacatcagagtaatggctagcccagatggtgataggagagaaacagagaagagggtggacaggaaggactttctgaagaggcgacatttaagccgatgactaagtatgaggaggatccagtctggtaaacagtggaaggcagaggttccagagagaagagctggcatatgccaaggccttgaggtgggaaacaccctcgaaatatttacagagtggaagtagctcccaatgcctatgacttcactagcccccaatttggaacaaccattatggctgctgaatgctgtaggactgtgaataagcaaagaagtgtttgaaatgaggttataaaggtaggtagggccatgcaaaccaggtgaggagtttaggtgtaattctaggtgcaagaggaagccactagaaagttttgaagcatgaagagtacctgtattacggttctctaaagggacagaactaataggatagatgtatatataagggggagtttataaaggagaattgactcacgtgattacaataggtcgtctgcaagctgaagagcaaggaagccagtccgagtcctagagcctcaaaagtagggaagctgacagtgaaaccttcagtctgtggttgaaggtccaagagtccaaaagctgaagaacctggagtctgttgttcaagggcaggaagcatgcagcatgggagaaagatgtaagccggaagactgggccagtttagtctttccaccttcttctgcctgcctttattctggccacgctgaccactgattagatttgtgtccactcagattgtacgtgggtctgcctttcccagtccactgactcaatgataatcttcttcggaaacaccctcacggacacacgcaggagcagtactttgcctccttcagtccaatcacgttgacaatattaaccatcatcatatccttctctttttctttttcttttatttttttagagacagggttttactctgtcacttaggcaggagtgcagtggtgtgatcatagctcactgcagccttgtcctcctgggctcaagcgattgtcccacctcagcctccctagtagctgggaacacaggcacacaacaccatgcctggctaattttttaattttttatagagatggaggtctttctatgttgcccaggctggtctcaaacttctggcctcaggcaattctccctcctcggcctcccgaagcactggaatgccactatgcccagcctacccttctcctgagtgagttcctccagagtcttttttttttttggctgggctgggaaatacccttgagttccggagaagggaagtggtttctggaatcctctgcccgtgaaggttaatttggcaatatgcatatctgctctggggctatagaggcagctgtgacgatgcccagagggggacctttatgatctgagagcccgtggaatgtttgtagcagcagagccgtgttgtcccattgaatgtctcttccatttttaatgaggagcctgggggcactgtatcaataaaacgaccaaattattaaattatcactctacagggcatcttatattagtcctaattaaatgatgcttttcatattaacaaacagtgctcaaaaaggattctcatttttaattcggacctcattgaaataggaagccttagaaatttctagaataggtactatgcctctggacgaatatgcaccatgtctctggactcactggagggcacctacagtgagttttcagacactgccctgaattttaaaaatcctcagtatccacaatgactacctgtcttcacccagactcagaaatgctaatgggggtcaggtgcagtgactcactcccataatccgaacgctttgagaggccgaggcaggcggatcacttgaggtcaggagtttcagaccagcctggccaacatggtgaaaccccagttctactaaaaatacaaaaattagccgggcatggtggcgggtacctgtaatcccagctactcaggaggctgaggcgggaaaatcacttgaacccaggaggcggaggttgcagtgagctgagattgtgccatcacactccagcctgggcaacaagagcgagactcaaaaaaaaaaaaaaaaagaaaaaaaaagaatatttacaggacttctgctttcgccacgatagagtaacagggactggtgtgcaccgctgccttaaagaacttttaaaaaggtcagtctcagaaattgccactaaagaattttttccatgcaaccaaccaccacttgtcccccagaaacaactaaagtttagaaaaaagtcaccatacaagcaacagtgatttcagacgttagacagcatgaggcatccacagaggggaagcagatgagatgtaccctccaggggccccagctcactgccttgagagggtctctaagccataggacaaggggtgggggcccaaataaggaatatttggggcgcacttgctgggtgaaagccatgagacactggagagacagtagtgatccagtcagccaatagctctgtgctactgagctgacattgttttgagggaaatggtcaataagtgagcaaataaatgggggtggtttcagaatgtgagaaatgttacaaagaactaaaaagggtaatgcagtggaatactgtgacctggaggagcaggtaggagttactctagctggttcagtggcatgcaggaagctgctggaataggctgccaagggccaattatgagcattactagccaaatctgtgttccatgagatcccactggtagcttgaaataggccatgatgtcaatatttacaccacagacattggcggtgtttttcttttttctttttccaacatactacggatggtatggccaagataggtttcataaagaagtgcacatttctgtatgacattaggataaagaacagcccatcatttatgtgacaaaccctaggaggaatattccagcagaagaaatagcatgtgcaaaggccgtgtgtccacatcctccatttcttcattctctatgatgttcagggcaggtatttttacccctccccacaattgtataaggagattttcattgtcacgtgtgtcagtcattttatctcattctctccaccacccgtttttaattcccatgttggtacagtagagaatatctttatccagttatccttccttcatccttagattttgtttcctgatttctctttccttgtacttcttttttcatagaattttacaacttgttttcaggtatgcttctttatttccatgtctatgagagctttgatcagcagctatagtttcttatgtaatccatagactccatcaatttcttttatagtgagaggcgacaggatactcattttacatctagaggcaaagtacttcagcactggaaggtgaaaagacttcagaagaccttttctggaagccttttctttagcagcagggtgtcttcagagaagttgcagagttgagtctaatggaacggcctgaatgaccactgggtcaatgttaattgataatgatgctttctaaggcgagatctgaactgaacctcaactcaattcttaatatgtgcggcagaagcaaaaacaagaaatccatagttcatgaccctataagatttatgtctaaagcatttccgacacccattctttgttgtgaacgactaatttgccactcttgtttttctttctttttttgcaatggagtgttactctgttgctcaggccgaagtgcaatggcgtgatctcagctcactgcaacctctgcctcccaggctcaagagattctcctgcctcagactctcgagtagctgggattacagtttcctgccacaacccccggctaatttttgtgtttttagtagagatggggtttcaccatattggccaggctggtctcaaactgccgacctcaggtgatctgcccgcctcggactcccaaagcactgggattacaggtgtgagccactgagaccggcctaatttgacactcttaagcataccttctctttcctctcagtaagcaagtcagatatttcaggagaaacaaggtatgtgctccttccttctttcattccttccctccttccttttttccccttcctttttaaaaaattttccagtttccacattttaaaattttatttctttctctttttagagacagggtctttctctgtctcccagactggagtgcagtggtgcaatcatagctcacttcagcctcaacctcctgggctcaaattatcttcccaggtcagcctctagagtagctggggctacaggtgcccaccaccacaccccctaatttttaaaattttctgtagagatgggatctcccagtgttgctcaggctggtctcaaactcctggccccaagtgatcctctagcattggtcttccaaagcactgggattacaggcatgaggtgccacacccagcccagtatctacaattttaaaagtggtatacatagcctaagatcttccataacaattaaaaatgagtgtcagacatgcaggactatcaggcactactgaacattgctgaatactcacaagagaagggggatacatatggcaaaatttcaaactcaaatgaagatctgcaagtggccagtgcacttgaaaggtgcacaactcatttcagaaggcactgctcagcattaccaagatgcagctgtgtcctaacccccagctacaagggagtgtttactgtaggttagagttagctgactcagtccatatgttagggtaatcacaacccaattttgatgaactcataaaccaaggaggctgttgctggagctaagaagagacaagatttttagtagatagtgacatttaacctcagctaagtctaggctgtcagcctggcaggtctttttgaagagctaagttctgcttaaaagccattagtgtatgtcaggctctatacattaggattaaagaatgtaagaaggccaggcccagtggctcacacttgtaacccaagcactttgggaggctgcagtgaggggatcgcttgagcccaggaggtcgaggctgcagcgaactatgatcggaacactgcactccagcctgggtgaaagagcaagatcctgtctcaaaaaagaagacaatgacccagatcctattctctcagagcccaaagcttagttgggctgatgggaaaactaacagtttcaatttaatgtgtgtattctaggatcgagctaggggaacaaagagtagcaggcaaaggaatgcacagaaatatttagtcatagcaggaaccgttcttcaactatcttccaaggactgtgctaaatactttccatgcattattttatccttacagcaatcctgtgttttatatacttttaggtaaaagtccattttagtcattagcaacctgagcacagagaggtcagttaacatactcaaggttgcactgcatgtggtaaagagctgaacagagaaaaccaaattcccaagttcagcctgagtcgtgtagactaagtgttagttggagtaaacagacttagcttctctagatctgcttcctatcagaaatgtggagatgttcaaagtcagctgcttacctttagaattgccatgaagtgaacaccagtgaattcagattagttgagcactttgagcctctaacctttttttttttaatttttttatttttaagcaccctacacctataacttaactattcccaatttggaaaaaaattttatgagtgctgtgcactctttttttcttcttcttctacaaagccaagtgcacgacatcaaacctgtaatcttggccacattatcaccatgttctaaccaagcaagcttattagttcagacaattaagaaaatagaagttgaaaatacttagctattagggagaacggagtaacataaatccaaggtgttgggacaattagcattcgtagtaataaaagccaagtagaacactaaggaaatgaatattatgtttattatttagcatttaggtagtattgcatatttataaaatacctggtaattgtttttggtcatttctttcagaataaatcggataaagggtatttgctattgttgtgagtagggtaagggggggtttttagtagaagcccattaaattacaatgcatctccccaccctcttaccctcaactcagatttaagtacagaaagaaaacattcagaaatcttgctgaaacagaaatcatttcacttttctcctttgttaaaagccttctgatgactcccccatttctgttgcagcaaaaggcaaaatcctgtaaatgcaacttgatgtcctagaatggattctggaacagaaaaaggacataagtagaaaggctgtggaaatttcagtaaaatccatggtttagttaatagacaccagtgttaccttcctcgttctgataaatgcacgtagttgggtaagatgttagtgttagaggaagcggggaaaaggatataagaggaccctgtgtactatctttgcaacttttttgtaaatctaaagttattcaaaaagttaaaaaagattttttgtttaaagctaaagttcttagagcagactacaaagacctgcgtgacctgtttctgtgccctcgtcaggtctctgacgtcatctccttttctcttccccttgaacgttctgtaccagcctcacgcttcatcactttctcaccgcaggacctttgcactggctgtgtctgggactgggctattattgcctgagctctccctgtggcccactcttctttgtcaaattgtgattcaaatgtcaccttcataaaagccatccattgaaaatgtcaagcctacctccacggtcccttcctcctgctcagtatttatctcatggtgcctatgcttccaacatgctctgcaatgctctgattgattaggttatgcttcatcttcctcctgctctcctaaaacttacgttccttgagaggagggattttttcctgttttctccacgatgcatttccaacacctggaattgcatacttagtgcttaatggatattagttgaacctaaatattaaattttatactacaagaaagtaaccctaactctgaatgctttgataaccaaggcattgtggtaaacactctaaattttctagatcttgtggcatcttcatgatagcttaaaatttgagtatcatgaccaccatttataaggccctgagaagtcttaagttttgcacaacatgacgcagctcttcggtcaaatctgagagcccagattcgaacttgcatctcccaacactacagctagttctgtttcttgtacaccagattgtctgctagatttgcatgcttcccctccatttcattaaaccacggcacatgaagaaatagcattactcatcaagtcagtagttgtttgagtaactcagatccctttcttagatgatggtacccaagataaatgtatggaacatattatttcccatgatggccacaggtaactctggaatattataaggtttatttgtataagcaactcagtatgaaacttttaccttgaatttccccttcatgggcctatctttgttttcattttcaacattctcttttggatacagagtttcattcacctaagaaagcttcatgacattagtggaaaggcactggttcagttctaagaccttagttctaggacccactctcctatctgctagctatatggaccccttcttaggctttaatttcctcatctataaaatgggcataattttaccaccaacttcatagaggtatcatggggataaatggtataacccatgtgcaatggtatgcactgctgttattgtttgaaaataattctttgttgaatcagatataaaggttgttattgttgttttctgaaaccgacttagtttaaaattactaagtcattttaatatctatcaaccatttccatagtttctaaggatttctcccaaatgcctctgttaacaacaacgacatcctcctcctcatcatatggatatcatgaaacaccaattatatcaattattgaacagttatttggagtcaggcttgatacagtctttgtaatgttgttttattttttgctgtgagtccacagagcgagtattataaacccattttacagatgagggaactgaggtaccatggaggtgaagtaatttgcctactgtcacgtgctactcatggggccgggtctcgaacccaggtgtttcttcctatagctgagggcttcatcagtacttagcacagctttattgccaaagagaattgtaaagcaactggaaaaatgaccaaaatacaatacctccaatgactatttttaaaaaaacaaaaaacagccgggtgtggtggctttcacctgtaatcccagcactttgggaggccaacgtgggcggatcacttgagatcaagaattccagaccagcctgaccaacatgttgaaaccccgactttactaaaaatataaaaattagccaggcatggtggtgggtgcctgtaatcccacctactcgagaggctgaggcaggagagtcacttgaacctgggaggcagaggtttcagtgagccaagactgtaccactgcactccagcctgggagacaaagttagactctgtctcaaaaaaaaaaaaaaaaaaaaaaagaaaaagaaaaaaaaaaagcattttcttaaactgtggcccagaaagcacttttatattagaattacctgatgcgcttgttacaaacacatattgctggctgtaatcagtgaagtgctagtaaatgcttaacaactagcttggtgggggaaggagcgggagagggctccagagactgatctgaagcatttgccaatttccatggtgcaaatactcccatcatggccattgcaagataccaatgcctcgtcactgaacacagagttaggaaaaaatatgcagaagtggaccatcacgcagtatttccaccatccagatactctaaacaaacaaacaaaaaacctcaagagcacagataatattcaagtatggtaaaataatttaatattcaaaactcattatttcttattaatttttaatatactttattgaggccaggcatggtagctcacgcctgtaattccagcactttggggggccgaggtggtagatcactggaacccaggagttcaagatcaccctgggaaacatggcaaaactccatatccactaaaaatacaaaaattagctgggtatgttggtgcacacctgtagtcctaggtactcgagaggctgaggtgggaggatcacttgagcctgggaggtcgcggctgcagtgagccatgattgtgccattgcactctagcctttgtgacaaagtgaggctctgtctcaaaataagacatacatatatatatacacgcgcacacactcacacacatatatatttatgctatatatgtataattatactgtatgtatatatcaatatgaatatatacatgtatagtacataaatacatgtgtacacatattttcgtatatgtatatacatatacaacatatattaatatgtatatacatatactttcttactatatatgctttaattatgggcttatgtcatttcattttttattaaaggttgtgtttaacaacagagtcacagaattcctgacaagttagcaactggctttcagaaatcagtatcaacaaacttcaacagtccaccagctaccccaggctgacaaaatcagcaccgaaaaggctggagccctggaatgtgcatttctaaagagcatccaactgcttctggtgcacactcaaagtattgagccaatgccataagcctttctgagagcacttgtgaaataagtatatgaaaatactatataatgtggtaagcatctgaaaaatgtagatgggattcatattcctagcaaatgctagtgggcatttatgctaaatgaaccccactgttactcttttgaagatttttttccctacttttaaaatggcataaaattattttatagttttattttattttacccatcaatgaagagtgcctggtctctgttaaaggagaaggtagtaatcctatttcccttgcagccagcataggagaaaggttcagaggcctttcctgaaaggtttaggcaaagataacaaaatgtcagagaaagctgcagggcagggctgaatggaaaagtaggtttgtaatctcaaattcaatataaaagatcgaaagtatcaaatagtcagtggtgagcctctccatcagaatgttatatctgccatgaaattctgctttatgattgtattacgttatatacattatacatctctttctctcagtctctctctttctcacctagtctctctttctccctctcttcctttatatattctcatagaaactagggcacatctgagatccataaggaagtcttgcttgactccagtcagagaaaccattggaaacatcacctgcctccaaccccaaccccatctgccttaaaaatataaaagtctttctttttaggtggaggttttgattcagggaaaacacaggccttgcaaattaagagcagcccaagaattgtgtgcaaaccctgatacacgagacacccaatccaaggcttgcactctgtcctctaaacagtgattgtgctttccaaggtggatatggagggtaattaagaatgaattttcatgacttgtgtctactgtgtgcccacacagtgccagaagccagagtaagaactttgcgggcctttcgcttttcatctaccctccttagtctttggttcttatccaggcacttaggagtttctcaatcagtattctttgaatgaatgaattcacaaatccccattttaaggctgtgggaagaaaggcctttagggatgaagtaacatgtccaaggtcaaatagttgtctttggtcaactgttggtcaaatgctacacaattacaggattgcctccctaaggtatagacagtggctgttaaaagaatggatcctatttgtcacctgtgaaggttattttaaaagatttatcttgagtgcataggagtatgaatgggtcactctgggatggggcccagaaatctgggtgttccacacccttacccaggtgacttagagacattcagcaggctgtacctggagaaagaccagtgcgattcatgtaaatctctctacatctccaaccagaggcaaacctgtcaacttttctggctgcaaaatctgcaccttgctaaaggctgtcaagaaccccctatggggggtggacttcttggcttacccaccctccctacatctctgatccttgcatttttagacgtgacaggtgcctgcaaggccaccaaatttcatgtcttcagtttattcagctgcaaaaaatttcatttcagaaacatgacacaatgagaaactgacaaaaggtgggcttgaattcaagtctcctaaatgaaagtacccccagtgactaaaagtcttgttgctgctccggatttcacattgtcatcctgcggtgggaacatatcttgcatttttatgtagagtatcaaaaaaaaaaaaaagcaaaaattgttttttggaacagccaaagcgtgtcctggagcataatctaatttgtttctctatggcccaagaaaagagggggcgagtgtcatccttcctttttcataaattgagattcagaaagggcgagtgactttctcagtcacacagcatcatgtctaccacccaagtctcacccgcttctcattggagccacaaatgacataattagatgagagatgatcccaagactagcggatgtttccctttcttcattttaagagtttggacttttttaggggacctaaacatttgctcctgagctctgctaatgtgtgactgctgagtttttctggatgaataagacttttttcaagaaatttcacatattcccgtctggccgaattatgtatccaaatgtttttccatcagagaactcatccgttgtcctgtgactgtgtggtttattcatttctcctccacaaagctaggagctccctactggttcaggttatgtcttcttcatccttcagtccccatatgtagcaaatgttctttatacaagcagatcttaaaatggtagctgagttgaacagtgtagacacagagtatttgtccctctaagaaccaacatgggaatccatggagctcagaccaaatccagcccactgtctctgcttttacaaataaagttttatcaaaacacagccacattcatggttcatttgtttacatattaccccatggatgcttttatgtacagcatggcttatgatgcccaactattcactctatggccctttaaagaaaaagcatgctatccccatctagatgaagagacaagtagaaaggagatgcaggcatttctattttcagagtatatttcttagcatttccatttccgaacatatatttactctccttcccacctgccaatgcaggagaaattagcctactgagaaactccgaaatatcctgactagtgtcaatttgcagaaattgtgcagtttatgtgacaggattctttcactgtcaaatttttgttcagagacatatcggtgttcacaaagaatgatatctccatgtctcagcatatcctggaaaaaccccagtagtcctagaacaaaactcttggagtgcttgtctctttgtttgaagcatttatattaatacaaagaaagaagtaattagccaggaaaacccagggatgttcagggagatcagtgccatcttaaattcatcacccattttctgcaactgaattgtgctttcagcagttttcttaggtctgggaaattagcataacgtatagaattgccatttggttcatttaaatcttgcataatatattaggggggaaatctttgagctaagtggaatttaggatttagtaccaaatacgaacttttgtgttaaattgatgtataggttggccttgatttctgagtgggacaggtaattaaagaaaaccaggaggttaagaggagatgaggaaaaaaaaaatactgcaggaggaaaaggttggaggcgtcagccagaaagggaggctgctggaagattgctaagctagagaacaatgcagctcatttttatgagaccattaacacagaagacagtggcaacaatcttgggagtatttgacatgttcccaaaattagttgggtgcgggatgtcatggcacagagctgtgtacctgctttttatctggggatttataaaagtggagccttgctggtgtcgtccaaaacagcaggatgggaaagagctgttggtgagaatgcattagggtacctgccgcctgttccctgtagttcctctggctcttgaaagagcctgaagttacagaagagggcaggagttctaagggtgtccaggaggccaaatgctgaaggagaggaccctcatctgaaaggagagttggaagcaatgaccattggcaacagccttgaagacacgagaccctgggcaactatggagaatgacagaggatggctgatcagtgccccaagtaacctaggaatgtggactccacagccccaccacatccatggaagccaccagtggcacctgagccccagcagaatgagatgggaggcaaaaagaggcacttctcatcaccaggatgcatttgatttcattagctgccttctgcctcctaggttccttctcttcagcccccagtcttgaaagaagcttcttccccagtgggggaaggaggaggaaggtcccagaggttgcacctcatcccactgatcctacaaactgctggagagtttggagccaacaggcaagaaacactctatgcccactgtaggtatactggaccacagatgtgtagcaagaggaagagagttttaatctcattgattttggaagctttaaagtggactggcctgagttttaacaaccaagtgccccgagagctgttgcatcttctttagatgccattaagggacttgacccaggggattgcaatgccagggctctaagccactgtgccacactgcctcccatgtagggactaaacatcccaaagaagctctgaggccctctgaacctcaatttctttgccgtaagatgggcacaatattagaatcctcttgtctgagtcatcagacaatgtgaagagattaatagaatgctaatcactcaaccaggatttattaaatggcaatgaagtattaatcagccactcttctcgatgctggttattataataatcatggtccatcctaagcacttacaggtgttgactcatttggggtagatgccaatagtattcctattttctagataaaggtaatgagacagagaggttaagtaacctgctgcagttcacacagataggaagcagtgaagctggaattcaaatctagataattgtgtttcgaagtctataaatgtgtcttgttgttattgctattgttatatatatacatgtttttttcttttcttgcttcaaacaaagtcttacactgttgcccaggctggagtgcaatggcacgatctctgctcactgcaacctctgcctcccgggttcaggcaattctcctgcctcagcctccatagcagctgggactacaggcacacaccaccacacttggctaattttttgtacttttagtagagacgggggtttcactatgttggccagactggtctccaactcctgacctcgtgatccacccacctcggcctcccaaagtgctgggattacagggctgagccaccgcacccactctattatatattttaactacctatcctggaaccaaaagccaaatctttgcaacaagaagaggagaagaaagagtgctttttgtagtcttgtcattccactttctgataagcagacaccaacctccaaccctgcccactgtaccaccggggcctgatgtatagtaggtgctcagtaaatatattttgaatgattggataactgagcacctgatttcaagcccccaggacaaacaatgcttctttaagtgcaggtgtttgtaggcgctgcctcagtaacacagctgtggactgaattgtgtcccctactccaggtcatatgttgaagctgtaaccaccaaagggatggtgtttggaaatggggactttggaaggtaattaggttaatttaaggccacgagagtagagcccgatgagacagtatccatacaggaggcagagatatcagagcttccctccctcttccatctgagaacacagaaaaaaggcactcaagccgggcgtggtggctcacccctgtaatcccagcactttgggacgcagaggtgggtagatcgcgaggtcaggagttcaagaccagagtggccaacatgttgaaacctcctctctactaaaaatacaaaaattagctgggcgtggtggcaccagacacctgtaatctcaagtactcaggaggctgaggcaggggaattgcttgatcctgggaggcggagcttgcactcagccgagattgcacctctgcactccagcctggctgacagagcaagactccatctcaaaaaaaaaaaaaaaaaaaaaaaaaaaaggcactcatctgcaagccaggaagagggcccttcccaggagctgagttggctggcactttgatcctgcactaccagcctccagaactgtaagaaataaatgtctgttgtttaaaccacccagcctgtggtattttgttataacagcctgagaagactaatacagacacctagacaaggctgtctcctttactgatgtgttaaacacctggccccttgtacattcatcctatttttttcccaaggaataaaaatagcaaaggaattcggagtcagcccttctctgtcctccagcccttctcctttcagaggaatttcatcactggagcagagcattgaattcattcgagttgcagggaaatgtgatgtatttcttaaatctgtgtcacctggccgtggaatcagcccagccaggctcgaaatgaggcattaactacatccaaagctgtgtgattaacttatttgtttgccgacggagctcaaatgaaaaagcaggaagctgggaggatctgcacgagccccgttttgaagtaggattgtgagaagacccgaagtgtgggttttagttcacattccctgggcttaccattattattacttttaatggaaaataacttttcacaatcttgcttcgttttaaatggagaatgtgcaatattgtctaatttagggtgtggagttgatctggtatgcatgatttttcttcccccgcccgccaccatccttggattctttgtacacattcaatatagttacatttttgcttagaacatatatattttcccccgaacttttctcgattgcttttttatcaggtttacaaatcaaatcaaataggtatattgcagagctctgcgatattattttctgagcttacagtacaatgtattgaattatgccagcccatgctctgccctgctattctctgcagactgagagagggggaccgtggaccctgtaaattcactcggcgcccagcattactggctaaatcaagaccgctcttcagtctgcaagaagagacagagcaagtgttcgttacacaaatcaatttggtccaaagtacttcgcagtgggtactcaaccatcgctcacataatattgtcaacttaatcaaataatgcctcgaagacactcagaagcttttctctctgagaaataacttgattggtggaggatggagcagcagctggctcttcaaagtacactttttatttatcactgtgaagagttttgtgcatggaggggaggaagcctgtaggaaaggaaagaggctgaatagtcagtaggctgactgtggggagaatcatgcagcattcatgtcgtgtcttgggtgctgggtttctacaccgtgatggtgaatttggggatgctcgtggatgaagcagcagctgggcccaaatcattagtttcctggaatgattcaggaaagacttgccgagcgcctactatgtgtcatggtaaggggcttttgatatagtgcatctgatacagtgtttatccacgggacgctcatattctaggaagcatttgatatggtgtttagtcatggggtgctcatattctcgtaagcatttgatagagtgtttatccataggatgcttattctaataagaaaacctgtcagtgagggcttaacagaggtcaacccaggactctagtagttcaaaccacacagctgaagcagcctgcttttgattgctttttaattggttggatgagctagggcctcattcacccacctcactgctctgtttccagcccagacctagaacataggcagttagggtttctgtgaatctttactcctgtctatatgtactttgcagctgctctacgtgcctgctcttagactttccagagcattttcaccttgaccttgaaaggccattcaggagcgaaaagagtttaggatacggaattagatatcctaagttcaaaccttccatctcctggctgtgtgacttcggacagatcgcctaacctctctgagcctcagttttcctagttgttatggcgactcggtaaaataaggcatggaaaacaccagtgagatgcttagctcatggtgggacctcagcacagttttcttttccatcctgtatcccagaccatttagccagtttcacattttgcttataaactacgagtggcattcagcatcagtgatagccggaatcctttgtcttaactcaggataggggagaagcaaaagccttcctcagtgatccttttccacatccaagggtgtctatgtatcctccagggagcttgtgaactttctgaaatcgtatgcaaaatttaggtgtatgtgtattttccccccaaaaggtggtccacagttttcataaaaccttcagtgtatccatgaacaaagaaatcgattaagaaacatgtatttacagagtaaagggaaataccacccaaaaataatggtatcaacaaaagtcacagctgacagctactgctaatggaactgactgcctgagcgacccactctataattaaagctggatatatatatatctccctatatatgtatatccatatatatctccctatatatgtatatccatatatatccctatatatatatccatatatatatccctatataaatatccatatatatatccctatataaatatccatatatatatccctatatatatatccatatatccctatatatatatatccctatatatatatccctatatatccttatatatggccctatatatatatatatatatctccctatatatggccctatatatatatccctatatatggccctatatatatatccctatgtatggccctatatatatatatccctatatatatatccctatgtatggccctatatatatatatccctatgtatggccctatatatatatccctatgtatggccctatatgtatatccctatgtatggccctatatatatatccctatgtatggccctatatgtatatccctatatatggccctatatatatatatccctatatatggccctatatatatatccctttatatggccctatatatatatatatatccctatatatggccctatatatatatatccctatatatggccctatatagatatatatccctatatataatccctatatatatatatccctatatataatccctatatatatccatataaccctatatatatccctctctatatatatccatatgtatacctatatatatccccatatatatacctatatatatccccatatatatacctatatatatccatatatatacctctctatatatgcatatgtatacctatgtatatatatatatccatatatatgtatggatacctaaaattaaagctggatattttttacagtattgcccaagaaaaaacattaaaatgccaaatttatttcatttaaaaatagatgtatttgaaacttagttgactcaataatattcctcatttcaaaggattctattgctactggaaaggggtcctgatccagacaccaagaaagggttctaggatctcacacaaaaagaattcgaggtgaatccatcaagtgaagtaaaaataagtttattagagaagtaaagaaacaaaagaatggctactccataggtagagcagccctgagggctgctggttgcctgtttttatgattatttcttgattatgtattaaacaaggggtggattattcatgagttttctgggaaagggttgggcaattcccagaacttagggttcctccctcttttagaccacatagggtaacctcctgacattgccatggcatttggaaactgttgtggtactggtgggagtgtctcttagcaggctaatgcattgtgattagtgtataatgaacagtgaggatgaccagaggtcactttcgttgccatcttggtttcggtgggatttggctggcttctttacctgttttatcagcaatgtgtttattacctgtatcttgtgctgacctcttatctcatcctgtgacttagattgccttaactggctgggcgcggtggctcatgcctgtaatcccagcactgtgggaggccgaggcaggtggatcatgaggtcaggagatcgagaccatcctggctaacatggtgaaaccccgactctactaaaaatacaaaaaaaattagccgggcatggtggcgggcacttgtagtgccagctacttgggaggctgaggcaggagaatggcgtgaacccgggaggcggagcttacagtgagctgagatcacgccactgcactccagcctgggtgatagagactctgtctcaaaaaaaaaaaaaaaaaaaaaaaagaatcacttaaaactgtctgggaatgcagcccagtaggtctcagcctcattttatccagcccctattcaagatggagttgctttcattctcctgcctctgacaattacggtcattgtcctagggaagactttctttctctactttcctcccttttaaacccattatccgttatcgctttttcttcccccagcacaccatggctctaaaacaggaccgtcccattgacagtgatgaaaatgttctatacctgtgctttctgatgagcgtgcaatagttttcttttgctgtcagatgaccatacacctagtaacttccacaacacaagtatattaggttacagttctggagatcagaagtgtagcatgggaatcaccaggtttacaaggattgtagctggcaggatgatatttctataggctcataatttgatctttccccatgcctttcctggcccctgaaggccactgtcattcttgggctcatggcccctttccccatcttcaaaatcagtaatggtgggttgagtttttctcacggggtgttcactctgacattgggggttctcttccatgccactggcctctgtttcacttctcaggaccctggtgattatacagggcccacacaggtaatccaggataatctattttatggtcatgtgattagcaaccttaattctccattgccatgtaaagtatcctattcaagattccaggtattagaaccttaacatctttaaggggtcattatgttgttttccacagaaagccaccaaccacaggtgtctgttgagcacctgaaatacagctagtgaggccaggtgtggtggctcatgcctgtaatcccaacattttggagaccaaggcagaaggatatcttgagcctaggaagttgggattgcagtgagccttgatcattccagtcttgggaatgggagtgagcgcctctgtctccaaaaaaaacaaaacaaaacaatacagctagtgaacttgatttaacttcaatttgaatgtaagtactgatacttgattgttattagtttgtttgggggatccttcacatgtcattttttcaaaggctaaatataaatcaagtatttccaatgacaattcagtttccatatggagatgtgtaaaatacaagatttcaaagacatcctccaaaaagaaaagaatataaaatatcttttacatgatagcatgttgaaataatatccttaataaattgggttaaaatgaacgttcttaaaattttactttttttttttttttaaaaagtgacttctaagaattctaaaatgacgtatatcacttacattttattttacaagacaggcttctctaaagtccttcaccagcatccttgagctatatctaatgctgtgtgatgagtgcatgtatttttcatttccatcaaatagaatttgctacagttcttattttatttctaattatcccctctcccctactgagcacagaacttcaacatctctaatttctgtctgtattctgatttctactgacaacttcatggtggtatcatctaccacattttactcaaccgaaactggatgagtaaggactgccaccagtaccctggacccacagacaaccctgagatagaagtcatttatctacgcttgcagctaggctcagaaggatgtacatagctggactagtgatgaaactagagttttattgcagagctacctagccataaatattccttccctgaatgtacattagctcaaccattgtggaaaacagtgtggtgattcctcaaatacctggaaccagaaataccattttacctggcaatccaatttctgggtatataccaaaggaatataaatcattctgttacagacacacatacacatgtatgttcactgcagcactattcacaatagcaaagacatggaatcaactcaaatgcccatcaatgatagattaaagaaaatgtggtacatatacaccgtgaaatactatgtagccatgaaagggaagaagattatgttctttgcaaggacagtggatggagctggaagctttatactcagcaaactgatgcaggaacagaaaaccgaacactgcatgttctcactcataagtgggagcaggacagtgagaacacatggacacagggaggggaacaacacacactgggggaaggggcgaagggagagcatcaggataaatagctaatgcatgcggggcttattacttaggtgatgggtgcagcaaatcaccatggcacacgtttacttatgtaacaaacctgcacatgtactccagaacttaaggaagaaaaaaaaatccttccctgtgcttctgtacccacttacctggtcatcactagaagatgccacgcaggtggcctcagtcttgtctccctagggtcagacagaggaaaccccaggagggggacagaatccaaaaggcatgtatctctacacgactatgcattttctctccaacagtcatccctggattggtcgatatcaaaatccaatttcaccaggattagtctcgggttgctcagagctattcattgaattaggaacgattatagcagagggagccccgtggttctttattaaggtctttgtggaagcactaagtgatcttcaggagattaaagtgccagtggtgttttcttaacatttataacctgcgccgatacctggggagtttgtgtattaagaaaaattctgccgcacagatcccgcctcctaataaggccttcacactgggcccgggtagaagctggcattgtggtcctaatgagcttatcagggaagctctgccaagtgccgcctggaaacccacctcttggggttaatggacttcccatctgtgtagggtcctgcagcctttcctgtttgatggggaggctgcgtctcagagttgtgcatggcctgagaaataaaacaaaagctaggcccggcgccgtggctcaggcctgtaatcccagcactttgggaggccaaggcaggtggatcacctgaggtcaggagtttgagaccagcctggccaacatgatgaaaccctgtctctattcaatctaaaaattagctgggcttggtggcacatgcctgtagtcccagctactggggaggctgaggcaggaga[145 bp omitted]tctttatacaagggacttaaccattcacaaagacttggatgtaatttcactctaaagcatccaggacaagtatacatttatcattttatgtatatgcaaatggagatccagagacatgaagtgagcagacttgcaggtcgctcatggtaaggcttagtcatttacgctgcagatatttactgagaacttaccacggactccaggtcagcagtttcaagtggtacagttttgcctcccaggagacatttgaatcccaggagatattttttgttccaactcacgggtaggcgactggcatgtggtgggtggaggccagtgatgctgttgaacattctgcagtgcacaggatgatccacccatcaaaaataataataggctgggcgcggtggctcacgcctgtaatcccagcactttgggaggctgaggcgggcggatcacgaggtcaggagatcgagaccatcctggctaacgcggtgaaaccctgtctctactaaaaatacaaaaaattagctgggcgtagtggctggcgcctgtagtcacagctactcgggaggctgaggcaggagaatggcgtgaacccaggaggcagagcttgcagtgagccaagatggagccactgcactccagcctgggcaacagagtgagagtctctctcaaatgaataaataaataaataaataaaatgaaccagccccaaatgtcaatggtactgacattgaggaaccgtactatagtggtagagggtttcagtgaacagaaaagccacagtctctgctctcctcgagttacatcctggtagaaaagataggcaatatacaaaatcacagaataaaataataaaaaggcaagaagagatgtatgctgtgaagaaatcagtggtcaaggggagagagagtgctggtgcagagttgctgtagatcatagggccagtgaaggtttctccaatgggtgacacctgggcagagattgtatcggcaagagggcaagctacaggtggtgtcccagggaaagagtcttccaggcaaagggcagaatgaatgcaaagaccaaagatggggtcaggaaaagcaaagaggccaacaagcgacaatgggagacaggcagcaggcaaagtgggaggcagtcacagccgagaacactgaaccttatagacctagagagccaatgacgatccaggttggagaccactgagaagggggtgtccctggccactttcccgtccacctctaacatccttactttactgactgccctcaatttcctccattctctgaattttctgcatggctatgtcctaccttctgatctcccaaatatggtaatgtccattcaggtaggtctcactttagagccaaacataacttttatggccaggcacagtggctcaagcctgtaatcccagcactttgggaggccaaggcaggccgatcacttgaggttaggagtttgaggccagcctggccaacattgtgaaaccctgtctctagtaaaaatacaaaaatgagccaggcacagtggcacacacctataaatcccagctactcgggaggttgaggcaggaaaattgcttgaacccgggaggcagaggttgcagtgaggtaagattgtgccactagactccagcctgggcaacagaacaagactctgtctcaaaaaaaaaaagaggtcaaataaatcaggagttctctcagagattacttcccactaagctttgatgtgctacagctttaggaactataactatgaattccgtagccactgcccttcaggaatgtgcattctagatggtttgtcctattagcaagtttcctagctttttcacattttcttttccttaggaattacacactatgcttttgtcataacgttcagcaagcttctcagggatgctataatgacttctcaagttgaatgaggcacactagtaggtactgggaacatacaggcagcatgtctgtccttgagtgttgatggcctttcaagaggctgatgaaaggctttccagccaggcgtcattgcatccagggccatgatcgaaggccactggggagagtgggctggagagaggaagacttaagtgttctctttggagagtctcattgaagtgacacctgtatcagggttctctagagggaaagaactaataaaatagatgtttatgtaaaggggaatttattaaggagtattgactcacacgatcacaaggtgaagtcccacaataggccctctgtaagctgaggagcaaggaagtcaggctgggtcccaaaacctcaaaagtagggaagccaacagtacagccttcagtctgtggtcgaaggtccaagagtccaaaagctgaagaacttggagtcccatgttcgagggcaggaagcatccagcatgggggagagttgtaggctggaagactcagccagtctagtctttgcatgttcctttgcctacttttatcctaggcgtgttggcaggtgatcagatggggcccacccagattgagggtgggttggccagtccactgacttgaatgtttatctcctttggcagcacactaacagacacacccaggaccaatactttgcatccttcaatccaatcaagttgacactcagtgttaaccgtcacaactcctattgacagatgacagcctgacaggaacattcattcctccttctcctagacctgctttgaggccactcatcttgagaacttcgtgctgcctgaagtggtggaggacgcattgcctcctggataacagctgcttgtttgtactgcatacacctttgctttatatgtttggtggagagatgtagtagagggaatggtgacctccaaaaaatatgtccttgtcttccataaatgtgatcttatttggggggggctgtgggggaggaggtctttgcagatgtaactaaggatca[143 bp omitted]ctcctgcctcaccctcccaagtagctgggattacaggtgcgcgctaccccacctggctaatttttgcacttttagtagagacggggtttcaccatgttggtcaggctggtcttgaactccttacctcatgatctgccccgctcagcctcccaaagtgctgggattataggtgtaagccaccgcacccgaccctagtatcgttttaagaagaaaaaggaagagggaaattggagtttcacccccgcagagggaagtagggactgtggacattgaagcagaggatggaaggatgcagacccaagccaaggaacacctgcagccaacaaaagctaaatgaggcaaggcatgattcctccctagagcctctagaggaagtgtggccctcctggcaccttgattttagatttctgtcctctacaactacaggagaatgaagtccagtggctttaagccgccagctttatggtcctctttcaggaaacgaatatagagacataaaacgctggctggttctaaatatgttttccccggaaggtcccagaaaaaagagaaagaaaagagatcacactcagtggagggctttgtgatgatctctaaccccaacatgcgttaggctctgaggtagctgctctgtcatctcctgctgcatttcatccttcccactatcctgtgagcttagtaccattagtgtcctttttgtttttgttttagaggcagagtcttgctccattgcccaggctggagtgcagtggcatgatcttccctcactgcagccttgatctcctgggctccagccatctcccacctcggtctcccaagtagctgggatggcaggcacatggccatgatcagctattttttttttttttaatttatttagtggagacagggtctcactatgttgcaggctggtgtcaaatgatcctcccaccttagcctgccaaagtgctgggattacaggcatgagccactgcacctagccccattaccccattaatgtcctttgatggaaaagtaaagtgaaggtcagagaagaaaagtgacctgcctaagattagcaaataacagggatggtctgtgtgattccaaaaccctggttcattgtgctgcatcccaccatataaaaggcatgcaggctgaaagagatttcctttttctgttgttttattcactcctcaacctctacttcctaacactcttctttttccctttccatacacccacaatgacctgaaacacttttggcttacttttttattttgcatgctttaaggattctttttaatacacaggtatttctccataacagtttatacgcatttgtatataagcatacactacaaaatgattaattgagcgttgtatgtttttatcaaaggaaacaatgcaaagatttctccaaagtgctgtttgactagagatgattaattttaattttcacatgagcggtataatgctattaatcatttaatatgtttaatcataatctctgtaattcctaattaggttcattaaactgaaacatccagcagttatacacaaatccaaatctatgtttccttctcaggataagaaggagctcattttgtttttgcattgaaacgggaacttctaacaggatggaagagaatggactggaagcttagggtttcagctacagcatctgtaaactccgagtctgggtgtagagtactaaaaccccttaacttctgaaaagtgacagttgcaggattcgagctcatttctgtgtcatggacgtggcaccaaacctcgtattctcagcggagaaaacgcaaattctgctctgtttgggtttcagtgttacagtgttgctcttcgactatcacatgaaggcggcgacattgattgtacacttcttcatgcatttgtttattcgtgtactaataattcattcggtcagtgagtgagccaactgttaaacagacatttatcatttgtgttacaagctggtcataccacactcctgctgtgacccttaggtggctccttattgctcttaggatgaagctcagactcttgctttgcacagtgtcctttgatctagccccttgactatctttgaaacctgtcctcctgccttcccttcatacatgcctcatctgaccagtggtgctggagtccacacatactctcctgaatccaagacatcatttcacatctctgcacatctgcacatgcactgccctgtcttggaatagcctcagtccttttcacctcttctcttagacatctcccacttaacgtttaacctccagaattggcaagcctggctgaacctccagcagtgtcatatgaccttgatttaaggttactcagccctttgtgattgcctcttatcccaacatttaccagtctctggggatggtggctcacgcctgtagtcccagtgctttgggaggcagaggcagaggcaggaggatcacttgaggccagaggttcaagaccagcctgggcaacttagtgtgacccaggctctgcaaataaaaattagctgggtataatggctcatgcctgtaatcctagctacttggaaggctgatgtggcaagattgagcccaggatttcaaggcttcagtgagccgtgattgtgccatggcattccagcctgagtgacagagcaagacccaactccaagaaaacaacaacaaaagacaatgacaaaatgattctatttatgattgtttttctctattggtgtcatgcactaaagttggaattgcatgtgacaaggagggctgatttatgtgtccaacacaaagcagttgctcagtaaagatgtgtaaacactttaaaaataagcaaatgaaaacctttccttcgtgtttctcaaaggaggtttatttctctttttggtatttaaaaaacttgccatcattctaaacatttcgtcactttccatttattgaatacataccaggaacttggccaagttagcacacattaatcaatcacaaagcctcaaaaggtatgaactcattattctttatttaccagttaagaaaatgaccactgtactgcttcctattcaatccaacagtataggcaaaatgactaaatacattgtctaaatacatgacttgcacttaaaagctgaagtcaactggtaggtcttttgataccagagcatcttggaagaatggtttgccagctaacaagatgtctttatttcaaaatgcgattcagggtgtgttaggaaggaaaatgcaaatgaaaccttccagtacataccagggctgatgagaaacttgctaattatgcccatgttatctgagtgtttgttttgtatttcactttgtaagattgtcttctctcggtcgttattattttacacctggctgcctacattgatagttttgtcccaattatgtacttctagattgcttataaacaggtcaggatgattcctcactcataaatttgataggcttctgtgtaagctttctatcatagtttcaaagttggtatctgatgtggatggcatttactgccagctggaggcaatagttgctaattgcagagaagtatcaaatgctaaatgtctgaaatgttaaaactctagaaccgagagtatggcagtggctataatgatacctaatgtgactgtgacttttcccctcgttcctgccaaatatgtgggtgtcaatgtaacgtcatgttatacagccttatttggaagacaggggaggtgaaacaatcagttatgctgatgatgttacatggtctaggcaaacagagcacaacagcactttctgcagagatggaaacgttctgtatttgcattattcagtatggaagcaataactacatgtggttcttgagcgcttgaaatgcagctaatgcaaacaaagttaaatatcttgttttaattcagttaaatgtaaattgtcacatgtggtcaactgtagtggacagcaaaagtttgtacaattagaacctcaaaagaataagtcaatcagctggttatttgaactccagaatgccaactagtcttttcacattttttacatttaattatgttttatctgcacaattacctgaacaattatgtaggcatatcttcagattctgaacagcgtcggttaagaaatacacactgtcctgcctttaaagattattacccccttcttgatgaggttctcgctccccacctcccaaccccagcagctcccagtccccttcctttgctttttctagcctatagtgcttttctctgtctgccaacactctatctatggatttattgtctgtgttgccctcatgagaatgatgctccctgagggcagggatttttgtctgcttttcccactgcctaatcccagattcataatgagcacccagtggacgctcagaaaacacttgctgaatgaatgcatgcatgcatgcgtcagcattttcttcccttctcagattgcttagttctgatcttttcctgccactcatggcaagcaaaagagcatcggaagagagcactgtggtccactgagaacctcttcggtttcttcttgttcttttagcagacagatgacgcagcaccgacggatggccagccccagacacaaccttctgaaaacacggaaaacaagtctcagcccaagcggctgcatgtctccaatatccccttcaggttccgggatccggacctcagacaaatgtttggtgtaagtatcacctttcttcccagcagtgcccgctctgggggttccagagacctccctgtctcatgtaagtttggggtatttacaatactaaggttagatgtttgtatggggagaaacaatttagagcctagtctgcaggtatattgtggctagaatctctttatggttttagcatgtatttctgtacatatgctcaccatgtatctactttaccaagtggctttcttctaagaagtaacttgtaggccaaatggaacacaaattcctagatgacccactgttgaaggaagcctattgatggtcctaaatccaatggcccaggacatcatactgcagcaaaaatacacatcgagtcctcttggttttgctttcttttacagttgtcaaatgatccagagggtgactcttagtgtatccctgcattgcctagtctttcccaggcactgtgcatttagatttcagatgcatcagcagagaacaactacttctgcataaagctgattttagcaaacaaaacaaaaccaccaccaccgacaccaaatgagctaccagtttctaagtccatgttgattcctgaagtctacgttcttctgaaatcagtgaaaaggattcagaggtacttactgtggtgctatatgccatgaagtgtagccttgcccaggcaccatggtgaaacacagagcaggccacaagtcaccactgacccaggagaaaataatagcattgctttttttataggtcatcttgcccctgattatttttttctcgaagatatcttcactatccactttgggaagacatgagtttgccatttctttgaccagtgttccaccaaaggacaaagctgtgacagggcttggatatcattcatgtttgcagatgtagccaatttgcccatgacatcccagcaatgatagcaggtgcctctggattcaatgaaaagaactacatccttaacatttgacttagagcaatggtgggcttctcagagactcttcctctaagagttaataaatggatgcaaatatcacaaaaggaacaagaagatgcccaacttgaatgcctcattcctagccaagttggtggtgtctccatataaaatgggaggctcttgttcactactcaaaggcactgtgtgttggggattagcttgcaccttttacttcttatacacacgtgatgcttatcaagtatgcatctgacacaaaagcagagcgagcatcctaatattgaagatacccagctttgaatgctgacatttcagaggaaaaggtcagctcttgcacttttatctctctcatttggtaataaccttgagttgagccttccaactcctgcagaacagagataccctcgggcactttcaggtcaaagatgactttgaaaagtgcagagcattcaaagtgagagtcgaggttaagtgtgtgtgaggcagtaagaccaggtgtgaatgatgggcggtaagaggagttatattctctttgccgtgtcaggttaggaagacatcttgctatgcagtctatttttttctcatcaagtgtcactgtgatgttggctttcaatgtgatccccttaatgaccgtcctgacactctttcatggtgtcactcagttatcgtgaaagttactgcaggctacaatgctaagtcatagaggtattcaaaatattcacaggaatcagagaagggatcctgagtctctctagtcttacagaggtagggtagacggcaaggagcaagatcttgccaaaaaattgtactaccggtcatcagaccttgatccaaatctactagtttcagggctcttgtttttaaaaagacaagttctcactctgctacccaggctagagtgcagtggtgtgatcacggctcactgcaaattcttgggctcaagggatcctcccacctcagcctcccaagtagctgggactacaggcacaagccaccatgcttggctaatttttaagtatttttttttaatagagatggggtctcaatttgttgtccaggctgctcacaaattcctggcctcaagcaaccctcccgccttggcctcccaatgtgctgggattacagcataagatgtgagctattgcacccatccagcacccccccccccccttttttttgtgacaaagtcttagtctgtcacccagactgcagtgaagtggcatgatctcggctcattgcaacctttctcctgggttcaagcgattcttgtgcctcagcttcctgactagctgggactacatgcattcaccacttcactttaaagtcaagattttcaagcaactgacaagatgtcaatttggcaagatgatagatacacttaatacctgtcaattaagagaacacaccatgcatttagtgcacaaactcaaccttgttcatcacaaatagcatctgtgtccctttttttaaaagtatgcaagatttatttgtttctgtaaattttgtctataaaagtgccaggaacatacagattcatagacccccttgcaatgactttcaagcctccttagtttacaaccactattctaaagaaatgcagttttatgcactaaaaatctgttctttcctgccaaacaccggtggtcatggagccgttcttgttataggatacatttagtggcaggaatcacattgtgaagcatctgtaaacattctcattggctccctgcactggagcttagggaatttaggagggtttcctcttttgggtcatagttactgcaagaaactacagtttaactccaattcggtacttctcacgttatttggacatgagacatcttctttccttttggtgctctatcctgtctttgtcttcccactttgacaggggtttacagtgaggacaattacagagaaaaacagtcacaaagatctttgtgcttttccccccctttgtctcttgttaaatataggcatgggatttcaaagtcaaaagcaaaacaagacaaaaaagcaacctccttcttcaaactgcctaaaacttggcagtgatcattacaacgtctgtaaccactaataattcgaccataccatctgcaaccgttacatgcctaatggttactgcagatgactcattttatttctaatttgtatcttcagcacatcatgaagattggaatcctgattaccttttccaccttgtgcttcatattctttactttctactcattggaagcatttgttcccatgtttggcattaaatcttctagctcatctttttttttttttttttctcatttgagatggaacattccttgggcaagatatatggctacagtatacaaagcagaagccatcgtcttttaaaaataccggttgaggttcaagggaatggatctgttctgtgcagtggcattgatattaaatggttcattggaagggatgttagttttataggtggctactttttccttgagctttgtcttcacgttaggtatcatgcatgagcatgcattttctttacagataaatgtttgatgatcccaaaagaggaatatatggatttctaacaaattaattgcgatatattgcaccctaaatagaatgtttaacttaatatttaacatttaaacattctgggtttgaagtgagacaagtggattgtgatatatccagacttctgctacaacagatggatggatgttctggatgccttcacggaattgtcagaaacagttgctcaatgactacagttctcaaatttacacaacacccttgttgattccacagccttactttaggggtcaaaatacagaccctcttggccaggcatgatggtggcttatacctgtaatcccagcactttgggaggccgaggtgggagggttgcttgagttcaagaattttagaccagcctgcgcaacatagggagacccagtttctacaacaataaaatcaaaaaaaaccacaccaaaacaaaatataggtcctctgggcaggaaaatggtccactaaacctctctttattgtcacaaaaaaacagatcacatgactttcagcacatgcaaaggaagatttcaagatcactttttagtcacgagacgggcttgcctgtacttatgacgttaatggaaagttccatctaccatgatgttgtgagtgaagtcattatggggagacagggcatggtaccttctacttctgcattctgaacaggaagctgacactaagaaaaactgggatgatgcctttctttggccttcacgcacaatctttgaactaacctttacttttacgttttatgctgtatccattgaacatccctcacagtttttcagagaaatattgtttgatctgagaacatctaaaaatgcttggtaggtatttgccaaagtgtgtgtgcctgtaagcttctagatcttgtttgttttgttttttaagatagagtctcgctctgtcacccaggctggagtgcaatggcacaatcttggttcactgcaacctccacctcccaggttcaagtgattctcctgcctcagcatcccaagtaactgggattacaggctcctaccaccatgactgggtaatttttacatttttagtagagacagggtttcaccaagttggccatcctggtcccaaactccccaccttgtgatctgcccgcctcagcctcccacagtgctgggattacaggcatgagccaccatgcctggcctggatcctgctcttgatacagctattgagaaactttgtgtggatttgaggcgttgttgaatgcagctgaacattgatgttgagcaaacaaatgctagttatgtctgcgaatgagtcgtgtctatttaaattgaaaatgtgccagctgtgtttacatcattagtagcgaacttcccaattaaactgttgatactataaatatagtacacaactgtcttggaaatggggcttacatcagcattcttctttgggcttgtttcaccggctttgagaaccgtcaacctaacagcaactgccacagaagcaaactttgagaccacttcagggcagctgatgtcattgtttcatttagggaatgacacctgccaagattgctgtttgattggttctgtctcaatcagatcttattttaaaggaaatgtttttgggttgactgcctagagaatgttccatagatgacagttgcatcgcggttttggaagaagtccttttcaagcttctctttctgtaaatatatgtgcttctaggctcttatgcctgaaataaatatgatagcgtctgtggagactgaatattcaagggtggttggtatcaaaattactgcttgaggagttcacaaaactggaggtttctttactatgaaattcagctcacgtttgaatggcaaatccttcatttccccaatctgaatgttttcttctatttccagtgatttttctctgcctaaaactagggcactgaaaatgctctgtaaaggaatattctcttgaccaaaagatctaagtccacagattgcaggatgagtaagctgcacgtttgttggcgtttccattgtgcatgcaagcaatgtgacccctttccatgttctcttctgagtattttctctttggtttcttcctatcctttgcttctctgaacagaagtgctggtagttctttgtttcacaacttgaaatatgtgcgtctgtgattcccccggctgtatagtgtatgggtcctgaggaacgggcacatttctatggcacagaatgacaaacttttggttactttgtcccatagtcagaactatttttatttcaagattgggctgtctgtattcaagtggcatatacatttgtttctactgtttctgggagggtggatttctttgtccattccagaggatagctatctgtatgttctaaataatttgtttcttgaatgttagtaggaccctcttgacattcactctctgtgtctctggatactctatgactgaaacacatagtcaggcaaacctcccctgcttcttgtgtggtctttttgtttgttccttttttatcctgccccacccctcaccccagtcgctctgtccgctgccacacagaagcacgcgtaatgctctccactcaagggagagatggaatacaaaacctctgggggtcataaaggatgcaattaaaatccagaatgcagaagtgaatggaatgataggaaagctcaaaacaaaacaaaaaaagaggatggaaatatttatgttgccctgtttaatttttaatcactcaaagagcatttgctctcattctgcatggagataaaattcccattttatttttccctgggccacagtacatgattttacattaccctctctctcagttgctcgtacttatgcaggttaggctactgtactcaagaaatggccacaatacttcatgtgatctcagaaaactgaaaaaattccaaggttgggggaaaggatttcagatgatccgatgcccctagttctagagcccatacttcctgttttgaaacgtgatcaagaattgcttgatgtacatttctcactgggacttccagatttcacaaatttaaaaaatatgtaagacacagtcgttgaatttgaagttcaaataaaccacaagtattaagtataagtatgtcccaaatgttgtgtgtgacatatcctgaaaaatctgaaatttaaatttaaccaagtgtctgcattttatttgtctctatttataatctgagtctctgtttctggacttttcatagagcctattcatgctagttgtctaaaatctatttgtttaacaatgtggagaattatcttgagagaatttcagcccaagcactgatcacaactgctgataccatcatgatgatagtgcctagatagtggagtttgcttctgtgtttgtactttcttgctcatatgatagagctgctcctagattttatgtgagctaggagccaaccccagtcacatcacattctcactggacattgattatcaaaatcacatttcatcaagggtgtttctcccagtgtttagtgggatagaccagaaggatcattgtatgtacatactagccacttttaatctttgctgctcagtgcctgggaaagcagacatgcacacaggaaaaaaagaaaaatagaattaacctcttgattaatattttgtatcaagccttgccggtatattccataataaggagaaaatatgggtggttttattttctcttgtttcaagcacattaaccataaaacataaaatgtgtatccttggtattaaaagagaaaaaaatggacgtgggaaacaattactactgtacatagtaatgtctactgcatttctcttcttgcttataagatatttctatttctttgcagcaatttggtaaaatcttagatgttgaaattatttttaatgagcgaggctcaaaggtaagcaacttaattcactttagaattgtttagtttatttttaaatgtttgttatgaataaggggaaacaactgcactgtcttaatcagctcattgtgaaaatacacttcagtgggaattcctttagagaccaccttccgttttcaaaatggtgggaaagacatcgggttcagtttaaaatgtataaggggataattttaaattgctgttttatatatatatcaagtttccagaggaaaattatacatgcttaaaaaaataatgatgttgctacatttttgtttttcagtgataattatgttctttatattaaaaagtgagttgatagtctcatgagcaggtaaatatgtgattattctgtattaataaagtgcagttattttcctgggttgtaggggagaaaaatctcatatacaccaaccttttgaatgtaattttattctttagtatgtttaccgatccacatttagcaatttgccattgctttgagtttgttttttcaaggaaaccaatttttaaatagattccctagtgctaataaaagtcaggggctctatggagaggtttgggttcaggagaggttctgtttcaaaacagaaatatgggctgggtgcagtggctcacgcctgtaatcccagcactttgaggtgggtggatcacctgaggtcaggagctcaagagcaacctgggcaacatggtggaacctcgtctttactaaaaatacaaaaattagctgggtgtggtggcatgtgcctgtaattccagctactcgggaggctgaggcaggagaatcgcttgcacccaggaggtagtagttgcagtgagctgagattgcaccactgcaccacagcctcggtgaacagagcaagatcctatctcaaaaataagcaaataaacaaaagaaatatgttgggagaagagaaaaacagaaacatttctaaaacctcctctctatcagtggctaaccaagggtggtcccagaccaggaatatcagcatcacctaggaactgattagaaatgcaagttctcaggctccagccctgatctgttgaattcaaaactcccaagttagggctcagcaacctgtgttttagctccactgaggaaaacaacacatgaggcctataagcagacacagggggttaacagggagaatgatggagaacaaagatgtggatcttggtaaccagaaagtgaatgctttcaatagctctgacgggtctcctggctgccagtccccaggctattaggaattttaagttcccttctccttgcatcctcagactatgaatgcaaatgttgagagatagtgatttcagcccattgactctccttacacaggcgatttgaggcaagtcggtatcacggagggtcagtaagcggtgctggttttatttgaagtgtcacaggccacattgccagctcttttggatgtgtataaccatctttcccccataaaacaaacctttgatttttttttctttattccttggacagccttcctccctcctaagtaaatttagtactaattaactaggatgatgttgatcatatcaaggaaagaaaaccccagtattttctcctccatggccagagtgatgttgtaatctgtcagatgagcaaaaacaaaagcaaaacagaatcccttacactttgtgataatactccttcagggaccttgtcatttttccatagctccagatattttacaatcgttctcgaacttaagtctcttcctgcttcttgtaggaaagttattacggggactattgctatacctgcaaagcaaagtgcattgagagaaaaatgtgcccagcctaattctgttcactcgagccttctgtattcttggcgaaattgtagatgacccgaatgttgaccaacttcgttctgaccctaggtctgtctatagcagcactgccttcaaagatgtgttgttgttgttgttttttaatatgtttaatttatattttgttttgtaacttttgccagttacaatgaagaaagctgtttaattccttctgagagctgttttgggacattagaagaatatcatttgccattttgaaagtacaatggtgatactgtttttaagacatcttccgtcattcccatgattagcctgtctctgggggcttcaggaaaaagaccatttaagtttgctgcatccagagcctgactttgtgaagctgcctttttttggtctttattcttttggtttaggaaacatccaaaatagcctctctcggtgggtatgcgccctctgaaagagcttgtcttgcaggtgttggagctgactgtttaggtactgctggaatggcactgagacagtccagttgggactgctaaatgggggcagcagctcacacagggatatttttcatagttgacattatcctttatgggaaagggccttatttagaggagcatttccattttaatggttcagaaacctgaactgttgctatggcctcattttcatcgtttggtgctggacagacagccaggaaatgagtgggcccttacgagccaggaactcaccttcttgcctttcattctctagagcagttcttcaggcaggccactcaatgctgaaggctgtgtgtgctgggtgtgtgtgtgtgtgtgtgtgtgtgtgtgtgtgtgtgtgtatgcggacatataaacccatatgtacttaagggatggacgcagtgtctcatacctaacattctagccctttaggaagctgaggtgggagtattgtatgaagccaggagttcaagaccagcctggacaacagtgagaccccatctccacaaaataataatttaaaattagctgggcatggtgatatacacctgtagtccaagctacttgggaggctgaggcaggaggattgcttgatcccaggaggtcaaggctttactgagctatgattgcaccactgcattccagcttgggtgacagagtgagtccttatctcagaacaagtatctatattactttggaatatagatccagtatctatattccaggtagtatctatattattttggaaatgtatataactcaagtatttaatgtatgggtgaatagcaagaatgcagaaaatccacattttaaagagatgtcagagagaaaatgagaattcgtaagcatttaggggcgaatgatcctgtaatttatttttcctttttacgagatttacccaaccatctcgtttacctctgatatggtctatttaagggctgtatgcagatatagctactccctacgtatatacttaagatatctggccgtgtgcggtggctcactcttgtaatcccagcactttgggaggccgaggcaggcggatcacctgaggtcaggagttcgagaccagcctgaccaacatggagaaaccttgtcttgactaaaaatacaaaattagcagggtgtggtggtgcatgcctgtaatcccagctactcgggaggctgaggcaggagaatcacttgaacccggggggtggagattgcagtgagccgagatcaagacattgcattccagcctgggcaagaagagggaagttctgtctctaagaaaaaaaaaaaaaaaaaaaaagctacactttgatctttgattcagtagatatcagtaagtatttgctgcatttcatgagagccaaccatgagtaagacagaagtacttcctgtcctcctgggctttcctgagtagcaggagagatggactaggaagatgagtgactgcagtagcctgtgctgttctgcggtgatgggagaggccactgagagtccggacaggcaggctgatattgtgagaaggcttctggaaagaaggaacatttaagctgagagtgagagttgcgtaagaatttcccagggaggggaaagagggatgtgtctcaggcaggagaagttgcatgtgcaaagatcactggagtaaaagtgagatgagagggctcatagtcccatcggaaaatgaatcttcagatgctcatcaacagctcccctcttctaaatatgaattctctgcaccagaaactagaggactggatttttcatctaggatgaaaaatcagtaccttcatccatccagggtgctttatttaagtctttaacatataaaatggtgtatttgcatgaatgcaaaaaaggaagatatcacctaaaaatacaaaagatgaaaaaagaacaataactaggatacaagaggatcagaatgtatgatttgcgaaaatattttaaagtaagcaagtcacgttggtctggcaatcctcttaaggtccccgttatctgccctactgattatacctgctcatgacagggcacaggccaccaatctcttttcttcagtagcattaaaggtaaactctgggaaggtgtgtctctgactccccttctctgtaccccttcttgcggtcttgattttttaagcagttacacatcagcatcacacccagccctttgccgagcaagccaagctcagaatgtgcttgttttgttctcctttttaaggcagaggtaaaaatattcatcatctttttaaaaactgcaaattgctgcttccctgagttagaattccgaccatgaggcgggtcagaaaaaacaaccttagcacccgctctcaaggttgcctggcacctgtgcatcgtggcaaaggttccctgctcatagagaggaccaggtgaggtctttctggttacattgcaaccctcaggtgagaattttgataacctgataacccagggaggccatgccacttcttgtctgggtgggaggtagaattgcccaacggaacaggtaggaaagtctgtctggcattttgaggaccgtctggagcacattctttctgcaccgaactttgtcaaatctcaactctaaatgaggaataccaagtagctgacaagcaaagagagaaagaagtttcgcagaaaaacaatgagaataataaaaaagaatgtattctctttgcttaaaaagtgagaacttgagaatagatgaggctatttcctttttagttcatgccccttccttgggattcaaaatgtatttctctttccacctttgtctttcctaaacatacttaatgctgatttcggggcagtaggtttgccttgggttcagacatgaagcatgagagcaaggttctggagtataatgttggacaggagggtgagtgttcagtctcacctggctgtgttcttcccagtgctgtggtaataatgactgctagttccaaagggcagaaatgataccacctggccctccagctataccagtggggctatggattttcttttcttgccgggagagaatataaatccaaagccctcgtttctctgattctttttggaatatgtggcatggctatggttgctaggaagttaggcccatcagggaggaagagaacgttgccaagaagcctgggacatgtgcttttggctgtacctctacatgtaagctccaagtaactgagtcaaaatctatagccaaaaatctatagatatcagcaatataaaattctatttattacaaaggatgaaaacctctttttcagatagggtgtcacccaggctggagtacaggggtacaatcacagctcactgtagcctcaacctcctgggctcaagcaatgaatgctcccacctcagcctcccaagtagcagagacaataggtacaggctgtcacacctggctttttttttttttttggtagaggtgaggttttgccatgttactcagcctggtctcaaactcctgggctcaagtgatcctcctgccttggcctcccaaactgcttgcattacaggtgtgagccaccatgcctggcccaaaaccttcttttgatggtttcgatcacacgtagtgaaatgagaggtcatggaaatcaaatcactgggccacacattttaagcaaacacatttctggactccagtctgggattctaatccagtggatacaaagcaaggctcaggaatcttaatgtttaatgtcctcccaagttccttctgatatgcggctaagtttgagatatactggccaagagttagaactgtcaaatagagcaaaatccccctaaattctctcttttttccctttgaagaacaatcatttccaaactatacagttggcgagtgtatttgcatacccaatatgggcatactttgtgcacaagactaagcaagacccttctgttatggagcaaataatcttaaatgaatcagataattcaggcttatcctaatcacagagcctcactatgggaaagattatggaaggtaatttggttcaatcccctaaagtaaagaaacgttatttttctcgatacagttcacccttgaacaacacaggtttgaactgtgcaggtccacttacatgtgaattttttttttttccaaccaaaggcagtattcccaggatgtgtggcctgtatatatagagggctgattttcttctatactcacattccacggggtgactgtgggacttggaaatgcaaggatttgggtatcaggggtggggatgtcttggaactaatctgtagtggattctgaggtacagctgtctatagaatcccgacaaataatcatctaccctcacttgaatacatccacatcccctgtcttctgtggctgatgagcctattccgactgttgaaaagttccgttagccagcccattgcacaatactttttttgttgttttattatactttaagttctagggtacaggtgcacactgtgcaggtttgttacataggtatacgtgtgccatattggtttgctgcacccatcaactagtcatttacattaggtatttctcctaacgctatccctcccccagccccccaccccgtgacaggccctggtgtgtgatgttccccgccctgtggtcaatacctctttagccttaaatttggaggtgattatagagaactaatgtaggactgggagttatcaccagttggttataactaccatgtatttgtaattattgtgcatttctttagtaaaactaagtattatactgtcccaactcaacttggagccaacaaggattatttgatgctaagaggagccccaacatattgcatgatttcacccagtttacagtgaaaaatctgaaagagctgggtaaatttatgtggaaattgttcgaaaggttggtgtatatttctgaacaagatgtacaaatatttttaggggctttaaaaataatgtgtcgtattttctgtacttaggaacaatgtcagtgaagacaaaatacggattttgacaatatagtttagtggggttgatttttgaggctgaaatattaaaagccaatgtacctgtggtaaattaaaaggtatatatgttatctatcagtaaaagaggaagtggccagaatattattacaaattacattctattaacaaagtttctttgctacctgttgatatgaaaaataaatattgacctaatgccagaactttacaatatgggtacacctttccctttctggttaacaaagtaggatggaaggttgtcaaattcaaaagcgtgtatgcaatttgaagagtggggaaagtatgagcacaaacattgaattgtttgtattattaatcaactgaagtttatttctgttcatttcatgtgacttttttgtttattagaccaaagagtttaagatttattataaaaaaggtctttccttttttaggcttttaagttttatttttgagaagtaaaggctgtagaactgacaaatttgaataaccctaaaactgcatgaagaagagatgttcttaaaaccacacggcatgactctgtaggcaatgttagaggattttggcattcattgttgaatttcgtgcacacgttttattttattttatttttaatttgcatgtcaaaaaagtggttcccttttcttttcctcattatttcattttattctctgtgaagacactgtaaatttattttgatctcattttcttttcgttagatttattttcttctgtagtgacatttagaaaggtatttttggtatccttctttgaatacttcaggggttacagctaactggtgacagaaaaaaatatcttgttcacatttgtcgcttaattattgcacatctcagtactcttataatttctctaatttgcatgttacagaactgaagccaggacaagaaatagaaattaaagcgagagaacattaccaagtggtcgttgactgaaataataatctgcatgttgttttcccttctccctcctgcatgcagggatttggtttcgtaactttcgaaaatagtgccgatgcggacagggcgagggagaaattacacggcaccgtggtagagggccgtaaaatcgaggtgcatgttcaaaatattttccttttcatcttttttataaatgtctgcttcacgctcattcgttgttccagatgcatcattggcgtcttgtatgtgaccctattccccctcattgtttatatatatatatatatttttatatataaaaaggaaaactggccttacttttttttttaattttactttattatgttactcttataccgctgaaaggtggatggcaaacgtgagacaaaagaaaggttaatcggaaagtgtttttttgttgttattttccatgttttataatcaatgggtgcagtaggttccaaagaatagacagtattgcaaaccaaacaaaatacagaacagtttctttttctttttctttccacttcagggttgaagagggatccacagtggttggcaaattaaaccaaattgggaaagcaaaaaagattgtttttttgtttgtttttttttgtttgtttgtttgttttttgtggaaaaaaaaacaaaaaaaaaaacgagaggtttttactaaacctctcgtttttttttttttaagaagccagtttgaatttctgtattcttttgataacaaagtgaataaccaaacaggatttcctgttcaatatctggcccctgttcactgaaagcataaataccaaaatactgacattcagagtctgctatttgtcccactgggatctcccgcaacatagccacagggtcatatttgttaattttttttttaataccagttacaaatgctttagtctttggagtaagatgttgcatattttgcctttcattttccccttcgacgataacgcttaggcccctcaccaaactctcagtaaccatggtaactgtatacaaacccatgctggcgatggtggtgaatggtaagtggtgaagtccatctgccgtttcacgtatttagtgctgatatatctatatacatatatatatataccacgtgaatttttttgacttgtcgtattaagttttcttgatgctctatttttttggatattggtacgcctgtaattgagtgtacgttctaagctagcctgggaggcactgactggattgagttatgaccggtgcacatcttactcagattgttaaccccatattgtgttaaacaatgcaccctctcttttatccttttgttagctgtgacgttaaagcttgaatgattttgttaattcttgcgatgtaaaaggctcttgttccaagtgttgaatgctagatgttgctttcctgatggttctttcctcctaaagtgttgcacacggctaagacttgtttgtccctttttttgacatttatgttcccttgtaccttgtctcttctctcttctccactgcatgctccttcatatgaattttattttatgtttaaaaaatatttcttgtttctgtgttaccatggagtacacgcatgcttttaaatcttcaattatgcagaatcttttaatttgcttttactgtccctttattaaacactcttaatgatatgacattgctttattgaaatgatttgtaagttaaacggttatgaagtaaatgtaattttaaaaatgtatgattttgttatgcacctactgccttttataaattaaaatgcattttactttttagttttcttttttaataagtaatcacggtcataatgcatgcaactaattgaattgggagctggccctagaatatgtgcttacttgagttttctatgtacataggtaaataatgccacagcacgtgtaatgacaaataaaaagaccgtcaacccttatacaaatggtaagtagagattggccttttacaagaaattctctctacttctgactctttaagtaatttaaccagagattctattacaacaagctgtgtttgcctgggcattgacactgtgtttttactactgacctgctacagtgaaccacctacatcaataagatcattttcacaacaaaggcaaatggagtgttcaggttaagtgtgcctgcccttcttcccttctttctagaataactctgtttgggattgagatgcactaattatttggaaattagtttgctaatttcattggttattacagtaagttgaggggagaattggaggtttagtttgtttgcttttcaataccatctgctcgttgattactaatcattcctggacgtgcagtcacgtaatttattctgtctttgagtcttctccagagagattagtcatttgaagtggtttagagtatacctcatgtctgaattccacagggttagcagaatgtgtgagtgggttatttgttcttctctgggctgctcagtgttattttgggctagttgagaatgttgctttgtattacagaccccatcaggacaatgcaatttctgtttttatcaataaaacttctgaaaactcctcctaaaaagcattcacatatgagttattaaaaatgtttgaacattttgattctttaattcctctcaaaataagtatctcttaagatatatggggaagaaacctgccactgtgttaatcacatacttaattgtaccaaaaattaaagcaatgcagtaagttaaagtatatacacatggtagaatattatacccattaaaatgagcaggataaggatcataaagggtctcataattaaaaaattgacataaatgtttgtcgcataactttagataaatgatgataatatgccagaatgctaatggttgtgctgaattgtgagactggcaaacattttttctttgattcaggttcataaaaataatataactttattacatcaaaaggagatatatggaattttatacttctaaaattttaattgcacatggagatacggattttttaaagtaaaaaaaaaattaaaagaaacgttaaagacaagtctaaaatatattttaaataaccccattgccaccctggtttcctacctcccccctcacaggaagccgctattacagattgttgtctatagttttattttgcgtattcatgcctatatatgtagtaggtgttcatttatagtattcatagtgttgtatacatttttatgtgaatgatataaggatacacctggcatttttaattgggttttttaataaatctatatagagttcctttaatttaatatatacagattagactaattcatttcagtggttatgtaatattacacaaaacagataaataggttcagtcagaactaaatactgattgtttatcacaataaaagaaaacaatgatctagcaatgtattatcatttggtagttttgattttcctgtttcttttgccagtgactaccaatttgacagtcagtttgctcttaattttaaaaggggcatcattcaacagggacataccgtctatataatagggctctaagttgaaagaccagaagaattacctattctgctatttttctcagctttgtcaaccaagacatgcccttaaatggtatagactattttcacaccagactttaaatgcccagtgctgaactgaagcaaacctctgatttatatgtcatacagcctttccagttgggtaaaagtaatgactctgaaacttgccagatttcatatatggtgacatcaacctgacggttgggcatagtctttaattatgaagttgcactggtgcccaggcacatgtgtgcttgtctacatatgactagctgctcatgtgtgctgagtgagaaactggagcgagaaaagccaaatatttcataagccatgtgcatgtatatttattttaaaagagttattgatcaattttatgaccagggactgaaaactagacctgtaggattttttaacacaattcaaagcccatttataaataactagcctttctggaatatgaggtatgcattatgtgaggcattttaagtgcactggacacaaatgaagtcctataaagaggacatcattatccctattttagaggtgcaacattgaggctagagaagatgaagaaattaataaagacttttttttttttcttttttttttttgagacagggtctcactttttcacccaggctggagggcagtggcatgctattggctcattgcaccctctgcctcccaggctcaagcaatcctccctggtagctgggactacagccacatgccacaatgcctggctagtttttttttttattttttgtagagacggagtttcaccaagttgcccaggctggtctcgaactcctgagctcaagtgatgtgcctgtcttggcctccaaaaatgctaagattacaggcatgagccaccacttctggcctagccttttctttttgttatgaagtaacaaaatcttgtgaccatgcctgtgtgtatcaggcatcgctttccctttgtcttcttgtagaaatgcactcaagtggcaaccaactacaataacaaaaaaattattaaatgtgcaacctcgtgttcctgccagattttggcatgcacatcccatgtcccattccaggtagccatgcactcagtttccaggaataagtcagtcatatgggtctgtcatccacgtacctgcaaaagggaactcagagaattgttcctgtcacacatactgtgtatggcacctaaggggttgatggatagacacagtagaatttatttaaaacacaaatgtcaattctaattatataaagactttggcttctgtagtggagattatggagaactttggtgttcaaagaaaagtagttctccaagctatcccaagtttcaactcaggagtatcaccactacagataaattcccttaagtggcaatacaatataactgaaaaaatatagggccctttcatatccttaataagcaagacgatagagttatggcaaaagagggtaagtcgggaccaataaagtcacattgaaatgagaaaattaagccatcggtgaggttcactcattagctacataattcattctcacaaagcatagaaattgtacttcagcaaaattataaattactggagctatcaaagtttcaggtcatctccaggtgatgaaatatagttatcaatgccagcatcaccttcatgcattacttcaatcatgtatccagaaaaacttttagcagctgcaaagtttccagtgataaataagactgaattctaaatgtgatgagatacctgtccattatagagggttacagttaataacatggagggtgtagatactattctcaggatatttaaacaatgacataatgaaaagctgtagaatgagccgtaggcttctggacattctattaaaaagttccacaaagaggggattggactatttctctattgctatttctctgaaggacacctacccacacggaggagttggggtttgctgtgttctttggggatcaaatgttggatctgcaatacaagattgagagctgaattcacaaggatttcctggatgctggggaagcatgggtgctagacatggctttttcattttcttagagatgttaggaaggatgaaaatggggcaaacatattcagcgctccagagagaggcatactttgttgcccggatcagttcttccattcactggctcttgaattgtaggaagttgtttaaactctccatgtgccagctctctagtgggaactgtacaaatgatgggaactacatcacagttctttgtgataattatgagagaaagtgctcaacacaatgctaggtatgcaaagtggcctaaaagattatttttactactatttatagcgcagtagtatttgattacacatagtttcaatattaagtcatcatattattcctttattgtcatgggtagttgaattccctgagagatactagtttaaggatcaattcttcagatgctaaaaggggctgaacaggtaaaatcagcaaacagacagtctttgaaaaactcagtcttttgggactagctattgttttcttactgaagtaaagcaaaatatttatctacgaggaaaaatcaacaccaccaccaccaccaccacgaattaacaataaaagatctcaaacatttaatctccctatcagtctcacaatggggagcagtggtaaatgtgactaagtggggagttgaatgcagtagcccttgaccacctctaataagtctgtctgtgaggcattctcaacttaaagttaccatttctaccgatgtttcaagagaaatagaaatcctgtattttagacggaatttaaattttggcaataaatacacgccgttaaagaatattcagtgaacccaaacaaaacacctttgtacccagtgcgaacctcacttctttttgtttggtatttgagagttgccacctgtaccatgtcagctgccaggtctctgacatccttagtatatgtctttagaaagcattgacaggcagtttttgtaattcctgtagcgtacataagggtgctctctggaatgcgtttctttgatatgtaacccagcaaagccttaagagaaagcctgtgctgatgttttttgtgtacacattcagacttggccttttaacacccaatgcagtcatagttaacactggaggtcttaaccagcatattttagaaatactgacacttgacctttgacaagctaaatttggggaggggagtgcaaattcagatgtggccccttgagtcctggccacggaggggtctaaactgcttgcgtatctgatacagagccagaccccaagacgtctgttctctggctccattgccttgttgtggggctgggggggccctgggaggctgggaccagtgggccttatcagccattctccttttgttgtaagcctcattgttcagtttaatgtccttgatcaaaatctctgaatttgcaaggcctggggacatacacaaactgcctaagaaattaaaaaggggatcattttgttcatcttcctgacagtgcaggctcttatctccagcagggttatcccaagggtctctttcaggtacgaggaggagtcacagggaatgtgggttcatttgcatgtgatttgcatatatttacataagcccgcatgagctctgtaagtctgagtggaggcgattttcaagggctggattctagaccaaatggacataacagacatttacagaataccttttccaacagctgcagaatacatcatctactcatcaacacacggaacattgtccaggataagccacatgtcaggccaccaaacaagtctcaacaaatttttaaaaaatctaaactatatcaagtattttcttagaccataatagaataaaactagaaatgaatagcaagaggaacttcagaaactgtacaaatacatggaaattcaacagtgtgctcctgaatgtccattgggtcagtgaaggaattttaaaaattcttgacataaattaaaatggaaacacggcatgccaaagtctatgggatacagcaaaagcagtgctaatcaaaaagtgtatagtaataaacgcctacatcaaaaaagtaatttcaactaagcaaccgggacaacagtcatccctaacacgattcttctttatttaatgtagagtctatggaaggaagcaggtccttgaagattggaaggagacataatcagagccaaaaaaaaatttgtctattaggaaaaactatattcctttagtttctttagagaaaaaccaagtaaatatttatggaatgcttactttgccaaacaacattttaggtgctggagattcatgttggacagcagtcttgcctgcttgactgttaattttaatgagggagaatggttataaaagacaagagcaagcaaagaaagaaagaagctaaatccagatagcattaacggcaatgcagaaaataaaactgggaatggaatcatggaatccaagagtaactctaagaggaggtgggaaagtgacattaactggcatgttctgaaaagactccagagccctaaataacatgaagtcgactttgtgaaaagctagagagttctccaagaagaaggagaagtggatacaaagagactttgatatacggtggtcttggggggttttataaagatgaaaatggccagtgtcactgtagctgggagagacggggaaagggaaaaagggaagtggtaccaaagaggtaccaaatagtttggttaatggttagtgtgtgctgattgactaaggtaagacatgtgtgcttatctcaaattgggaagaagctattgaattctgagtatcaggatgacaaagctgatgttttttttaaaaaaattgctttggtcaccatgaccagaatggacagggggaaggaggaggaagaggagacagtgagaattagggcatttctgctgttgaacttgtccaggcagagataggaatgccttggtctgcagtggtggcaatggagaagaagggaaggacttttcaagttttaaccaacaggattttctaatggatcacacatggggtatgagggtaagagaagaatcaaggaagtgttgatgaattttattttgagcaaccaagtagatagatatgccatttgctaaagggagaaggacttgctgagtaacaggtttcatgagtggggggagaagagggagactagaaattgggttttcattcccatcgcagagttcagaaaggtctttggtctccaacagtgggagtggagtagccttgtttagaagggatcaaggatgggaagaaggttgacacctgcactcatgttcccatgatgacccaagcatttcattttgcagcacacagattcccagctggtttcttgtagaggagactttatcaattacctttctcacgattaatacttgcaaacatgagatagcacagatctcctgatgaaggagagtatcatttattttctttatttttttatgaagagattgccatgtgcagacttggcaaactcataacttgcagaaagatggggaaataaacagcagattatagggggatagacagattatagatacgtttatagatagatcagtagatagatggataggtgggtaggcagatgagataaacatgatttctaggtagcctcaaatgcctctgagagatctggaattttttgctttgttcttagaaaatgagagatcattggcaaatttataatctttaagagctacaccaaaattcactgataagtataccttcagtgaaaaggaaaaggaagtcttatatgcaaaagaaagtatttaaggtagtaaggatattcaagaaacaagacctgagatgcacagtatgggaaagacaccatctccactaccaataagaggtaggagcatcagtagagtatgagatgggtaacagtggaaagatgaagagtgatcacttaataattattcatttaatatgaccccatatagagtttacaaattctaggtttctgtgaaaaactagaaagaaagaacattaaatatgtctgcagctttattttcaactagttttttgtactttttcttagactccaagttgaaatgtagatattaattcccatatcctcaggaattagacttttttttaaaaaaaggaagcagtggaatttcagttgatcaaattgaagtcatttccatactcataaaacacattctgaaatgtctgaactaatatttatttttacgtcactatagaaattcttataaggcaagatgtgattaatacaagagaagagggtgtcagtatgaaatttcagaaaccgctagggcagtaggtctcagaatttcatgtttctttctgtcactctaaaaagggggcccaggaattaaatatgcctcccaggtaatagaagtataacactttgagaatctctattctgagatcatcccgggggctgtaaaccacctagcttcttcaggttggaactgaaagttcttagaaaacattcttatcaagttttagaaagttctggatttcgatagacatactggcctgtctgttgagttagtgagcctctgttttccttagtggatgttaagaacacctctgggctattcttagttcgggcagaaaatcacacctctctcttctcggcaaacctcagaaagttcttactgtcaaaaataccttccttcacattcaaactttaatcattgccttctctcaaaaacatttattaaaggacctttggtatttggccttctgctcaaggactcagagcaaaggactacacaccttaccctcctctgtctttcaaggttttttttacttcttgagacagagtctcactctgtcacctaggctggagtacagtggcaccatcttggctcactgcaacctctgactcccagcttcaagcgattctcatgcctcagcctgattagttgttactactttgtatttttagtagagtcaaggtttcgccatgctggacaggctgctctctggaaactcccaacctcaagtaacctgcctgccttggcctctcaaagtggtaggattacaggcatgagccacggtgcccgacctgcatggattttttttttttttttttttcccgagagagtctcacactgtcacctgggctggagtgcaatggcgtgatctcagctcactgcaacctctgcctcccaggttcaggtgattctcctgcctcggactcccaagtagctgggattacaggtgcccactatgatgcctggctaattttttgtatttttagtagagatggggtttcactatgttggccaggctggtctcaaactcctgacctcgtgatctccctgccttggcctcccaaagtgttgggactacaggcatgagccacttcacccagcccgcacggatgcttttatgaagacttagccagcaggagcaggaaacaataacaaaaccctaaaacgtgatcagtctctggaaattgttcccctaaataatgcccagcatatatgtaatgtgctttccaatttgagaatattcttgtatgctctttttttgtgagtaaagatttctaaagggtcaggattcattttacaaaaaactctccatccagaacatttggaaaattacaggattccattaatcatatatacagattatttgaaagttaccttagatatcatacattgattaagaattttttacagttcctgaatgcatcaaaatgtaggccacagtaaatctctaggggataaaatatcattttctttggtttttatgaagcactttggaattctctagtatctcgaggttataatttggaatgacaattgttagaatatattgctgccaagaattttgtttatgcaagctttctaatttttgtgaacttaatgcagaggggtgtgatggattatctagcagtgatatataaaataagaaaaaattaaaattattatagtagttctaaaaaatattgatggagtagaaaattaattaccatgtcattttcaaagggttcacttgtggctggtcagtagtttccattccattaacttgcactggcagaaaatcaaagaagggcataaatatattttcttatgtgtggtttttaagtatttttatgcatgcccaaacgacacctcctttacattttaaaatacaaaatgagatactttaacccatttgatttgtgattcatttgcaattatataagatgttgaatcaaatgtgataataatgtttttgtgtatttgttttaaggctggaaattgaatccagttgtgggtgcagtctacagtcccgaattctatgcaggtacagagtttctctttgcacgaagtcttctcagtcttttctaaatgtgctttgcctgccaagaatgaatgagttttgtaaaataacctgaagcaagtgaattcctatcctaacaagttctgaatgatttctttgggcaaaatcaagagtgcttaaaacagtttaaaaattacaagggaatcgtctaagtttcatggttgggggatcagcgtggagccactgctccttaggacaattcacattgattttgccctaaaaaaagcattgtgactttgttcaatagtgtattgaacaaatggagagctgctcacacccattgtatttcaatgtgcctgaatgtgtgttttagccatacatttccatttggggttggcattttctttttcctggcaaagcagagagtcgagttggcttaattattccaataatgtgggagtgatttagaattgccaagggaaggcctttttcgataactaaaaagttgtccgtcttcgttcattaatcaaattcccttagcaattccttttctctctactttgccttccagaatatgtctctctcctcaccccttccctgcctaagcaccaattacctctcagctgggaaatccattctcttagaaattttgggagagcataacccagaagcagtagtggctgagatttcatgtctcgatgtcctcggcttggcccgtcactactgcctgtatgtctccttgctcttgaacaaggctgcattgaatacctaggaccttagtaggtttgccacatggctatttaaaagaagtctttctttgatgtggctcttgctttttaataaggagaaataaataatccgttgacctagagccactcccttagtaacctcttgacggtaagtcataccccttgctttgtttcttcctgggctgcctaacttttgtcattttcctaatactgaacactgacccttgtagatgagaaaggaacacagaaaacttagctactctggcacaacaaccagtctgacaaaatttaagttaaaaatctggtaaatctggaaaggctcaacaggataactgattcctggattttacgtaggcgatgtttggagttgttcttcatgtatgagttttaccgggagcctgggttaagtccagggattctaacactgcaaaatagctgtgttcactcttgtgggggaagagacttagccgtcaggctttccatgatcatattgcaaaccctaccacctgagaagacacctctgctgagtaaggaacatggaaaccatgcctacacagctcgggttcaaattctgcctcccctactcaccagcagtgtgactctgggcaagttacttaacctctctgtgcctcagtttcctcatctattaaatggagatgatagtaacaaactcatagtaatttattagaattaaatgggttaatatatgaagagtggtgtgtagccagcaccgtgtaaacatttagtaaacaaaaatgaatatgttaatctctttaccaggaaggcaaagttagctgcatattctgctgaattttgagtatgctatgagacaaagagattctttccttcattgatgagagtactagtccttcagttctcagtgtgttcatttagggggtgttaatttctgggatcgggggcatggcagtttattcaggggacacacagaacatggcatgtattgctgggatgcatctttgtgcaaagctgcaaggaaatcaaatactccaaatggttgaaaagtcagacaacagcttccatgtgtccgcagcaggcactgcccatgaatggagtagttagactaaagaaatgtcagtttctcctatatgcacatatctgagtgcatattttcagcctaaaatagtccagtgaagaacaagaagccttcttgtggggaggaagggtatggatgtgagtgttgtggtggagagggcaaaatgcatttttacatttttctggtcctgtgcgatggagttgccagtcacccttgggtctattaagcaggaaaatacctaatatccccgttacttgtgctttcgtagccacagacatatctgtgggtgttgaggaggacattaagatgagagaaacagttaagactgatttgtaactataagaataaattcatctgcatgacttctagaacattagagcagctattcagattagcccagggcccaggttcagaagttagatcattaagttagaggaaaagaaaatgttataatgtaagttaatatttactggatactttctatgggccagcactgttctaagcactgtacataagtttaatgtatttaatgctcatggcgattttccaaatgaggataccaaaatgcaaaaagttggtattactgctctgagatttcagctggtcaggaggaggccagattttgaaatcaggctttgatcatctcagaaatcgtgttctttacaaccagttgatactggtggggttttgtttgtttgtttgtttgtttgtttgttttgagatggagttttgctctgtctcccaggctggagtgcagtggcgcggtctcagttcactgcaagctctgcctcccgggttcaagtgattctcctgcctcagcctcctgagtagctgggactacaggtatccgccaccatgcccggctaatttttgtatttttagtggagatggggtttcaccctgttagccaggatggtctccatctcctgacctcatgatccgccctcctcggcctcctgaagtgctgggattacaggtgtgagccactgcgcccggccccctttttttttttttttttttttgaggcagttttgctctgttgcccaggctggagtgcagtggcatgatctcgactctctgcaacctccgcctcccgggttcatgcaattcttctgccttagcctctcgagtagatgggattacaggcgtccaccaccatgcccggatcatttttgtatttttttgtagagacagggttttgccgtgttggctaggctggtcttgaacttctgacctcaagtgatgcgcccagcctgtttatttatttttttttttaatattaaaggtcatgattccaatcgactgtctcctatgatcatgctactgctctgtgtgcaaaccagtgaaataaaagaagagaggtaacataatcattctgtatgattccagctgccaccaccaccaccatattcacaagtgttacatgacaaatctgagtatctgtgtttcatgctgccactatccggattatccggaaaatccacatgctttcctcttttcagctgtacgtttgtatgtaggtagacagagctcataatattcagaaatgtggggacatgtagctgtaattttaacactgcagagcaattcctttgaaatatttgaagacctgcaaacactgaaagtctggctggcttaaatctgaagtttcaggcacctgcatctatggaatggacctatgcaaagcgatagatgcagagtgcattcatttccatatccaggtataattattactgtcacgcatctacagatccatgactaagaatttatggggcatttaaaatttccccagctataaaaatagtctgaatttatcttgcaattctgagtgtgcctcaaagctgaaatgaagaccccttgtcattgatttgctttgtatttttagtaggctggctctgtatctgcttaagatagaaagccagacttattagtcatttctctatataaggttgtgtgttaatgacatgttttataatattctcatagtgtaattatttgattttctgaagcttatgcagaattaacaacccagcctcccgttgtctctcagaatgaggcatgaaaagttcacatattttgtaaattaaaatcaatattttcaatctctcctaaaggtaattttcttagtttagtagacttgtccctaacatttattttctcttttaattataaaatggcaagttattgaccaggcgtggtggctcacgcctttaatcccagtactttgagaggccgaggagggtggtctcaggagttggagaccagcctggccaacatggtgaaatcctgtttctactaaaaatacaaaagatctagctgggcatagtggtgtgcccctgtaataccagctacctgggaggctgaggcagaagaatcacttgaacctgggaggcagaggttgcagtgagccaagattgcaccattgcactgcagcctgggtgacaagagcaaaactctgtctcaaaaaaaaaaaaaaaggcaagttattgatttttgtatgtaatgttttgactccccgagtatgtttttattgcaaacttgggtggggtgggggcgaggcaggaagagccattgcacttaatgaggacctttaattactatttgcattgataaattatgacattccttctccctcacacgtgccttccagaggaagcattgagaacgttctaatgtattttggatggtttttcttttctgaattctcatcaagtcatacttataaaaatctttctaaatgcttattccgtgccagtcttcagagcagatacacatacatcagcacatcccatgacatatattaatataaaccttctcccaggagagatgggtagttttctataaagcaaaaacagcattgataatttcttctaaaatctaatcatctccagagtccttgaggcttattcaagacaaatgatttgccgggcgcggtggctcacgcctgtaatcccagcactttgggaggccgaggcaggtggatcacgaggtcaggggattgagaccatcctggctaacacgatgaaaccccgtctctactaaaaatacaaaaaattagccgggcgtggtggtgggcgcctgtagtcccagctacttgggaggcagaggcaggagaatggcatgaacccgggaggcggagcttgcagtgagcccagatcgcgccactgcactccagcctgggtaacagagcgagactccatctcaaaaaaaaaaaaaaaaaaaaaaaaaaaaagacaaatgattgtaagtccccacacacaaatccaggtgagtcatgaagtctttggccaatgtgtatggcccttctttagagtttaagtaaaatcaaggcagtaaggagaagtagactcagaatatctctacccagtagcaggcctcatgttatctagtgtagttaaaaatagtgtttccaagaatgtggaggaataggcctcagaggggattcttacactttctctgtcattgtgagaatttcccttgtcttctaataaaaaaatatatatatatatttttaaaagcagtatcttctagagataatcacgatatccagccaatgaaactgttgatttacggcacctttaatcttcatgaataagtaaagcaaaatcaaaataaataacagaaggttacacaaagttgtcagcacggggctgtcaaatggtaaatttatctgtttctcaattgccagtaaaatacacactgcaaagctcacccacgttgtatatcatatctgccaactcatttctgtgattaaatattccatcagcgggactataaggcagcaaagcttaacaagattcataagatgcaccacttgaacacacataactcacttccgtggatggagagcaccccgcctgcaaagggaaattggaattgagttaaattactccatgagacgtgatcaatagggaaaggcaaagatcttctaacggaaatgcagatctaagatatagttaggtcccagagatgagatacatacaattaaagtaaaaataaggagatgcagagtagatcaacttgaaaaccttgaagaaaacaaaaaccacccctagggatatttattattagtggaatttggggggaataaagagattctgaatggatactcctgaaaagaacaatttgtggttttgagagggaaaagaaaatgacaggaactaaaaatgcgccatgcctgactgcaaagtcacatttgaaaggtggtcaggtcttgaaacaagctcaccctagggttacaggggcgatcagataatatgagcatcagagaacatcacagactgtaaaatagaaatagaagagattcatgtgatcaccaaagtcacctcgactgattatatccatttcagaaagaacctggccacggatcacatgacttgatgctgggctaggtgatgggaaagtggatttggatctcagtatgaagtttaaaaatgaagagggtggttataacactctttgattgcttatctcaaaagggcaactgtatttgacctcggatttacccataccaaaggtattggttttctgtgggctagagtgaaccatgattcatctcagaattgggtcaaaagaaggtctatgaaggctccctcacattttttcctcccacttccaccaccaagagtctattaccgttaagagaatgacttttagtcatacttttagctgtacctcttttcaattcccttcctacaatttggatacaatagcatctgagaaaagttaagattgtctagaacccacctttgatcactgtggtccctgacacaagtttgctctattttattcagattggcattgggctcagggtgatttggctataaaaagtcctaggtataaagcatgccctgtttgggatgaaagagcacagtgtgggtttacaaggtaactgttaccatccaagcccttcaaagcagcaaatattcaggtgcccctcttggctccaacactttctcatacccaccaggaggactagactcgaatcaatggccatagggagcagttcctcatgaaccattgacctttggctctgggatgttttgcatagtttacgcatctgccaaattcaaatgcagtgcacttcagtgaactggaacaggagagtccagatttaagtccccgagcaaaggattttcagcctggaaatgttccacttcaaagagtttatcttgcacatctgtttacctttgcctccccttttagttgtaattcacttcgcttctctcctctcctcccctcttctgtcttatcagattttattccagccctgcccatatttggccttaatttttatctgcgtccttctagatcccacagagggaatgcaactcatctttgatgaagcctgtggggttttttgatcttcagataagatcagtacttgcttatgtgctaaaaactgcatttttgaagtaaattggttctttttcttgtgtgtgggaagtctgtcaagaactgctccccccaaaagcagggggtgtcaaggtagtccttgtacaagaagcttcacatccaggctatgggaagcgaatgaggtttggatatccgactctggaaaaatttcacaggggaagttttaagttaccattgtccacatagtgagaaactcaaaccatcaacaacagcaagccacttgcaggtacttgctctgtgctgaacaccttgtttctcctcaaatccttatgaaaatgctatcccattattttcatgatcaaattatgaagtcaaggtttctgggaaagcttacctcattcgccaaatcacagaactaccatgtgaaaaattctggttattatataaaggtcttttttcctaagtttcaaccccatgttttttcactgctttgctacgcagcatcctcaggaggtgtagatgagggcatgtcctcagtgtcttctattcatgaggtcacagaatataataatgaatgaaggccgggtgcggtggctcacgcctgtaatcccagcactttgggaggccaaggcgggtggatcacgaggtcaggagattgagaccatcctggctaatacggtgaaaccccatctctactaaaaatacaaaaaagtatctgggcgtggtggcgggcacctgtagtcccagctactggggaggctgaggcaggagaatggcgtgaacctgggaggcggagcttgcagtgagctgagatcgtgccactgcactccagcctgggcaatagagcaagactccatctcaaaataataataataataataataatgaatgaaaacacatttgcatttaatattgtctgccacatgccagagttcatgttgagaactttacatatatgtacgtaaattagaagttttcaggagaagtattgttaccttcgatttgcaggtaaattagatccagtgaagttatgatgccagtgggtgctgactctgaaagttaaggagtagggccaaagctgttatctttgtgactccaaagctcattttctacctacaagctgcctcccaccaatgctttagttaacccaagtcctagattagtgattcttaatatggagtgacctttctcttaggggaatttggcaatttctggaaacatttgtttcattgttacatcttgggtggtggtgggggcggggattggggagtgttgttcactgctgacatctagtgggtggaggccaaggacgcttcaaaacaccctgcaatgcacaagacattccttgaccacaaatcgttatctggcccaaaatgtcaatagtgctgggtttgagaaattctgtcctcattgacgctattcgagatgccacatattcacggaataccttaacaactctcatgccccactggttgctaccactaataatgtatgaacagctgcagtcatcaatggcagtcaaagaatttgaagactttcatgtaaatgtttcatctttggagcattgtattgtgattatttactccagaagggaaaagcataaactttgatttgataccacacagctgtgttgggagtccccaagaccactctcaggctccatgattgattagaaggactcagagttcaaaaaggctgttacactcacagttagtttattataacaaaaggatacagatgaaaaattagcaaagaggaaaagtacatgcagtgaagtttagaagaaacctagcaaaagcttccaggtgtcctctcaccgtgcagtcacacagatgtgcttaatttttccagaaatggcatgtgacagcacaggcatagtgttatcagtgaagctcacctgagccttagtgtccagcgtttttgttagtggttactcacataggcaagctgcacctgcatgactgaccaactctcaaacctcagcccatgctatggaggtgtgaggaacaggaattcaccataaatagttaccataaacaattggatcaaacctatatggtgtggtccaaggcctcaggcatacaaaaacaattttgtttttgtttttgggatggagtctctcactctgtcacctaggctggagtgcaggggcgttatcttgtttcactgcaacctctgcctcccaggtagctgggattactggtgcccgccaccacacccagctaacttttgtatttttagtagagatgggctttcatcacgttagccaggctggtcttgaactcctgacctcaagcaaccctcccacctcggtattccaaagtgctgggattacaagtatgagccaccatggctggcgcaaaaatagttttatcaggcagataatattctaaggcctgatattttatctcccaggagctggccaaagtccaatcctaaggacaagctgttgtggaaaatgtgcaaggtttgagatagcccaggcctgctagaatccacccttccctgcacaaccattaaaaaaaaaaaaaagtaaacttgcaatttatagtgacatctgtaatgatggtagtagtgaggatgatgatggcataagaaacatgataccactgggtagcttgactgtaagaaaaccaagccaaatttagttatgaaagagaaaagaatgtacagcttgttagcttaaagcaggggtcttcaaacaacttatcactgtaggcacagatagtgtttttgactttgtaatccctatgatccctgtttcaactactgagttctgccattgccgtgtaaaagtagccatagacaatgtgtaaataaatgggcatgattgttttccagtaaaactaaggacgtggaaatttagattttatacaattttcatgtgtcacaaaatagttgttttttttcaaacatccaaaaacgtgaaagccattcttagtttatggcccgtacaaaaacattgtccctactttgctgagcttggcttgaagagctcagcggtaataaagccaccagtttaagcccttgagagtttttcttttggttttttaaattgcacagctttagcggttatatactacatgaacccatgaccttagctggatggcactcagttgtttgatgttcatcagggaagggccaaagagacagaccgtgtattaacacttaatccttgtttccatgaattcaccttttattgcagaattatagtatcgggcgctagacactgtgctaggtgccgaggtaccaaaacagacccaggctttccctctagaagtcaacagggtagtagaaggatgcaaaacaaactgtcaatgcgggtatagtacacagtgatacctgctagagccaaaagaataacaaggctctctgcatgaggagtcaagggggtggtgtaaattgagtcttaaagggtaagagttcacctggtaagaaagtgggtaaagatcattgcaggagggaatatggaggtggttggtagggtcccaagctgtttctcaacctttatctttagaatccattgagaaaacttaaaaaaaaaatacacatgcttgatcttcacctgatacctactgatgggaatttctgagccaagttgacgttttttccaaaggctaaggtatattgatctgttgagattagagagtaccttctagagaaaggttgcataagaccttaaaattttacataatgaaatctgaattttggaatttatcctttcagtggtaggcagccattgaaagctctattaaaaataacaattataattaaaaataaataaggaagacacctgttggtgagttagtacttgtatctatattcacactgagtaacagtcttataattaagacttgtattattactaatatgtgcgtgaagccctgtggtgctgggagacttaggagcagattatcaactgttcagcaaccctgcagattgggttcttaattactaatctagtgcctaggacaaaggctattgtgaaacttatttcgtggttttctctaaatcttttaagaaagtaaattaccagcgatttcaaacgcaaggtgacatgtttttttttaatgttttaacttgttatcattagattataaactctttagtttgaaagactttttgcttcccactttcattgttcttttcaaaatttattgttcttatttccccaacaaattaagttggtgtataaatagaaataaattcacccaatagtgtttaataccctttctgttaattacatgtagatactcattctctacatataaaacagagctgtcctgttgtcttttgaaaatgtagttttgaagaaccaactgacaaatggcaaaaccctactttgagtaacttcatcagtgacagttaatgcatttctagaacttccatggaattgttataacacattacagtcgacatattggtttatgaaaaattaataaagccagtggaaaatggaattccgcatctgcattagctatttacaccaaaagaatcagccagaattaattatgccgtatgctacgttctaatgagtttttcattaaactgtataccattatggaaactaaacaaggattattcaaagaataatgccaacggctgttattttgttgagagattaaattagttaatgggttatacatttaaatctgatgcaaaggttaatcgatgcacacttattgtattaaacccagtatcattttaaaacacaaacaccccaatatcactgatatttcctctggagaaaaaaaaaactatttgtatgattctagtgtttggttgatgtgcatgtgatattgtaaagattgaaatccaccctattctctttcatttttgaaaatgattttcactagctgaaatattatgtttgtttttagccatagcaggggaaggggcagtgtgtgcgagtatgtgtgtgtatgttgtggcaggcatagacaacttcatccaatcactctttgagagattgaaaggtgacgtgtattttctactctcaccaaaaaagtcaggttaaaattttaagcctaatctgagaaggcttagaaggcaattcaagatgaaggatctcatcctcattccacaaatagagtccctcctaaatagttctgtaatagtacttgaaatatgaaagaagtgacaatagagaagcctgtctagacagctttttaggctcttacagcatcttagaggctcttattcccaagaagataagaagagagtatagaaggccttctaggttctttgcacagacttgtaaattccactgttttcagttgaatgacagtttctaattttttttttcctaatcagagattgcaaactaaaatgtttttaggaacaagctatgacataaataagtgaaatgtgccaaattggaggagctgtgtctcaattatagcaagtagtggcttctcacctttgcctacagtggctctgccggacaggaatcctagcccagacacctatggtctgtcccctgacttcccactagaagctagacatatcttatcacattaaaactcctaagtttaagtgcttgcaattcatttaatactaaaatatttgccattaactattatgtttagcattatgtttagtggccaaacacaatagttcaatagctataaatttgctatttcctttctgaaaaccaaagtaagtcctcagagcatcattgttttagatacccaataataattgctatttccatgattatgattgattcacttactgattactatttgccaaacactttcatgccatagttgtaatcctcacagcaatattcgatcaagtacacatttttatctctatttgacagatgtaaccactgaggctcagagaagtacagagttttacccaaagtcaactcaacttccagtcagcaagatcaggaaacaaaacaaagttaaaagtttcaaagcctacactttttcagtgacactatagaaatctcagacgttcattatttctcctctgcatttgcctcctctatgtcttatttcaatcttgcaagtaggatttttcttatctgtagaagatacattctgcccaaaggcttccttggttggatttaaaaccctatcacagattcttaaacatgatcaggaggttctagctaacatctttagccaggaagagtcaggtgtttcctgccagatggcagcttcggaattcttagatgtggctttgttgtaatgggggtaatggatattgatcattctcatgctgaaggatatgtttttatcaactcaggaccaagtatcaccattgataaacaggtgtagctttgagagagagtgtctgagctttggagtcacacaaaactgacttatagttcagttttattatactttttctctgagctttcatttcctcttgggtttgataagaaaaagacgtgcatgtggagtacatcttgtatagcacctgaaacctagggccaccttaatgggcactgtcaatattagctgtacatgaggttcctatgtaatccctagcaatttactgttgtcagcaccatctgcatcccctggaagcctatgagaaatgcagagtctcaggccccaccccagaccccctagataagaatctgcatttagaagagtcccaggggattcagagcatagtagagtttgagaagcaaggccctagtagtcttatcatctatatattgacacctataactttgaaggacaaacatcttgcaagatagaacttattttcattgtttttgttgtggctgaattgatagacctccacaaatactctatggaataactttttgaatttttttttttcttttttgagatggagtctccatcacccaggctggagtgcagtggtgcaagctcagttcattgcaacctctgcctcgcgggttcaagcaattcttgtgcctcagccgcccaagtagctggggttacaggcatatgccaccacgcctggctaattattgtatttttttgttagagacgggttttgccatgttctccaggctggtcttgaactcctggcctcaagtgatcctcctgccttggctttccaaagtgctgggattacaggcagggtcaccacacctggcctaattgttttattgttttgaaaaacaatccaaaagaaattttgagcaaatatttttaaaagcctgtgtttgaaaaaagtttgttttgaacaaaaatgaaataaaattaattttttggcaagtattgatcaaatgatagcctctgaaatacttagtgccagctcccttgggaagggctaatggtgtactgagagacagttactgttagtatttttgcaagcagtaaagggatcttagaacactgatcagcaaactttgtctgtaaagggccagacagtaaacactttagcctctgcaggccataaggtctctgtgcaattactcagccctgtcattttagcagaaaagcagccatacacaaaaatgaatagatgtagctgtcttccaatgaaactttacttattagatactgaaacttgagtttcatgcaattttcactagtcaaatgttactgtgatttttgtcaaccatttaaaatcgtaaaaagcattcctagctcacagaccatacaaaaataggtgggggctcgggggaggggagcagttggatttggccaaaagtctgtagttggtcagcacttgatttagaagatgattgttagaaccatgggtccaggaatctggttggtatgacttgcagtttcagcatcacgagatctgtgtcacctcaggcaaggaaaaagagttctctatgcttcaatatcctcatctattaaatgggtataaaaatagtgtctgtcctacagggtcattaagagtaaatgatgatctaagttaaagttgagcaggatacccagtgattctcaggtattcagtaaaacactttgggaactcttattgttaggtttatcatattaagttaaatatttcctgtcaatgccactattagcctacattttggctgcaggagattaagtgaacagttggagtgagtcattaaaattttcaaacaataaatagtcaaggaacaaattcttctttgtattattcttgtgacttttccaaaaagtctcaagttatgtcaaaataaaaagcaaaaagaaaacaaacaagaagtggtgtattttttttttgaatattatgaaaaccaaagcttatgaaaataaattggagtgagggattatttacactatagacagatgcgcttcagggcccctttaaatatggaaatcccttggtacaattaaaacatgatttgatttataagaagtaaacatacagagcaacattttttctgcaacatctgtgcccaaatggaaatatccctatacttaaaactctaccataacccttcagagaagctcatctttcaggctggtgtaaaagcattagggattaactgtgaaaatattcttacatggattagctcaatgctagtcttgcgttcaaaaatgcatgactgtaaaagtatccaccgtccattcgggctttgggtaaattttggaaaaatctgtcaattgaaagcagtcacctccattgctaggtaccttatggcaacctctttggcttctaagtccaagagaagtttgaggcttatgggtcactttgtaggggactctcattataaggtaggaaggtgtagtagttggctagtgctgccatagcaaagtatcacagactggatggcttaacaagcagttcccaaccattttggcacccgggttgggttttgtggaaggcagtttttccacgggtcgggtagcagggatggtttcaggatgattccagtgcatttcttgtgtaccttatttctattattattacattgtaatatataatgaattaattatacaacttgccataatgtagaatcagtgggagccctgggcttcttttcttgtaactagacagtcctgtctgggagcgatgggaggcagtgacggatcaggcattagattctcataaggaacacacaaccaagatccctagctcagttcacaataagattcacacttttatgaaaatccaatgcttccacttatctgacaggaggtggagctcaggtggtaacatgaagtaacatgaacaatgaggagcggctgtcaatacacatgaagctttgctcgctcacctgcagctcacctcctgctgtgtggcccagtagggtccgtggcccaggggttggggaaccctggcttaaacaacagaaatttattttctcataattctggatgctggaagtctgagatcatggtgttggcagggttggtttcttctgaggcctctctccttggcttgcagatgaccatcttttctctgtcttcacctgggtttccctgtgtgtcctcatctcctcttcttgtaagatctgtcagattaaggcccacccatatgacctcattttaacttaattacagctttaaagatctctctgcaagtaaagtcacattctgaagtactcagagttatagcatttaaaaatgattctacaacagtggactgaaggaaggactcgatgaaatgagtgacagtgtaggaacccaaatagcttgtttttcatctaaaatttacctctggttggtaaggtttttggtaaaggacttagttgttctgtgccacctttgtaatgccagtaaaggaggactaatggcatcagacgcctactatggagggacaaatgcaaagtaaatattctttggcaaatattgaaaaaagctttttctttatgtagaatcaaaacatttctagcattgattcctattactactaaactttcagttatgatagaattatatagcagaaatagagaattttggccaaagccataatagttatatctaataaaaattgttctcgaataattatacttatcttagtgagcagtgtgactaattatgtaggctaaggtttggtttgatattcagaatcattcttttgttccttttcatgtatacatttgttactgaacctatgagcactaaacgtgataacatgtcatcctctggaaaagcacatggagttcaacagatgtaccccaaagcccagcacagtgcctggcacatagacgagtagatgccaataagtaccagccaaatgaatgataatactcactacatcatagttgcctagctgagcactagaggcagagggactaataagcacttgtgctactcagacattgccctgcagggttctagggttctcctcttagccttcttccctgagtaagctcctttcctcggctgagtgacattaggaaagccagacatcagtggagagttctatttttgtgtgactctgcaccaccacacagtagaggtttgttgaggtgatacggttctgatgactggagaaatgccaaggttgttggttttgcgccgattggattaacaatgtgaacacacgtggagtggttttaaggagcgaaaagtgtaataggcaagaaaggaggaagaaagaaaagaacagcttccccatacagagaccggagagtggggcctggaacagagaaaccttgtgtgtggcagataagtggtagattataggggaggcttgaggaggcggtgtctgatttgcatacagcccaggggattgctttggccaggtgtgtcatttatgcagcctgcaaaaaacctggctctcccaccttagtcctttaatgtgtaaatgcgggtcgccatgatgttctgaacacatggtgttatctggaggtggccattaaactgggcacaggtggtgacaaggagaagacagcaggaatcgccacattgagtgaaccctgttcctaatggcgggtatttgcatatcaaagcttgcccacccagcccttcgagcagtcttttctgttataaaagagatggtttgggggtggtttcttattacaggaaaatttccacctagaacctttacccttactatctgcctaaaataatttcttaataactcctgtattagaggtacagacagtgcatgacatatacagaaacttcctgcatgggggccccagaatactcattccatcttaggtatttcataaagtctagctgttgttctttgtgtcttcaagagcatcctccagatttcctaacccattttaatcttcgagctcttgaagctaattggccactcccagttgccaggcagttgagatgttccgttcacattttttgtttaaattcagaaattatgtaggaaaagttctagttattcaccatgtactgacttggaactgtgcccatttgatactaaaagggaacgggcagacattgccaaacagcctttcttttcttccttcccatcctccattttaattttatttcttggaagtgtagcatggctgcctatcagaaacctttggattctcacttcatttgctccctgcctcttagtctaggttcctggactcatgaggataggaagataaacacatgattcctgatctctttgaattagtagcatcaatgggggaagacactcattaaatagattacacaacacaattttaaaaagaagagaaaggaagctgaactctgccagacaaaggtacatagatagggtttctaggagaagccagagctgagtccagaaaggagttacctagagcaaggaaaagatttcctggaaaaagacaaagcctctgcaaaggcatggaggtgtgaaactgcactgctgttccggtttgagtccagttttcctcacttagggggttggcagcagagtaaacagttttcgacacttcctccttcctgtctgtgatgggaaacatcccttctaggcttgtgcctgccccttcaggggccaggaatgatcccctgcatgccgtatggagactactgctcagcagaaagggttccgatgccccatctgagaccttggcactggcttactcccttcctcactggaggattcaaaatcctgctggagagtggctgtgggacatcttgccaggttgtggggatgccgatgatcccggcactcagagtgggcgaacgtgacaggctttggaacgggctctgattattctgagattgaggtctgtcccatggagccaaatgtctgccaggtgctgatacagtcatcgacagtccaggctgcgcaggtttcttgttagagtgggtgagccaactttataagaaccaggaaagaagagaaaacacgtgaagtagattgaagctatttcaatctgtaaaagttatttacatgtagtgtgtaaatctatttgaacttcaggcatgcaaatttcctgccatgaacaggcggaagaaagattggttgaaaaaaaacactatttttagcaaagagggtagaagtggagacttgtttttaaaaatgtattataattcaatcatatgcattaatccttctgaggatcaggtattttcctaggtgttggggatgaaaagatgagtatgatttggctctaccgcaggtggattttgtagttcagacgaccaatgtctaagtagaaaattgtagtagaggaccacgaaggatctatcagggaggtttaaaaatgcaagataagagcatagtgtaggtaataactaattcacccctgaggacaagggagagaagaggtcacttttaaactatgttggaggaggacaggggaagcccctccgcctcctttttttttttttttcttttaagttgaaccacatgaacttggcaacattcaattctatttgacaaaaaaaaaaaaaaagtcaatttgaaatggtttaatctaactctaagagcaggaacagcatgaaggtttcatccacttcaccaactctaatcaaatgggaatcattgcctactggctgtgttgagaatgattgtgaggattccaggccaataggaaaggataatattgaaattgattaattccgttctggctaaagaatgggtaggtagtggtataaattgaccccatttgccatccctagattataaggaatttgataaaagcacagaagtctgagaagtacaggatgtcatcatgtgatacaaatgaaggttcctggcatttggcagtagaaggtttatgttgaaggctagggacagatagaagatccagctcagtggactcaatgaagagctatgttgaagctatattgagaagtgctttgaatgaccttgtaggccctctccatactgctgcttgtaccttattacctatttgacttactttttaaaacaaacacacttacctttccctgcccaaaaaaatgcatggaggttgcagtgttctctgctgctttggttttgtcgaattcaaagcgtccttttaagaaaaggtcacaaagcactaagggaacatacagtaagtactttccaaattaaattggaggatgcttttagataaaacaaaaaccaagtcctgtgaaggcatagattttgttttacaaaaggtcaaaatcattgcataaagattttttttttttttaactacgaagaaagtatccaaagaaaatatttcagtccaggttctcagaatccacagcattaaaaaaaattaggaatgcttcattatgccgtgccagaggttagctttccaggcaaaaatctgtgctgtgtcccagtggaattctataaattgcatcgaggatattgaaaattgacccaagggttttaaccatacaatactgaaatgtccttctgtgtatgtttgtgttacagttatacatttttcttttgaaatttagcaccccaagaaacttcatagctgattttaagtgtttttttaaaccaggcgtgcacaggagagaaggttgaggagcattccctaaatccacttgctaggatcctatcgtagatgattccgacctgataactctctgtatatcctatagaaacacattcatttatttctaagatttctagcagtgagcagaagcacatagataaccgctgcagagtcacacaggagtactcattgataaacaccactgactgtagaggggactaactgtctttcctggtaggtagcttgcctccccttgcttggtttcatatcccaatctccattctttggagtttggtttgtttgctgttaatccccagtgacctgctaaaactggaaatacctgaggcgaggttaaaccatggaaagtatcatctcatacgttgtgataaacttttttttttgagatggagttttgctcttgtcacccaggctggagtgtaatggcgtgatctcggcttactgcaacctccacctcctgggttcaagtgattctcctgcctcagtctcctgagtagctggaattacaggcgcctgccaccacacccagctaatttttgtgtttttagtagagacaggatttcaccatgttggccaggctggtctcgaactcctaacctcaggtgatctacctgccttggcctcccaaagtactggaatgacaggcatgagccactacacctggccgataaactgtttttaaatgaagaagaaagaactattagtttagcacaggtgaatcatactgacactccgccagactcttgatatatttactacccagagaaggttagttaatttcgagttaatttcactgttgtgtgaagggctattttgcgggtgggggtggctgttctccagctataagcatgggaaaccagatcgaaaaagaccatgggacattccttcaggtagaacctctggccctgggctgcttctccctgggaaaaagtggatggagttgtcagaccggtaacaggggaagagtgagatgggttagaaagaattgtgtctggtttactgtcccttgatgacatcaccgtgcagtccctctgtgtggcaggaccccacacgctttggaagttttaactacatttttgttgatcatagggaagatacagaaggagcatagaaccattccctagggcaagtctccaaggatatagaaaagttccctgttctgcgggtgcacttgtaaggttggcttcttatcatgggagattgctttcccgttgcggtcctgacaggggaatccaaatcaaactggggcggttgaccttccccagtcaaggaagtgaccagaaaccacagggaggtatttccatcaccagtaatggccttaaaactcctcagaattctaattattttcaaagtcttggagtttgagctttgcagcagtgggaaagtagcactgataccctgacaattcctgaccccagtcatccctggagtgggtggttgttcaaaatctgtcatagattgaggaggtatctcaggattccaccattatttgccgctgtaaaattccaccttgcaaggatgaacccagtgcccttcgctttaaatcaggaggaggcaagtcattgctgcaatgcagccgcagtttgcaggatgagctaggcagcctttctggctggaaggcagagagctttagggaagaaagcgggaatacagaagccgaagattctctcatccagtgtccagtgtgggtccagggtgggtcccagggatggcaaaaagttgcaatttttctttctccgccttacttctgttcttcctctgaagaactgattcggaaagactgacatttgaaggaagttaccgttttctctaaacctatcaacatgtatgcttactattgattgagtgattattacatgccagcccctgccctgggtacgtctccagtcatatgatgcacagccattctcggaggtaggtatatttacccctgttttccagatggaaacactgaggcacagagaggtacagtgacttgccaagatcacacagtgaagaggtgtctgagtcaggcttactatctagctccctccaatatttctcaagttcccttttcagtatgccacgctgcttccattcctgatctgaacctgggccctggggcaaccagagtccgctacacaaccccgtgtgaaaagtcatgacgtgtgcttggtgggccgggttgtggtgggtgggggggcttccattgattccctttggctaaggcagggggctttgttgggtacccttgtcctgcgctctgggatgtggctatgttttcatttctctgcatttctcggttgcattgccgtgatctctcaggtgtagtgtaccgattcccaaaccagataccatctctctctctctttcgtaggcacggtcctgttgtgccaggccaaccaggagggatcttccatgtacagtgcccccagttcacttgtatatacttctgcaagtaagcccactgtcgtggctctttttgttttgtgacataaatctgagtccaatcaccttccctgccatgtaagttctctccccctccctctgccccaccctctcttgtggctctctctgaggtgaagttaattttcataagcatgtctgtctcccatgccacttcccagatgtcctggacattctctgttagatccgtcaggattgggtccaatggttgggaatgtgggcatggggttggtggggaggggcatgggagggtgggaagctttagctcattgcctgccttctatcatagctttgcaaattaatataaaaataatttaaatagcatatacaggccaccccaaaggcacccttgcctagtaaaagatgcttaaccaggattcttgtacacagttgtctcacgatggaaaataccactagcctgcagctagtcacttgtttgcaaggctgttctgtcctttgctatgtaattccaatgaggaggaggaggaggaggaggagcagagagagaaatgtggttcccccctcatttaatcaagtgcaggggcagcaacattaaataactgtcttttaaaaaatcggggcacttttaaacgtagataagtatacccatccagtgcgggagggaagagacccaaaataaatacaggaagtagatcacaacattgacatggaagaaccgaagatttctctgcctcggatggatgctctgggttcaaggatgccctatcctcaccccaattcccagagcaggtagaagaattaaagccgccactgactctaccatgttctcccagagggtataccccttcttaaagaatctcccagccacagctgaaactttaacatctgttttatacaatgtgtgtaaatcctgtggagttgccgtaactgcagaatgagtcgtctttagggtcagtgcttaaaagtgagtctgggtgcctggagtgggggtggggctgtttctcagagtagttgtaaaaggcagggatggggaggagagcaggagtaccaggctcaagggataagagacgtaggagaatcctcaccatcgtgccaaaaccaaacatcttcgtttcctaaattgtgaagctgaggaaaaccaacctcctcactgttggggcagcacctccctgttaccagcagtcacagggaatcaaaaatataatgtgacacacccaagggtctgaagtcttcaggaggtctgacagccagttgtttctcacagttagaggttttgagacaaagtctcactctgttacccaggctggagtgcagtggtgccatctcagctcactgcaacctccgcctcctgggctcaagcaattctcatgactcagcctcccaagtagccgggattataggtatgtaccaccactcccactgatttttgtatttttagcagagatgaggtttccccatcttggccaggctggtctcaaagtcctgacctcagatgatccatccacctcagcctcccaaagtactggaattacaggcgtgagccactgcccctggcccagactataatctttaatggcaattttggcattaattaaatgcaagacatttttctgtgcctcccaagaagcccaaatctaatcatattggcaagaagtggttctttctgaatttgtgacaacaaattcagaagggcctccttggggccagtgtaaatgtgtgtgcatgtatctcctgaaattgtaatgttactacacattttcacatgtccagccttgtgtattcctctcaaaaccagcaccaggtaggtatcacaatgtttgctttacaactgaggaaatggagggcaatcccagagccagtgtgtaatagatttgtcttctgaacctgggaacattattcaaccttcagctacctttctgagtccatttgactaaatctgatcgctgtaccatttacctagccttcctcgtctatattattttctgaaagagagttggtgtgccaaaacttaccatagggctgggtcctagagtattatttttttctctaacattgcggtcctatagaagtgtctgggataaaatctttatgctatccagcatagtgctgatggaactgagacactcatttttatgttatattaattagccatataggggctaatggttaccatattggacagtatggctctatatgatgatatgacatatctatatttcaattttctttacagaagtgaacaaaacaatcaactccaaaagtgtgctagtttgaattggtatagctattctaaagtgaattggggaagcatctctcacatcacatgaaaatatttcccaaattctccataataaaatagctgaagcatagagagaaaatgaaaccatctaaagcgagggccacccaagccagcccatggcctgtgttacaaggcttatgaatgaagaatgatgtttagattttccaaggattgaaaaaaacaaaacaaaaacaaagaatgtgccagagaccaaggtggcctgcaaagcctaacgttttaacagtccggctctttacagaagaagtgtactgatctccaatttaaagggtcgattttagtattaaaaatacaaagtggcaatatcactgcactgtgtgtagctgtacctttttctatgtttaaagtaaaaattaacaattatgaaattgtataatgtgcatccaacatccttcatttctaaattgtatcagtcgtattacctgcacattatatgccatgtgctttttataaaaatatgttaatgaacccatagtattgtttcattatattatattttaatctattcccccattcttgagaacttaggttcatagcaattttttttcaaaaatattaaacaaaataaacacccttcaatagagcagttttaaagaaaatagctaattttaccaccccattaaaaagcaaaatgaaaactagtttcttacattaagaatcttcacttgtcgaggcttaagcaagggcattcagatggtcaatctcgattagtattttgtaatggtgaccaactctgagacccctccctctccaattgggtaggcagaggggccttcagttatttctgtttgcaggctgtgcattggtgttgaatgttaagtttatccgcaaatccctaagacacattgctgcggtttcctttctcttttatggctttttggtctaggctgtttgtggattgctggcttggcaacattcacttaggtttttctcttccagattaggtgcatattctactacaaaaccattccccatttcctgcaacaggtcagctggcacataaagggttatttttacatgcaggcctgtgcgcacacacacacacgagttatattcatggtcatccaggatttttcttctcccaacagtttcgatttgcacagggctgagagtcacatattttatctttgctctctgatgggtgcagactttttctctaggaatccaaccattgccctcaaagctgaggctaccatacttttcagcaattgtgtaggatgctcttgttttttaacttgaaaatgcatatgttcctcatttctgtttaacagctgtgctcctgaaggaaggtgtgtgtaaattacacttttgtatgttggatcctatgtgtctacagacttgcaagataactctggagcttcgtttttgtttttttgcgtttttttcctccatggatctttaactggcctttgatgtttgtttttttttttcgagacttaaattgtacctcttcctagtcaaatagctaatcatctgtaaataacatccttaaatgcagtaggggagatggtttttaaaggaaccctgctgaattagtctgtaatgaaaataattcctactgaagttatctgcttttgatatgcatttttgcataacagtgaggttttctcccccattaagtgaatcatcctaacaatgtgacccaggactcataaaagtattaagagaaagattttcactgataactttgtgtccatacaactaattccgtagactcttccatcggaccccaaatgactccagtttttctccgtcacccctgaacttcatgcaggtttaaaaccctagttcaaattgtgtcacaggtcatcatgcatcctcttacacgtcctaataaactactctcatccagagtgtaaaatgggcctgctttctatgaaacttaaatgaagaaagaacaaaactctagagaattaggcaacatcacctagtgtcaaatggaaaacatttgcaattaatatttttcaataggctttcaatagaaacaattcaaccccttaacagaaaggtttagtgaaatgggcagggctgcttggtatgtggactgttcattccattccgaaggccagtggtcagcctgctcctcttgttgaggggaaaggtactaggtgtattattgccagcgctgttttgcatatggcgaatgctcaacatcaaaattggcaccaggcagaaataggaaggtaaagaacataccacatctcttccaaattaatacatgagtttcattttcattagttgaagtatctaaaggtaaatcattggttccatgaatgaaaaagttcacttctgattcagattagcaaagccagctaccgcagatccttatttacatatgaagtagatgtttccagaagcacgtaaatgtttattttgttttcttcaggattttatgaatatgttttaaattacaatagtaacaggtgctcattgcaatcaatgtgaagtgtgcaaataaacatacacaccattgtaataatgtgggaataatatccccactttatccagtaacataaacccttaaaagtgtgtggacgcccagtatctttctacattttctccgtggttattcaggaaaggacatacacacatgcaatggtgggggcgggggacggtgtgttattagtttgactttacagaggagagtatacacagatgttacatggacattacatatatcaatcatatttagtttcacataatacattgtgaccgtctccctttaagccttttagatattttcatccagtttgtttaatgacataaatggttgacagtcaattcaaccattctctatccatagtcattcaagccacttctttttactttttattttatttatttatttttttattttttgagatggagtcttgctctgtcacccaggctgcagtgcagtagcgcagtcccggctcactgcaaactccacctcctgggttcacaccattctcctgtctcagcctcccaagtagctgggactacaggcgcccgccaccatgcccggctaatttctttgtatttttagtagagacggagtttcacgtgttagccaggatgatctcaatctcctgacctcgtgatccacccgccttggccgcccacagtggtgggattgcaggcatgagccactgcgcccagcccaagctacctctttttctattccctccacaaggagatagtaaaaatatttgcaaatacccttacgtgcaactacatccattctacacttaacattgccaaacatggaactgttggttcccttccagcatgcttgccagcactgccatgttttgctctattttgcaaattgcatagtgaaaaataacatctcaatttgttttagtttgtctctgcctttctcctattaatgatcaccgtctttcacatttttcatttagactttacctctttgaatttccagtatacatcttcctgtttgagatttttcttattttattatcagttcacacgtgagtgacacttgtttactaggataacctatgaatggttcagatgttacacgtgtatttcctgttttgacgattgatgttgctcagattccaccatacatttttaattacataggcaaatgtatctgtcttttctgatcattttagacgtcattttggattacaaaatccctgtcaagagcaagttttgttttgcactgtatcagtcagtttgggctgctataacaaaataccgtagactgggaggcttaagccacagacattcattttctcaaagttctggaggctggaagtccaagatcagggtgccaagaaagttaggttccggtgagggctttcttcttggcttacagatggccaccttctcccatgttttcacaagagagagacagagacagagagaaacagagagagagagaggaatagagcaatctctggtgtctcttcatataagggcatgaatcttatgaagggcccaccctcaggacctcatctaaacctaattacctctcaaaaggccccatttccacaaagcatcacattgggggttacggcttccacatatgaatttgagtggagaggacataatttagtccgtagcaagccccttgatacagggatgtcagttttatttgtcaagggctagaaaagcattttctggaagaaatttctttattgttccgtatgcttatcaatgccaatgagcgcgttttccacagttccatgaaagccagagttgaacagtagatccccatcaggataaatcctaaagttaatagaagattaattatcgtttcccctgaaattttcaccctgatacccttccctcctcaaaaaaaaaaaaagaaggaaaaaaaagatatcatgggcaaatgcttgggaacctgaatgttatcaaaatgcaaaatcaattcctcatttattgacttctatgaaactcaagggcaggtggtaggggcatagtttcaactgatatattgattgcagattttaaggaagtaattgtgtggaattcataaaacgatgatttaagtggcagaaacatacataaatcaggcctgtactattttacttttaggtaattgatagaacttccatgggtttctgtaattaaagtaaggacctaaattaatttacggcttcctttttcttctgcacaatacagaaaatgtcagtgggctggactcagttactagaaaggacacatacaggtcattttgttactgacacattggtgtaaagaattgtgtcttctttttccctcacttgccagtgtctgacagcttcttgctttcctcctagatatttttctactattttatggagggggtgcttaacaataactagctccgggactagggtaagcaagtgacgtgctcacttcaaagattaaaggggtatccaaatacctcataaatagcattttaatgcaatatttttaaaaatctaaagtaacagaaaaagatccatgattaacagaatatcaagacagaataagttttattcctttttccttttggagccttaagatcccatatggcttaatccagcactatttcaattttgatagtctgctcatcgtggatttaaaaaataatttgggtgttaaaagattgcattaaaacatgatctatctccattacagagttttttggtgtttcctcccttccaccccccacttaagttctgcaacgacagtgaacgcctgttaacctagttgcagccctgaaatcatgatgatatccataatcataagtagtggttattgggcactcactatatgtcaggcattgtgctaagcccttctcattagctttcttaagaaggaactataggacaggtatgattaattatgctaccttttctcaggaggaaatttaggcttgggggcgttaagaagcttgtccgagatcacccagctagatcagctttgaaccaagcctgtttaaatcccaagccgccttcttcactactctctcaacttaccccagaggctggaaacaggatggactccaagaaatggctgagcagggagtggtcacggggaacctctcagcagctgtccagcaactctatttgggccaaggctgtgctgtctcctccccatcccatcatgtttggagaggcagttttcccctctttgagatgtctggccagggcttagcaaaattattctgtaaaaggctggatgttattaatattttcagctttacaggccatctagcctctgttgcagcgactcaactcttgttatagcttgaaagtagccatagactactgtacatatagccatagacttctaggttgaaacatgaatgaataggcgtgactgtgttccaataaaactttatttacaaaaatggtctgtaggccagattgggcccaagcgccatagtttacccatctctttgtcaggccgtaattcttacttaaaaggacagaacatggtggctggctgcttgggggtggaaataaggaaaattcttttaagtgtgcaccctcatgtattttttgcattttgtaccattttatcacattttaaatgacgtgaagtagtacataaagataggtacccttctcctggtacctattaagatcaagatacaaattgatcttgatttaaatgatacaaaatgatcttgacttaaatttgatcaagatacaggaattgggtggttagttttgcttgcacaatgatcaaatctggtttcagaggcttaattctactgacattagtctaagacctgccccagtttccttgggcaaaatgtgaagactccattgtcttacccaggatcttctgtctgaactgtttccatttctatccccacactttcaacaatgctggctctaaaagatcctctgggctggacccttcccatcagggaatcagacactccttcttctcttttgctatggttcagcattacggtggcagcctacctgtgtcctctttgtcattttctcagagataattccttctagtttttagtcctttgatcggagagggggttgaaaggtgttacttcattcaaccaatctttattgaagttttttctatatgccaggtgcaattctacatcctgaaaatatgctgtgaagatactctcaagttggcttctattatacctatattcttggggggacacataacagacaaatatatataatgctaaggtttcagaatttcaaacgcagtgctcctaggggatatttgggaagtaacacccaacaggagacttattcactgttagcactgccattggggtgcctctcagtaggtgaattaagtgtccctattttcaccattcttcaacactgtagacaggtgccctttgctactgagaccctatttgcttcaccaaacccatggattgaggtgttttcagacacctactaggtgccatgctctccctgccacctcaatcatagcacttatctatttatgaacaatagttgcccacagcattgcagaattatccagctaccccccacccaccaatggtgaactccagagattattctttctccatcactgaagcaccatctctgcttttctccatctgctcaacttttcccatgtcccagcacatttgattaacagatgatttctaagaggcttttactagctctgatattaacttagttattccacctggatcacagtcctcagaataggttcatttgtatttttaatccctgcaaccactacccccaacttcttcatccgtgtgttgtttctttggctgtcataatcataacccactttgttgtttgtcctttttaaccaattccaagaaagaattaaaaccactagtagaacctctcacccccagttgtttaaagggaaagttctgcaaagaggcagccacatttcaggcagctgccatgcagctctctgtcattgctttcgttattaatctcaatgcagaatggtgattttcattttttcagatgggtgtctggctgcaaaaggccgccagttgcaaaaactaccatcccatggtgtgcccccaaacatcttatttgtcttgatatttctttcacagaaatacatatgacagataaggagtcactagaggatgcttttgctttgtgtcagacagatattaaaacaataaactatgttgccctgggattccaatgcatacacagccagagaacaaggccgagatgagatgtttcagaaaggcagtgaggcaattattctgggggaattccctggaaaccccaagtcctgtgatagcattgacagaaagtgttttttaatgctcacattttcttaagaggatcaactggctagtgcagctcctgcatttaactccttgacaaaactcaccctcatccggcctcatcagagtcaagagaaatccttcaatagtttgagaggcttattttgagagtttattttttaagcacttatctgccctttatttgcttccccaaactaatgtggatttacattaaaaaaaaaaaaaggaatccattttacattcagagctctgagcaggtaagttgcaggggccaacggcaagatcttgcttggttcttggaatgtaaaagaggacagtttgatgcaatggagcaggtgcacattcccaagggccccagctttataagttgagtcaagctctctctgggtctacagagctgggaaggaacagcttaggaagggagaggctgaatccaagggcactcataattcaagagctggagcaatcattctttcatcaaataccagtcttcttggatagaaatgtgtccaaccatagaggtggctgctgcttcttcccttgccttatttcttttctaaaataaatctcagtgcaaagaccatgaggagcagctcaggttgcctctcatccaagggaaaaagagcctggtgtagttcatataaacccagtaatgtaaacacgtgcttcaaacaccattttcttaaatcatgtttttatataaaagaactgtcatgccaaaagctatttatccctaatggagaacttcggagcactgttaagaaaatgcagtttcagaaccaaacaccacaccacatgttttagatttatctccttgagttttgtttgtatgcaacataggctcttgatgcctaatacttttcatatgaaagcaaacagaaaggcacaaccatctatgggtatttattatccctacccttactatttgctacaggagtctcaaacatttccagaagatcatttttcctttctctggcaagtcctaattcccactagtggttttacagcatttttcttgagctacagcgtgacttagtgaaaagagctggattcaggaaagtctgggagtaaactgtcacggtagactagtgctgtgaccttggccaagtctcctcgccatgtaaatagccatgactacctacctacccatgagcactaaatgagattgttgtgcagcgtcctccaggctgcttgaggcgttacagctcctcaaatgctactctttctttttctggctcagaagccaccttctccaggattttttaaagtccaccaaaccagatgtgatggtgtacttttatagtcctagctactggaagggctgaggtgggaggatgacttgagcccaggagtttgagattgcagtgatccatgaccacgccactgcactctagcctgggggagaccctgtctcaaaaaataaagttcaccaaagaagcgggtttggatggtttatattagtccagtgactggactggtggaccactcctggatggtagttccttagtctattctatatgggtgttttggaggctctggctcagatatcaggcagatgatccctaggctcagacagtacctgtcctccaggttggctttgggcattgatcaaaggatcaggactcttttttttaagtctgaaagctgatgctcaaaatcagatggcctcagcactgacacacagatcagctatccccacagctatggctgggactgaaatgaacaatgcatgtgcgtcgcgtacccatcttgtgagccaccgtcagacccctctgaaggcttcatgttcaggagctgcgtcagcccaagagaaccttgggaaatccagcccagcataaggaagctaatttatctcacttgccctgtttcctacctggagaggcaattcaccgagcttgctgtttcagccagctgttagatagaacatgaatgatttaacaattgaaacttcagtatgtatatgcactggataaagtaattatataaattatttgggttttttttttccgtggtttcccgggaaacaacaacatggttatcagtacagattttgttaaactaatagatgatgacgaactgctgcatccaaattaaaataaatctcagctcttcagggctttgtcttctccttcaaaggacagaaagcacctttgcaaatgccttttgcagttctgccaagttaaacactccaagactgagactcattctcattttgccgaatgttacaaaaatcctgcccggcgggggaaattgtcgatacctgtgagtaggcaaatcacaaatacctcttctgcatagtaaaaacatatcactacacatttagcagccatgacatttgccacttgtctgttggattaatctagccatttataacctgtgaggaaagatacaacagctaactttgggaggtaagcaggaacagcacgccaattagttaccaccaattctactgccttcgctcagagacacaaggaccttacatgatcaaagaatattcatgtgtgtgaatggtgtgtgtgtcttttgctgttgctttaatttgttaagttaggggaactttctcctttgggaacaccagactcgttgctcagagtaaatcccagtgtgctcattacatgtaattttattttcctagatgactatttttatttccacaaaaagaagacttatttcaaaaacccaagttgtaatgtgatatttgataacatattaaaaaagcaattatatatagaaaaacgtgcaatagcccaaaatgttatgaaggtttcttatgcagatcttccaaggctttgaaataagtttctcattccagtcttccaaattagaaatttctagctgaatttagttgtaaggagctcatcattgtgacagtaatcaggtttgtgttcatctgcagcctttactcacactgtactagtacaaacctgctcactaactctacagaatctgcattcccaatatttttgggttgaacacaacctccccctcacatcgagatgtagaggtaaaccctagtggcaaagggaaacagcctgcctttgaactcttaccaggaacataaatcagtggtgatccctatggccggcatccaattagcagaaaaggaacagggcctttccaggtgtcttgaaatctcagaacttaagtatctaacagaagaaatggcgggcacacacacagaccctctaatgtctcccctatcccccaacaagaagcatattgagatctctgggaggactgtcaacagattcccctgcaaattaacccagtctatgatgaattggggctggctctgtctcagatgtggtatggatatagggagatgatgtagcagcttgtacaggcaataggagggaatccaaactgagagtctctaagaagcagagagagagtagaagtagaaagcttttcccggagcctgactggggttgcctttatgttgcatgatggataaaatcataggctttggtgtcaggctgccttggttcaaaccgctgggtgagtatctgagccactctatacctccatctccaccccaggaaagtgaagatagcaacaatcatggttcatatggttttgtgaggcgttagtgggttaatctccgggtctggcaattagcaagtgctagtaaatcctagctgttatcatcatgcaattgaattttctccacctgataatggagcctcagaggttggaattttgccaactgcaatcacatcgttccttgaattactccagttatcactgcctgggtttttagacaagggaggtccaggatcccttatcactaactccatcaccccagagtttctgtgggaatatgcatccctcacaggccgctccttagcaactctcacccgtttgaggattgccacccattttctttcgtaactgtaggactatggcattccgagttcatcacacaccgtagtcaatacacatatcagtgatcaccttgtgctcggtcatcttctagatgttggagacacagtagggaccaacatagagtcctcaggacatccctatagagagatgtataaggaagttgaaatcaactcaggtgataagaaactaatgggaaggaaaaagaaaacaacagggtaatatgatggtaactggtaacagttgtgggtgtcaggagatgtgaaattagataaagaggtaaagcctttggagggagcgatgtttgaactgagaactgaatttgggagtcaagttcactgttagagcctggacaaaggagagagaatctgccaaaagccactgaaatacagccaagtgaggctggagaaaaaagagacattttagcctcttacaatcttattcccgaagtctagctgaagtcgagatttagatcaatatattcagcttggacaatcaggccagcacgttgtcaccatcttttttttccctttcaaaaatgtgcatttctctccaagttcacattcttgccaattccttcgatgcatcccaatcagacctataacagcctagaaacttctggctaatttggatttgactaaaacttttctaccatgacgttatgtaaagagattcaattatggtgcgcagtgttttgtgagtaactaccacccataaaaagttaattaatcagggctgtgtcaatttcctcgtgccatgtcaatttgctgcaaggtaattaatcactaatcacccaccaagcagcaggctgagggacaatccctgagtcatttattgtctttccccaaataaatggcacacgcagccaggaagaaacacatcttgcctttcataatatttttatcgacacttttgcatgttgtaatagactgcagcaacaagcagctgcagttcaatggaatatgaatattaaagaaacaaatgagcagagatttataggacattgcgtttctgtaatgtcagtgttgagattaaaccaagcaaatgaacagtgaaaaattactcttccatgtggagcatggtgattagacttgtacattaattagaaatttttgttttcctattcaatgcatttcaaatgagaatgtcctagaagaaactgtttgtccaaaatgtagatttattcacttctaaacagcagtatttaatatcaacatgcatttcatactgaaacaagggtcaatcccaaatgtgtgtttcagggataaatgtatgtgtatatgagaactggagattcgacaaattaagtggccgttttggtctttctatcagtgaccgaaaggatggaagctttctcccccacccaccacccacccaccttttttttttttctgcgaaactctgaaattactggatttttttaaaaaaagaaaaacctttccatttttgtttggagctagaacttaataagtgccatcatgttaaaattttaatttaaggccatttaaagagagtgacctagttgtctgtaaaatcctatgttataaaccaatttgatgtacttttgagattcgttctgaaaaaggagaaaacatattttgccatttggaaaaaatcaggttttttgattcttcattgtgatgttcattgcacgatgccctgcctcggaaattgctgctctatgagctatggctggtggtttatttcgcctcagtatgttacctattatgccacttcttaatttatggtccagcacatggaatgggagttcccccaaggggaatcctgcaaaaccatcaacccgctgttgaaagcacatctgcacccccagaattgtgtaagtgaatatttcctaccataaattacccacagaacaatttcaccccaaatttgcatgaatctctctccatcttaaaaccttccaaggctggggaaatgtgtcattatggagcaaagggagaggaggagcaggacaaagagagcccccctcatccattcggatgcccaccttttccagggcatctggcagtctcatgcaaattcaaaccagtgcacaaatgcaaagaataattgcccattaaagcggttgtatatttttatggctttggtgcagaatccgcccccctgtcgggttttgcatctgctactcttccatctcccccagagctctaaaactttaatatgcagtttataaccctcaagtattttccactggttttgtgttttttctcttgggatttcctggctggtgagatgatctcatttgtgtttattttcgaaggtaagcaccatgttcgtaaaagagggagagaagacacactcatcactgtaaatacattgagtgcagggctcattggaggtgggaggtgggggctttgtttttgagggggagacaggcagttagcagttgacactttagtaaatggcccatttggctggtggatacacccacacatcttccgttctaaaatgttgatttgccgtgatacttgagcaccaccacagcgtgcctcttgttacatccctaaagcttccatttcatcgagttccatgggacagaacttcttattcccaagaactgagatggttactctactaacctcccccagaatatgctctgtatataaatctagctgaagggtgagagtgggtgggctggaaattctcatgtgtcaacaagatgctcaattggtattttctctgaaagctcttgcctgttttgagagaaattcatttttagcttatgagctgaatccaatttgtgttgtagtgataccagatttttctctttgattcatgctggataaggcttcagaaggaatctcttcagtataatgaacctatgggttttcttgtttccctcatgccaaaaactaaggatttatactatatccacaaatcaacctgcgtcctttccattgttccttattgatggtctgcttacatgtgagttaacttgaaattgaactaggaaaaaaaaaaaaaaagcaaacttgcagtgctggggtttagaaatgaccattgtttggtgtctttttcccctaacattgttttttaattaacaaagaggcatttacaaatactggatagggtgatgtttgacttttaacattgatttaaatattttatttcatattctagaaatggagagaacattgtgagtttccactgggcattttgcattggctttattaaatagtcattcattgcccacttactggatctagacttctaagccagggtatttggcatgtctggatccagacatctaaactaggatagatgacataactctcactcaacaaaatataagtgccatacctcaaagtaaacatgtaagaggttctctttctatgtggtcaaaaaacagttttagtcttgtttaatttgtgtctgaatcatctgtccaggtaatcatctcaaatatacattttaccatgttccagaatcctacagaccaccacacctgtaggcaaataataaaagcatccattcttccacactgtgctgggttttttaaaggaagtgtggcaaacagttgtgtgtgtgcatgtgtgtattttgcccttgaaatggattattcgtgttagtggcatgcgaagaagccatgttgtccctaaaccaacaattgaggaaaaaattatttatttatttattttttttgagactgagtcttggtctgtcacccaggctggagtgcattggcgcgatttctgctcactgcaacctcctctacctctcctgggttcaagcgattctcctgcctcagcctcccaagtagctgggactacagatgcataccaccacacccagctaatttttgtatttttagtagagacggggttacatcatgtttcccaggatgatcttgatctcttgaccttgtgatctgcccaccttggcctcccaaagtgttgggattacaggtgtgagacactgtgcctgaccaggaaaattcttctaataaagatgggaagaaacacagaaggcacagtcataagtcagaagagtttggaattatcaagattgttattttctattgttcctggttgcacataattattttattcagggactgttgttgctgggttgtcagagagcatggtctggggctatatggaagggtgagatgtgatgaagaccctttaataggtgttacctgtctggggccaaaactggagtcccgcttttcccctgaacaagaaacaattttaaatcctgatagtgtgctgccatcgaggagaatttaaatgaattgagggctctgacaattccaagtgcaacaaacttggtccaagcagcctccccttgcttgattgaaatcatactctttcaaaatctggttactttttccgagacagtgaaaaacgtacaagggtagaagtggaaattatctttctagggattgtgactaagtttcagttgtgttacaggaaaagggttcctatccagaccctaagagaggattcttggatcttgtgcaaaaaaagaattcggggccagtccacagtgcaaagcaaaaggaagcttataaagaaagtaaaatggggaaagtacagctactccatagacagtaggatgttcccaaaagtaagaggaggagcatgtccaccccttggtataatacttgtttatataggataaaaaaaaataagatcatggggaaatgtgctctgctacaagggtttgtgataaaggattaattttcttaattactatattttgcaagaatcaatattatctttaaagcaaatttaggaatgcttctgttcacaagatattgggatatcaggacactcctaaagtctgggtctgtttagtaaacataatcaatctgtttccttaaccacaaacatctagaggccaggaatacctaactttctggaaatgtagtccagcatgtcttggcctcatttttcctagccttcacttacgatggagtcgctgtggttcgaacacctctaatggttgtgttgcttgcatgctgtttatctgcaaattctgagcaggtcactttgtacacaggacagtgttatagaaggtggacagtgaagaggtggtggctgtactctcccagaaggaagacaaacattggttaaccactgacagggtgtccaggcacagtattaggtacctgatacctgcttggtaccagttactcatcctaactgatgagcagaacgtggagatcaccacccttacgcagcttgcatgcacgcaccagtaagcgtccttctccttcatttctgtgactcaagctaatgatttttacatgaaccaggggaggaacagggcagccctctttagaaaaaaaattccaaagtgactgaaaggaaggattgtaatgaaggcaggaattaataaagaaatgaagggagaggagaggaagaagagggagaggaagaagagcgaggggagaaaggaaaaggaggagggaagacaaaaggaagaaagagggagggaaggacaggagggagggaagacaaaaggaaggaagaaaaagggaggggagaaggaataaaaaaggagcaagtataagaaggaaggaaggaatgtaagaaagaaaggaatgtgatcgatgagcatttttctaactagagatttcacgaaagggccccttggccagccctagattaacaagaaagagaccactgaaaataccaaccacccaggacacttgaatcctccagccctttctccatgaagcctctggcccaaagcatgacctgtggaactctcttttttttttttttttggccaagggtacctagccttccaggaaggcactatttaagccaggaattgattttcagtccttcctgtgttcttttcacaaaataagaagtcccccaatgtgccctgcttgggagagcccaaagaacctcctaggaagccttgtaaatatcctgcctcaggaaatccattttctccctgtaatgaagagggtacaaaatggaatcctggctccacgctcttaacagcacgtgctcccctctctctctcttgccaagcttctgtttcatgttatatctcaacatctaaatcctccaagaattattgtaaaagctgcttgtggctgagagggagcttgtctggctcactcggctccatagccagtgacaatgaatgggtcagcataattaccgtgtttcctcacacaggcagccagctgctctgccagattgtgaatttttcattttctttatttcaaaatccagggtgttcctctgaaaacttaatagttgaactgtggcaagacagatttggagtcaaggccattcccactcattttctccccagtcctgaagcaagcgtctcatctctcattacttatgggcttttatgatattaggatttactcgtgttccccattaagaccccacacgtctctgcggtttcaagcataccagttgccacgtgatccaagaaactcaggtgctaggagctggcaaaaaaagttaaataaaatggcatgatctatctttagcaagaataaaaaaagttaaaaataacctttatggtcttctcagatacaaatagaaagacggaatcattctgggttctacaatcctcgtattttacccgcattgtgatagaaagatgcggtagaatccatagaacaggacggctgtgggacctttaagaacacacagaattccagataatagccatttggtcttcactttggtcgggttcgggggttttatttgggcccttaaaattgcaagagtaatttggaatggctgctgtggcaaaccccacccgctcccttcacccaccatgtaagtacaaacataccctatctatgggtgtaggtgtaattcttggagttctaagtgcactacatggtcaccccgtccaacctccttggtcgcagccagggcctccagtgaggcttctcatgcacattttttccttccaattcttttgccttttgctccttctgcaaccctcacctgggtccatgcatcagtgtatgtggaaaggactctgaataatggggagacataaggtggaacgcttctactcctgaagctgatagcgggaagggaagaagctcttcttggcagtttggatagagggtggagacaactttaacatgaaatgaactacaacccctgccccttgagaggtttgctcttctgcagaaagcctggaaaaggagttggttgtgctgggttaactaagagcatttccttcatggtgggccttttgagcctttgctgtggctctcctgggacagggacttaccaaatgcattttttcagaaaagcattctctgtggacacagtttgggaaacaatacctgctgcttagtgagatgggacaagcgtagtgagtatggtgagagcactgggagggttagagaagcgaactgagcttgaaggaaaagtggtttgctgactctgtgggccctgatgagttaggatttgcatgagaagggaggaagggcatcccaggtagaggaaacagtgttggttatcaggggacaggggtaaccggggtaaccatcaggcatcctctgcggacacagtttgggaaacattgcctgctacttagtgagatgggacaagtgtggtcattatgctcagagcactgggagagtcagagaagccaactgaacttaaaggcaaaagtggtttcctggccccatgggccctgatgagttagttaggatttgcatgaaatgggaggaagggaatcccagatagaggaaacagcagtagttatcagggggctggggtaatcatcaggcttaattccccttcctaactcctcctcacctcctcatcttgctcagagaattttacccaagggaagatatccccgcccacattcttcttcttatttgagaaaaagtcttgctgtgtcactcaggctggaatgcagtggtgccatctcgactcactgcaacctccacctcccaggttcaagcaattctcctgcctcagcctcccaagtagcgggaattataggcatgcgccaccacgcctgaccaatttttgtatttttagtagagatggggtttcaccgtattggccaggctggtctcgaactcctgacctcatgatccacctgcctcagcctcccaaagtgctgggattacaggcatgagccaccgcgcccagcccccacattctctttttaagggtcggggtcccagacttatcgcgtatttgtaatcatgctggttgcctttgcctttaaatgctgcacaggagttcagcagacttatcagatgttggtaataagctgtttctcatggcatgtgtggtttgtgcactcataccacatacatgtgtcagtgggaatacttcaattagaagttttaagaagtgatatctgtacatgaaggaaactggaaaaataggatgggggaaagttatgaataaaaaccactcatgcagttcggccccagagattgctagcatgtggaaagttgtgtgtatgtgtatacaaatatgttcatatcagcatatgtacatatatgtatatatacatgcacacattcatacacatgtacacatgcatatacacatatgtgtattttgcatgcaaatacacctgtacatatatacataggtatatgattgataagacatgacacatcttgcaatctgcccttttaaaaatatgtttgtgggttgggcgtggttggtccataactgtaatctcagcactttgggaggtggagacaggaggactgcttgaacccaggacttcaagaccagccggggcaacaaagggagatccccatctctacaaaacatgaaaaaattagccaggtgtggtagcacacttctatctatggtcccagctacttgggaggctgaggtaggaggatcacttgagccctggaagtcgagggtgcagtgagccgtgattgcaccactgcactccagcctgggtgacagagccagtccctgtctcaaataaactcattaattaaatactcatgcagtgagcttttctcccgttatatagaattatttgcaaatgtttgtcagtcaccacattctcctgggcaaagggcccactgtgttaactactcatcctctctggagtcccaccctggccaccgtgctgctctctgctttttaacctcttgattccgggaagcgggcgggggtcctgctgggaccctgtgcagggacaagggttcccggggcagttccctccacagcagggtgtgcatctgacagcctgtgctctctctctctctctcctcttgccccgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcgggtaagtggggcagcctcctgggtgggcctccctgcaccagccctccctccccagaggcacggagctgtttgcgagcgcatgatggtcttgactccccctccgccacccccagaaccgcccccagcatgcagcccggccgcgcacctgcagtggagcaccttgctaagagtattgaaaaatgagtgtaatttgtcctgtcatggttggtgcctttaagcattctacatgtcacatgttgttatgtaaattctctttgagactgaatgctggagaacagagaaatggttacagccaaagatgtatttctgatgattgcaaacatctggttattaaggaggttggaccacatttgccccttgaattcctccacagaaagaagtgaggttttcatacataaaaatcactggggtcgtcttgctcgcctccccagggatatcttggcttcaagggtcacgaacctttgcctgcaaagagaaaattaggtgttgagtcacatgcaaacatacaagaattaatgaaattggagttaagatgcgttgcagttgcgttttccaaaatggcatttgccttcctttctcctctgtgggaacaatgcagattagtttgtttcccattgccaatttggtccttctctgcacagactttgatattgccaggcgaatgtcaaggaatggtgtgaatgctcagtaaaagaaaaaaaaaaatgatactggtgtgtttggtggcagtcttgaaatgctagtctgtccctcttttaaggctcctgctagaatattcttgcacctctgcagccagggagaaagggatacctccaaggcagtggccctagaccaggggacatttgcaaggtctagagacatttttggttgtcacaacaggaatggagagatgctatgtcctctattgggtagagtctagggatgttgtttgacagcccccaacaagaaagaattatcagactcaaagtcagtcatgctgcagctgagaaaccctgctctatgttaaattcagcgatccccagaaagcctggcactaggcttccctggccagtgactggctttctggtgtgtagaagaaaatatggctgcatttaagactgtgtgaaaagggttaaatgcccttttcatagctctgttgcttgtaaatctttcagaaaatctacattagcctagatcatctattatactcatgacaaaaagaaacactttttttcattacatattcattctaaaccagagcatttgaaatgtttgtttcaaaaataaatgcaataaagttaatggtaaaaagaaatgagagtaggtaaaaccatcagagaagggaaagttaaggaaaagtagtaagacaaagtccatcaaatttcttgtgtagtcatttgaattgggtcaactttgagcttcttggacaaaacaagagctctctctatgcatacacatattttaactgaaaagacggtggatagtaacaaaccaagaatgaactggctataaattctccctaatgcctgtcaaatgtatttgtatgtcttaagccttttatgtgaccatgcaatataaggagttgtcgatagtataatttttatctctggtatcacagcaatgagcccattttatggatccagaaatgtaaaaataaagatttgttattcccaagatcatgtaatgagttatgaaggaaaaagaaaatcccaagttacctttgggctcatgtaattactaaagcaagatttgtatgctataaatccaaaattgcacttataccacattcgtttgaaaattgttctcagtacatgggagttgaagggttttagtatatctaccatcagtatctcactactatattgaagagcaaaagaaacaatagaggaaaattatatggtttatcctcacatgaccaatttataaacatctcagaatgacacacctgctgtaaaatcaaaattaaattagctaacttataatgaacatgctctttgctgggaataaccatgcataactaattaatgccatgtttcaccagggagagacacaggcatttccaaatgatgaaacaatgtgtttgtaactacttgggatgaaaattaattttaatattccagcaatatctgtgatcagtttggttatagtggtggattgtacctccttgctgataatagtatggctggcattctaaagccatacttggaagcaagatcaaattctcagcagagaagcaggagccccagcaggactaagattgcaagcattcatgtctgcaataacctattagagcaaggtactggtcaaaaagaaggaaattcgtcttgttgcctgggtgtttcactggattacagactcctgggaatgaattggcacggaatgaaaaactttgaggccaccatcttagaggtttccttttcctctggaataaacagattaggttgcaggagatggcaaggggatggctcctcttggaaaggaagagagcagagtgggacccagggcaggagctggctggaagagcaagaacccctatcttgtgttcagggagagcaagaacccctatgttgtgttcagggaaagcaagtagcatagaggttagaaatacttgttttcagaaagtaacatcatcaggattcaggtggtccagagagcagatttcctgtagccttttatctctaaattcctttggaggaaaactaagatttgactgacgtctttaccccagcccagtgcagctcaccctatgactcacacctattgtgttttaggcactgttgtgtgctgaagagacaaatggcaccttgagaggtatttcttctggttggggcagggggtgacatacaagccaacaatttcaataaatgtgataagtgatacaagaggatattgtgtgaacactagggaaaggtccttagcccagcttgggtgtttacagaaggcatcccagaagagaagaaatatggggtatatataagtccaaacatttcctaaattgccacagtgaaatcttatcctgtgacccctcctccacccacacccccagcaatctccatcttttctaagatgtcacctaacaaactacatttaagaatttgtttccactgtcaccaattgaaggcatatctgccaacctaaatctgttcttcctgaagtatccaatatgaatctatattgttactaaaataccagtcaaaaaggtgtcctaggtccatgcatggcttccacattttcttcctcctgggagattgaagaaaatatcctttaggatctccatggctacctttatggaagcttgggtaacccttggagatatccaacataaagatagtcacaccagtagagtccctaaggatgccctacattcatccatttccttttaaaaaaaattttttttgagacggagtcttactctgtcacccaggcttgagtgcaatggcacgatctcgactcactgcaacctccacctcctgggttcaagtgattctcccacctcagcctcctaagtagctgggattacaggtgcccgccaccacacctggctaatttttgcatttttaatagagatggggtttcaccattttggccaggctggtcttgaactcctgacctcaggtgatccgcccatctgggcctcccaaagtgctgggattataggcgtgggccactgcgcacagacattcatcaatttccttttattgatttgccttttccttccatgtcttgatattttctgaagcccttccatgcagctgaagaacatcggttatgaagaggcccttttttgtctcacatgcctaaatagaaacctcttgggacattaacacatgatcattcctccaggggtagggaaagttgtggaccatggtgggatcataggtacaagtggaaaaccctgtaccaaaccaaccaactcccaattgattgccaacatcaattgaatgagactgaagagttagaaagtaatgtctacatagcctatggaattttatagtcctaggaagacactggatttaaggtaaataagactgggccccaatattctacccatactggcttggatagcttacttaacgtctatagacacagtttgcttaagcgagagtgggggatatatctgcccccatagagtcgatagagggtgaagcagggaaatccatgtaaggtgacaacttggtccatcttatgacatgcattcagtgaactgtacctactgttctccaggttgatgaacttagcgactttattaaccacccacagtcttctttctcaacatcccccttttgcttgtggttgagtacaaaagaagatcccatgtctctccctctatgcattatttatctttgctagggggcacttgcagtttcacagacctccatttccttcaagccacagaaatggttgaggcacttgcattgcttatggaatatgtagattgaaaatacaatattgagtagggaacagtcacagagcagagtagagttttccttatttctccttgcatttgatcctggactcaatttgactgagaagccacaatgcccagtctagcttcctatgactcacatttgggaggaattacccatcaggtaattgctgttcagggagctcacaagctgattatctgtgcatcaagacagcaagtggaggctttggagacaaaccctgtagacttagtatctttgatgttagaaaacagcagctaaatcccaatcccctccctcaaagaggaactcgatgagtacctattaggtaccgtgcatatttcatgtgagtacaatggggtgctctaatggagcatcacatgagttatttttgagatggagtcttgctctgtcacccaggctgaaatgcagtggtacaatctctgctcactgcaacctcctcctcctgggttcaagcaattctcctgtcttcagcttcccaggtagctgggattataggcacatgccaccacacccagctaattttgtatttttagtagagacagggtttcaccatattggccaggctgctctcaaactcctgacctcaagtgatctgcccacctcagcctcccaaagtgctgggattacaggcatgtgccaccgccccctggccatgtttttattattattctaagcctaagcatctagtgtcagctgtaggcttttggtcttgttctctaggtatctctgagtaagattttctgccctttctcaggtaattgtcatacatctgtgtaaacttcccagagttaccttgagaagtatttgagaagactctatattatttggggtataggaaagatagagcagtatcccaggagaaaacttaaagctggtcagtggaagaacaaatagatcctttggaaatgttttcacgttaagtcctaaaaaagtctccaacaacagtctctgggactatgggcatatctttctgtgtacagatcagccatgctttctggttttatcttctaaatatctaaatccgcaacctgtagtatctgatgcttaggaactgtatttagtataaatactaggaacaaaagtcatcattacccattctcagaatactttagacacaggggcgtccaatcttttggtttccctgggacacactgaaagaattgacttggaccacacataaagtacacatacactaactacagctgatgagcaaaaaaagaaaaaagaaaaaaaagaatctcataatgttttaagaaagttaatggatttgtgttggggctgcattcaaagttgtcctgggccacatgcagcatatgggctgcggtttggacaagctgcctttgcagaattctttttataaagtgtgacttcttatttgctagttttaaaatgtaatccaaacagcctctgaatagcatgaacttatagacaaacatgatgaataagtggtctttaaagcctttttttggaggggagaatgtgaaaagacattttcacagatgcctttaataatctgattaaaaattctctaggaaaatacgtacaaacagcacacacacacacccaaattctatacacatgccagctagtttctgatccccccaatatccattaaaaaatagcggtatttgaacaccttaaaaagtttattttctagttggaaggggcctcagggtagaacaattgtaaacagccttttctataagaatatacttgtggctggtatatatcatattacacgagcagattgtatagtttgggcattttatactttttttttaaagtaaactaattttctgtagtgcagtcactccctgctcgcattcattcaaatatttaactactggtattacttttctaagaaaataagatgtgcatttgcattatgtccttgcaaaagcacattgagtcccgatgtgattgacaaacaatacaagtacctttgcatggctagacggaccatctctgcattgaaatatgactgcgcctgtttagtgcgcaatggtaactcccttctctcctaactgttccgtggttaatttatctatagctgcaccgcagacatggatccctgtgcctctttccctgcatatcttatattttaagtgcagctgtttgatgaggctttacaaattatttggatacatttttggaaactagcatgaggctttgtgatgagaactttcccgtaaccagctcctccattagaatataacctaggaggctgaccttcagttttgtctcaaatgtaaagtaaaataacacttggaggatggtgttgcatagagctatgattctcatattcctgggaccaatagcatccgcatcatctgttaacttgttagaaatgtaagctcttagatgctgtcatccggatctattcaatcagaacctgttggctgggcatggggcccagccatctgtgtttcaaaagtcctccaggtgattctgctacacattcaagtttgaccaccactgcctgccatagtacttaagagtttgcactgtggagccggaccccctgggctcaaatcccagttcagacaatacccaactctctttcagtttctacatgtctaaagaggcaatgatcatattgtccatctcatgggggtattctaaggactgagtgggatcatgagcacagaaaggctagactagggactgatccatggtaagtgttctgcaaatgtgagtagtgggagtaatggtgctcgtgctgttactattagggagaaaaacaatgttttggtaaaattggcttcccattacatggctttatttcacactgccggtgaggatggctacattgcttccacattttttagagttatcctaaagatagatcactcgtcctttccatttctctccaatacatgtgcactttgaaaacaagtaatcccttcatgatggggtttataatggcagctacaatcatctttttgctgtgaagccaccatatttagaccctaatgcttatacgtttccccccagccctccaagaagccagagcgtgggtcttccagccataggtcttgccttgcagtaccctcaccccaccaccctttgccttgacagcacttcactcctctctaccgagccaaggctttgaggtttctgtgccatttgcttagcctctctcgtctctgctgctggccctgcctccttccgttccacattcagggcacctctgttgctgtctcctgcagtatctatctcagctgtgattctacagttttatgcataatttgtgactgtgtgtcccacttcctgtacactctgggagggcagggttactgagggggctttcttcttcggtcttcatgccttcgcatagtagttggggtacaggaaagctttcagtcacagagaaatagtatgtatttggcttgtttgagcttttcacaatgagaaagctacactagttcttctttggttcagtgtttcatcaatgtaggatgtcagcaacacccaagtaactttccatagcccacagtggaggacaaagcatggcaatcaggttaccctactgagcagagactcctaagagcaaacatcccggcatgttctttcctcacctctgggcaatgttggtacaaataggcttgacatggaggcacaaaactggccatggtgcataacaacttgtcttaatgaaagaagggatcagtttcttggccagagctcagcctcagccatatcaaagaaccccaactcttggcccacacccatgccatgtgccccgttggaacagcctccaaggcctgggatcaattcttctctccgtcatttacagaagatcagagacagatgaggttccaccattgagatctttagaagtcattatttcccatatttaaaagtatgtttcatatctcatgaaaaatacattgtttacttctagactgctgtctagtctcttgccctggtctcctaattcaggttcgagtctgttaatcgtatttctcctccattgacaacagccactgatactgaatagccaaatcagagacaaacctcagactcctcccgacccattattgaattctacctggagttggtaaagcaatgactcaatctccttctgacgccttctcatgcccacccttccctctaaaatatgaaccctattcacccagttattgtccatcttctaggtaacaagcagtgtgtcaggaactgagaatagaatgttagttaagccacagggtgtagcttttaaggtgcaacgagtcacatgcacacagacctttaatgtgaggcagaaattgacgagtggctctgataagagtctgaaaaatgatgctggtgttcataatgggaaaagtcacccagctgcaggtgggcaccgggtctcaaacatggtgacctcgttagagctacagtgttaagcatgatgccacccatccctttgcaagcattatcttacgaaaccctttcttgaggtaggcacttacctattttccctttttaacagatgagtaagtgaggttcagatgtctcaagtaatatgtgcaaaggcactgcactgttgattgaggatgctgcagtctgattcaaatgcccatgtgcttcccatctaacttggctcttgaatggtcatgtcactgcttttggatgaggatactagaataaagggcattgccagcacaaggcattgcacgtgcaagggcatggcagcatgaaagaatgggatggagcggttttgatatggctaagtgatcagtcctgtggtttgggacccaaactaaatatctgttgctccctctctttcatcagaccttggcagagggtggctctgccttctgaccccccaaccgacattctctatgttggaaaagttgaaaaagaattcaaagcatagctcaggacgatgcacacctcagcatcttggattagggctttatgccacttcacaagcgctcttgtgaactgtagccctcccggatcaaatatgaacaacagctgaaagctattcctaccaacctccttagtgtgtgaaatccctgccacatttttaaggacaatggtacttggagtttagtcaatcaactctgaaatactctaagcagcacactagagtgttctccagcaaaccagtgtcacagctgcgtgtgtgtgtcagtacagcgtgtgtgtgtgtgtgtgtgtgtgtgtgttgtaaaatgccttcccttggctcaatatgctttgcttacatgtgggttcattctgctacagaaacctgctggaatcctttggtattaaagttgtgtttctattagaacctcagcttcattcaatggtggggctcattggtcctttgccagaatcataagtcatctagaaacatcatgggaaggtatcggggaagattgtaaataactatgatccttttaaaaataggcatttagaaacagcttcatatgcaagatgccttgtgatccttacaaaaacctgtgaaggctacatatgattctcgttaaactcgttttcatgcttaggaaatacaaatcagtttctcacgaccacgtagctaagagcttcttttcctggttgttttactcaaagcataccaaaaagcttctggggaatcattccctaacccctgtccccagccctctgaagtctcttctttctgggatggtcactacatgggtggcaatcagagagctgctatcagattgggcttgttcaatcaaggtgtgggtctttgtttagtctagatataatttacgtgaacatgcagatattcacatgtatacacccttgtacatataagtacacaaatacatataaataagtatacacatgcatatatacatgtttacatacgtgtatacactatagacaaatacatgcattcctgcacttgtccatattaacacacacaaatatgcacacaatgcacttgtacacatgaagacatgtctgcacagaaaacacattcttgcacatgtacccatgctcacccacatactattagagatattctccattaaccataaaataatgcacgtgcaattaccaaatataatacaatgtgaaagaatatagaagaaaatttttgaaaccatatgtgttgtccacctcacctaaggccattcagctctagcccatactgagaatgctgcaatctgtgtgtcgacctttacaatccgatttttaaatagatgttttgggtttttattctgtggggtagggggctatgtggtttgattgccaactctgacctgttaagatgctcatgtctgtctgggccacttaaatctcagtcctctttgcatttcaaagtcgtgcctttctgtacccactcctgagagagtgggaagtttgggacctagcacaccgccaccaccacatcctaattctgggccaacaccaaagcccggcctaattttctcggtttgctcaactgccgttgtctccaacctccttaatccaatgtgaaaacgatcctcggttcctgtgttttggatcttgtgaccagactaacctcgccagtgcaggggttggtgtgtctgcatgggaaatgcactaatatggatgtttctctttgtgtgtgcacccttgcagtgttgtttaccaggatggattttatggtgcagacatttatgtaagtattcattcacgtgcatgccatccccgtttcctcctggagtcattctttttacaagtttgctgtgaatttctctacttggcgtagttgagtttctctccttggtctgtaggaaataattccgtggtttgtcttgcaggacagaaagccttctgctcttgaacttgtggcagacatcactggctgtttagtggggtggaattaacccctcgatcaacttcagaacgaatgcaattcccccaaaaaggtggcatttctttcatgccaactaaagaccccacttcacccacaaagaaattgtctctcaagttctcgatatgttcttcgttttcagtataatatttaggataacagctgtagtcaccagctgcagagggttaaaagatattttcatggctgctatttttgatgttttccctaaaatatcacagtagccttaggaacactctttctctctctagacatggacaagtttagccctaaacatctcctgattctcttaatatgtatgtcaaattgaacattgagcccccattttctttaaccttttattccatttcccccaattacctgacttaaaattgcttgctaaatagtaacactttaagtttatttttagaaaagagtaggctatttctcattatgagaacaagaatttaactatgttcatctagaggtagttattctccgacattatgatatgagcattgacgatatgaaaatgacttggagtaaacacaattttgaataagtaggcagtgttgggagatattccctaaatcacaatttttattacaaaagacctcagtcaatgggattatatttgttttacagactagatagcaaaaaaatcatatttctgatgaaattggtatcatgtactagaagatgaataaggcactgattattgtattccttttgaatttcaaatcattacaattttgagatatagtatgtatctccatcaataatagacttagttgagttctactattgcatcaagtatacttactataatctgtgggttagtattttttcccccgtaataaaatgagtgaacaacccatatgtcctaattcactcagtgatcaattttcttcttttttgtggaacttaagcttttctgtctcatgtcctcttttttcagactttcagattttaaattatgaggcaggctggggctgagcagtctgaagcccattcatttcctcaggcacctgctaaacccaatcaccagtcctggctctcgactccatgcagcccatgggtagattattgcagatgggaggagccagaatggtagttggcatcgcagaatttagggctttagaaatgaaagggaatagacaagggatagagaaatggttttttaaaaaatccaccaaaatggaaactatctccagcaacacctacccaagaaaaaaaaaatgcagattttcctgagtttagttaaaagtatttcacaatcatttagtgagtgtccacctcttcacgcctcagtttcttcaaactgacaataatttattgaatcattaatgtgtggtgtcttatgcagatatcaaattggtgtcttcttggcctcagattcttgagtagcaggaaggagaggctgcctgaaggcagggtctgtggagctcccacaaataaggaaaaagaagggactcatttaagtgagtgcgagtgtgtgtctgtatcgattggggcatatcgctgcatcagagaatccacagagcaatgcaaatagagaaaaaacaaagttagaagaaggaaatatgccaaccacttgactagagaggaaaaagaaaatttattcagggaagaaagccacagaagtgtccctttgtgcttttctagttcctttaggagattttgtctctcacacattcatcatgtttgggccaagcccactgggtgcagcggtgcagctcgggaagcatcagggtgagcttcaaggacagagtttcttccagtcctaagttgtctgatatgtttgttcataaaactgccctttctctgacttttcaggccacgacccccagccagaaattatcgttttccccactctttatattataatgacaataagatttttcagtgggggagcatcacatatgcaatcaggtggcagaaaaagttcctgcaatatgaatttagagatttgattacccagcacatgtttctgtcctgtctctaacagtctctggaatctggtagaccttcctgaatattttgctttgtctgatgatgactttaacatattgctgctggtgtgcatccgtgtgtatactggacagcaggaaactagcctgtgccactgcccagctcagcagcagaacaagaggtctttgatgaccataagtttaagaaatataaatatgttctgcaccacagaatatacagaacaagattcatcctagctagaaatatatcataatcttgaatgtgctttttaaagccactaccctacctcccttgagataccagcatgttctgatgagtggaaatatccccaagcttcgtttttaaaagagatgatggttaaacagactcttagaaagtcatgtgagcttctactttaaagaaagattttggcttactccttcaagctcgttaaaagtagtacacaataaataggtttagggcaattgtcaacggccccgggatatatgttagacacatcagatacctcgaatagatttaaacctctttttgttattattatattttttgagacagactcactgtgtcgcccaggctggagtgcggtgcaatgtcatctgtctgcaacctctgccccctggaagcaattctcctgcctcagcttcctgagtagctgggattacaggcgcctaccaccacccctggctaatttttgtatttttagtaaagacaggatttcaccatgttggccagggtggtctggaactcctgacctcaagtgatccatccgcctcggtctcccaaagtgctacgattacagacgtgagccactgcaccaagccataaacctcttctttttaagtttattgggtagtcagtttctagcttcggtcactgctaaggaagacaaaggaggatactgtcagattcttcctgctcaaaatgttctccatcctggcagtatatcagagcaggtcaacaactcaacagcttgcatctcagaactactgggcttttctaggtgccctgctctctcccctcccccgtcctttgttcttcaaggtctttccatgcctaccacctgaggttggagccctcgggcattttttagttctgccaaagcacatagtcattgaaagacctgcgtgatccctgtaactggcaagccacaacctcttctctcaaatgacctccttctgaaagttttcagaggaaagaggattgaacagagagggacagatgatcacagatatcttgaaattgccaaagggagtagacttgttatgaaatgctgtgagccagacacgaagggaaaaaaccaggacagctcatttgggcagagagcaaagacaaagccttcaatcctattcaggagctgagccctgcaggaaacccactgcctctagccacagtggagaggtgcaggcacagtgtggttggctactcatcggaggtgatgcgggggttgtctgagaatggagggtaggaatgatctttatctgagtcccttctacctgagaacagaacagaacacacacacacacacacacttttgtataaaaagatagataggaatttaattttcataatgaaacatatcaaatcttttgatatgttcactattattgcttagtggtgcacctttaaatacattcattttaattaaaaagtggatcaagttaagcaaactaaatggtagagtttatacaaacagagttgcaatgcaaggactaaggttcttagatctacagagtctctcatacttggaagtgaagctatagatgttttttgaggtggaatctcgctctgtcgcccaggctggagcacagtagcacgatctcagctcacttgcaacctccgcttccagggttcaagggactcttcaacctcagcctcctgagtaactgggattacaggcactcgccaccatgcccagctaatccatgtattttagtagagatggggtttcgccatgttggccaggctggtctcaaactcctgacttcaagagatccacctgccttggcctcccaaagtgctgggattacaggtgtgacccaccatgactgacccctgaagctataggttttatgaggctagaagttgaccaaggagtggaaaacaagcattgcttaactgaaccaagacatctgttggttgaccttctcagaaagagaccaaaaagtatagcatttgatcaaaagataactattaatattacaaatgaaaagagggagagaaagaaattataatgaactgttaaaaagaattgacaaacggatagaaactggaataacatagtgaggtgtgacaatggtaagagcagagagaaagagtgagaggatatagagtataaatgttaaccttgttcctttttattaagaacatcctaagcgtcctaacattagacgcaaccatgagggccgcctagcaaatatgtcttgagattccagtgcatttttataccattcctaaattctgtataacaagtttctggttaacaccatggctaaacacaattatttctgaattcctgtcactctgccacccatatgttttaaaacaaagaggtatcctcatttcactgatgtttaaactcaggaatgagatgtgtcagtagctttgggaacatgtaaagctggaaagtaggaattctttaaataaaaactcctagtctttcttcctgagaccttgctttcagtgtgaggtggctgaggattggcatttgacttgccgtccgcagtcaccatagtggagacctcagtccaccaagaaatcaggcgaatgctgtgtttgcaatgggagagacaagatgttgagtgttttacctgtattacgtcatctctcctcaccacagcccttgaaacaaggaatcttacctctatttttctgttgttccagaagagaaacttttttgggagacatagcctccctgtatcacccagggtggagtgcagtggcatgatctcagctcactgcaacctctgcctcccaggttcaagcaattctcctgccttagcctcccagatagctgagactacatgcatgcaccacgacgcctggctaatttttggatccttagtagagacggggtttcaccatgttggccaggctggtctcgaacttccgacctcaagtgatccagctgccttggcctcccaaagtgctaggattacaggtgtcagccaccacgtgtggccaacaggaaacttttttttccagaaaaaaagaaaataatttgtccaaaaatcttcagacactgggccttgagcccacatgatttgactactgagtttaatgctgaagccctgagcccacaaactcaagtcattgcgctagttgagcaatatttgaaaagtacggtgaaagatgggaaaggaagagggagagaagtaaaagcataacggggtggttagaccactgagaataatatttgtactggaaatattcaagtaagcagtgaactaggagcgaaaggaggagagagaggaacaagaatgttatcaggcatcgctccgtaagcttagacttttaacataaggaagcaaatttaaactggaaaggcaggctatgtaggaaaaagtatacacaagcctttatagggtacgtccctcagtctcttcaagtgttcagccatctcagtgtctgccctagaattggagaattttatttcaaactgtgaccactcacatggaagattaatcttgaccatgaatgactcttatgtcaaaaaactgcatcctagtccgcacaaggattctacagagaccttccttgccagtgctagatttgtatgaaatgatagcattttgatatgtatattaacactagtttacacacacgcacacacactcatatatactcacagttctctagtctgaaagtattaaaaggagccatcgtagcttcagtgtaattcatgaattcatgaactgcaattttgctgttagttgaaattaatttaacaagtaaaggcatttatgcagttatggttgctactgtgctgttttcttaactacttcaataataaggcattcatcttaaatccttagatattccagaaaattccaatcatgagataaagagatgaatgtgaaatagttaatttggactgttggaatatgctttaagaggcaagaagccatgaaattatctttttcttctttagaaataaacacaagttataacacaaagtggtttgatccccatctccaccttgatactctccattgcagagatttgcaactaaaaatgtttgtcgatgcccagtgcccctttcagcttggtgggccagtcccaaggcttggtgaagtaagagagaagcaaacttgtaaatgaattgctctggaatttgtctgacttatgcattctcttttatttatttcatttttgcattgaaaacattacatttctgtttccttatagagtagtgtatcaagagcctgtgtatggcaataaattgctgcaggtatgaaatcccgactggtggagaaactcatcactatgattgtgggtttgctgtgaaatccttactaacaagataattctggggaggggaacagttctctaacataggaggaaagacttaactgaattttccagttttaatatgaaatctcctagaatagaggtgaggtggctatccctgtatctatcagtatatccactgtgttgtggcagtttcttccaaatatgggtgctgtttccatgactgagtgctgttagctggcctcagccatgagctttgttagatcctgagtgtgtcaaatggtggtctagcttggctgttaattttttagtttaaaagctatctggactcaatcagtataaatccaatgaaaataattcaaggttctaattgaaccaattgtctggataattttttagtaggttcccagagtgaaccggaatggggttaaatcaagaatctcatgtgcaacattaagggccagcatacctgacatctaacataaccctccctggtcttagtagagctgatcagaaatttatttcaagcctgttgttatagcttttaaacctatttctcactgctaaagcaaccaccaactgaacaaatttgtaggaagaaaaaaagtcaacatattcattggaatgtggctggcctagagtctccaaatttggtctattacccacattgaaaccgtcaaataagatgaatgtcaaactgaggatgatcagtgagagttgtaggacattactttccctatctctgcaattcccttttttcttcagtattatgagtgaattacgaaagtactttttgtaaaccatgagaattgactgagttttaattaaaacctgaatgtgagaaagaggtactttgacctagtaaagagcaatatggttaaaattcctgagatgaactttcactgtcacatttcaagagaactggacctccaactgccacccttcaaaaatagatggatgtggccaggtgtggtggctcacacctgtaatccccgtacttcgggagacctaaggcaggcagattgcttgaggccaggggttcaagacggggccagccaggcctatgtatcaaaaccgcatctctactaaaaatacaagttagccaggcgtggtggcacatgcctgcagtcccagctactcgggaggctgaggcaggagaatcggttgaacctgggagacacagattgcagtgagccgagattgcgccattgtactccagcctgggtgacagagaagactccatctcaaaaaaaaaaaaaaaaaaaaaaagaacatatagataaattagggagataaatttttcattttaaaatgttcttataagtattatatagtaaataagatttaagttgtatgtgtatataccagcacacctgttttgcaccaagtgagacttgacccttgcatattttcatcataaagggagcctttacccctagttaagctgatttactttcctatgcactccagctgaaggaagcatgcgtaacacgtacatgttacagtcctaccgacgcccacgtctccctagcacacacaggtttcccctcccctatttcactgtttggccggtagaacatttattttcaaaagtgatctaaagtgaaaactttgatttaagcctcaaattctctgagatgccttggaggtccctcagtgttcatgaatattgtcccaaggagttccacaaacagagtaaccagtttaatttaactgagcatctgccaaaccagtttggttgtggaaattttcctttccttgccaccattaataccccacaagcataattttgaaactgctttattagctaggcacagtggcttacacctgtaatcccagcactttgggaggctgaattgggaggatcgcttgatcccaggagtttgacagcagcctaggcaacatagtgagaccccatctctagtagtaataagagaacaaaatgctttattggagcatcatttgaggtgcttaatgggtaactacctcaaaggacctctagaggttttgctaacaaaggaaacttctcagtccacatgagtggatcactttggtggcctcactcatttggtggtggtggcaacaagatgcacaatgacaatttgaaatttttatataaggttacatttatattttgctgcccatcctgtgaagaaataaatgtttcatgaatgggagcgtagaactattttgtgtttgtcatgcctcgttcctttggtttggtggtgggaaaaatttaattgtcaatgacacatttttgtcaaatgatctcggaagaccaggttcaacatgaacatggtctggtgacagcaattgaaagtgagtgttccttttacagacatcactgtggaaccttgaagaagttctggatatgctcagtgagctgcaaaatacagagcgataaaattgattcaagtcacctgttaggaaaattaaagcaatttgtatttttgtatgtaaagcaatttatattttacagtgtatgtacacatacactgagttaatacacaactcttatttccctagtatgaattgcatacagaagaaaaatagcaaaggaagaccatgcagtaaagatagaggagagataaaaccaccctaatccctttttccctaattattacatgtttcagggatcatttaggctggtattgtccaatcctttggccaccagtccccatgtggctatttacatttaaattcaaattaactgaaaagtaaatttaaaaatcagttcattgcactagttacctttcaagagttcaatagtcatttactagaagtagctactctgttggacagcacagatatagaacattcatctccaagtggtctactgcacagcaatgagaccactgatcaaggtttaaaatctctccgctggctctggagagttaaggaaattgtgatcttaaccctggaatcaggaatgctcacaagcaaatttctagataataaagtcataaataatatcagaatattgacgacttgtgcccgtcttgtctggaaacacacattttctgtaactggccaagtcatatgcaaacagagtagaggtcattttgagaccttcatagatgaccacatttgctgtgcagcggaatcccaggtgtacacacctgcatttgatgtttctactatacataacctactagtcagtgtggttcatttagttgtttgcaccgcagcaattcttcccatttatcggactcgctgccttcttccattgactgaaactaaggcagaaggtggaggatatgcaaagttcaaaccaagaggcttgcaaataggatgttgctagacatctttggtgggaccaaattcagtcaccaaatcatgattcacatggcatctgattgctgcaaatactttttcttgttccagagagaaacacattcataccacacacattctctccactcaaaactttaagcctgttgcagctaatgtcttctggaaatcagctagccagttctagcccctccctacctcattaagtttaatgtatgtacctgcacacctgtatctttctgtgaactttatgaaagccaagaagatgaacaagctatatagaaaaatggctccataaacctggtgacccaatttctctttagtccgtcactctgttgaactcagtgctgttataactgctttggttttataactcctcagcacatttaatgagttccccattcctaattggagaacatagtatttggaacaccaggtggcatctggctaagacctctttttgttgtggttaacttccattacctctttaagggaaacaaaaaaaaaaaaaactggttctaaattattggtgattatgtggcaggatgttttggatgtgtcttctccaggactgatccaaagaataaactttaaaagataaactcgtttctttgaattgctgtgcaaatgatagcatatttactctgaaagttaactgtgcaggaaagaggcagaaagaaattgagacccgtgtacctacatcttgaaagaggctttttgtagcttccctgcttcatctatgtcttatcgtatttagtttcatgaagccaaatgccatgaacctacctttccctctcatgattctgctgttgtataccttctcacacactactttgtcctgagttgcccctttatggtgatggtgaggacacttacctcagaggattatgggactgtgtgttctaattagaacctgaatggtcctgtgttatcagcggacactggatcctgtttaactgtgctgagttcattgtacactggttgatgtatcattgtggtccactgagcaagaagctctgttatattcacagtttgatcatcaacgctccactgaacacaattccttttgaatatgcctatttgctcgtcctctttgcttaattgaacaattgcaattactggtacatacaactaaatgttaattattttttcttttcagattttttctgttaatgattttatttacaaattagaagactatcatattttccacaccaaacaaattctccgtctgaagcagcatgatacataaccatgtgatatctttggccaaaaagaaatgttcagtcatttttgtaataattgtgtaacatttagacagctacagacattcttcaataacattagtggtttaacaaccagataggtaagagattactaataaactttcaatcaaagggtgatttaataaatataaaagacaggaaagcattcactttataagaaaataagaactgtttgaataaaatttaagttaatatctgataaaggtaaagcagaaacaattttgaaaatctggaaagttcagcaaagtataaagagtatttaaataattccccataatcctctccaccccaagacaatcgccattaacatttaggtacattttcttccaagggcctctaggctcttcttttgggatgtgcttatgaccgctaacctttaacatccagctggggttggtattccaccccttgtttctccagggtgtttttgtattttcgctttgatactaagctttcattaacctcaactttagctcagtagatttgggtaacagctgctctggtgtggtcttgccactgggcatccctgcattgggctccgctacattcctgagtcacatttctccttgtgttttagggtggttatgctgcataccgctacgcccagcctacccctgccactgccgctgcctacagtgacaggtaagggtcatccttcttgtgcttgacaactacttgtaaattaacttagttgatgggagaggagattcttgtatggtcttggtgaaactgcatgactgctgggggaggtagcaccccaaaagttaggtcccatggtgaacgtgaactcaagtccccatagagagagggcaaatgcttcagccaattctaaactactctctctgctgagacacaaagaaaatgatagccttggtccttgtgtagtttttcacatctcttaatttctgtgacaacgcaccttgctcacatacacatacacacacacacacacacacacacacaccgtacaaccttcttatggtcttccacataagaccacggtttcatctaactcataggaagaaaaacagaccatgatcctacaaggtttacttcaatttcaagcccctttcctttttacaaggtcttatacccaataaatcattccctccattgcattattacaattctaaataaaggagagggagagtgtccctggcattcataaggagattgattctttctagcaatgcccagtgtccaatcctacaaacataagccagcttttatttgtaatgtacaccacatgttaaggcaggcagtggaaggaacacagtgtgtttgaggaatgcagaagtcagaatggatgggcaggttgcgggggtggggtggaaatcaggggtttctatcacccaggctgaacagatgagttggttcctgaaacagcaagccgtagctacttttgtatggttgccttgaaaaggaaagtgtgtgttttcatattgaatgcaactccttggctctgttttctgaggacataaatgtgaatgttcagatgctctgcatgcacaaatgtcattgagggtgcttattttggtaatgagtcctttattttaaaaatatgtttcacgaataaaacaatgataacaatttgcatgtgtggctggggcatgctgggtcagacaggtaagcaggcgatgtatttgactcctgaatgggaagcgtcagcagcctctggtcctcctacctggcctgttgtgatgtagttcctacctcggtttgctgtggtgtgctttctctgcagttccattccatttctcacgagacgtggtgttagctaattgtagctacagaattcttgcaatataataaagcagaataaatccctgaatcctaaaagctgcattttgaaaaccccatgcatacacttgtaacaaatggctctttggcaagatggagttgagatctgctatctggttctatgcaggtatcattttcttataagcagccataacaagttctcaaggctgtagggggccttcagagaaatccagacaattgtcaagacaaggttctcaatacataaattatacatttaccgagtaatcagttgccaagatgcaaaatgtgtttcatgtaagttgttatctccaacacactttgacactggattaggaaagtagagagggtcaataagactaataaaaatgatgacaatcttgaaatactcaagatcattctacaaaggaaaaggcctaatgttattaaattctgcactgaagcttcacaaagtatcaattgtaatgtggttcagctgcaacccttaattattttttatgaaaatatctctagatgctaaattctcaaacacccactttgtatataattataatcatagtaactctagcctgctgtataattataagaatcttaaacagatttgatttatcttgcttttcagtataagtgcatctatccccaagttgaaaaaaaaagattacaaagatatgatttaaatggactccttcaataagactggtctagacatttaaacaattaacaatatttaatgctattagaattacctgagattctggccatccctacttgcattcatctaaacatttttaaatttctgcattttggaacaccatacatgtaaaatctgttattttgatattattcagatttctcattggcaacatgtcccactgaaagattgcccttgttcttggattggtgaatctttaataactgcaattccaactttagtaccatagtttcagttgaagaaaccaactaactaatactgttgtccatataattggcctcttgttgttcattagagaaatttgcacatttggtcttcttggttgctgtggaaattgataactattcctatttaactttatcataagcaagacacttgccacatggtattattcattgaagtaaattaattaataagtaaatggacagaaagcaatctttaaagttgtatttctgatgttttaaaatgtctattaaatggtgctacttccttttatctgtaataagcagatattgagaaagaatacctttttatagaagacacgtttaggggaaaatgtgaaattatcagaatagcttttgaatctagattaaagatgccaagtacctataatttctctcagaagtagcaattgtgtaaccaattatttttatatcatcacagcatagaatcagtaagtgatggaagcttagttcctcttctgtagaagacaggcaagataaagaaaaacttaacagaaaaacttcgtccaaaataggaagtaaaatcagcaggcattgagaatgttttggtaatgctcactggttgtcagttgatcaaaagagaaacagcaacaaactttccctgtaatcatgagattcactcttcagacatcttgaaagcaaaagaagtttgatgtccccagttggtaggattttaccttttttcagcacaaattaagccctcatcaaatgaaagattcagggatctttgaaaaatattgaactccagtaacctcaggactgtccagaaggtccttaatgggcaccttgcaactccctgcccatcatcttcttggttaaatgatcacatgctgattatctcggagcaacctgagagtctctgaatgttgacctccagaaagaagaccatctggtgtgggcagagatttccccaaaagaaaaatacctgactggactaggtaattttatagtctcattgacaaatttaatgggaataggtgaacatcttttcttggcatttaggaaacatttggcaaagcacttgaccttcaccaaatctttatttctaatctcactttgatttatgcaaagccaactgtctgaactttcaaaggagagcgtttcctgagcttgaaccaactgaagcatggcagaggggcctttggtcatccggtcattgcatgccacttggtgttgctgatgtgtctgtgatacgttctggattggacaggtccatcacatcagcttgatgaatggcttgcttgaattaagcctgggggcaggcttctctttattgattggctcatggtttgtgtattatgacttggttgttgttgcatcttgaagcagccaaactgggaggtgcggagggggtggaaaagattccctgtttgatcaactgtgccacaaatatttgggaaaatgtgatgtgtacatggctttgatgaaagtgttatctccccagacagacagacatttgtcatgcttgtcctgcttgctaacactcttaacatttcctaatgatcagtgcatgaaaatgtccctccacgtcagggctgaaagtagctagatgcagaccgcctagagacggaagcaagacagtttttcactcagatttcatcacagtccaattacactgatagttaccaggggccatttcttccacataaaacatgcatttcttgtaaagatccatgaaagccaagaagcttttgacattaattgcggcaccaggccacacaggtatctctaaactgagcaaaagatggcaaccaacataattttgttttaatgtatacctttttggattctgaggccttaaagtttcactgctaatgtagagttagaaattgctacttttgtgtgacaaaaatgacatattggctctgttgtaatatgaaaatatacatatatctacataaatgttacgtagctcaacttaatagaaatccaaataaaatgccatattatcttcctctctgcacacacacacgtacacacacacacactcacttgtgccttggggcctcacaagggacttataagtgttttcaggtaaagcttaatgcaaagagaccagggcttgttaatttcaagtggtcacaaactacatgctagagaacgtaagttaaatatgacattcataacctatgaataaaaggttctatttcagagacagatttgtgtttcttagaacctagtaaggataagtaggcatattttcaggttcatagaggatttagtcttattttaaaattatttaagtgacagagatagacatatacatacatccatgcttacacatacatagatgggtgaaggatgggtagatggatagatggagataaatcgatacataggtgggtggatgaatggaaaaagagggaaggaagcaaggaagggaccatctttctgccctctaatatttcatcataagctaaatacagaaaataggactaaatccttatgcacaaaagattgtacaagctgaactaaaaaagtaaaaggatttgagttgatttccattagcgcaggctacttcctgtctattttagaatttttctggcctcagattaagtagtagagaaaggctgtcatgaaaatagacaggcaaataagtatatttacagtgatattccattttaattggagttcttatccgatgatatatactaaaaattaaggaattgtcagcatataaagtatatgagcatcctgaatagaaaatttaatttaccatttaagggcttatttttgtaggaaggttaattttttaagaagatgttgtattttatggacattatgttttcattttttttttcccatgggataggatatagtttaacctgtggataatttggaacccttaatgaaagtacacatgcaaagcagacaaagggggcacttgctttgctttccccagtcctcttatctgaaccaagtttgatagggattgaaaatatttctagctaaacagcagtagcagcccttgttcttattctttgtgatgtgtggcaaggagagatctcaagatcttattctagtgccgtattgaaagcagtatctcccaaggccagttcaagacctggcacctgcctttgatggcatatttacggtttatcaaaacggaagaacaccaaccatgtaatatggttgtcaaccctcttttctgggaaataggctgtatctattcttccttctcacatgctgtttaaaaagatttataaaattagaacaatagcaaacggtagttttagacatccaattttgtttttcatgttcttccttggcaaagtaaacattggcaactttatgctagactctgtatcattttatttacatttgcagtctctgagaaatctgttggaaaaatatagtgagagcattgtaaaacatggccatgccagagatggtattctcagatcaacaaggaactgaggatggagttcttgggggttcagaagggatgggagagttttccatgccatcttcccagctgggatacagacccaaaggcagagagaagccacttgcaagtttgagtctaggctgtggaatcaatacgtggcaaataagccaaagtcatatctctgtgccatttttgatggtgctttgaagaagctgttcttggttttagttttttttttttttaatcttttatttttactcaacctgatgaactctcttgggttctataattttttttaaaaaaaagatgatctgtcaagttgtaataagaatgtagcagaaatgagtcactcatgcctttatttacatcctcctgtgcccctgtgtctagaaaagcacgtccaggttttagttagaactccaggttgagcacgtgtacatctatacatatctacatgtataaacacacactttttcttgttcatttaaagtttactttcctaacagatccattttgttgttgttgttttttggggtttttgcctattcagactctccttaggaagaaaaagtgaaagcaattgtcctagacagctttcgggtaactagaaacacacagttatacctgtgagattcctattacaaagcacacatgccagataaatttcttaatacttctatgtgtgtgtgtgtgtatatatatatatatatatatataaaacagtgctcctcttaaagtgatgttgattgtatattctccaaaaaattaggataactaagataattctatttcctcctgatctgctctgtagactgtcactgatgtatggagatggctctgaaatagtgaggaagggaaggtacatctcagcttttgatagtagagtcaccgtaattttttaaaattgggtttatgcatgtcaagctctcagtactgagaagtaatatggctgtaactgatagatatatttcctgagtttctcttagtttatagaaatcacacacacacagagacagacagacagacacacacacgttaaaagaaaatgtgttcaactttctctctcaagaactaattgcctttggtccataatctataatggcttcataacaactgttatgcactattggatgaatatgtaattgaatcagtttaaaaaaagaaccaatcctgtaacagtcaacagactggaccaccaaggagttggggagagattaaaggaatttccaagcccaacagaccgtagctgtcacagccacgtgggtagacacttttgccagtgacaaggcaaggtgtaacaactcctttggtcatgtcatggcctaattacacactttttaggtcgcagatcattgacttgataggccacaaaaaaggaaataaagcctgtcttttcagtagcagcatcagaacccttcagctgtgaagggtttagaggcaggttgggaaagcctaatgctttctaggtgtagctctgttgagaatatacgtgcaaagccctatgaatgagccatttctattgctaaaaaaaaacctgcattctagaagacagtaatccagtaaagcagaagatagaatatcttagctcatgcagcatttgtggatgtggcaataaaaattaaaccgctccactttgttacgttgttctttgtttgggttttatgtcactaggtagtatactatggatggtagtatactatctttcaagataagatgaaatttttcagtaaaagtgtctaatatttcattttaagttatcaaagcaagttctgactctgtacttaccacaagttgaaattcttttccagaagaactgatttctatttcaatgtggcctctaatttatttccacttttgtgtgtagtacatgcatgtaagcagtcaccagacagaaatgacttatggcttccttggtgtaaatcacaatgcttggttcctgtggaattaggcacttctcaaaaactatgatgaatttcatatttaattaacatatgaaacatttagaataggggccactattggaatttgaggggatgggagtctgtggggcaaaaactagggagaatagaaggagtaactagtcacttttctttttttccaagctaattattgatacattatgatgtgtgactgttcaaatagattaacagatttctgaaagctgaaacataatcaaagccaaatattctcgtaattatcccaatcatttagattgaaatgctttggcctgagattatagaaatatgccacacatatgataagctaaatcagtggttctaacgggtcttggggacctggaatttaaagaaaaaaaaaaacatgattgttagatgcttctaacatcctctcaattcttgcctttcatggtttcaattttgtaatttaaaattttagaatgtattaagagatgaagaacttgttttttccaccatttctgctttgttagagtgtttgtggatgactactaccaaacagaatatgagcccaggtagtgggagtggaggcactttaataattcttcctggacaataccagcttccctgttttttcagaatgatcgtttccccactatttttgttttcttccatttctgtctcccaaacttagaaaatgaacaaatgggggaaaaggaggattaacttgttctgttttgaaatttcaagatttgagtggatcatctaaaaagcctgcagagccttgccttgtaaagtgtagtttccagaccaacaccattgggctcaccaggagcctgtgagaatgtagaatcccaaaccccagtcccagccgtgctgaaccagaagctgcacttcccagactccagaatgactagtgaagtttgagaagccccactttagagaacaagcttctgttctaccccgatatgccataatgttgacaaagggttgtcctgccacaaaccttgcaagagataagaggatctatctttataaattattgacttttattaccattgcctctctactctcccttcttcaatgagagagtaagaactatcaacagctgagtgacttcttccctctcctggcccagggccacaattaattctttaccccaaaagatccgtggacggaaacagttatttatgctaacatcgtgtcattaattgcatagattcacgctaatataaaggagtacctgaaaaagttccatctgatttcactttactgaccctcagttttttcctatgctaagtggaaagcatggtactaattagaatcagaaagagatgaagaaggtgaacattataaactgaaagaggtggtgcaaatgttatcaataactcggtttcagattgacatattttggaatgtatgctagtatttgcagtgaatatatagaggcagtagcaagtacattaaattaaatgcatttaaaaatgtaaggttatttttagtctaggcaatctctaagacacactgtaacactaaccctctgggaacctgtgccttgcttagcatcccaggtcttgtaggtaactgtgtcaagatttgaaatcagatcttttattctcattggacctactctgatatagacatgcactagcaaatcattgctgttgatacagagaataggattacagattgagatttacacgtgggtcctgaatctctgtgaggttacttactacacgagataatttgggcaggccaacattgagctagttgaccctcaactgcctcatctataaagtgggattaatggatgaccattgcttctttgcgtggttgtgagaatccattgctgtcatgaacagaaagcccctctaagagatcctgacacttagttctcaggatattagcagcagcagcatcactgaactgtgggattatcgtgttctgttctcgagtgaaaaaaaaaacaaggagtttcctgtggaaacgggttttatgagttagaataatttttgactaaatacatttgtttttggttgttttaaaatcttgacttctaccctagaaatataaacataggttggggaatagaaattgggaaccgcaagatcaaatatcctatccttctttttcaacctgtgccttggatatttgttatcttttctgctcatggatcagcttaggccaccacacatgcattagctttgtagaagaaatgcccaatctcccagtataaacccagccttcgaactatcaccgctttggatttttgtaaaaccaattgcctgccctcttctttgggtggagagagaaagagactttcctttaggagtctacacagacaaaaaaagaaaaagccaatttttctaccaataaaatgacttcacatttgtttctcattcaacttgcacaaaaggtctgggaagggcatgtactgtttttatatctcaatttttccaaatgaagaaactgaggtccagacaggtgaaatgaattttctattggaatacagcttatatgcaacaaagcatggttttcagattcacggttggttctctttcacctgagcctagacaagaagtgcagtgggaactggggagaatgttaaatgttggaggaactaaaatgacaaaagggaactgttcaaggtctccaagtaatggagatgaacttgggtttgaatttccaaaactcagatctttttttggtagaatagccaaactggggagagattcacagaccttatcttctttctgtttaagcttctttacgaatatcatgttagcaataggaactgtgtctaaatgaaatgtttttaagtgtattttcatgtgttcccccttttcaaaaagagataggtgtaggacctttgagagctttctataatcaatctgtttggttacttgtctgtgtataccctgtctcattctacaatttgccacagtgtattgaagtacacgtgacaacactaaactgaataaaagtgacagggcaggtaaaaaatatgaatctgaatgggatttgtaccattctggagtagagtattagtattttatgtggaaaggaggtaaaatactgattgcaaggaacctccctttgaaggtgataaaactgaaatataaattagattatgagcttccagacaggcaagtccaagatactccagtgatttaaaggatatgagcatagcatcagaccccttagacttagctcagtgcctgatatgtagcaagcccctcatttacaatctgagggctgaatgatgtgagtcaactctttggtaagatcagcaatatgaattttaataggtacatcctatctgcatattatgtttaatattcagaaaacactcatggctgagttccatatggcacgtctagcaattttaacaacaagaataaactgattattgtgactttccaccttaattttacatgtaaaaaaggaagcaacctggtaagcatgattataagacaattactaattataactactgtaattagtataattagcaattaaaatattaagtataaaatgttaaaaatcaacactagtgcaatttaaacccaaaagacacaactgtttcctgaagaggcaagatacatatgttcagagaggtattcatacagtgagatgagttctccgtgctggctgacagatgagaatcaaccccaggggtttttcaggcatatctgtacatgggaaccactctcaaagatgctcaagttaaatgaccggggtgtgggcctggtcattggtattttatttaaaaaacaatcctagctgaatatttattaaaaaacaaagtattggctgggcagtcagggctaaaaacctctgccttataaacaacagatatcccaatacgtacaggtagaattggattttgtcccactgctatcctggggcatcttggctgccatctaccaggccagaagaccaacttctcagctgtagggattgcctagtaggcatccttggcaggtttaaatgtgtgtgtgtgtgtgtgtgtgtgtgtgtgtgtgtgtgtgagagagagagagagagagagagattcaatattcatagcattggatacaagaagaatcttgctatgagtgatatcgatcctgagatatatttaacaatagcaatgtaacagaattaagaagccaaataatgagaagtgagcagaatctttgcccataagacttaaagacagtattatttgctatggggaatgtttacgtcccacctgcccgcaccaaaagttttctctgacttgatatctagcatctcatgtcccctccagcaacacaggctggctactgttttaatttaactctgagaattcagctgtgggtaatttttcagaaggaaaactgccaagagatgagatttaacctaaggaacaaaagtgggctatgagggtgatatgcggcaatccacaggactaatttaagtgtaccaccagctgaggcagatagagtatagatggttgatctataaaaccatcttaaaagattagtcaggctagtgacataagagtgaaagagacagaccatggcatatgccatttcataatcaagttgttgttagaatatgtttttaattctttctctcaattattctcaaagaggagttcaaatatttcttagaggaaatgaagattcagaatgttaagttactccacagagacatcacacctcactgctgattaaataccccctacgtgaatgttccaagcagaaccttagatagtaaaagcttggtcttgagccaagccaactgtgttcaggtttcacctctaccacttaacagctgctcgcattatgtaacttttccatgcctcagtttcgtcatctacaagacgaggataaaaagaagggttataagaaaaattaaatgaatacataggtatgacacttggcaacttgcagtcataagtgccccatcagtgttagatagtagccgttgcaatcaacattcccatgagccaagacaaacacagccttctcccttaaactcaatttggccatttcatcatttttcatacattggtaatccttcctcttctccacccccaaccaagccttcccagttcaaaataatcttcctgggacaggtgagctttgaagtgaaaatgggaatgaacttgcagatttttcagcaaggttgcccaaacttcaaggtaagaagcagcaggaggcgtgattccctcacagcagaatctgctacctacagaacagtgaaaatgagtgcctgtggagctgatcaacaggcaggcctgagttcttattaagtgtatagattaccagacctctctcctggaaattctgattcaggtggtcagagttgaaacccaggaatctataccttgaatgagcactctaggcattcttatcttcagggaagttggagaaattttggagtggaagagaggtagaatatagaaaagttgtgggtgacaggaatgggaaaatacagaagtaggggccaactcaaagaaaaatggaaaaacccaagcaaggatgatcttgagtaaatgcataagaagtggtccattaagaggaacaggtaaggaagaactcaaataccaagagtatgatatggccactgtagagcagtttctctttcaggatgaggtttaaagtcaactcttagaaggcatctagaaactagaagtaccctttcttggatactgtatcaggtttgtgtggttgcatagtctaaaacctaagtagctaggttgccctggaggcaagcatggtggccaaacagaagctgcaaaagtagaaaccaaagttggaagagattcagtgattcaactcccttgaatcccttccttgaatccacttccttgaatctcttgaatccctctgccttggtgccataacactgcttctcagctgggccacatattagagtcacctatagagcattttccgaactactttccaggccctaccccagatcaattaaagcagaaacctcaggaatgggccctatcactggcactctcttaacctctatgaatctaaggagcagccaaggtgaggaccattcacctcaacaagtgattttcaaacgaagaacgttagcacattagaatcacttggaagcatttaaaaactgctgaggcccgagacccagtttcagaggttaccatttaattggtcttcagtgtagcttggtaaccagaaatttttagaagtgcaccaattatttacaatgtgcagccaaggttgagaacgactcagccagacttgttttatgaacaactaaggaacagaccagtttgtggaaaatcaggtgcattttgaagtttaaattcacgggtctgtgttgagagaaagcagcacactagggtttgcataaggagacagaccctggtaccagccttctttcttctcctgagaggcagccccactgtccagaatatacctgcattgttctgatcttttaatttttctgaagttgtttggatatagcggagacattcgtctctttgatcatatgtgtctctggtcatctggggcaaatggcttgagagagggtcatagatgatccatttatgggccctctaaatcaatagtcttaatgttcaaggtgaaacagctgtacataaaatggcataacatggtgaatatagacagcaacatgcaatctccccttagaactgtaccagaattcttctgttgtcctgacactgcaggccaccaaagccaatctgattttacagacatttcctgttaattgcacttaccgattgatgaaagcattgttcagggaagtagtgatcacacagattgaattcatggaattaattaatgaactctatagaaaggcactttctgacaccttatggtgacctttctgggatgtagtgggattgtttatgtggattaaaaaataaaatagtacagaatggatacgtcaaaaaaatacttaactggtagctgttaactccttttaaatgtcactattattgagaactctgccttgaaacagatgtgaatttgtagtcagaagtaatctaagccaactcttttgaagagggtgagttgtcaaagggagtagtcccttttgttctgaaacttagggatcaagaagagaccaggggtaaaaaataaaataaaaatcaatacacataggttttcaaaaaaaaaaagtgggggagagaaagaatgaagggaaaatgaaaggagagaaagaacggaaagaaaacggaaaggaaaggagaaaaggaaggaaagggtaggagaggaaaagaggaagaaaggaggaaggaaaaagggtagtttaaggttaagtgcagactcaaaaagaatactttcaaggacaccatcatactataaaattctgaaacaatttttaaaaacaagcctagtttcttagagggctgtttctattcatacttgtaggttgcattttaaaagttacctattcgttcagtcacaattttacatctgtttttgtctccaagtggctttcctgatgtctagcacattggacagttccttagggaaaattgcagaaagggaacacaagctagcaatctgttctaggattaggcagtagaaattgggtagagctgccccaccctcctgccatagatatgtgaatgcctagtgcaaagaccttgccgctttggataaatcatgtcgccattcttgcttacggtagcattcttaggagcattctgtaaatagaggttattctaagtgcctgttttgtgcagcccagaatatcatacctgtagttaggaattcccgtgttattgccccttctataagtcaaaggtgagtaagtcaaatattcaaccaaaatatctcctttgttttcagggataaattttattgctcctctaacatagggaatctggggccagatattcatgcggctcaaaaagtctgtgtcaaaaagcccaaaatcttatgttaacttttattgtcttaaggaaagtgataaacttagttgtgacttgttatgtaggagaaaagtactaaaaatattattctcaaagcatgtataacttgtttatattttattggtgtagaaatgactagaatttaactgaatgtgaaattctagggaatattcaaatggcagctctatttatattccagggtgtacctcttgcaacagtaaaactttcttaagatgttttaagaaatgctccatcactagataccttttgaagcactgaaacatttgaacaaaaccaatcatactaagaagaaaaatgcatttatcttggttcttggtgatccataagcataataaaaatctaaccgatgaaaacccagagcccctgtactgctacttttgaggcatttacgaacctagccaacctcattgtgccatttttataatttgactcagacgatcttatttgtagacgaattagtacctctgaattagaacacataatatcgtggaagtgtcacagttggaaacgtcttaagagagttttatcatctttctgggtttactaaaagtaaaatagcattttctattttcattatttttaatactgcatcattaaaaataattagggtttatttcaattgacaagttctcttagctctatgtagcaagctgggtttgatgaggaaattattatccataacacatcaccatataaaattgtcttctgaaatgacagcactttttcttatttttttttgatattataagtctagaattttataatttttctagctagctgtagtataccctatttcttaatcattagtcccattttaaaaagtaatctctttagcatagaaagtcatatgagcacaatttgaaatgctttagccttagaaacatatcctggcatgttttggtaacacatagtattaatatttggtgcaacagcttgtacatagttcgtattctgacattaccatgactttaagaggtccccgcatgcttatttcatgatctttctaaactctgaggtacatcagcacatttcctcgcaacatccattcacacgcagcacccttccctcccctcatctgtacacatcgaagcaattggcagagagcacatttccccctgagcgagcagtattgtgaattttatcttctcttccagaaatcagttcgtcttcgttgcagcagatgaaatttcttgtaacacctctgcaggtaacaaacgttgctacttcttgatgcatccatccaagtctcagtatccttttttttttttttttttcttcttcacatgctgcagttggtcactctagaaagtttagttaagaaaaaaaaaaaagatcttatatctttggagtacagctgaagccttgaggctctgccatataagacgacattaggcattttgctaactttgatgttttatttctggttttaataatacatggtccagaaaagtaagagtatgttgaatgaatccacaagaaaatcttacagtataatcagtgctcttatggtaaaatagggaacaggaagattaggtacacagacgtatgacttccatgttttttgacgtgttatgtctgggttcatagagactgatgtgtgaattatttgggatctttatggaatattagaggctgtaaaagactgaatctataaagcttagaggcattcgagaatataattatctctgtcttataagaaggggatcttcattctattagccaaagatcctctatttcctttcttataaaacatctctcaagtagcaggacttagagagaccaggtcttttggttttgaaaccaggacattggcaaatggaaattgcatagctgcatgatacgtccatcaaaataacacctgtcttttttctttgatgtggttcagaacagttaaatttgtactttgattagtatggagttaattaaatgccaagataggtgaatgccttaacactagatttccttctttttccttttgtcgtttttaagcctaaactatgaccaaaacaatcactaggaagtcttgccaatgtgttgctttcagcctgcgagggaggacgttacaacttatcactacataactgagcatcccatgaccttcagacacatacattaaactgaaccttacaaataaacactcatctgttaccttttatcaatgctgcagtaaaaaaaggcttatgtgccaatgtttcactccctatttactgcctttggtgagaatgaatgaatgaaaggaaggacagagagctaggaacatgcacccaactatctctgttctaaaaggcagggtcagttttatttatatggtcagcctcaaccttcataacgggttaaagtcttacctggtgagttcaagaggtatgcatgatgcatgctgacattttaaaacaatggtatactctttctataaaacctctttgctgatggtcctgcaatttccctcttaacccctagactcgtatctctgcttctcattgtgagaggtggcgacatccttaacactttactaatgcccagtgctaggtgcaatggttaattgaattgctgggagtggcagggaatgttcctgcaatacaaaagttgtttaacattttcagagccttagtggaatggagcatgaaacaaaaggggagaccgcttggaatgggaggtaggggtggggaataatgttaatttaaaatgttcataggcctcatgtatagatgcctcagtgcactagagcttctgccttctgttaacccctgtgcatgttccagtatgttaggttatatttggacatcttagatcaaacatgaaaaagatattgattttgccccgtgacttaaaccctgccttataagcaagtgatccacacacaatatttctaagaaaggcgacagaaaatgaaagtttgcatgcgtgtggtgagtgtttccatctacctaatctagatggctgctcagtaaattcttaatgaattgctattgatcacatttcagattgagagagatatccctagtcctttgatggccattttaatattatgttgcatgcttcataaggttccgtttgaactctgaattttgaatgaagcatgaaaaaggagacacccatatccatcaaatgtcagattatctcccagcaagttcaccttgctcatagagcgaaaatgaaaaatcaaaactgctcagtcaacaaaggttgtaactcgtggtttcagtgaaagccttctagggcatcatctcctacatgctgaaaaaacctgctttgggaggccaaggtgggtggatcatgagggtcaggagtctaagaccagcctggccaacatggtgaaaccccatctctactaaaaatacaaaaattagccgggtgtggtggcacatgcctgtaatcccaactactcaggagactgaggcagagaattgcttgaactggggaggcggaggttgcagtgagcagagactgcgccactgcactccggcctggacgacagagcaagcctccatcaaaaaaaaaaaaaaaaaaaaaaatcctgctgtgcccactacccacattctaaacagcactactgtaatgagctctcacctccttataaaaacatttattagagcaggtgtattgaatcctgctatctactggatatcagagtttgacaaaagacaagttctctatttttaaatggagaaaaaaaaatcaacatgcttaaaatctcagtgtggggtttgatggatgttataactgaaattcttataaagaggtgctattgtcacattgatgcccatggtggatgggctaagcataggcagccatcaggggcttcgggtggagatagtgagatgaaaatcattaagcagtagaacagcagcatttcaggatttgttcttcacgtttcccaaagaaaagcaatgccttttacgtgggtcttgtgtcgagagtgccaacacatctggtctgctttttctagccacatggaataggcatttttcattaacatttgtggtctgtgagactaatttacaaggatatctattttcttacctaggagtttcaacaatgctattagttgtgttgttttgttttggtttttcccaaagaatgtgtgctctgttgggtatcacttgggactaggcttttataacagggcaggacacctcctaatgcatccagcttggacaactgagtaggtcctcattcagtaacatcaagaacctttgatgagttggattcttcaatagatggtgaaaagggagtaaatgattttcccttcttagacgggaggtctccgtctgtgattcattaggaattttccagggtgggctagtgattgtagtagttgcagaagaagggtctggtatgagaatggaggttgaaaagcaagttacttaatcagtgactagaaattcattttagtcgattaatatctctagtcctttgtgggtgtcaggaactgttctaagccctggggacatagcattaaatgagtcaggagaaggtctcatcaaaagaccttcatggtatgggagaacagatcccaaagcacgtatatgaataagcagataatatatatgcatagtaagttatgtacttactgtaatgaatcaaaaagcaggggaggggatggaaagtaaggtgcaatgctattttagactcagccatcagagaaggcctgtctgagggggtaacatttgagcagggatctaaatataaagtgaacgtgtgacccatgaaacatacagcaggtgcagagaccctgtggttgagacatacttgaggtgtccaggagtaagacatccagtgtggcccacggatatgagtacaggtgagtttaatagataacatctaggaggtagacaggggtcagaggaagttaggacttggaggctgcagaacatatttgggattttaacagtgatgcagaggcattggagggagggttgtaatctgactttaatgatcagataagactgctttgtggagaccaaactgccaaagaacagaagaaacagcaccgaagggcaatgggggggcccttacagctgtccagagaggggtgacaatggcttgggttagtggggtggctgtgggtgagaagtggtcatctttaagctgtattttgatgggagaacaaacaggacatactggcagattagaagtgtacaagctcgagtctgttaaatgtccactccccactcttgttctaagggtctatcagttaattccatggagcaccaaggctttaatccctgaggaaagcaaaccctttatccctgtagtaattgtcccttgttgagggctttgctgaactctccaaggtgtaatagtaacttactgtcatttattgagcaaattatgtgtgctagtatgatatacatacatgcatgtatatgtataatgcatgcatatgtatgataaactatatatgcatgtatatatgtatcacagtagttcaacgaggtgttatccccattttggaaagtgaaaaaaacatacactcaggtccagaaacatttagtagcttgcccagtcacactggagtccatctgatgccaaaacccttcccctgggtcacactgcctccacacacacctttttcttcacccttggaactttggccttctcactccagatggaattctaccttccccagtatgctatcttgctcctatgaaactagtattttgagtcggatgacaaagttgttactatttggaagagacccaagggcactgtatgattctttagcagttgttccactggaattttatttaacttggcttgtccccttcaggcagcaggcatatgtttagttccgtgtgctgggagtactggtgtagttgtggggacagagggagcagatgtcaggtcaggaagcatgttgcgtattagggaagagagggttaaacaggccaagtgtgttctaggttaattcaccagacgtctttttgctgaaagttagtggctgaaaaacaattaacaatatgctagtccctgaaaaccccagacaggttgaaacagttgttttagacacagagtccaagagggtgtgtgtgtgtgtgtgtgtgtgtgtgtgtgtataaagggggtaggtggaggctgggactcactagcaggaagatatgccccttccaccatgccaggacccaccatgcattcccttagcaaatctggggacatgttttcatctcagttcctgatgagtatgggacacaaccatgtggggtgagggtagggtctgcaagaaagccttgagcaaatgaacaatctgcaaaagctgttgaaactgttctctgtggggcaggttgctacccaagttaccaattagaagcaagttcaggggtacaaggaggtgtcaccagcgcctttcatttttctatccccacttctcaacctacacatgctgccagctacattaaaactttaggtaatatttaatatttagaagaagtttcccaattggccattcctctaactgatccttcagcaagtctcatctaattgtcttttctgcattttagtgatttgattattcagcaaagttgtcatgcagtaaattgatttgtggctaattggtccatttccaataaagtgtgatatgtattataatagggaaagtacagggagctaaggggccatataagcaaaggaacttaggaaacatactcccacttattgagaaccttctgtatatgaggcatagtctcaggcttgctgcatgcaataacaataccctataaagtgtgtgcaatcaatttgtgaaaattaaagatgtctagatagtctgaattagcctaagtgggaaagtgctgtatccatgcatgcagaattttaaaaaatggaatggtggttatcaaattctagaagaatgcaccaaagtcacctggagaacttgttacaaatgcagagcctgttttgtcgccttcccctgcccctgagattctgattcataagtccggagagggagcctggaaatctgcattctaacaagttgccccagataattgtaatagaaaagacctcacaccttgggacacactaactgatcaatcagggaccttttctctttgagatagggtctctgtcatccaggctggagagttcagtgcaatagcctgatcttagcttcctgtaatcctggacctcctgggatctagcgatcctcccacttcaccctccctagtagctgggagtacaggcaggtgctaccacacccagctgatatcttaattttttgaagaaatggggtcttgttctattgcccaggctgatctcaaactcctggcctcaagccatcctgcccctttggcctaccaaagtcctgcgagtacaggcacgggcccaccacacccagccaacgttttttgtttcaatggtaaaaagagcacacaataggacttgctaaagttgtgttcacatgtggctgtggagcccttgagatgtggccagtccacaccaggatgagttgtaagtaaaaaatgcatgctggatttccaaaacttagtacaaaaatgatgtaaaatatatcaataattgtgagttacacattgtagtgatgacagtttgaatattctggagaaaataaaaatgagttcaccttttttttttactttttaaaatgttactgtaaaatttaaaatgacatatgtcttgcatgtgtggcttttattatgtttctctcaatcccattttagaaccacatttttcatttggctcaaatgaatattgaaagagtttgtgtgtccccaagaactggtcatttggaggtgggggatgttcaccaggagttaaaatgttgtgacagataatctggacattgtcagtgtcttggtattggattttaacgttgcctcctggtgctaggtgggtgtgttggtgctgtagagggacattccttggggttcagggcccagaacctccctacttctcaacctgcttgttttgtcttaatctttgatctgcttgctttgaggatgggagatgccagtacataagactttggatcatcaatccaattcaggggtagctctgacacatgtacccctggggctttaccgggaagctcactgatcccacataaaatagacgagaggcaatagctgcagtcctctcagtcttaataactgtcacttgtttagtccttaactagtaatcataaccctcctctcaccctcactgtagccttgtacgatgaggatgcaccattatcatctccatttatagatggtataaccaactcaaagagaagaactttgagatagcttagcaagaagtaacagtcagtgtttgactctagaaattctgactgagggatccccagctgctgttcaaccctgcttcatggaagggtattgaaaatctcataagggatacaatttgtttttcctcctatggggtaaagtatagctggggtgccatggtgatttcaaagcacaataaaaattcttagtgattttggtagagcaggagtagacaaacaaaggagaaatgaaatttctaagagaaggatggccttgagctctgcattaaagagaatgtgcctacagctccttttttagaggaggtattctagggcaggagaatttcatcaccaaaagtgggacttacttactgtgtcttctctactccgagagtggctgctattctgctttccctcaaatctgctgttgggtttcagaataggaagaggttttcagaataggaagaggttttgaatggcattggtgggctagagaaaagatgatgtgatctgatttgccatgggtaaatggtctgagtcttttagatgccacagtgttggatttgtgtacgtattatgtatgcatagttctgatgtatgacaggtatccatgggcaaaaaaaagcaagttctgtggcttctcatgtagggtctaaaaagctcagatgtgttccctcctacttctcaggggaggcagggaaatcacgaggttgaaaaatgtgctaagtgatttctgaagttaagcgctttaaagacaagctaaggaagtcagcagcaatgaaactcaaacagagccaagtagagatgactccatgttatcttggagcatttcttccacttctagttttatcatttttggagactttgctgcatttttagtcattttgtaggtcaggggtccccaactggacacacagcaggtggtgagcggggtggggggtgagcaacgcttcctgtttgcagccgccccctctcactcacattcctgcctgagctccacctcctgtctgaccagtggcagcattagattctcatgggagcaccaaccctactgtaaactgtgcatgtgaggcatctaggttgcacactccttttgagaatctaatgcctgatgatctgaagtggaacagttttttttcctgaaactattctccacctccctggtctgtggaaaaactgtcttctacaaaactggtccctggtgccaagaaggccagggacttctcctctaggtgtttagggactggtttagttcctccaacttcagtatcttgagaagctttgaggataagtgagcttggtcatccctatggtcaataaatgtataagtcattgctcaaattaaaactaggagaaggctatagtaaccacagaggagtatttccctaaattcactaactgaccaacagatctgaagtccagaactcagttgacccttgtagagtgaaagtgaacaggaacatttcctagataaaccattgctttctgaatttcccaatacatccaagtagttatgttaatgctttcaggagggtttctccctgttgcagcaaaccagggtgcatggcctgaggttctggaaaccctctcaaatctttctgtagggcagaggtggggtggttggcacctgttgtctctccatgtacctgcatagtgcactgagataacttgtcctttccttgaatggctcttctcctgcaagattaaaatcttggccataattaccccaacattttctcaaatggatgcgcactgggattagcccagaccttacaacctgggattctgcgatttgaaaatggagattttggttgtgtggtaaatatttattggcatgaagataagagactgatcatttcagagatatactgaggtgtcctaagctcggaatttttgaaagatcttctgtgaagtcccatattctgggctacatttctttgtcctttgaagtgagcttttgtctccattctgaccccacagaatccccaagaagctgaggggacctctctgcagttgcagaattgccaagagatttgtcagaagccttcagcctctttcagtaggactgtgagatcttactgttttgctgcattttcatttagtgacgagtatgggatggttgagttggaaaacataaatgcccataacagtttatgattgacaacggattcatttatttctagttggatgagagaaggaagtaaagcagtagctggggcagtgctgcagaactcagaagccatgcgccctccccttctggtcttgttctttcttttcctggccaatattggctgtgactcctttccagcccctgagaattgctgaaagccgagcattttgtccaaacacagaacacttggtctggaatgtatgttccagatgcagttcctccggatgggcaaaagcaacaactcattggtaatgataccagcaacaatgcaaaccaaaggattgtcttcaacacatcatttatttttcatttggaaaagtcctcaaaccccaaaaatgagggcaatgaaataggatgaatatctgagtgggatgagaatcacttcttcctgggtgcaggttaccttctgatgtcccccttcttacctggtgccccagagcaccccaaccaggggggtagacagcagaactgctaaatctcatttgaccctatacagggaagtgaaagagaacatccctttagctagaccatggctctctaaagagcatgcttttagaaccactgaaccacagttggtgccctgttgctatgctgtacggtaagtgtgcgacttgcatggattcatttttccaaatacttaagactatgccttagatataaggataaaggaggcactgtagtccctaattgcattgcagagacccgggccattcattgatccctggtgagacatcccattttgaatgcatactctgcagcccttctctgtgttgggaggggtacaagcccatgcattttcttgctgccatttggctgtttaggatgtctttgctaccttctgaacttcatctgagagctgagcagatttcactcatctttctgctccacaggattcacccagctatctctggggtgagaagcatggggagatgatactaatggaagaataaaaagttcccagggcataaacgctcctcatcaaaatagggagtaaaatatagtgaaattaattagtgttcttactgtggccctataagaaaattatgttaaaaccctggtgtggagtaccaacatgggcccattgtatctcattagcatccagcttgtttcaagtaggtgtacatagtacttcttgctaacgtgtctcagtagagttgataaagcactttaacaaacacgggtttatattcccattcaagaggctgcatacttattcattttgctccaacacaaccttaagttcaagtaagtatatccatttgaactacatctgtaactcataaattagatctcaactccaaaagcatctgtaatttgatcggtagagctgcatgtgattatattagaatggaatttttcaattgcctctgcagaccaaaagtctgggcaaggagggagagattggtttgtgaaatacaatctaagaagccatgtatcataatctcctctatctgtaggtggcttaatatttacctggctttcttgaatgcaccttgagttaggtagggctcagtcagaaaactactgctttacaaatgaggaagatgaggctcagagagcatgctctgtccaagtcatgagagcaaggacatcataaaagcagaactcaaacctggatctttttgccccaagtcctgaatctccaagccctcgggttgcttcccagttttaacttgttgctaaaggtcaaaaagatgaggtctcatgatggttgcaagccatggtgaattagccaggaaagcagtcctcttttatatctttgtttagtttttccctgaaggcttttgatgagttttatggcaacttggccagtgttttgcaaactcacagaaatgatgtaaaaagtgtacactatttctagagtccccagaaagttttcttctgtcttgaagcatcctgaatgtgtctgggagcagctgacccagagtcttcaaaaagcgtatctgaatgggatcataattacaggcatgagtgtctctcccaggccccatttctctctttactcctttgtcttgctgcctcctctctacctgcactgttctagacagtggggatgcaatggcagacaaaatagacactgccccagcctccatggagttctcgttccaggagggtgaaaggtaaatgatcaggtggagtgggaaataagattattagagttgctatacaacatgaaggggtagggatgaagttggaaagtgcccttaaaaataagagcagtcaggctgggtgtggtagctcatgtttgtaatcctagcactttgggaggccaaggcaggcagatcacttgaggttatgagtttgagaccagcctgggcaacatggtgaaatgttgtctacaaaatgcaaaatttagccacgtatggtgatgggcgcctgtaatcccagcaactggggaggctgaggcagaatcgcttgaacccagaaggcagaggttagagtgagccgagatcatgtcactgcactccagccgaggtgacagagcaagactctgtctcaaaagaaaaaaaaaaaaaaaaggcagagagccagagaaagaagcatctcttcatctctctagggaagggacatttgatttgaaacataaaagatgaaagtcaggtggagggtgagcaagtgccaagactaagcagagaatggatttgcatgtgtgcaggaacgatcaagaaagcctgtgtgggccgggcatggtggctcatgcgtgtaatcccagcactttgggaggccgaggcaggaggatcacgaggtcaggagatcaaaaccatcgtggctaacacagtgaagccccatatctactaaaaatagaaaaattagctgggtgtggtggcaggtacctgtagtcccagctattcgggaggctgaggcaggagaatggcatgaacttgagggacggagcttgcagtgagccaagattgtgccactgcactccagccttagcaacagagcaagaccaactcaaaaaaatattaaattttttaaaaatcctatgtgcctggagcacagtaaccaagggaaggaagatgaagattgaaagagggacagaggcagcttattcaagtttggattttattctaggatcaatggaaaactattgaagggttttaagcggggagtcataggattagatttatatttaagtggagagatggacagacttgagagatttgatacatgtaaatagctgctggtttgaaggagcaagagttgaaaaaatgagacaagatttatggctgttgagttggtgttgatgaactagtggcatatattagtgtagtcatcatgtgcatggagtaaagtggacacattgaagatttcttccgaaattactgatggatgggaagtgggcacatggagatcatcatgatctgactgcactactgcccactttggccagggatgcatggtgtggaggatgaccatatagctggtcgtgtcctaacatggcgaccgtaagacctcttcccatcattcctgtggacatcctgggtattgctgtgctctgtctccgggctgtgcttagccagctctgaggacatcagattgctgacgtgcttggcatatctgctgcaaacgtagcactcaagtccacatcttccccaataaccttgtgactaaattgtagtgtcacacaagggcgtgttcagaaattagcatttgaaaagaagcctccttgctttcagtttgagctgacatgatctcttttcctctggggaaatgaaatttattaatcataataaaaccattggattctgaaggtagaggtcaccctgaagagaaaaggaggcagctcatttctgaggagtagttcaatgctgctgtattttccttctgccttggaagagaatactgccaaattgttaccttgggttttccacaaaggttgaaactatgcccagcgttatagaatttaccactgaagtatgcagtaggaaaaggtgggagctacgcttttattaaatacattcaaattgcccatatagtgtctccccagaagaggaaattattgccacagtaaaaccatttccccaatttttaaaataatatatctgaatttgcatcttttcacatttgttttgaggtaacaccttgccataacatcacttaacaaactctcaaggatttcagtttgcctctgcacttcatatcctatttatgaaacagctttgccaaatttaagtaccttaaaaataaccctattaacagatttttctctggaccaatcaatcacagacttcattccctcatgaaataaagagcagtaccaaggttatagttttccttttatgcctgttactatgtacttctagttaagtgggtaaaggcccaggtctcaggagtgagctctctgaatatattattattttatcaaaaactttttaacacatctgcccttggaccgatacctgtttttcctcccagaaagaaggataatcgttgattaaaggccatttttgataagaaggactgaagggtgtccccaaagaatgaaaggcaagagggagatgactgtcagtttcactgacagattcacctcagaagagaggcatcccttcaggtccttgtttgaggatcaggagaatcctcttgaagctgaaagcctcatctagattatttgcactcatcaagtgccctttgacacaggcagatgggcttgagagttggaagatgcccagtgcaaacctggtataatcaattgttttattccacctagggtctaacttggagtctgagaaggtccatcatcacgctttcttcaccttctcagactccatggtgtgaggtggtcaaacatgtattggattggtatcacttatctaccaaccatgagaaagcttggaaggaaaatggggggaaaacaggaaaggagagggaaaaggtacgtgcaaattgggctctaagggatgagagacgagctgaaggttgataatacagacaaaccatttcttccaccagccttgttccttcattcaggaaatggtcaaagaatcaaaaaacgatgtcgatcccagtgagtgtctgatgcattcatgccgagctgctgtgaatgttggttgctaacagtacagctgttcccttctccagaaaattgccccatgtcagaggaagccactttaactcaatggtgcatcactcactcctcaggaaagcccacagctaatgccgaaaacttatgtaggcattaaaaagccaacccacttgcctctaggtggaacctgctgtagcatgaaacccataggatcaggtcgcagatattcatctcagacgttgcgttttttttccccttgctctgacctacttgcccctctcttcctcttgaggacaccccattcggtaagtcacttgcacaggaatctattccagtatcagctttcaaggaaggacgtcagcttcagtcagtattaagatagcagcattcaaactatctccaggaaaatatctggcagggcaaacaagtatgggcacaggatacggtggaccaagcacgcaagttgccctaagagattcaagtatcaggctgagtgcagtgactcacgcctgtaatcctaacactgagaggctgaggctggtagactacttgaaccctggagttttgaaccaacctgagtaacatagcaagactttgtctcccccctcataaaaaatcaagatctgccctgtctagttatgcgaccttgagcaagtgacttcacttgattcctttaaaaaaaaaagttaacttccagatatttagtaggcattcagcacgtttggtttccatctcttctccatttttatcctaaagcctataccagaagccatggcaggtagtaggatggtagagagaaaaacacaaagatgagtaaatgtcattaagatttgttgtttcaaatgcctcccccttcccagaacctggccatggattaatgtgacagaagttctggaataataggatcaaaaccaaatcagtctgattgaatgggaatgggaatgggggtcccacagaccctttaaggctgcttccattcaaatatacttgttcctttccattctaagatgctggacactaacttcagacaggttcacttcaccctttctgattcaccctatttcacttgaatggtgacagctgaatcaggagaaaaaggcactctcttgagaattaaaataccctctgtgggtgctgggcttaatacttgaagttgtttctttcttacctacctcagtctctaaggcagctacttgagcagtgtagaaacagtattatggggggaggcagggaaaagcatatgtaagtacgtgtgtatatatgtatttatctgtcaaacatagcaatagcaaccatgttaaatgcacaaaaaatgtatcatgtacagatgaactcttcttatactacacagcagagtagaatttgcttctcactggaagatgagtagggcccctgcatactgtcttggtattttggattttatgattgttattgttttgtaattgcatactgtggatcaatcttcacctctattttcctttcagttacggacgagtttatgctgccgacccctaccaccacgcacttgctccagcccccacctacggcgttggtgccatggtgagtacaagtttctccttgtcctcactttctcctgcctcccttccctttccccagctgggacctcagtacgggttgacgtcctctcacttcccgttaattgaatttgtctcttgtgctaacagcagctaaaatgccacattaatcctcccagtaaacttgataaatgtcttaatttcttggcaatgtagtgcatgtaagttattatatttctaattttgcaagtctcacctagcagagcacttaccttaatggaataattagtcattttgataattaaatccatcactaacagaatgcagtgtcaatgcagaacttttttttttctttttttttccctcccttgctgctcattcacatagccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatagagaggggcacactttgtgtgtgtacctagtacataagaaagtagaaggaatcagctgggtttgggggttgccttttgttttggggcaggtctgggtttttgttttgggagggggtggggggagggtaaaaaatgggaggtaagggtggggtgaacttgcctgtacttgttcaaacttctatgcactgaaactcttgagtacagtaagacgtgcccatcacgtgagagcatatgcaatcattacaaagctttggcatgcagttttctgcttggatcaagaatatcagtccttaccctaaaaatgaatccccataggcattcatttgaattgccaatacttttagaaaaaggaaatcgttaagtgccaccttgtagccattaaaaccatggccggacagttcactgaagctcagtcatagaaattcagccatgatttggaagcattgttttgcacaagcttaattacatcaagcaattcatctgtacaactccacaactcccttctcaagatcagattccatacagcttacagagccaagttaagtaagaagtaggttgagattttcatcccaattctgcattcaacaactctgcttcaacacctagtccacatgaggaatgtgttggagagttgaattacattcaacaactggtccaaattcaacctcaagtgcagattattctgttataaaaaaatgagacagtgaaaatccttccattgtccagcttataatagagtccttttagctaagaggactggctgacagaatttggttttgcagggaatttctttaggaggagctattggggaaggtcaggaatggccctatctttagttctccaagaatgacctgggatgggtagggggtgcctccatttcggttggttttgagtgtctatttttcacattagtctttttgatgatccacatgttgcaaaaggaaaatgtaaaaaacacacccctcaaattgctttgtttcagaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaagg

SEQ ID NO: 38649 - DNA, 144237 bp, Homo sapiens; identical to SEQ ID NO: 38451

SEQ ID NO: 38650 - DNA, 48412 bp, Homo sapiens
ggactggtgttaagggtcacgcaagatggcggcgcccagaggctgctgaggcgcggaacggaggatggcgctggtggcgttggtggctggggctcggctggggcggcggctgagcgggccggggctggggcgagggcactggacggcggccaggcgctcccggagccggcgcgaagcggcagaagccgaggcggaggtgcccgtggtccagtacgtgggcgagcgcgctgcccgcgccgatcgcgtcttcgtgtggggcttcagcttctcgggggcgctgggcgtgccttcctttgtggtgcccagctccgggcccgggccccgcgccggcgcccgaccgcgccgcaggatccagcccgtgccctatcgcctggagctggaccaaaaggtgcaggccgcggcttcctccctctctccttctctctcttccgcgctcccggcctccctcgacctgttcggctctcttcaagaagttggctcctctgggtggacagacttccggcaggacgaccctcgagctggctgcaagcccaggaggggaaggcgttaggggtggccatcaacatttattgggtggcagtgccagatgttgtgccgggtcgtgtcattcgcttagcacccagtgagtcgacagttattcccaattacagggaaggaaggggaggcccagagaggttgaggcccgaggccccaccgctgctagctgtttatatgcggtggaattctcactcaggccagcgtgactgcaggagttctgatgttaggaaagcaaaattcaaaagtccattgaaaatgtataccagctgaggtgtttcaatgaacaactcagaaaggggatttttttgttttaatttattttttatagacagggtctcgctctgtcgctcaggctggagtgcagtggtgtcatcatagctcactgcagcctcgacctcctgggctcaagagatcgtcctgccacctagcccggcaaatttttgtatttttagtagagatggggtttcgccatgtttgctagactggtcttgaactgaactcaagcgatccgcccgccttggcctcccaaagtgctgggattacaggcgtgagccactgtgcctggctgaaagaggattgattttaaaatcaaaccatctttggtctatatccaacctcactggaagccccggttttctcatcgggtcagtgaagggaggattgatgagagtgtagttaaaacacccaacaaagaccttggggttgtcactgtgttaaattcacagtagctgtagtactgagttttccttttcatggtaatagcctgagtacgtaacggtgtagtgtcagtgaaaagcatgcagtcaagttactcaacctttagaagccacactttctcatctgccttatactactgctaacagcaataagaaatagaaaatataataacaaaagcaataacaaaaactaaacaacaacaacaaaaagcatacaatataggccaggtgcggtagctcatgcctgtaatttcagcactttgggaggccaaggcaggaggatcatttgagttcaagagtttgagaccagcctgggtaacacagtgagaactcatctctctgtctctctctctctccatatatatatatatatatatatatatatatatatatatatatatatatatatatatatgtatatgtatatgtataaatttaaaatacaaaatagagtacaaaatataggtttgttttttttttttgatctggctctgttgcccaggctggagtacagtggcgtgatcatgggtcactgcagcctcgacctcctgggttcaagtgatcctcctgcttcagcctcccatgtagctgggaccaagcttaaattttgattttttcatagagacaggttgtcactttgttgcctaggctcaaaatatagctcttaccttgagatgggtactattccctataagggctttagctatattaactcgtttagtcttcacaacagcttagtgagagagatggtactattatcatctttactttttagagaaggagaaacagatatagaggtaaagtaatctatctcagatcacacagttggtaaggatggggccaggattcaaaactaaggagatctgtcaacttacctaccgcgctaagagatggtggtgttttttgttttgttttgttttgttttgtttttgagacagagtcttattctgtcacccaggctggaatgcagtggcgccatcttggctcactgcaacctctgcctcccaggttcaagcacttctcctgcctcccgagtagctgagattacaggcgcacgccaccatgcctagctaatttttgtatttttagtagagatggggtttcaccatgttggccaaagcgggtctcaaactcctgacctcaagtgatctgcctgcctcagcctcccaaagtgctgggattacaggtgtgagccaccgtactcggctgctgctagatagtgtcttgatcttggtgaatggggatggtaatacctagtggtaagctgacatagaccataaatagactatatttatggtctatgtgtaaatcacccttcatagagtgattataaagattaaatgagataatacttatcaaacatatagtaaatgctcaataaatgctagttgctgtcttaataatatgtgttcttgggccaggcacggtggctgacgcatatagtcccagcaccttgggaagccaaggcggacagatcacttgaggccgggaatttgagatcacctgggccaacatagtgaaattctgtctctactaaaaatacagaagttagccagacgtggtgtgcacacctgtagtcccagctacttgggaggcttgaacctgggagatggagattgcagtgagccgagattgcgccactgcactccagcctgggcaacagagtgagactgtctcaaaaacaaaaacaaaacccccgtaaatagtatgtgttcttggatttgataaataacctgtcatttactactgaacaaacttgacattataaatcagttcatgctttgtgggaactgcttttcagatttcatctgctgcttgcggctatggattcacactgctgtcctctaagactgcggatgttacgaaagtctgggggatgggactcaacaaagattctcagcttggatttcacaggagccggaaagataaaagtgagcatccctaccttgtctcctctttgccgggattggtctgagaaagctctttttttgtattttttttgagacagagtctcagtctgttgccaggctagagtgcagtggcgagatcctggctcactgcaacctccacctcccgggttcaagtgattctcctgcctcagcctcccgagtagctgggattacaggcacatgccaccatgcctgcctaatttttgcatttttagtagagttggggtttcactatgttcaccaggctggtctcgaactcctgagctcaggtgatccaccctcctcagcctcccaaagtgctgtgattacaggcatgaggcacagcgcccagccctccctttggtgttcaagaacatggttacataaacaaagaaatagcaaagaaatagaggaagacttaaagggatgttgtttgaaaccatctgggctaggttattttttagcctctttggtaacaatgttgaaccctcaggcaaaaggcaagcacctggcatttgcagataagtaaagatgttcttttgtggcctaaaagagatgacctttttttcctggcttggagacagacagcgtgaagtactctgcagtgcctagaatatgttttggagggaaaaagcattgaaatcgttaacatggaggctttattccaaatgtttgagccttggattgtaaaaatgttagaaataacttataatggcattttaaaaagtagacattagcctggctgggcgtggtgcctcacgcctgtagtcccagcactttgggaagccgaggagggcagcctgtaatcccagcactttgggaagccgaggagggcagatcacttgaggccaggagttcgagaccagcctggccaacatggtgaaaccccgtctctactaaaaatataaaaaattagccgggcatggtggcacgcacctgtatagtcccagctacttcggaggctgaggcacaagaatctcttgaacctgggaggtggaggttgcagtgagtcgagatcatgccactacactccagcttgggtgacagagtgagactgtcctaaacaaacaaacaaacaaacagaaaagtagacattagctaaaaattactgtgagaacagtaagaaatatttccttggccaggcacaggggctcacgcctgtaatcccagcactttgggaggccgagatgggagggattgcttgaggcctggagttccagaccacgctgggcaacatagcgagactctgtctctaaaaaaaagaaatgaaaaacgaaaaagaattagctgagcatggtggcatgcacctataatcctagttactccagaggctgaggtaggaggattgcttgagcccaggagtttgaggctgcagtgagcggtgattgcgccaccgcactccagcctgggcaacagagcaagatcatgtctcttaaaaaaaagaaaaaagaaagagttcctaaaatagagaggaaatgccaggcgcagtggctcacgcctgtaatcccagcactttgggaggccgaggcgggcagatcacgagatcagaagtttgagaccagcctgaccaacatggtgaaaccccgtctctactaaaaatgcaaaaattagctgggcatggaggcgcgcgcctgtaatcccagctattcgggaggctggggcaggagaatcgcttgaactgggaggcagaggttgcagtgagccgagatcgcaccactgccctccagcctgggcgacagggcaagactccgtctcaaaataaataaaagataaataaataaataaatataaaataacataggaaattacccagaagtacatactggacaaacctttcatttttgttttttcctgttcccttgttcacagacaaatacatttttacatacatagcatatattttgttttctgtcttttttcatttattttgtatcagatatcttttttgtttgtttgtttgagatggagtcttgctgtcgcccaggctggagtgcagtggcatgatctcagctcactgcaacctccacctcctgggttcaggtgattctgttgcctcggcctcctgagtagctggtactacaggcgcccgccatcacacctggctaatttggggattttagtagagacgggggtttcaccacgttggccaggttggtgttgaactcctgacctcaagtggtccacctgccttggcctcccagagtgctgggattacaggtgtgagccaccatgcccgacctatatatcagatgtcttttataagtcagtatagaagtctttattagctgtaagatgttacattactttttttttttttttttttgagtcagagtttcactctcgttgcccaggctggagtgcaatggcgtgatcttggctgaccgcagcctcctcctcctggatttaagcaattcacttgcctcagctttccaggtagctgggatttacaggcatgtgccaccatgcctggctaattttgtatttttagtagagatggggtttctccacgttggtcaggctggtctcaagctcccgacctcaggtgatccacctgcctcggcctcccaaagtggtgggattacaggcgtgacccaccgtgcccggcccgcgttacattttttataccttttattcagagcaattttagacttacagaagtgtgcagagtagtatgatgtggcatcaccagcttcaggcatcatcaactcatgccagtctcgttttcttcatttttcccaccttccccctcaataaatttgaagcaaattccaacagtttaattttttgggggggtaaggggagacagggtcttgccctgtcacccatgctggagtgcagtgtcatgatcactgctcactgcagccttaacctccctggcccaagtgatcctcccatctcagcctccaaagtagctggaagtgatcctcccacctcagcctcccaagtagctgggaccaacaggcatgcaccatgatgcttggctgatttttgtatttttgtattttttttttaaaacagtgtctcgctctgtctcccagaaggctggagtgcagtggtgcaatcttggctcactggcaacctctgcctcctgggttcaagcagttctcctgcctcagcctcctaagtagctgggactacaggcgtccaccatcacgtctggctaattttgtatttttagtagagacgggggtttcaccttgttggccaggtgggtatcaaactcctgacctcaagtgatccgcctgccttggcctcccaaagcgctgggattacaggcatgagccactgcccggccaagatttctttaataagaagacgaagtatgcattttttttttttttccagatgaagtctcgctcttgtcccccaggctgaagtgcaatggcgcaatctcagctcactgcaacctccgccttccgggttcaagcagttcttctgcctcagcctcccgagtagctgggattagaggcgcccgccaccatgcccggctaatttttgtattttaaatagagatggggttcaccattttggccaggctagtctcgaactcctgacctcaggtgatctgcccgcttcggcctcccaaagtgctgggattacaggcatgagccactgcgcccagccagaagaccaagtatgcttttctggaacccgcattatgtaatagagacagcccatgccatgggctgggagttgggcttctggtccttgctctgcgcctaacttacctgtcttgatgagtctttcctacctccgactctcttttttccagtgtagtagcgtggagttggacagtatgatttccagtggtagaaatgcatgcctcaatcagtgtcctgtgtcttttccagcgaggggctacgagtatgtgttggagccctcacccgtctccctgcctctggacagacctcaggagacacgggtgctgcaggtctcctgcggccgagctcactctcttgtgttgactgacagggaaggaggtgagttgacctattgaagggtgatggaagagtgcagggaccatttcactgtgaactggagcctcaaatcaggcctgagtggcttgatcgattgagccacatctaatgagtgaaatgtggtatttcctgagcagatcagtgggattgctcaagacagctggacaaaccttgttgattctttatttatttttatttatttattatttttttgagatgaagtctcgctctgtcgcccaggctggagtgcagtggtgtaatctcggctcactgcaagctccacctcccgggttcacgccattctcctgcctcagcctcctgagtagtagctgggactacaggtgcccgccaccacatccagctaattttttatatttttagtagagacggggtttcaccatgttagccaggatggtctcaatctcctgacctcgtgatccgcccgccttagcctcccaaagtgctgggattacaggcgtgagccactgcacctggccaccttgttgattcttatgtgctctgctctctggttcttggaaaatcacatgtatttataaatgtaactgcacacaaggcagcctgatccatttgctatgaagtccctgagctgggtggtgtgtagacgtggctttttctttttttttttttttgagacagagtctcgctgtgctgcccaggctggagtgcactggtgtgattttggctcactgcaacctctgcctcccaggttcaagcaattctcctgcctcagcctcccgagtagctgggattacaggtgcctgccaccacgcctggctaatttttgtattttttgtagagacggggtttcaccacattggccaggctggtcttgaacacctgacctcaggtgatccgcccacctcggcctcccaaagtgctgggattatagacgtgacccactatgcccggccggaagtggctttttctattggaattgaaagaagcctatttgctaacacatactctaagtagttgggggctttcagagtccgggcccctgggtaacatggcctctttttagaaacggggtttttccagggaaaggtcaatgtgatcacatttttcacatttcatttttcttttttttatctgagacggagtcttgctctgccacccaggctggagtgcagtggcacgatctcagctcactgcagcctctacctcctgggttcaggtgattctcctgcctcagtttcccgagtagctgggactacaggcacccaccactgtgcttggctaatttttgtatttttagtagagacagggtttcaccatgtttgccagtctggcctcgaactcctgacctcaagtgatccacctgccttggcctcccaaaaagctgagattacagtcatgagccactgtgcctagcctcaaatttcattttctggctgagtgtgctctgtaggagaaggcggaggtggcatttaggagctctttctttttttttttttttaattaaaaagtaaacgttaatgtcgaaaatgcaaacttggggaagatgggaaagatcacacacaaggctgtcacttcacacttggaaggttgcacagcggctgggcagaggtgcttctcacttcccagatggggcagtggccaggcagaagtgctccccacttcccagacagttgacgactgggcagaggcgctcctcacttcccagacagggcagaggcgctgcatttaggggctctttctagaggggattggtgttaagggcagcctggtgacaggtgtggggagtccggttctagcctcagaaggtggaattcccaagaagtggatctagggccaggaggggaaggcgggtctagattcccccatgccccttgtgagtttctgcagagcctgagaaagttggagaaggaaacccaggggcagttggggggtgggggtgagtaaccaggacgggaccaccagcgagaccccttccagtcctcacattctaggatcccacaaacctgcagaactgatttgattggtggtgttatttttagtcttcagcatgggaaacaattcttatgggcaatgtggaagaaaggtggtcgaaaatgaaatttacaggtgagttcctaaaaggcctacccttccccatgttgagttaagtgtcaaaacatttctagggagatgactgtggtaaacccgcggggcggtcagaggcatgcctgagagggggccgtgagaactcagcagaaagctgggggagtgctgtctgtttcaggttgagcaccatgtgttagcttggtgggagaagagggggcatgagcattggttttaatgtgtaaaacctccggataaattttttttttttttttgagatggactcttgctctgtcgccaggccagagtgcagaggcgcaatctcggctcactgcaacctctgcctcccaggttcaagtgattctcctgcctcagcctcctgagtagctgggactataggcacgtgccagcacgcccggctaatttttgtagttttagtagagagggggtttcaccatattggccagaatggtttccatctcttgacctcatgatctgcctgccttggcctcccaaagtgctgggattacaggcatgagccaccacgtcctgccctcttaggatgaatttttacaaattaagtttttattttaccaaattgatttttaaacattcccctttattcattttatttttatttcatttttttcattttatttttatttattttttgtttgtttgtttgaggtggagtctcactgtgttacacaggctggagtgcagtggtgagatctaggctcactgcaacctccgcctcccaagttcaagcgattctcatgtatcagcctcccgaatagctgggattacaggcgtccgccaccgcacttggctaattttttgtatttttagtagagatggggtttcttcatgttggccaggctggtttcaaactcctgacctcaagtgatccgcccacctcggcctctaaaagtgctggaattacaggcgtgacccaccgcgcccggtgagttcttttcattttagtgtttaaaaacacttccctctagttccttgtatgttgttggagggccttaacaccactctcaactttggccatgtgttaaaatcacctaggattttgtttggctttactttcatgaccaggcctgactcgacctcagatttgaccttgagagttaccccaacagttactgtgtgagcggaggggacgggccatcagttggggtgacagggaaagggctgcacagtgcttgtcatgaccgcatcccttgcttcttcccaatttgttcctggctgtagtgaaagtcacagagtccacaggatgcaggacttcgatggccaggtggtccaggtaagagagatgggccgagagctgcttgttgtgttcctggggtgcttttgaaaagttgagatttgggtagggtgatggcaaatttgttagggggattttctgaattaaattattttagtaaaaattgtagcctacttactataggccaggatttatgctagattctagggatacaaagtttaataagattttggggccgggtgtggtggctatacctgtaatgccagcactttgggaggccgagacaggtggatcacctgaagtcaggagttccagaccaccctggccaacatggtgaaaccccgtctttactaaaaatacaaaaattagccgggtgtggtggcacatgcctgtaatcccagctactcaggaggctgaggcacaggaattgcttgaacctgggaggtggaggctgcaatgagctgagagattgcaccactgcactccagcctggatgacagagcaagactctgtctcaaaaaaaaacagatttttggggatgacactctagtgagtgaacaagttaaaaagctaactgaggccggatgtggtggctcacacctgtaacgtcagcctctggggaggctgaggcaaaagtatcacagcacttgctgtattcatgcatatgtgcattgaaatatttatgataggtacctaccatgagccaggcactattctggggatgagaataaaatggagagcaaaatacagctggcttagaacaccacagcactaatcatactgtgatacggctggctttttggttttatttggaaattttttagaggcagggtctcattctgttgcctaggctggaatgcagtggcacgatcatagctcactgcagccttgaactcttgggctcaagtgatcttgcctcagccccctgtgtagctgggtctacaggtgtgcatcaccatcctcggctaattattttaaagagacagattctcactgtgctggccaggctggtctcaaactcttggcctcaagccatcctcccgccttggctgcccaaactgttgggattatgggtgtaagccaccatgtcaggcctccttcacctattagactgagtgactttgtgcaagttaccagacatctccaagatagtttctttttcttttttttttattttagtgcagtggcacaatctcagctcagagcaacctctgcctcctgggttcaagcgattctcgtgcctcagactcccgagttgctgggattacaggcatgtgccaccatacctggctaatttttgtatttttagtagagatggggtttcaccatgttggccaggctggtcttgaactcctgacctcaagtgatccacctgccttggcctctcaacgtgttgggattacaggagtgagtcactgtgcccagctgagattcagtttcttactaggtggttttggttattgacttaacacaatgcctggtgtaaaaattgttcaatagatggtgcttttctttaggcagttagaaaaatgagtttggaactgaggagagttgttgagaccagagatcacagtgcagaggccacagttaagcattgagaatggctcccatctcccagggtagcatgaggagtgaggagagaggagggcaggagacacaccctggagagagatcccaacagcaaagggtctgaagtagaggctgagtgtgtgagcaaggctggaagctgtgaaagtagaagagagggctgggaggagaagggttatggagaaggggtggttctttggagatggcgtgggatggatggcagagctcttggatttgcccctttggagatctgcattttactttaacaagagcagtttcaatgcagtgggagactggtagattgagaaggagtaagatgagcatggagcagtctgcctggaccatgctccaggtgcccaggagcggcaggcgatggtgctggtccttctttggatgaggacaccagggttctaagtatttcttctcatcccccttacctctgtttgtctgctaggtcgcctgtggtcaggatcatagtctgttcctgacggataaaggagaagtctattcttgtggatggggtgctgatgggcaaacaggtagagttcttttcatgcactggggtcgtgaaacttctcagcccgtgtcatgtggagctgtgagctgtagggcatttatgggctagaacccttcttccttaattcagctcttacctcttatcactttctgaggaacactattcttggctccatcgcccaagctggagtgcagtggcgcgatcacatctcactgcagtctcaaactcccaggctcaggtgatcctcccaccacagtctccagagtagctgggacaacaggtgtgagccaccaagcccagctaattttttgtaacaacagggtttcgccatgttgcccaggctggtcttgaactcctgaccttaagcagtctgcctgctgtggcctcttggtgggctgggattccaggcaggagccactgtgccctgctgtaatactttttttttgcatcccttccattcccctcagccctggctcccatagaaatgaactgagagaaggctgggtgcagtggctcacacctgtaatcccagcactttgggaggccgaggtgggcggatcacttgaggtcaggagtttgagaccagcttggccaccatggcgaaaccccatctctactaaaaatacaaaaattagctgggtgtggtggcacacggctgtaatcccagctactaggaaggctgaggcaggagaatggcttgaacccgggaggcggaggttgctgtgagccaagatcgcgccattgcactccagcctggacaacagagcaagactctgtctcaaaaacaaacaaacacaaactgcagagaaaaggacaggcaggacctgcccaaaggcaaatgtcattattggcacttggtatgggggtaacccctggccagcagcccaaggcagagcactgaactgtagactcttgccttcatccagggtccttaaaggggcctattcctcagcaggtgaatggatcaaccgtggtgcatccagacaatgtaatgtttgttatttagcactaaaaagcaataagctgccaacccatggaaaggcatggaggaaacttaaatgcatgatactgattaaaagaagcctatctgaaaaggctacatactataggattctagctatatggcattctgaaaaagacaaactatggagacagtaaaaagatcggggccgggcgcggtggctcatgcctgtaatcccagcactttgggaggcctaggcaggtggatcacgaggtcaagagatcgagaccatcctggctgacacggtaaaacccatctctactaaaaaatacaaaaaaaattggctgggcatggtggcgggcgcctgtagtcccagctactcaggaggctgaggcgggagaatggcatgaacccactgtgcccagcctctctgcttattgttaaccatgccattttaagttccctgttttttgggagtggtgttggggatggcatgggctcttagagattttctttacttttagcaagaccaccagtgcattagaaattgcttgttgtgatcaggcaggtggctcacacctgtaatctaagcactttgggaggctgaggcaggaggattgcttgagcccaggagttcgataccagcctgggcaacatagtgagatgctgtctctatttcaatataaaaaaattttagaccaggcgcagtggctcacgcctataatcccagcactttgggaagctgaggcaggcggatcacctgaggtcaggggttttgaggccagccttgccaacatgacgaaaccgcatctctgtgaaaaatacaaaaattagccggctgtggtggtgcgtgcctgtaatctcagctacttgggaggctgaggcacaagaattaaagaactgcttgaacccaggagctggagattgcagtgagccgagatcgcaccactgcgctgcagccagaggaacagagtgagaccgtctcaaaaaaaaaaaaaaagttgtatgagcatgcaactaagcagattagggtttcttttctttctttcttttctttttttttcttttttttttttttttgagagtctcattcttgccaaggctggagtgcagtggtgtgatcttggcttaactggaacctccacctcctaggttcaagtgattcttgtgcctcagccttctgagtagctgagattacaggcatgtaccattatgccctaataatttttttgtaattttttttttttttttttaagtagagacagggtttcgccatgttgaccaggctgatctcgaactcctgacctcaagtgatctgcccatctcagcctctgaaagtggtgggattacaggcgtgagccactgcacccagccccagactgggatttctgagctgatacttgttaagtgcttaaaactgcacttggcatatagtaagtctgcctatgtgtttgttaaaagagcgaataattaaaaatctgtattttccactgtgttaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtatgcagtcgccgacagcgtggtgctgggaggtttggaaacattaaagtgttaaggggccgggtgtggtggctcacacctgtaatcccagcactttggaaggccgagacaggcagatggcttgaggtcaggagttcaggaccagcctgggcaacatggcaaaaccccatctctaccaaaaaaatacaaaaattagccaggtgtggtggtgcatgcctgtaatcccaggtactggggaggctgaggcatgagaattgaatcgtttgcagattgcagtgagctgagatcgtgccaccacattccagcctgggtgacagagcaagactctgtctcgaaaaaaaagagcaaataggctgggcgtggtggctcacgcctgtaatcccagcgctttgggaggccaaggcaggcggatcacctgaggtcaggagttcgagaccagcctggccaacctggtgaaaccccgtctctactaaaaaaaaatacaaaaattagccgggtgtggtggtgggtgcctgtaatcccagctacttgggaggctgaggcaggagaattgcttaaacgtaggaggtggaggttgcagtgagctgagatcgcgccattgcactccagcctgggggacgagagtgagactttgtctcaaaaaaataaaataaaagcaagtaaaggaataaagaatgactacttcataggcagggcagccaccacacacttttaagtgaccagatctcaggaggaccaaaaaaggttatgttaaaccatgagaaaccacccccatgagccagtcatctccgaccagaccccacctccagcattggggtttacatttcagtgtgagatttgcgggggggacagagatctaaaccatatcaatcgtataactaatctctcttcccatcactcattttccacaattaccaactgatggccaattcaaaaaatagagatatgattcacataccataattcaccattttaaagtttacaatttagtggattttagtattaacatattcacaaggctgcacaactgttactactatctaatttcagaacattttaatcactcctccaaaaaaccccacaccactagtggctagttttttgtttatttgtttgttggttttggttttgttttttttcgacatagggtgtcactttgttgtccaggctggtgtgccatcatagcttgctgcagcctcgaactcctggctcaagcaatcttcccgcctcagcctccctagtaactgggaccataagtgcacaccatcacgcccagctaattttaaaaaaaaatttgttataaaacaattagccaggcgtggtggtgtgcacctatagtcccaggtgctggggaggctgaggcaggagaatggtgtgaacccaggaggtggagcttgcagtgagccgagatcatgccactgcactccatcctgggcgacagagcaagactctgtctcaaaaaaaaaaaaattttttttgttgtagagacagggtctcacttttttgcccagcctggtctcaaactcctgtcctcaagcgatcctcccacctcagcctcccaaactgctgggattataggcacgaccactgctgtacctggctggtgcagtgctgcagtttgaggctgtactgtgttgtgatcatgcttgtgaatagctgctgcactccagcctgggcaacatagtgagatcccatctctaataaataaacatattacattccttgatatgatcaaatttctgacaacatacagcaaggttttaaatatatattaacagagaaatctgcataaagggaaactaaaggtcagctaagaatatttttttaaaaagtctcctctgtggtctggtacagtagctagaagtggttgcagatttggctaggagcttcctagtaggcaaagcaaagaagaaacatggtatttaaatgattcattgttccataagataaacagcagaaaaggtgttggggagaagtacggctctccctgttaccaaggtctgagagaaatgtcacccatggccttcctgtgggggacagatccagtggtatgccattgttatctattgccacataacaaatggccccaatacttagtgaattaaaacaatacactttatttatttatttattttgagataggatcttgctctgtcacccaggatggagtgcagtggtgtgatcacggctcactgtaacctccacctcctgggtacaagcaattctcctggctcagccccccgagtagctgggactacaggcacttgccaccacgcccagctaacttttgtatttttaatagagacagggtttcaccatgttggccaggctggtctcgaactcctgacctcaagtgatccacctgcctccgcctcccagagtgctaggattacaggcgtgagccaccacacccggccacaaatgtcattttatgttaattttggttgacatctgcctcgtccactagactagaactctctgagggtggaaactgggcctcttttgcttcccattctaccccagcacctagtatgatgcttggcatgtgatgttcaggaagtatctgtggagtgaatgaatgaactaggactcagctactctgtacctaagaccagaacacttcccggtccttactggcttgctttcctaacagtgtggctcctttctttggttcaggtgaatgtgccccgctgcttacacttctcaggagtggggaaggtgcgacaggctgcatgcggtggcacgggctgtgcagtgttaaacggtgagaccttctttccggtggctcattgggaagctgtaggtagattacatagggagtggtcagtgtccattggatttgcaggccgtagaccttagccttaggagggtaacatggctgggcgcggtggctcacatctgtaatcccagcactttggggaactgatgcaggaggattgcttgaggccaggagttccagaccagcctggacaacataacgagaccctgtctctaccaaaaaatggagaaattagctggaaggctgggtgtggtggctcacacctgtaatctcagcactttgggaggccaaggcgggcagatcacctgaggtcaggagttcaagaccagcctggccaacgtggtgaaaccctgactctactaaaaatagaaaaattagccagacatggtggtacatgcttgtaatcctagtacttggaaggctaaggtgggaggattgcttggacccaggaggcagaggttgtagtgagccgagattgcgccactgcactccagcctggatgactctgtctcaatagaaaaagaaaaaatgaaaaattagctgggcatggtggtgcacacctgtagtcccagctactcagaaggctgaggcagaaaggtcccttgagcccaggagttcgagctgcagtgagctatgatcatgccactgcactgggcaacacggtgagaccctgtttcaaaaaaggaagggactatggccatgggaagatggcattggattagaagatggcattacagggtgtgaatgaagttcttaacaaaaagcgaatagtctgcgatttatctgtagatacatggccacagagctgagtcatcctagagcaaacctctggagtggagagcgaactacttcattcccctcccttagcctgggccagagagactccagctctgccttctccagccaaaaaatcaaaggcagatgggagaacagccttcagctttggataacgatgaaatatctggcaccactgatgaatattaaactttctataaccaaaacatcatttctaagagttttaagaatctggccagacattgttgatgtgtttggccttctgatcagtgtgaaacacagagctgtcattagggggagaaaacatcctccaattctctggtattcgtatgggttttctggatgatttatacgctcgtcccttccaggttactaaccctcaagatgtgggaagtttgtgttctgagccaggagagctggcgagacagactcccccagcaagaatttaagcaggggagagagaattattattctaaatctctgtctgcatgttcttgccaagcaaggaggaaaaaaacagaacaaaaaaaaaacaaaaaaaaaccgtgtggatgtcataaaccttggtggtgtagtttgagtttctggtgagggaggttcttacttggatggacttactgacccttgtttttactgtaatgtaggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccagtaagttaccaagcccggtggccctggtgtgagcccagcagaggttctctgtctccagttcaaccccaaactgcgggcagctctcaggttccacccatccaacagaacggcgcctttgtactgataactcaagcaagggctaagccagaagttgtttgcctcgaggttgtataatgtcttgttttccccccctggagttttaattttggttcgtttggtttgtgggtaggctaacgtgaacgtgcattttctcaagagagcacccgttggtggtaggaaggggcattgctagtacgtcgggtgctggaggaaaccagcagaggcttggcggatccatgggtgggtgattaggaagtgaatgtgtggggcttaatcccattccctggccgagcccagaccctgatctgacccaggatatgggatggcaaaaggccgatttgtcagactgtcccgtggtttcacggaggtaaatctaccgatttctccaaagtgccggggtagagaatgatgaaaggggagagcaaaatggaggtttttcccaaaggcctgccagattacaaagccacagaatatccgcttaccctgcagggtaagggtaaggaatgtgtccttttcttggttacatctcttactccaccacagttaccgtgggttcaatttgctgctctttagttgactcgaatagtaaaactgtcctgaattaatttcattctgtgattctcaagtaaattagttatttccttgcaattaaaagaatcttttcatctcatggcaagtaattgttttctttttaaacatccaggccgggacagtcagttggtgtcatctttggttgagttctctggcctcattcccacgtggggcctgtcccagatgctcaccctctgtaccagggtcctaactgctattcacttattgtctgaattccaggctccagaggccgtcaaacaggcaggcctgggttgttatggctgccagctggagttttatctggctctaggctgaagcactgaagtggcagtggtcatgactaagccagagaattcctggccactgcccagccagagtggccacttgcatttgcagctgagtgtaggtctcatgaattctttttttttgagttggagtctcactcttgttgcccaggctggagtgcaatggcgcgatcttggctcactgcaacctccgcctcccgagttcaaacgattctcctgcctcagcctcccaagtagctgggattacaggcacacaccaccacgcccggctaattcagtgtcatgaattcttaaagctattttgatttgataaataagagtcgtatggactaatttttggggaaacaaatatctactttccagaaagttcttaaggcctcaactatgggcagagacacatgtttagaaatctgtgtgaagcatttgactagagcagaggcttttctatttgccctcatgccatgtagccatttcaggtcacagcgaaatgaaattcctttctggatttctccccgagacttaacaggcctccttctaagggtgagttactgcctgttggtagacagagcctagctgtcttcctgcctgtgtgcctggcatttgcagatagccatctgggaattagagttggttggtttatcctgtggtctgctagcattttggggagccaggccgaattgttctattaaacacctaagggctagctgggtgcagtggctcatgcttgtaatcccagcactttgggaggccaagatgagaggatccctcaaagcccaggagttcgagactagcctaggcaacatagtgagatcccttttctacaaaaaatacagaaattagctgggtgtggtggtgtgcgcctgtagtcccagctactctggaggctgaggtggaaggactgcttgagtttgagagttcaaggctgcagtgagctatgtttgtgccactgcgtcgcagcctgggcagcagagtgagaccctgtctcaaaagcaaacaaacacacacacacaaaaactatctaaggtctgagtgtggagaacaaggggcatgcttagatcaggggcctaagacagcttgtaattattccgtacttcatcagccccaggtcttgtagtcctggcttttccatgtcacttcctctgcctcccatgacccaagccttttgcccaacagctgatggtgacatgggcccaggagtgccccagctggtgcagacagagtcccacctgaaggccgggctaggagaggccatctcctgggttgacctcttaaacagcatcttgtactttttcttcatgacagtttttacagtttgtaaacatatattaaaatcatctgtctgttccgtctctggccagtccccagctcctggaacacagacctagacccagcacaagcaggcacttggtcattagatgccctgtggctgaatgctcccaagatatggacaatcaatccaggaatgacaaattgtcttacttttcactgtcaaatcaggaagcccagggtgtcgccaggatttgtggaaggcagagtttggtggcacacgattgtgggcggggcacaaggggtgagcagagtgggccgtgtgcaccagtgacctccagccccgtgcaccacccccagaccccagctccatgcaccacccccagacctgtccaccacccccagaccccaactccatgcactacccccagccctgtccaccacccccagaccccagctccatgcaccacccccagccctgtccaccacccccagaccccagctccatgcaccacccccagccccgtgcaccacccccagaccccagctccatgcatcacccccagccccgtgcactgccccctgccccatcttcatttgagtgctcatctcccacgtgggtggatgcagcagaagtcctggccgtggatgtgttttcgatatggggacagcatctcagacccttacttttgccttcaaagaaagcatgaacgcctggtaaaagctgaacagtgggctctgtaggtatccggttctagaaagcctgttctcatgacccatcctctccttggagacttgttcttcacacagtcccaaccaacccctgttttcctccctttgcagacaaaggagagctgtttgtatggggcaagaacatccgagggtgcctgggaatcggtcgcctggaggaccagtatttcccatggagggtaaggctggccggggaggtcttgagaatggatgctaagagtagagtcacctgacgtcactgcagacacctcgcgtgcagatgggccaggacgagggccatgggacctgctcccccttccgggtcctggctgcactcctgcagcgcggcatgctatgtcattgcacactctgtggtgacacccatgagatacccgtggtgcatctgcatggtgtgatgcgtgggggagtgacaccaggcttcttggggtgcaggagctgggtcaacccatcccggcccactgactgggaggttggagggagtagcccactcaagcatccagtcctataagaagccctgtcggaggccatccttggggtggatcggggaaacagaggcacgatggtgcaaaggctctggtagggtgccatgaggctccggagagggggagatattggatgaagttggcacgctagaagctgtttacagaagcccatgtgggggaatgcttcacaatgaatttaaaagaaagcaggatgtttaatatttagatggcccaaccgcagctatgaagtgaaaaaataaagtcgcttccttaggggcggtagtatgcaattagacaaaaaggctccttccagaattacaggggaagagacgctcattctaaaattgtagtttaccttagtgttgtttactaagtcagttctttaaggcattctaaaaaaggaggtttttggggttttttgaacatgaaacatatgttcatggtacaaaaaaatgcactatggaaaatgagtctcccaccacccagtttttgttccagaggcagccactggtcctgatttctttatgttcctttccagagatagtctctgcatagagactggtgtgcatgcgtgctttgtgtgtgtgtgcctgtgagtacatacatgtgtgtgcagtgtgcatatgggtgtattttatcagaaggttggattttaatttgttttgaaattgtgaaaagcgtttttaaaaaggacttgcaccaggtgtggtgtctcacacctgtaatcccagcgcttggggaggcccaggtgggtggatcacaaggtcaggagttcgagaccagtctgaccaacatggtgaaaccccatgtctattaaaaatacaaaaattagccaggcatggtggcacacgcctgtaatcccagctacttgggaggctgaggcaggaaatcacttgaacccgggaggcagaggttgcagtgagccaagatcagacgctgctgcactccagcctgggcaacagagggagactgtgtctcaaaaaaaaacaaaggacttgcaaaagaaatgtgtatatatatatgtgtgtatatatatatgtgtgtatatatatatgtgtgtgtatatatatgtgtgtgtgtgtgtatatatgtgtgtatatatatatgtatgtatttatatgtgtgtgtatatatgtgtgtatatatacacacacacatataaatatatatacatatataatacatttatattatacgtttatatatattaaatatatatatatattttttttttccaagactatcggtggaggctctgagaaagcaagttgaaatggagactttaactttgtttttttgtttttgcttattatgagacagggtctcacttttatcactcaggctggattgcagtgatgtgatcacagctcactgcagccttgaccttcctgggctcaggtgatcctcccacctcagcctcctgaatagctgggaccacaggcgtacaccaccacacctgacaaatttttttatttttagtagagatgggagtctcactatgttgcccaggctggtctcaaacttccggcttcaagcaatctgcctccctcagcttcccaaagtgctgggattacaggcatgacccatcacgcccgggcgactttagccttgttggaaagctgtttgtataatagagttgttcccaaggtggtggggcttgccggctttctcctgagcctggaaactgccggtgtgaggaacagagagtcgggcagtgggtgtggctcagataatgtgagcatcagtcatctacatgcccacttgctttctcactgactcctctcttctctcactttgccctttctttcgaaaaggacttccttctgaggggggaacttgggaaacagttaaagcagccgggttttgggtgaaagaacgctgacgagggtctgccccccgccctcatttccttcaaatcagagtgatcagcctgagatttgactcaggtcacgttgcccctgccataagggcatgtgcaaagcgctggtccctgtgcgggcagggagtggccggagcccgatcccgttgacattccatctgggtcacttgccctggctcgccacacaccaagtgtccttctggtcatttgctttttatttttatttttattttattattattgttttgagatggagtcttgctctgttgcccaggcttgagtgcagtggcatgatctcagctcactgaaacctccaccttccgggttcaagtgattctccttcctcagcctccctggtagctgggattacaggtgcatgccacgacgcctggctatcatttgctttttaaacacatttgtgcctttgggaaaagagcaccccagcctgtccctgtgacggcggcatttggcgccaaaccattgtccttcctcttgcacattcagggagcccctaagggtttgtgcacggagtggcctcgacccctgtcctctttggattggggtgggagagtccagtcccttctgatgactcacttaaaaaaaaaattacaagtgatttttcttttctttgttttgtttgtttgttcttttagacagggtcttgctctgtcacccaagctggagtgtggtgacaggatctcggctcactgcagcctctgtctcccaggttcaagtgatcctcctatctcagcctcccgagtagctgggattacaggcttgcacaaccacaccttgctaatttttgtattttttgtagagatggggtcttgccgtgttgcccaggatttttttttttttttgaaaacagggtcttgctttgtcgcccaggctggagtatggtgtgatcacactcactgcagcctcaaactcccaggctcaagctatcctcctgcctcagccccacaagtaactgagatgtgggatgggatgacaggcatgtgccagcaccacacccaaataatttttttttcgttttttttttaagagacggggtcttatgtgttgatctcaacctcctggtctcaagtgatcctcttgcttcagcctctggaatagctgagattacaggcatgtgccaccacacacggcttattttattatttatatttatttgttttattttatttatttgagagatgaggtcttcctatgttgcccaggctggtctcaaacttctgcctcaagtggtcttcccaccttggcctcacaaaatgttggaactacaggggtgagtcactggcttgggtgatctttattctttaaaacaactatgttcaaattaatcttccgtaggggatatattacatcatttaaaaagtattccagaaaagaagagaaaaaaagagtaaaactttacttgtagctcatacactggtaccaactagttattcttagacttgcagaatttggccttttctgagtatgtgggcccgggaggtgacatctgagccacctgattcaaacctctgcttccagaaactttccaggacatgtttttttgctacacgttgagactcatccctcagagaggttcagtggtttcccagggtcacatatctaagttggagtcagagccaggatttggactcagttacatctgacttttaagacaatggtctttccacggccacccacctccctgggcgagcctgaagctggtgtggagagaaggcagcacgcagtggcacggaacatttgaccaggcgttgtctggccttccaagaccctctgacctaagggggagtgccacagacctacagcaggcagcgagggggtgtggagtggccttcacccctcatcccccagggagcgccctggctttccacagacaaacattccagcctggcttcgggggagggcagggcatggacagcgtgctgggcacgtgatgtccattctctctcatcctccagacaccttgagggtggggtttctccctccacagtgtgcacacggggacacggaagtcaggagcgaaggggcttgccccaggtctcacggcccctgagctcattgggtataatttgaacttgcgactctgcctgtagacggtgcttcccctccccgtgggccctgcaggtcaggaccggtggggtctggagacacaagctggggagctcgctgacttctagcctcgcttatacgactccttccatagccctgggtcttaggtggtggttctttttttttttttttttttgaggcgatgtcctgctttgtcacccaggttggagtacagtggcacaatctgggctcactgcaacctccgcctcccgggttcaagcgattctcttgcctcagcctccccagtagctgggattacaggcatgtgccaccatgcctggctaatttttgtatttttagtagagatgaggtttcaccatgttgcccaggctggtctcgaactcctcacctcaggtgatccacctgcctcggcctcccaaagtgctgggattacaggtgtgagccactgctcctggccggtggttcttttttttttttttttttttttttttaattattggccaggcgctatggctcatctctataatcccagcactttgggaggccaagatgggcagatcatggggtcaggagttcgataccagcctgaccaacatggcgaaaccccgtctctactaaaaatacaaaaattagccaggcgtgggggtgcacgcctgtaatcccagctactcagaagtctgagcaggagaatcacttgaacctaggaggcggaggttgcagtgagccgagattgcgccactgcactccagcctgggcgacagagtgatactctgtctccaaaaaatatatatatattattttatttattcatctgtgtatgtacccacctaggtggttctcacaatgcaggagaggagtacaagttaaaagccgggcacaggccaggcatggtaactcaacgcctataatcccagcgctttgagaggctgacgcgaaaggattgcttgaggccaggagttcaagaccagcctgggcaacatagtgagactccatctctacaaaaaacaaatgacccaggtgcagtggcgtgtgcctgtaatcccagctccctgggaggctgaggcaggaggatcacttgagcccaggagttggaagctgcagtgagctatgatcacaccactgcgctccagccgggggcaacagaacaagaccttgtctctaaacaaaaatttaaaaatacaaaagcggccgggcgcagtggctcacgcctgtaatcccagcactttgggggtgccgaggcgggcggatcacgaggtcaggagtttgggaccagcttggccaacatggtgaaaccctgtctccactaaaaatacaaatattagccaggtgtggtggcgcatgcctgtaatcccagctacttggggggctgaggcaggagaattgcttgaacttgggaggcggaggttgcagtgagccgagatcgtgccactgcactccagcctgggtgacagagcgagactccgtctcattgaaaaaaaaaaaatagaaaagctggtgccattgaactgcagagctgggcgccggagtagtctccctttctctggctctcttgtccccacgaaggactcaccgcccagggttccttcttcccgcacccccgtctttcacctggtgggcgttcgttttagcaacttgtaattgtggatagggatgttcctaaatggattctgctgagacttttaagagagtcaccaaggctaaatatggttctggtttttggaactgtttccctcagcagcggagttgtgagtgtaaattggcttagaagaaaaacgccatttaaccttgcctaggacaaaaataaaacatggctgagggcagtctcctcttggactcagttcagagaccgtgtgagattgtccgccagggggagctggaaccttggggagcctcccgctggtccctagggctggctcccaggagccgggcccttgctgcccaggccacccgcagcagagaccatcgtggcttcctttgctttgggcttgaatggccagagccctcggggagcaaggacctgggggcttaagtgcagccgtgaggaagcgcactgtcccgggaaaggtaaataaagtgctccctaatggctggggaggttgctaagaggcggtcggggcccagtccctgcagaggcagcctgttttcttctccggccagcctctcaggctttctgcatcgacgtgcctttgcgattcactgggccccgttcttgtttgtttagtgattcctgtaataggttctgctaaagacattcatttgtttagggacagggctgggggatgacagcatgacttggtttctagcatccatctgctgtggccaggagtccctaatggtcttgtctcctggcgtaggtgcaaagctccggggtcggcgcctgccgcctctcggcttttagggccaggccatctggattaggcggtttccctcttaagctcggtaaactccacagactgtgacagatcccctttccagctgtcacaccacctggctgcatgctgccaccaggggagggtggtcgaattcggatctggtcagtagatcaagtgccagcatcctggcaggggtcttccggccaagccaggcagggtcactttctttgcagttggcacttaagaaaggaagagaaggccaggtgcagcggctcacgcctgtaatcccagcgctttgggaggccaaggcaggtggctcacgaggtcagaagatcaagaccatcctagccaacatggtgaaaccccatctctacgaaaaatacaaaaattagctgggcatggtactgcatgcctgtaatcccagctacttgggaggctgaggcaggagaatcgcttgaaccagggagtcggaggttgcagtgaactgagattgcgccactgcactctagcctggtgacagagcgagactccgtctcaaaaaaaaaaaaagagagatgcatatctgcttctttgcataaagaacctctggaaggccaggcctggggatcacacctggaatcccagcacttcgggaggctgaagcaggagaatcacttgagcccaggagttcgagaccagcctgggcaacatggcaagaccctgtctctacaaaaaatacaaaaataagctgagcatagtggtgcatgccagtagtcctagctacttgggagggtgaggtgggaggatagcttgagcccaggagttcgacattgcagtgcgagctatgattgtgtctctataatccagcctcggcaacatagtgagacctctgtctctacaaacaaacaaacaaaattagccaggcatggtggcacgtgcctgtagtcccagctacttgggaggctaaggcgggaaaatcacttgagcccaggaggttaagcctgcagtgattgcaccactagactccagcctgggcaagaaagtgagactctgcctcttttttgtttctgagccagagtcttgctctgttgctcaggctggagtgcaatggcgtgatctcggctcactgcaacctctgtctcctgagttcaagcaattctcctactttagcctcctgagtagctgggattacaggcgcctgccaccatgcccagctaatttttgcatttttagtagagacggggtttcaccatgttggccaggctggtctcaaactcctgcccaccgcggcctcccaaagtgctgggattacaggcgtgagccactgcgcctggcctagaccctgtctcttaaaacaaaaacaaaacaaacctctggaaagttaataagaaatcagttaaaagtagttttcagttcagaggcagatggggactggggcagctggtgataggtgtggtaatgaaagactttttttttttttttttttttttttcgagacagagtcttgctctgtcgcccaggctggagtgcagtggtgcgatctcagctcactgcaacctccacctcccaggttcaagcgattctcctgcctcagcctcccgagtagctggggttataggcgtgcgccaccacacccagataatttttgtatttttagtagagacagggtttcaccatgttggccaggctggtcttgaactcctgacctcaagtggagtccacctcagcctcccaaagtgctgggattacaggtgtgagccactgcgcccggcataagaatcatttaatagctttttcttctttttcactgaatgtccttttatcttgcagctatgtgaatgcactgcctagtcataataaacaagaaagagaaagcagagtgcccctttcctggatagctggattggctatggccctgggcacacctggagttgttgagggtgtccgtttccatggcgaggctatagaacagtgggcgcccttccaacaggctagagcctccatgtctcagtgaggccatcttcttgctcccttgaagcttgggctgtcctctgatgccatgttgtcagcccagacaggcagtgtgatcagggctcctggcaagggtctttgagacacagccactgcccctgcttggtggtcgtgacttgggacgcagcctgcctgtgactggagctgggggtgacgggtaagatgagtggagatgttgggccagtggggcctgattcccagactggacctgcaaggcaagagacagggtttctggagcttgtttttgagacagagtctcgctctgtcacccaggctggagtgtagtggtgcaatcttggctcactgcagcctctacctcctgggttcaagcaattctcccacctcagcctcccgagtagctgggattacaggcgcctgccaccacgcctggctggtctcaaacttctgacctcacgtgatccgcctgccttggcctcccaaagtgctgagattatgggcgtgagctacagcgcccagcccctggagcttcttagtgagccatagcagtggctcccaggagagatctctgaacacctggcctgggggcatggagcctagtggggttagggtcagaggggagcagcccctgtagggcgtgcaggttccagggatgcacacaggcccatgttcctgcccgacatgccctctcaggctgatgtgaatggtgatggctgccattgactggagggagttgggatggccttgtcctcatgaccacacgcagttgtcctgatggacctgctggggaggcctaagtgcccccattcccagagggtagggagccgaggctcagagaagctgtctcctactgagacaagctgtctcctgctgagacaagctgtctcctactgagtctcctactgagaggcagggccgggtcggccaacaccagcgcctgtctcctccgggtgcgccacccccacccatggtatgctggatcttatttttcaggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggtttttaagctctgaagagatcttcttaaatcttacttgatcatttagagttttgcttttataaacaagccttttgatacagaggcagaagccagtgaaaaatacttttatagagatgaggtctttttattttatttttttatagagacaaggtcttgctatgttgcttaggctccaacccctggcctcaagccatcctcctgcttaggcctcccagagtgctaggattataggtgtgagctaccgtgctcaactgaaaaatagtttagaagacagtcctactcgacaaatattttctttttcttttctttttttttttttttttttgagacagagtcttgctttgttgcccaggctggagtgcagcaacatgatctcagctcactgcaacctccaccccctgggttcaaattattctcctgcctcagcctcccgagtagctgcgactacaagtgtgcgccaccacacccagctaatttgttttctgtatttttagtagagatggggtttcaccacgttggccaggctggtcttgaactcctgacctcagacgatctgcctgcctcggtcccccaaagtgctgggattacaggtgtgagccaccgcacccagccatacttgacaaatattttctgaacagattctactcccgcagttcagttgggagaaaatacttggtactcatgtcacaggctggactcccatgccctgtctgcctttacctcgttcctttaatgcgttcacaacagatacttgtcatgtgccccatcggtgcccagtactgtcctcatgctggggcatgtggtgacaaaaatccccgcaccatgaagcttacattctagggagggaaacgggaaaaatgagaagcagcatatgaagtggttctgtgggccgtcgagagaaagcaggaggagaggatgggatctcgggagggctaccctttatttatttagttagttagttagttagttagttagttatgagatggagtctcgctctgtcgcccaggctggagtgcagtggcgcgatctcggctcactgcaacctccgcctcccggttcaagcaattctatctcagcctcccgagtagctgggattataggtgcctgccaccacacccagttaatttttgtatttttagtagagatggggttttgccgtgttggccaggctgttctcgaactcctgacctcaggtgatccgctcaccttggcctcccaaagtgctgggattacaggcgtgagccaccgtgcccggcctagagctgcactttaaagtggaatggtcacccagccagcagtgtccttgctgtgacctgcggccatgagaaccagccactcagatatctaggggaggggcccttcacctgggctgcgaaccccattcttaggtttattacagtcaaattttctcataaacttgaaatagaaattgaaaaccgtgtgtcatttttccttcctgaaaccgttactggggctgggtctaaagtcgcctctgcagtgaagcagggtaatccgacctcagtgaaactcaagcctagatcaaactcacgtattgatctagagatggtaagtgcccctggaggtcagacccgggtcacactgggcggggttcgggatggcaggtgaggatgggggatggagggtctctggagaaggtgagtttttaataaacctcccaccctaatggcaaccaagatacagatctagtaatgatcttttttgtttgtttgtttgagacagagtctctctctgttgcccaggctggagtgcagtggcatgatctcagctcactgcaacctccgcctcctgggttcaagcaattctcttgccttagcctcccgagtagccgggcctagaggcatgcactaccacgcccggctaatttttgtatttttagtagagacggaattttgttatgttggccaggctggtctcgaactcctgacctccagagatccgcccacctcggcctccaaaagtgctgggatgacaggcgtgagccaccaggtccagccccagtaatgatcttgactttggacatagcaagcagtgtagaagcagggacgtccttcggtttgtcttttctttcttccagctgggctctgtctgcccaggagggctgcttggctgtgccttctgtgggtcacgagggctcctggttggagctcttctgctgtggaccaagccttctccccagctgtcacctgtgcctgcatctcagcgtctgtcctctctttccctaatgccgcccctcccccaaccccagcatttgacacacacgtccatagaaaccctactatgccattagctcggttgctaggcttgatcatcgtgttcctgcaaaaaatcagtgtttgcaagctcccgtctcctctcgctttagtgagcacgtgaatggcacccgcgatggagtgagccttgtaccaaccccatgtgtccccaggccattctccatacacaccaactctgtccctttctctctgatggggtcagtaaccaaggtcagagaggcacccgggtggaagacgtagcgtgtccaggttgtcagccttgaggaggcctcccccccatctccctcggacagtttgcaggggtcgtaggtccagttttccatcctcttcgcccctgcaggtatgcagaccgccactccacactaatttcttcggggaagagatgggtctcactggcatgaaaacccttcacagctaatccaagctcaggttgtcaacctcaataggatgctgtcatgacttgtttcttgaatacatggtcagcccacattttcattaattcaggaaatacttctgcgctgactgtgctctgcatgacaaagtcaaatcctgacaaataatgccctaaagagaaggctcgggcacggcccagcaggttgcattctgaggccaagtgcccagtgccgtgcctgggccagaatcaaaactcaggatgcgcttatgaaatcccacatttctctcgccttccacccggtactagcatctaaaggaggcctggccttcacctggacggcagtgggagctgcttaacctgttatgggaggccaggtgcagtggctcacatctgtaatcccagcacttcgggggtccgagacaggcagagcacttgaggtcaggagtttgagaccgcctggccaacatggcaaaaccccatctccactgaaaatacaaaaattagccggacgtggtgacgcgcgcctgttgtcccagctacccgggaggcttaagcaggagaatcgcttcgcttccctgccctactccactctttgaccttggggagaggcattcctctcccgagactgggtttccccccggaggcaggaggatgtcatctgccactggcacaggtggcttcacaaggctcagtgagctgcctcccagggaccctcccttgccacgcagccatgttctgagctcctcaagggccccctggtgggtgccagtctaaccactgcagcatctgaggatgcagtcaccagactacccacaggccctgatccagttagccccagctcacaggctgtcgtccatccacccctgcctggtctgacttcctccacccctgcctggtctgacttcccatctaggcactcctgcccccacccatggagtaggaatgaacactggtctgcgcgccaaaaaaaaaaaaaaaggcgggaagcggaggttgcagtgagccaagatcacaccactgcactccagcctgggtgacagagcaagactctggctcaaaaataaataaataaaaacacaaatacaaaaattaaccgtgcatggtggcgtgtgcctggaatcccagctactcaggaggctgaggcgggagaattgcttgaactggggaggcggaggttgcagtgagccaagattgcaccactgtactccagtctgggtgacagagcgagactctgtctcaaaaacaaacaaacaactgttctggggtcttctctatgcaatccatggcaccaggactgacctagtggcccagcttaaccacctgatgggacagaccctttcagagatggccatgagggcagcacccggcactggcccagccccgccccaggcagcatctgctccaggctctgtcctgcctgtgatcgtgcaccaggcacctgtccctgcctccaggaccccacacttgctttctccctcccaggggacactatgcagctacccgagacgctcctgctgcaccaaccaagggttccgaattcattaaacaccagccccgatatttaacatgggagacagcagcagcctgggttaagcctgagctggagacagtgttaggagtcctgatagctgtgcttttcttggatttggggccaccatgaggtgcatcctctgtggtcatgtttaagaggataaaccatggccaggtgtggtggctcacgcctgtaatcccagcactttgggaggctgacgtgggctgatcacgaggtcaggagttgaagaccagtctgaccagtctgagactggtgaaaccccatctgtactaaaactacaaaaattagctgggtgtgatggcacgtgcctgtagtcccagctacttgggaggctgaggcaggagaattgctggaatccaggaagcggaggttgcagtgagccaagattgagccactgcactccagcctgggagacagaccgagactccgtctcccaaaaaaaaaaaaaaaaagatataaaccatggccaggggtggtggtagctcacgcctgtaatcccagcactttgggaggccgaggcggacggatcacctgaggtcaggagttcaagaccagcttggccaacatggtgaaacaccgtctctactttttaaaaatacaaaaattagctgggtatgttggcacatgcctgtaatcccagctgcttgggaggctgaggcaggagaatcgcttgaaccagggaggcagagtttgcagtgagtcgagatcacaccacggcactccagccggggtgacagattgagactctgtctcaataaataaataaatacgtaaataaataaatggataaacctagatactgttgtcacctccaaccaggaggcacttgtttttccggagaaacatcttactcttgctctggtagcaagtggcagctgaatcccaggaggccagagtggagcacatgaagtcacgccagtcggaaggatgccccgtttgagttccctccttggggcctcagactggataggctcaggctaacggtggtagctggttccacaactccagcagttgatgtgcattccaggaggaaaattacatatatatatttttgagacagagtctcactctgtcaccaaggctggaatgcagtggtgcgatctcagctcactgcaagctctgccttttgggtggttcaagtgattctcctgcctcagcctcccgaatagctgggactacagacgtgcaccaccaactccagctaatttttgtcttaatatttttagtagagacggggtttcaccatgttggccaggctggtctcaaactcctggcttcatgtaatccgcccacctcggcctcccaaagtgctgggattacaggcgtgagctaccgcacctggccccgggagaaaaatattgaagatgaagaagatgattgataaaccacgtgctcctcagcacgtactgtatgccaggagctgcagatggggtggtgagaaggatgcctgctttcaagggtgtgtgtcttgtggctggtctgccacctgccctgcagagcagccaaggcaatgatgttcataagagggactttgggcagggtgtggtggctcacgcctgtaaatctcagcactttgggaggctaagcgggcaggtcacctgaggtcgggagttcgagaccagcctgaccaacatggacatggagaaaccccgtctctactaaaaatacaaaattagccgggcatggtggcacatgcctgtaatcccagctacccgggaggctgaggcaggagaattgcttgaacccgggaggcagaggttgcagtgagccaagattacaccattgcactccagcttgggaaacgagcaaaactccatctcaaaaaaaaaaaaaaaaaaagagtgactttgggattccttggagcagattctacccctcaaacctggggttctcattctcaaccctgcttgtacaacactataccatagaatcatctggaaacttttagtttttgagacggtcttgctctgttgcccaggctggagtacagtggtgcgatcatagctccttgcggccttgaactcctgagctcaagcaatcctcctgtctcagcctcctaagtggctgggattacaggcacgcaagccatgcccggctaatttttaaaattttttgtagagatggggggacctcactgtgttgcccagggtggtattgaactcctgggctcaaatgattctcttgcctcagccttccaaagtgttgggattacaggcatgagccacctcgcccaggctttttttttttaatatataatataacattttgcatatttattcatcagttgctggacatttgggttggtttcactttttgaccattataaataatgtcaaaacattcatgtataagtttcacattggcccagcgttttgtttctggaatgtttttgtgtgaacataagttttcaattttcatggatgtatacctaggagtggagttgctgctcattcatttaatttttttgagttttgacatttgcgtcatttaatctacaacacactctgtaaattccaagatactgaatatttatttccctgcatacaacttgggctgttccttgcaggctcatggcaggctttctgcctgcttttcttgtgtttctgctgctaaagtagggacccaggccgggcgcggtggctcatgcctgtaatcccagtactttgggaggccgaggcgggcggatcacttgaggtcatgagttcgagaccagcctggccaatatggcaaaaccccatctctactaaaaatataaaaattagctgggtgtggcagtgtgtgcctatagtcctagctactggggaggctgaggcacgagaatcacttgaaactgggagttgggggctgcagtgagcttggattgctccactgcactccagcctgggtgacagagcgagactccatctctaaataaatacataaatgtaaataaataaattagggaaccctcttggtgcccagtagtcatcagagcttataatgaccaagtacgtagaaatgggccccacccatagtggctgatgcctgtgatcccaacactttgggaggctggggtgggaggatcacttgagctcaggagttcaagggcagcctgggcaatatagcaagacccctatctctacaaaaaataaaaaaattagccaaacatggtggtgcacgcctatagttaacagccactctggaggctgagattggaggagtgcttgagaccaggagttcgaggctgcagtgagcaaataaatttaaagaaaaaaacaaacaaaccaggccctgggtctagctgatgctgcctgagtttcccactcagctcaggtagacatctgttggaaaaacatcccaaatgtgatgttctgctatcaacctttacaaggcgaagacctccacattcagttgccaagaaccgtcagagcaatcaccttttttgttttgttttgtttttggagatggagtctcgctctgtcgcccaggctggagtgcagtggcgcgatctcagctcactgcaacctccgcctccctggttcaagcgattctcctgcctcagcctcccaagtagctgaaattacaggcacacaccgccatgcttggctaattttttgtattttcgtagagacgggatttcactgtgttgcccagactggtcttgaacctctgagctcagacaatccgcccaccttggactcctaaagtgctaggaccacaggtgtaagccaccacgcccagctgcaatcacctttctttctcggctgtcctccaatgtgcatccagacctgttgctttttctaccgcattccttctttaaaacatcaagatataagtcacataacataaaaccatttacagcacacagctcagtggtttttcgcaaactgtgttgtgcagctgtcaccatgatttcattgcacacattccctttcggtgcatattttctttccgctttcttcaccatgtgagctgatctgacactccctcccctgcccgagtcagctgaaattcacatgacaaaaccagggtcggcaaagtgaccaaagatgacgccctttccttttgtggcctttgctttattttttaatttaattttttttaatttattgctttttagagacagggtcttgttctgttgctcaggctggagtgcagtggtgtcatcatagctcactggagcctccaactcctgggctcaagtgatcctctggcctcagcctctgagtagttgggattacaggtatgcaccaccacacctggctaatttttttttttttttttgatagagactcgccctgttgcccaggctggagtgcaatggcgtggtctcggctcactgcaacctctgtctcccaggttcaagcgattcttctgccttagcctcccgagtagctgggattacaggtggctgccaccatgcctggctaatttttatatttttagtagagacggggattcaccattttggccaggctggtctcgaacccctgaccttgtgacctgcctgcctcggcctcccaaagtgctgggatgacaggcgttgagtcactgcacctggcccaccccacttcttaattaccactacgggtccttctttgcctttgcattctacctgctgtttcttgtctaagtctaactctcccgtccctccctgcttctctgtcttccctctactattggccggcagctggtcatttcctggtccaagcacagcacccctttgtggtccatcctagcactgcatcccttgtaatgctccgggaaggacccctggtgcaggggctatagtgggtccccagcaccagcataaggggatgattttgagagttttggggcagtcaggatcgcccatggatgttccggctccagtggaattatcttttttttttttttttttttttttgagacaaagtctcactctgttgcccagcctggagtgcagtggcacaatctcggctcactgcaacctccacctcccggattcaagccattctcctgcctcagcctcccaagtagctgggattacaggcacccgccaccacgcccaactaatttttatatttttagtagagatagggttacactatgttgaccagggtggtcttgaactcctgacctcaggtaatcctcccgcctccacctccaaaagtgctgggattacaggtgtgagccaccgcacccagccctcctgtggtattatctgaaggcccgagcgacaggacttgtcttcagaccccaggcataaaagcttctcagcagctagaactctcttgggctcagggtgatggaagaatattcagcttccattttcactcccggtctccaggttctcttcctgtgggccaagggtgaggcagggttgggatgggggctgatggggcctagggcagggatgggtcttcagctctgccctgctcacagctacccccccatggaaaatctcagagaggagaaggggaagggtgtcagtctagaacctgccggtctcaagcccatcttttcttgctggcacagccccagtgtcccgcctaccaagagggcagtagccagaagcacggtgctcctctttcctgcctgcaggatatctaatctggaggtatcagcttctgggcttctggaacttacctggagctgtgatgtccatggcaaggctctaggtttgggtcagagacccttcggccaggcaaccagcccctgacccttcccttgccatcagaaaggccccgtccaactccttccccccaccgtccccactcccaggcctggctctgcccaaggtctgggtggggatgctgggcatagtagctggcctccaagatggcccccagtcatctttacctcctggtttccacccacttatgtagttccctcccatgtcaaatcagagttgggccgtatcacaccagagcatggtagaggcaacggcgtgtgaattatgtggctaggaataaaaataacactttggtttctaacctggacccttgaatctcttgctctgggggaagctgggcgccatattgtgaggacactcaagcagccccgtgggttggcccacatggggaaggactgaggcctcctgcctacagccaggcctcacttagaagtgcatccttcagtccttagctgatttcagacaacggcaacctcatgagtgactctgagccagaatcactcagccaaacttcctgaattcctgacccacagaaaatgtgacctataaataatgatcatgttaagccgctaagtttgggggcaacttgttatacagcaccaggtaactaatacaacccctccggctctgggggcccttcctcaaattctgggtgtttttctacccgcctctagcccctggcctgtgttcccccgaccacagtgtggaggagaaagagatgagaccaggttctggctagatcagcaaaaaaccagacggccaccagccagcatcgtttttttttttcattttaattaacactttacaaagtacaaaatatactgtcttttttgggggaacattaggtaattttttttctccaacatacagtacatgaatctcgagggttttgtgtttcttcaacaagaaaataagcttgagggccccgggggggtagggataagatggcaggttctccccttcacccagatcttgggagcgatggaacgccgctgctgctgctggtgacccgggcacgccaggtgagggttggagggggttgtgggcaggaagtcccctgcccccactacgatggtgggggctctgggcagggcagaggcccctcagtacaccatccatccactcacccccatctcaggataacggaaatgattttggcatagagaaagaggagggcttgggactgttatcagctccctactcttttagagggaactctgctcaactcttcctagactgtcttctgaatacaggtaaactgaggcagtggaagggaaaccgcactggccttggcctgtcttgggacctgaacttggcctgctgttcaccctgccacctccaaagtttgggtgaggggcaggggtctccaattcttctggaccttcttccagaatgagccccagtagatgagggagtgccggcccccacaaactctccctgtgaacaccatctgcaggatgggatgcctttgaagagtcagcacgggcagccccagccccttccaatcagagctgggctgtatcaaaccagagcatggtggaggcaacggcgtgtgaattctgaggctagggataaaaataacacgttggcttttaccctgggcccttgaatctcttgctctggggggaagccgagcgccatattgtgaagacactcaagcagccctgtgggttggcccacctggggaaggactgaggcctcctgcctacagccaggcctcacttagaagtgcatcctccaatccttagctaagatttcagacaacagcaacctcatgagtgaccctgagccagaactgctcaaactgttcctgacacctttgcccccctccagagtagttctgacaagtggggtgaggccgtcctaccagagacgccccaccctctcccctggagccagggtctgcattcgagtcctgccctcactcacctaatcatttctgcactcaaggcctgacaacaagactgctactgagaactcaaaatactccaagagccagtcccatatctcaggtgtgggctctgcacacgtgcacgcacacactctaatgcataggaacacatccacgctcacacgtacatgcacaaacgtgtgcataaacacacctaggcctgcacccccactcctagcacacaggccaccctgcacttccaatttccatagctcctcttcccttatagtgacagccacaagctctctcggccaccaggctgtccctggatgccatggctcaggcctcaggctcctgcctctgctccaggctgctcctggctggcttccttccctggggcctctttcgttattttcttgtagaggcagggtcttgctatgttgaccagggtggtcttgctatcttggcctcaagctatcctcccaccttggtctcccaaagtgctgggatgacaggcctaagccaccgagcccggcctcctttgaatgggcccccaccaggcctaaccccctccctcagcatggtacccaaagccaatgtcttttctctgttggagaagccccccggcctcactcaggctctgcctattacactaaccaatgtctccaatgctccaggccctgctcggagcggactagaaggttgggggtgcttcttcccatccccatgcaaagcgcttcactcaggaagtggcgtcaaaaatcccattggccaggcggggtatctcatgcctgtaatcccagcactttgggaggccaaggtgggcggatcacctgaggtcaggagttcaagaacagcctggccaacatagtgaaaccctgtctctactaaaaatacaaaaattagccgagcgtggtggtgggtgcctgtaatcccagctacttgggaggctgaggcaggagaatcacttgaacctgggaagcagaggttgcagcgaaccgagatcgcaccactgcactccagcctgtctcaaaaaaaaaaaaaaaaaagatccccccattgcagggctgaggtgctcttgccctaaagccccctctcttagctggggctgggaaaagccctggttgtcaccacatccagatctctaggctcagaaaggggcccagggtggccttaggactccccagggtatccctggaaaatgtggccaggaggagggggccagtgggaggtggcctgtgttcacctttgaagatcaccaaatagtgccctgggctttaacaggggcctggcccttcctgtcttcccagtcttctctcctgacctccagggcatcctctgtcacctcagaggggcaagcccctccagaccaagcctcctcctgctgaacaaatgtcaccctggctacgctgctgcttccggaggccacactggaagcctctgatcccccagctccttcctttcccaccagcagcctggtgcctggaggtgagaggaggtgagaatgccagtggtttggagtgaggctttgggtccccgcctctgaatcttggggaggggaagctaccagggtcaggcctgcaagcctctccagctcagatgcatgcctcgggctgaggacggtggtgtgggcagtgccccttgaaggagggcggtcctggagatgcccatggaggaaggaggtgcagagtcagcaatgcccagatctttgctgggttaggacgacgggctgagggaggaaggggtgtcttgggaaccaggggagccccacgacgaggcagaacttatcagtggcagggaggggtggtcactgctctgttcctccccatccttcagctcccactggtactctgagtgcagcaaggggagagggtggggttgagactatctgagcttttcttaatggagaaccacacaggggccaagacacacactccaggagctcaagtggcagccccagggtcacctgctcacccctagaaattccatgaggccgggcacggtggctcatgcctgtaatcccagcacttcgggaggccaaggtgggtggatcacttgaggtcaggagttcaagaccagcgtggccaacatggtgaaaccccgtctctaccaaaaatacaaaaattagccgcgtgtggtggtgagtgcctgtaatctcacctacttgggaggccaatgtaggagactcgcttgaacccaggaagtggaggttgctgcagtgagctgagatcatgccacagcactccagcctgggcgacagagcaagactccgtctcaaaaaaaaaaaaaaaaaaattccacatcatagagagccctcttcctcccccgccaggcacctgccccatccgccagcgccaagacaacaggcccactcctctgattacctccgggggatggacggcaaacaggtaaggagttccatgcaactgcggatggagcccctctgagaaacacatgcccctccaagtggggtctggggcctggagagaccctcccacccagcagaccaggagatagctgggggacaagggcagacggcccctgcctgggaaaaaccacactcacaccccaccccgaagagctgtggagaccaaaccaagactacgctacacacagaacgccgagaagataaaccaagctttacacgagcaggatggggatgggaaaactaaaggggccccctgtgaccgaggagcagggtccccagggggcagctcccacggagcgggcttgaacagggaccacccctgcagagccagccagggcggagagccataccctggccccagcgcgccccgacacacatgcttttctccatgacacgaggccagtccccaggagcagccccaggagcacaacctgagatttctaagcttgcaggttacaaaaaacaaaaaaaacagagaagctgcctgcgtaaaaagtgccacccacggaggcaggacacaggcagcgtgtggcccattcagcaggcccaggtcttcagggtgaggctgctggcgagggcaggggagagggggcattctggttaaaagcaagaaattccaaatactcctccctcgggatcaacatccccccaaataagggcgcccagggatcttgcctggggaaagtggggtgcagaaggcatgacccacgccacagcgggctctcagcacccttcccacgtcccatgtcacaggctctttgagctgctggctttgttctctcaagtcaggtctgagggaacccatcggcttctgtaataatcgtattgcctatatacttgaattaaaaatatatggtggctc

SEQ ID NO: 38651 - DNA, 850 bp, Homo sapiens
cttccgagcaagatggcgccgcgggcatttcttccactgcccgtctgagggaacgctaagtagtgtgtccggcgccgtgttccaggtaactgggccaccgtggccggggaacgcagacgcgccaccacctcccggccggcccggaccctcaatctcctcggcgtctttggaagatccgaggcccaggactggtgccaggtctcggaagctccagggggagggggcggcgtgaacccaactcaccgagctccgggcgccacttgtaacttggttttctccgcagctccgcgttgttccgcgagaaagcgagaggccgagcccgggctggtgcgatggccgcggtggtggccaagcgggaagggccgccgttcatcagcgaggcggccgtgcggggcaacgccgccgtcctggattattgccggacctcggtgtcagcgctgtcgggggccacggccggcatcctcggcctcaccggcctctacggcttcatcttctacctgctcgcctccgtcctgctctccctgctcctcattctcaaggcgggaaggaggtggaacaaatatttcaaatcacggagacctctctttacaggaggcctcatcgggggcctcttcacctacgtcctgttctggacgttcctctacggcatggtgcacgtctactgaaatgggggcccgggggacttttttaaaaaaccagatcgggaggactgtggccagcaattaacaccatgtagacttccttagttcttaagtggttgaattcgctgcttgttctgtaacgttataaataatttatatctgaagacggagagcctgtaatattcttcagattaaatgaagcgtgagac

SEQ ID NO: 38652 - DNA, 14900 bp, Homo sapiens
ggaagtgctgactacaagggcaacccagctctcagaggaactggcccagctccgggatgcctatcagaagcagaaggagcagctgcggcaacaactagaagcccctccaagccagagggatgggcactttctccaggaaagccggcgactctctgcccagtttgaaaatctcatggcagagagccgccaggacctggaggaggagtatgagcctcagttcctgcggctcctagagaggaaagaagctgggaccaaagctctgcagagaacccaggctgagatccaggaaatgaaggaggctctgagacccctgcaagcagaggcccggcagctccgcctgcaaaacaggaacctggaggaccagatcgcacttgtgaggcaaaaacgagatgaagaggtgcagcagtacagggtaggcccattgggcatgaaaagaactgaggtcttttaacctggggaaagagtggccagagtccaaggtctttggggctgaaagatagtgtcacatgtaggaagaaaaatttgttctttggggccacgcaattttttctccattcttcattcattcaggcccatgctagggactagaagttatctgcactgttttttgtttttttttttttgagatggagtctcgctctgtcgcccaggctagagtgcagtggtgcgatctcagctcactacaagctctgcctcctgggttcatgccattctcctgcctcagccttctgagtagctgggactacaggtgctcaccaccatgcccggctatttttttgtatttttagtagagtcggggtttcactgttgttaaccaggatggtctggatctcctgacctcgtgatccgcctgccttggcctcccaaagtgctgggattacaggtgtgagccaccgcgcccggcctgcactctgttttttttgcgacagggtcttgctgtcacttaggctggtgcagtggcatgatcacagctaactgcagcctcgacctctcaggttcaagcgatcctcccacctcagcctcttgagtagctgggaccacaactgtgcaccaacatgcccagctaattttttcttttttgagacaggtgcaatcttgagggctcactgcacctcaaacctcttgggctcaagcgatcctcctgccttagcccccaagcagctgggactacaagtgtgtgccaccatacctggctaattttttgtagagacagggtttcaccacgtggcccaggctggatttgaactcctgagctcaagctatccgcctgccttggcctcccaaagagctaggattataggtgtgagccaccgcagccggccaatttttgtattttttgtagacagggttttgccatgttgcccaggctggtcttgaaatcctgggctcaagtacttttaatggcaaaagctgcaattaattttgcaccaaccttaatagaatcctctcatcttcactttccttttatgtgcatttgtccccatctctcttgcattcaagttatttctgattaagtgtgagccagttctaatccctttttagaacagagtgggatataaatactaagtgaataaacaattacgtagtccctcctagactgtgaactttcagaaggtagggaatacattttacttattgttgtattactctctgctactcaaggctcagagcacatgtgctgctgggcactaatgagaagactgtagtgtggtgctctaagcagtactttaatcttttgaaacactgattcctttggataaacttagaaatctatgtcttcccagagattgtgatatgcccttaagggaacaagtttccctgttgaaatggctgcattcacttcactgaagattttgtcaagctttctgtagtttgtattatgaaaacactctgtctgggagcggtggctcacgcctgtaatcccagcactttggttgggaggctgaggtgggtggatcacaaggtcagtagtttgagacaagtatagccaatatggtgaaaccccgtctctactaaaaagacaaaaattaggggggcatggtggcacatgcctgtagtcccagctacttgggaggctgaggcaggagaatcgcttgaacccgggaggcggaggttgcagtgagctgagattgcaccactgcactctagcctgggtgacagagtgagactccatctcaaaaacaaacaaaaacaaacaaacaaaaaaaaaacactgtggtttttggggtcataatactgaatgttttttatttttatctttatttatttatttttgagacagagtcttgctctttcacccaggctggagtgcactgaaccaatctcggctcactgcaaactccacctcccgggttcaagcaattctcatttcagcctcctgagttgctgggactacaggtgcccgccactgcacccagctaattttttgtattttagtagagatggggtttcaccatgttgcccagggtggtctcaaactcctgagcttaggcagtccacccgcctcagcctcccagttatttttacagagtctcgctctgtcacacaggctggagtgcagtggagtgcagtggcatgatctcagctcactgcaacctctgcctcctgggttcaagcaatcctcctgcctcagtctcccaagttgctgggattgcagacctgtgccaccatgcccagctaatttgggtattttagtagagatggggtttcaccatgttggtcaggctggtctcgaacacctgacctcaggtgatccaccggcctcagcctcccagtgttgggattacaggcgtaagccaccacacccagaagtaatactgaatgtttttaaactcttcatattccccttaccctattttttaaaaaattggttcacagtctagtgaaaagtcatttatttagcatcaatactatccttaacagccaatactcagacagacattacattaatagttgtatctcagagaagaaagtaataggtgatttatgagaggtgcaggtaaaagggctgtgggatagatgatgatgatgatgatgattattattttttgagacggagtctgtcactcttgcccaggctggagtgcagtggcgctcagctcactgcaagctctgcctcccgggttcgcgccattgtcctgcctcagcctcccgagtagctgggattgcaggcgcccgccaccgcaccaggctaattttttgcatttttaatagagacggggtttcaccgtgttagccaggatggtctccatctcctgatcttgtgatccgcccgcctcgcctctcaaagtgctgggattacaggcatgagccactgcgcccggccgggatagattatttttaggcgctggttaaatcagagaactcttcatgaaaaaagaggtggaatttgagctaggtatgaaagcatagggagaatctagaccagtgctgcccaacagaaatataatgcaagtcacataaataattacaaattttctaatagccacattaaaataggcaaaaattcagctgagctaagcctgaggggagcaggggagaaaagatataggtaaaattaatttaaatatattttatctaactcaacatatctgaaatataattagtaacttggctgcaggtgacaagcttgagttttggactttattcagtagtctgctgcatcattaaagggatttaatcagggaagtaacatgattgccttgctacttttttttttttttctgagatggagtctccctctgtcacccatgctggagtgcagtggcacgatctcgccttgctgcaacctccacttcccaggttcaagcaattttcctgcctcagcctcccaagtagctgggattacaggcgcctaacaccatggacgtggctaatttttttttagtcggagtctcttctattgcctaggctggagtgcaatagcgtgatctcggctcattgcaacctctacctcccgggttcaagcagttctcctgcctcagcctcccgagtagctgggactacaggtgcacagtgccacgcctggcaaattttttttgttgtttttttttgttttttgagaaggagtctcgctctgtcacccaggctggagtgcagtggcatgatctgggctcactgcaacctctgcctcctgggttcaagcgattttcctgcctcagcctcccgagtagctgggactacaggtgcatgccaccatagctggctaattttttctatttttattagagacagtgtttcactatgttagccaggatggtcttgatctcctgacctcatgatccacctgcctcggcctcccaaagtactgggattataggtgtgagccactgagcccggccaattgtttgtatagtagggacggggtttcaccgtattgcccaggatggtcttgaactcctgagctcaggcagtctgcctgcctcggcctcccaaagtgctgggattacaggcatgagtcaccacgcccggccctaattttcgtgtttttggtagagatgaagttttaccatgttagccagctggtcttgaactcctgacctcaggtgatctgcctggctcggcctcccaaagtgctgggattacaggcttgagccactgcctgcctctctacttttttttttttttttctttggagatggagtcttgctctgtcactcaggctagagtgcagtggcatgatcttggctcaccgaaatctccgcctcccgggtcaagtgattctcctgcctcagcctcccaagtagctgggattacaggtgcccgccaccaggcctcgctaatttttgtatttttagtagagatggggcttcaccatcttggccaggttggtctccaactcctgacctcgtgatccacccgtctcggcctcccaatgtgctgggattacaagaagtactggtggcaggatataaagtgggctagagatgcagagcaatggagaataattagaaagctactctaaggaagaggttaagatggtttcagatttgacgatttgtgcatcttcccaaggattgttttccaaagataatcttatgacacaaagttttaaaaagaatattcagaagtctatctaatctctatcaaatgaatctttctctattgagaggaagtcttggtcttcctgcctcagcctcccgagttgctgagattacaggtgtgagccactttatctggcctgatacactcttggtagtataatagcttctcttgttgctataccatcattaaagtaggaagcaaggtctgaggtccctaatttttctttctgaaatggcttcctaaactgtttgctaaagttctatttcatcaacttacttttttttttttttttttgtgacggtgtctcactctgttgctaggctggagtgcagtggcacaatcttggctcactgcaacctctgcctcccgggttcaagcgattctcctgcctcagcctctcaagtagctgggactacaggctcacgccaccacgcccagctaatttttgtatttttagtagagatggggtttcaccacgttggccaggatggttttgatctcctgaccttgtgatctgcccgcctcggcttcccaaagtgctgggattacaggcatgagccaccacgcccggcccatcagcttacttcctaagggtgtccctttaatccttaggctgcactccactcttaacgttgcctctatcatcaccttcatcaattcaacagtttctaagtgcctaattactgtgggccaggcagtgagctatgtgctggcaatagcaattagaaatagtatgtgtggccgggcgcagtggatcacaaggtcaggagttcaagaccagcctggccaagatggtgaaaccctgtctctgctagaactacaaaaaaattagccaggcatggtggtaggcacctgtaatcccagctactcaggaggctgaggcagaatagcttgaacctgggcagcagaggttgcagtgagctgagattgtgccactgcaatccagcctgggtgacagtgactcacctcaaaaaaaaaaaaaaaaaaaaaaaaaaaaaggccaggcgaggtgcctcacgcctgtaatcccagcactttgggaggccgaggcgggcggatcacgtcaaaagatcgagaccatcctggccaacatggtgaaaccctcatctctactaaaaaatacaaaaattagctgggcgtggtggcatgtgcctgtgttcccagcttctcgggaggatgaggcaggagaattgcttgaacccgggaggcagaggttgcagtgagccgagactgcgccactgcactccagcctggcaacagagcaagactccgtctcagaaaagaaaaaaaaaagtgtgtgtgtgttgcggggtgggggtaatgctcctgccctcaaagagtttgtactccagaggccgggtgcagtggcccatgcctgtgatcccagcactttgggaggcagaggcgagtggatcatgaggtcaggagatcgagaccatcctggctaacacggtgaaaccctgtctcgctaaaaatacaaaaaattagccgggcgtggtggtgcatgcctgtaatcccagctactcgggggctgaggcagaattgcctgaacccgcaaggtggaggttgagatcgcgccactgcactccagcctgggcgacaaagactccgccttaaaaaaagtttgtactccagaaggaagcataacagacaaaatgaatgtatttcgtaaaatctaagcactgttgattttaacatgcatcctgatcagagatgttaaaatgtggcagtcttggcatcaattaaacatatttcaatgttataagcactgtaatagctgtagtgataaggcactgtcctgatgaaaacaggcatgactaccccagcctgggcaaaagaggggacatttcatagatcaacaatagctagtatgtacttgaagttctttacacaaaataattcctttagtccttacatctctatgagttaggtataaggcatttgaaaaataagaagacagaggtaaggcagagcagtgatttgcccagggttaggcagcttgagagtgatggagcgaggatgtaactcctgaacaatctagcttgagtccatactcaggctcttcaagatgctggagctgaaccttaagaatgaattcatgccaggagcagtggctcacacctgtaatcccagcactttgggaggccgaggcaggtggatcacctgaggtcaggagttcaagaccaacctgaccaatatggtgaaaccccgtctctactaaaaatacaaaaattaggccgcctgtagtcccagctacttgggaggctgagacaggagaatcacttgaacccaggagctggaggttgcagtgagccaagatggtgccagcgcactccagcctgagcgacagagcaagactccatctcaaaaaataataataataataataataataataattcactgggcaggtaagggagaggtcttccagacagagggaacagctcatacaaaagcatggaaacacaaaaagacatgttttgggaagtgagcttagtggtggaatcacaaggaatgttaactagatccagctgggactaaacatttttttctttttttttttgagacggagcctcgctctgtctccaggctggagtgcagtggcgcaatcttggctcactgtaacctttgcctcccgggttcaagtcaattctcctgcctcagcctcctgagcagttgggactacaggcgtgtgccaccatgcccaactaatttttgtatttttagtagagatggggtttcaccacgttggccgggatggttttgatctcttgacctcgtgatccaccttggcctcccaatgtgttgggattacaggcgtgaaccaccgtgcctggcctactaaacacttttatggtttttttttttttttgagatgaagtctcgctcttgtcccccaggctggagtgcaatggcacgatctcagctcattgcaacctccgcctcccaggttcaagcaattctcctgcctcagcctcccgagtagctgagattacaggcacctgccaccacgcccggctaattttttgtatttttagtagaggctgggtttcaccatgttggccaggctggtctcgaactcctgacctcagatgatccacccgcctcaacctcccaaaatgctgagattacaggcatgagccactgtgcctggccagttttatgtattctttagactagtggtttccaaaactaaagttttctctaaagctgtggaccttctcccccagataattttacatagaatgcaatatataaagcagttaaaagcggagttattctctaacggaaaagtaccaagggcactccaatttggccagcttttggggttgcacagaaaagtttgagaaccactaaaaagcctgttaccttgagtatgagctctaagccaatggcaaatcctggctctatcactaagttggaaactttggacaaattacttaagctctgtggctcagcaccctcacatgaaacatgagattaataatactcccatatccatagggttgcaaggaatgaactagtaagccactttcccacaattccatgactatacattgattagacctcttcttcccctttaactctttactcatcctttaaacccatttcccttcttcctgaagtttcccgatatccttagtgtgcgacagataaccctcctgtttccacagcacctgttactttatactactattgctgtagcagttccccttttcctgagttggggaatgtatcctttctttgtctttgtcctatgtagaaaattaaaactggcaatgctgtcaatgcaagtgctggggcaactgtagacagacatgtcctggcccttgagaaattagtatctaggtagaaggcagcagaaaacaagggactggctgtctaggtgaaaaaagtggcaggaacacaggcacacagatctgagttgttaggctagagtagtgctgtctatcactgcaagcaagccacagatgtcattttaaatgttctggtagctctattaaaaaaagaaacagatgaaattaactttaatgcattttatttaacccaacacatatatttcaacatgtaatcagtatcaaatatttttgacatattttacattttgtgtgctgtcttagaaatctgctgtgtattttacacttacattacatctcaattgagactagtcatatttcaaatgagtcctatgtgactagtgacttcggtactagtagtccagggctagaggaaaatgttcatacggaagagtaacagaggttcaagttggaggtaggggtcaaactagagggggtctgaatgccactaaagaaagtggaaagcctttgaaggattttgagttgattgtaaagttaatctagtggttaacacaggattaagagaccatccttaatgccactgtagcaatccttccttcatttcattgaggctgttccactctgtcacagcttatcactggtggtgcagactgcttttccaagcatgtacttttgtaccttaccaacgggtctggtaggtagtgaggactgagcaatcaggacagcagtatgcagatgcttccctcttcagatgacacactcttaggcatggctgggcactaaaaaaggtcctttgacaatgttggtgaaagctgagattcagccagagtatcaaacagtgcggattgatgtgccacaggtacaatgtcaagtatgactcagaggacaaattatctagatccttctaataatagcatgtaccccaacaactggattccttagtattcttcaaaatctgaggtaaaatcactctcgctttaaaagataccaacttcaccccttcctctcttcccaactccctcctgcttccttaaggatccatgccagctagcaggtaaaccagagactgacttgctgacatcttccttaccttattcctcaggtatacatcctaggcagggaaaatttacagaatgcatcccagcctgattctggaagaatgagaaagttatctgagggctcccaagggcctcctgtgcataccatctttatcttccaacttagaactaaccaaattcagtctttttgtgtaatgaaaaaaggataagctgggcacagtggctcacacctgtaatcccagcactttgggagaccgaggcgggaggactgcttgagcccaggaacaagaccagcctgggcaacatagcgagaccctgtctctatacaaaaataaagaagaaaaaaggatgcaggaaattagcaataggatagccaacaccctcactaaagcatcaatttccatatgatgttaagtaccaggtagaaatctctctgactttaaggagctttggacacaaaaacttttccttaaacaagccatttattttctaaacatggacttccactagttgtgtaactctcctagaattctagccaatatttaataattgttgccacacttttgtatttcaacttaagtattttatattattaaaaactaccaattatcttaacaaacctgcacatggagggagaggtatatgaaactcagcccactaactagaccaaaatcctcctcaatgacactaaggttgtaatactaaaaagtcccaatcaccctcccaggattctattaaagcaagctgtggttaacagacaagatgcctttttcgtcatcattttcaaaagcattgtcactttttttccaagacacaacttctttgaacctgtttcataacctatcatataaataccagcctcaatactgctatcaagattaaacaatgaacaaaaaagtgttttataagtaagagtggacaatgtgagtttttattgtttggctcattagaaatgttcttggccatctcatgcaggaacagctggaggaaatggaagaacgccagaggcagttaagaaatggggtgcaactccagcaacagaagaacaaagagatggaacagctaaggctcagtcttgctgaagagctctctacttataagtcagtttctgctgctatacaaatctcatctaatactggctgaggggatggtgggagggcttagggaaaattttaccttagaatcaaaaacaaaaagaggatttgggaaatgattttcaaattgtgcttatccaaaaacacatggaaaatggctctctctttttaaagggctatgctactacccaagagcctggaacaggctgatgctcccacttctcaggcaggtggaatggagacacagtctcaaggtgatctttgtgaagagaagagtggtgtttgcattgttactgctttcctaacaatactaattaatgccttaaaaacaggccggacggggtggctcacgcctgtaatcctagcactttgggaggctgaggagggtggatcacctggagtcaggagttcaagaccagcctggccaacatggcaaaactccatctccactaaaaatacaaaaattagccgggcatagtggcaggcacttataatcccagctactcaggaggccaaggcaggagaatcgcttgaaccaggaggcagaggttgcagtgagtcaagatcacaatacagcactccagcttgtacaacagagtgagactgcctcaaaacaaaacaaaaacccaaaaaacaaaaacaacaaaaaacccttgtgtgcctaatgacaaggggataacccaaacctccaaaacgcctgagtcaggcattcagagttcatttggaatgtttgtttctagtaggactcaaaatatgccctgattatcaccatgaattctgtggcatctaggctttgggcatcttgtttcctcatcctaccctacccacctgctattctcagttttccttataatagcagagaaagcagttgtgctatcaaaaataataaacatatctatccattaagttccttatataatattcaaaggctgtggttttgggtggaagcagagatgttcatgttacacagacttactctttttttttttttttttttttgagacggagtcttgctctgttgccaggctggagtgcagtggcgtgacctctgcctcccgggttcaagcgattcccctgcctcagcctcccaagtagctgggattataggcacgcaccaccacgcctggctaatttttttgtattttagtagagacggggtttcaccatgttggctaagatggtctcatctcctgaccttgtgatccacttgcctcggcctcccagagtgctgggatttcaggtgtgagccaccatgcttggcctaaacagacttaacttttagacactgacaaaactgaaggcatctttctgaccaatcacctactcaggatccctcccccaatgttttaccagtatattctgataaaagttctagagtccgtgaaagaaactaaggataaaagaaagtccgtgtcaagttgtacattatacagatgcctataaattttattcatttcctaagcttacatcaaattcacaactttcttttttttttgagacagtctcgctctgccacccaggctggagtgcagtggcacggtctcagttcactgcaacctccacctcctgggttcaagtgattttcctgcctcagcctcctgagtagctgggactacaggagcatgccaccacggccagctagtttttgtatttttagtagaaacggggtttcaccatcttggccaggctggtcttgaactcctgaccttgtgatccacgtgcctcagcctctcaaagtgctgggattacaggcgtgaaccaccgcgcctggcccacaagtaactattgttgctttttctaattttctaggattttatttttttaaatttctttttagtagagatggggggtcgggtcttgctattttgcccaggctggagtagtggcacgatcttggctcactgcaactctgcctcctgggttcaaacaatactcctgcctcagcctgctaagtagctgggattacaggcataagccatcacacccagccttgaggattttcttatactgtgtttgaatccacatgactgataatatgcttaatgtttgagaaattataaccttgcaattgaggttaatgatctactaactacctttgtgttgatcagattgtgtacaatctggaaaagacaacgactaatccaaagaaatgaaactacagaatttcaggcattgtaattatacctgtaagaagttaacctagcagagaaaacgtttaactatccctcccatcaccatcaccattcattctatttgacaaacaggaggcatccaaatatttgctaggggaaagtcatccctgatcatccataaatcacactgtaacaatctcttctcaacaaagcctgcagtaactaaacctcagaagttcactgttataaactttttctttcaactttacaggggctgtttagaaatatatggccaaatctgtaacccggaaacagcaaaaaacttcttagcaaaggatcactaagtaccctttggatgtactcttccaaccagacaagagtgccagaaacttggcaagcaattcatcctgtggaagttgcaaatactggctgacctgcttaaaaagattctagagttggccggaggcagaacatgtcaactctttgctggattctatttcatctgctgttgatactgatctcaatgcaccaaggaaaggaaagatgagcctcctgtcttccagcaacaaccctcacatatgcactgagtgaaggatgaatgtatggacacatctgggagtattttaaagaatgtatcttgccttgtgttgacccaaaccaaaaacatttttgaggggcacatgtggggtcaaaaagatagccaatttccattacatgggtttacaatttccattcttttgtgccacgagtgttagaatttaaatgaatacttttacaaagtctactttttgttcaaggatatgctgacccatatagtttactcttaaaattgtgtcaaggtatttctcactatactctaaaacaactagacttgaaaagaaaccatttgagatttgaatctaatggttaacgctattcagattttcccaaagatcttacctcatgaaagtagttctgggtcagaatgatctactcagttaaaaaacaacaacaacaaaaaactaagcgattgggaaaaaacaggaattttatctggttattgcatctggtgatagaggccttcaaagcctattatttctaacctaagtaaaggccccagtgaaaaacatactggggaaataaaacctctgagaaaaggttcaagcaccttttccaaatttaaatcttgccttaaattctctctaccacactgcctttgacactcttggaagtccatgtagttctctacagatagacttcaaagaaacgttaccttatcaaagactaatctgtgccacctctgattcagtgttttatgtctttcactttccctgggaaggagtaaagttcttttctacagctctgggactattacatttaattctgctcttgatagtcaaagaccatggacaacaactgtcatctgaaggactcttctagaagccagagactggtgtttgatggatgttttatactaaataaaacccatcagcatggggttatgtagaaaagcaatttattccattttaagcacttacacagttagtcatggagagtaacaggcctgctggtgaaacaggtcacccaaaatggagatggcatcaaactagtggtcaaggactaactcctaaaaaaaaaaagcaactcttatcaaggattaatttaatttttaaaacaaatacaagttattgattcactcttctcaacttgacagtctacctgtggtataactgtcaggtaaaaacatacatctttacaacttggtggtcccaagtt

SEQ ID NO: 38653 - DNA, 993 bp, Homo sapiens
atgctgccggactggaagagctccttgatcctcatggcttacatcatcatcttcctcactggcctccctgccaacctcctggccctgcgggcctttgtggggcggatccgccagccccagcctgcacctgtgcacatcctcctgctgagcctgacgctggccgacctcctcctgctgctgctgctgcccttcaagatcatcgaggctgcgtcgaacttccgctggtacctgcccaaggtcgtctgcgccctcacgagttttggcttctacagcagcatctactgcagcacgtggctcctggcgggcatcagcatcgagcgctacctgggagtggctttccccgtgcagtacaagctctcccgccggcctctgtatggagtgattgcagctctggtggcctgggttatgtcctttggtcactgcaccatcgtgatcatcgttcaatacttgaacacgactgagcaggtcagaagtggcaatgaaattacctgctacgagaacttcaccgataaccagttggacgtggtgctgcccgtgcggctggagctgtgcctggtgctcttcttcatccccatggcagtcaccatcttctgctactggcgttttgtgtggatcatgctctcccagccccttgtgggggcccagaggcggcgccgagccgtggggctggctgtggtgacgctgctcaatttcctggtgtgcttcggaccttacaacgtgtcccacctggtggggtatcaccagagaaaaagcccctggtggcggtcaatagccgtggtgttcagttcactcaacgccagtctggaccccctgctcttctatttctcttcttcagtggtgcgcagggcatttgggagagggctgcaggtgctgcggaatcagggctcctccctgttgggacgcagaggcaaagacacagcagaggggacaaatgaggacaggggtgtgggtcaaggagaagggatgccaagttcggacttcactacagagtag

SEQ ID NO: 38654 - DNA, 11384 bp, Homo sapiens
gttctttggccctgtgacacgtagcaacggggctggttcagggtctgaaacagagtttgggggttgtttgggattagtgaagctactgcctttgccgccagcgcagcctcagagtttggtgagtgacccaggcccgtggcacagtgttcagcttctctccacacccgtgcaaatgggcttgttgccgtctttcggcgccgcgccctggtcctttcgctcagaccctcgctctcattcaagcccttgccctgacgcggtcccctgcacctcaggcgcgaccttccagattctgcactttttcctggcaggccgcaggccttattttgcaaggaagcagtcgccttgtcagctgtaaagcccagtcctaaggtgaaaaatcatctttgttgttattgatattttagaccgcttatggaaccacaactcccacgacctcgcccctaatggaaggcatatcagctctttaaggtggagttgtcttactgggccgcaacttaaaagaatatacattttcttactctctctccgctaccgtcgttcaaatgctgcgtactttccgcccccatcccctctccgaattactgaaaaaatatttgttgtgtttctatttgcttaagcagactgccaggaacgaattcagtagaaccttgggcataaggaatatttgccatttctcttttattacagattatttgcaatgtcaggctttgaaaacttaaacacggatttctaccagacaagttacagcatcgatgatcagtcacagcagtcctatgattatggaggaagtggaggaccctatagcaagtaacttttcatctttggcaattaatttagtctacattgcagtgaaaacacatatttagaatatttggttctgcctaaaacaatatgtgaacatgtcctttatcaggagtatgatctttcatgcataatcttcttcctctagagagatatgtgacactggcttggcttcgaaggtattgttctatttaagagttgagtgtcttctgcaaactcttcaggtgtaccatgaatggaaaagtagcttgtttgaagaactgttttctagtaacagtatttctgtatttagaagatgatgggagcttcaggtacctaggagataggctgttagttcataggaccagtgaaaaattaaagtattttgttagtagttaaatcagtccaactctgagacttttatcagtgctaattgaaagtgcttagtgacattatttaatgatgtaagctccttattacgaatcatcaggcgattttcatacagcagttgataatcatttttattactcctccttctcaaacccttatggtcagtgccacacgtgttataagttgcatactgaggaggttgactcaaagccgttagcctctgaacatttttttttaaatgatctttttatagtacctggtgtttgtgacaaaaatacatgaactgaaggctttctagcaatctcacctaaaacatcatctccttagtttcttaggaccctagagataatcttatcagcttcctgtcaaataaaggagcttcctatactaggattgcttaaacttttttagatggttctggatctctttgagaatcctattacaactgggcctctttcccataaatacatgcattcactcaaacacccaaataaatgtgcatatataacttcagacaattcatgtgttaaatgatgttcatcatggatcccgaatttgaaacctcataaagactgttccacgatgagggcaggggaaggttatgtatctgtcagtttgtgagaaacatgcaatacaggaatgtgtttggattagagtgcccaagaatttaaaaaacaaaacaaaattcaaattcactgtggctctgtaatagtgtctgtcttggttaggctatcctttctaaaacatatagtctctttgagtctgcttaatttggtatattttaaggctttgttttcccctctaaaacttaacacatttgaacaatgggagtgagcatgtcaaaataccccgtgattcatttctcttttctgttacttaattacataccaatgaggatttatctcttttgataaattaatgggcagagttggaaaatttgtattgaggtatttccattcatttatttacctaaatatgtatttttggtgattgctctgtgtataggagagccagagtccatctaataaatccttgcctaaagcagcaacacagcttcggagaacctgtctctctatgcaggcctgtttttatccgaatggtttttatgattagaactcaacagagctattccatttagattgcagcctacgagatttatctgcctctgcttttcttttcttttctgtcctgtccacgtttgcatcacttaaaaggtgtgacttacagtctcattccctttaacagtcatttcagttctccacacagcaatttagatattctaaacaacttgttgctggttagcacctgttgccaactgttctcacagtttcattccaaccaaatcatgtaccagtaagcattgcttcagtactagtgatgaagttttattctgggtgattatataaccattattgctataaacttgggtttatagatgatgcctgggaaaacaagaagcctaatgtattaacagtaataaatttgagtttctgagatttattttgtaaaaactggactcttctgtgcgtaccttcaagtagatctgcaatctaatgacattttaaatgtccatctccgttaaccaaataatattttgtttgatttgctaatttagtaacaaagatccgctaataacttttagctctccattggtgaaaatctaggtgcaaatagcatattacttgcattgtctttatgtttttaacttgacttgttattagtacacagttctgcatttgccataatgaagtcagctttaacattttttggtttcctctataggtgtttcacaagtatcattcatagatccattcaccaaaaaaacaaaaacaaaaaagtataaaaggccctttgatcataatctgttgagttatataaatggaaaattggacaggttccacattgtattctagatatgcttatgaaatatatcataataccaagtcacattttttaaattatgaaagctgttattttttttcttctttgacttacctggtagtatctttatggaatatctgaggttttccatgaacttaggtaaccaacccaatatgttaagaggctttgtctttgttactggtacagagtacttatgagagtattgatttagtatctgctgcttttcatgttgttttagcctgtaaagatcgtgtctgccataccatgttttagtttaaaaccagcaggaacaagtcagaaattttcctgaataggtcctgccagaaaaggaaaatagtaaaattctatgatattgtcattctcacctttcctcttgaagatggaatgatggtgccacctttgaaacaatcaactgcttgcagtacttttcttccttacatgaaatttattggtctgtatcagcaactctcaaaatttaggctgtagactacagagggtccttgagactcttctgagattctttaaagtcaaagttattttcataacaatactaagatatcatatacctttttaggtatgttaacatttgcagtgctgttgcaaaagtattgattggtaaaactgctggtacctgagtatgaatcaaggtagtggcatcaagttgttctagtagtcatcatattattcatcactctatatacttgttagagagttggcagacagtcagtttcatttaaggattctcttgaggaagcagtaagaattatctttttattaaaccctgaccctttagtacatatatttctttaatattctttgtgaagaaatttagtgtttactgcatactaaagtacaattactgcctctacgaaaagcacctgtgcaagctgaactggctgttatttcatgaagaccatttttatttgaaagaacaactgataaactatggttattcagacttgagcatttggcagatattttctcaaaaacgaatagagagcctcaccccaaggaaaacaactgacattatgactataagaatttaaatgggaattagactaaaggttttctaaggcttctcagctctcatttttaagaatatcttttaaaataattattttacatctgtgtttcttagtatatcattagattagtcccatcagtaagttggattttttcaaaacatgatggaacagatgcgtaaagatgtggcttcagtatcctcttccctcttgctattgtcactaaaatagctgtgataagcctttccctctagatgcagggtttgctatagcacatatcaaatgagacaataagtgtataactactttgaaaaatagtactttgctaaagtactattcaaatgcaaagtgtactaaaaatcttttgttacattcagcaagtgctcacaaagcaaaagcttgatttgtccactctgtttttaaattgatggtttttcttaaagagatttgtccgcttgccaaaagtaacatactatgaagagtaaagaagaatgataattcgatggctatccaaattacagtgaaaaattatataacatgtattacaaagtctgacatcctaaggtttcattcagtcttagccatagattttatttcatagtgtatcttcatattgtatatatccactaagggagaaaaatagacacaatttttacattttcatttgttgacctcctaacctttaacagtttgtaaaatgcttagtgctatgtaagtgaatattggtatcattaagaatattttctataaaaattatgatttttttattgtagataataagcttgatcttagtgatcatttcaaccatgatttataaaaattggcaaagtttgtacctgaggaatttcacaactaaggttctttagctgtcacatgaaaatttaggaatttaagggatattaactgtacagagttgaaatacctctgaaaaatttaactttctttcatttatagacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaaggtaagatttgttgcaacacttgatagtactcaatagtattcagctggttagtgaaaattaatcttaatttggagaaattgtcttttcctttaaaaaaaataatctgtagaaaaaagttttctgctaaacaactcattttaaacagagtatatgcgaaaccacattgggccagaggggaccagatttttaatagatcttttaatagtgataataaagtatgttactatgtcagcatcgacttttacttcaggttattgactaaattctgctagtgggaaaagtgagaagaaaaagtgtgctatccattattctgtgtggaaataaactggcagaactagtgacatcactaaaaaaatggtgattttcaaattgtgttccaaaacctaggaagtggtagttctgaactttttttttaactagataactctttgaaaatctaatgaaaggtatgaacactctcctcagaagaaatgcacacatatgcatagagacgtagttttgtatacagttaaatgggcccccgggtattcctgaagccccaagtaaagaaccccttactgttaaccctttttgtatattctttgctatgcagtcatacctaagggatgtaataagtgtctgtttcatcagatccatacccttttccaacaccaatccagaaatgacatatttgtgggatgagcaccacattgaagactggcatagagagctcactgaaataatatcatccaggccaggcacgatgtctcaacgcctgtaatcccagtgctttgtggggctgaggctggaggatctcttgaggccaggagaccagcctgagcaacacagcaagaccctgtctctacaaaaaaaaaaaagaaagaaagaaaagaaaaaaattagctctgtgttgtggcgcacacctgtggtcccagctactcacgaggctgaggcaggaacatcactttgagttcaggagtttgaggctatagtgagctatgatcatgccactgcactccagcctgggtgatggagacagaccctatcacaataattataataataataatatcatccaatattgctagatccttttttgatgctatgtcattttgtctcttgtttcaggatagattttgatgaattaaaaatacatcacaaatcctaattaacttttaaattttctttctctttagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggtaagattttcatttcaaccttcagggtgcaattaaagaacagcctttaaattttaaatgttctaccaaaagccattttgaaactccgctttacacctcaagtctttgatgtgtttggaatagtactgagttgcttgtatttatacctattcattagttctccatctatagtaagtgtagcatgttttaaaaatcatttctttttctaagaaatgattaaattattaggggaaaaaacaaaaaaaaaatagtaaacaacaggtatagcttcagtccctcattagaattctgccttttcagaggttacttacagtttttacactattgctttttttttttaatgacagcatttttttaaaaatctctaaaccttggttaatattttgttctagtcatactgatgattacttttctatataattattttcccaatttatcaccttcccaagaatgttaaggcatattgaaaacagaaaagttgtaaagataattgttaatatttattttatcttatgtctctgaattatgagagataactaatgtaatatacggaagatgggatttttagtcataagagctgggcttgaactgagtgctcctgatcagcctttggccacatcatttaatccttcagtttcctctcatagaaaataatcctatccttcttacctagcaagattattttgaaggtgaaacaagacaggttatgtgagaacacattgaaaagttaaaaacactgtacaagtgtgagtttttttattactacatgaattaattcatcaatgaactcagctgagctttttcaaacttctgcatttttaatcaagtatttacaaataatctaataaaagtcccaataattttttttcttaacataatctgtagaggcattctcctaatttactttttatgtgacaaaaattggataaatcaataatttttggaggcttttctgtaaactggttttagtgatagtgtgacctgaatacaaagtttgttcacaaacttcactaacaggataattccaatttagctaatctttgcagtgcttaaactgtttattgttgtcttttcttaatcaaagggatgtataaatcagccaataatttggaaaaataaagaaaaaaatatcttccattatattccttttgccatttcttctctgttcctcacagaaccctggcttcctgtttatcctggcttcctttccccttgctcctctagcacccatataaagtgaatcataagatttcttcttaaaaagattatgactacctccaccaatgagaattaatgctttggggcatttttggtggaattaggtactttcaactgatataacaattatctagacattttgaacggctttccatcttgtctctagtttatttgcctaaaatcatccagagttctttttagaaatcttactattttgggtgattctgctatgcttttgtctctttatttgttcacttctatgccaagcctacacactaactggaaaatggagaaccaaatatctctgtactttaaagttacaaagaatgtaacaagccagtctgctcagtcttttacttctctacgtaaagaatagatagattagtagattttgatgctcataaattatttgctacatgtactgattcaggtgaaataaggccagaaataacttattttttgccctttaacctgtaatcttctttacccataggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcagtaagtactgttctttattttgggggttgattgaccaattctatgtagtaggattcacctcatcttcagtttgagataaatcaccgattcagcaaacatatcagatagtgcctcttgtagtagggacagtgccaaatggtttcggatgaagaacaatggtaatgagaataaatttaaaaacctttataccatctctattttactcatgatcaagaatttcactagttttgtgtttacttaccattgtcatagtggtaacaaattgaacagggtaattattaaatattacatgaaaaaggtcaagtcattagtgttcaaattatgcttaccctctttgatattttctagatcccacctaatttcttcaaaccattggacatatgccaaatgtacgaataataaatacatactctctattgggcagctttctaactggaaatgaaatgtattctttttatgataagaggctgttatcagcctgcggtgtttctcagatagatgtacttgtaagcagctttaaatatggtgtaatttttaaatgatattttaggttaggttaaaaggataggtatggccaggcacggttgctcacgcctgtaatcccagcactatgggaggcctaggcgggcagatcacctgatgtcaggagtttgagaccagcctgaccagcatgaagaaaccccgtctctactaaaaatacaaaattagccgggcatggtagcacatgcctgtgtaatcccagctactcgggaggctgaggcaggagaatcacttgaacccgggaggcagaggttgcagtgagccgagatcgccctgttgcatacttcagcctgggcaacaaaagcgaaactgtctcaaaaaaaaaaaaaaaaaaaaaaaaaaaaggaaggaaaggtatacattaccgccaataaggttcctcctcttggccagtgtgcagattgtctcaatataaaatcctccatgtgactagtgttagacattaccagtggtcaggctttgttacactttgaaagctaaagtggaggtttgggaggagaagagacaaatatgtcgattatttatccaatacaagaaatttggcaagatgatgctttacactatttctgctttgaatagaaatatttcatattttcagtgtagaaatcactcttatttattaagaatttatatattcatatttgaattttacagaagttattttctactaaaacccttttttcaactaggaacaattttgcctccaaggggacatttgacaatgtctgatggggggcaagggtgctacttatatcttatgtacagaggccagggatgctgctgaacattctgacagtgcacaggacagcccccacaacaaagatagcatccagcccaaatgtcagtagtgccaagaatgagagaccttatatttttaaaaagtaaaacatagttctaaaaaagctgtttatcccatgaaatgattcaccatcattgaatttactgtgaggtacattttagcatttgaaaaaaaaaatcctgattatttttgcatatgtctacttgcagatttaaaatgtaaatttaaaatgctttagaataggttattgtagtattcttacataactaatctcatctgcttttttttcttctcccccctttttccttgttgtttacagaggaatggtaggaatcattctcactgctgggattattggatggtgtagtttttctgcttccaaaatatttatttctgcattagccatggaaggacagcaacttttagtagcatatccttgcgctttgttatatggagtctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccgggcgtggtagctcacgcctgtaatcccagcactttgggaggccgaggcgggcggatcacaagggcaggagatcgagaccatcctggttaacacggtgaaaccccgactctactaaaactacaaaaaaaattagctgggcgtggtggcgggcgcctgtagtcccagctactcaggaggctgaggcaggagaagtgtgaacccaggaggcggagcttgcagtgagccgagatcacaccactgcactccatccagcctgggtgacagggtgagactctgtctcaaaaaaaaaaaaaaaaggagacacaagacttactgcaaaaatatttttccaaggatttaggaaagaaaaattgccttgtattctcaagtcaggtaactcaaagcaaaaaagtgatccaaatgtagagtatgagtttgcactccaaaaatttgacattactgtaaattatctcatggaatttttgctaaaattcagagatacgggaagttcacaatctaccttattgtagacatgaaatgcgaacacttacttacatattaatgttaactcaaccttagggacctggaatggttgcattaatgctataatcgttggatcgccacatttcccaaaaataataaaaaaatcactaaccttttttaaggaaaatatttaaagttttacaaaattcaatattgcaattatcaatgtaaagtacatttgaatgcttattaaaactttcccaattaatttt

SEQ ID NO: 38655 - DNA, 17672 bp, Homo sapiens
ctccacaccctgaagacacagtgagttagcaccaccaccaggaattggcctttcagctctgtgcctgtctccagtcaggctggaataagtctcctcatatttgcaagctcggccctcccctggaatctaaagcctcctcagccttctgagtcagcctgaaaggaacaggccgaactgctgtatgggctctgtaagtaaaactgttttgttcaatgaaaatgcttgactctagatgaattggactttctcacccacagggagtaatttcctcacaatgtgcagaattagattagatgttggtatggtgggctgaggaggacggtagaatttcagaattatttattcccaggaaatacgtagagaatgggtatttcgttctgcctgatataggttagataacttgtttttagtcaaatggtttaatcagtgtgctgatatatttatcacagtcagtgaatctcatttctatgcccaataactattactaaaaatgaaaagttaccaatttcgaacgcattgcctgccagctactggtattagacacagcgcatatcctgtcttatagatgaggaaactgggtcacagaaagtttatattacttgtagatttcagtaaaacaattgtttttgagagcacgagctttggaattaaaaagacctgagttaaaaattcagctctgactttcaccagttgtatgtgatttcaaatatgtttcagacttctgatactcagtgtctttaccagaaaaatgaatttaaagtgaatctaataatacttgtcacatgatgacatagtaagaattaaaataatgcttataaagcactgaggacaataatgttcacagaacacgtgtccagtaaatggtagctatttctatgagtaatatttttattaatggtgtagatggtctcaaaactagttagtgtttgagcaagaatctgaacccaggtcagtcacacatgatagccataccattgacaatagcatggagaatactgatgacactataaggtctagttcagcagattaagacagccacaagctatagcttataatagtgcaatgaaagaggagcatcattgtaatccgagtgggcagaaaaattagttgagagaatatagcttatttcacaagagagaaaatgaaagtatatatggattggagaggatgggtcggaaagattctagagtgaaggcagcacaaaagagaagcttgggggaaatttagtgcctccttctaaggatattcattagtccccctcttgtcttgaatataaacacttaagattttttcaatgtaagaaaaatgcaatgaaataatagctgcaaatacccactactaacaattgcttggccttcttatatagacctcccgaggttctcatcttttacatttcaggagtagaatcagttaaaaactaatctttatatgtaagggatgagagagagaaagaggagggtatgtgtgtgcacacatgtgtgtgtgtgtggtgggtagtaattttaattcaatgatttactagagttcgatgtcgtttgctgataaatgaagcaggaggaagagccaggtttggaggggacgagagaatgagttccatttgtctcatatagaagttgaagtaactgagtgatgatgggtagagatgtccctcaggggtagccacagtattttatttactttttattcaccacatgcagcaaggagctttgttctccaaaatgctgtcaattatttttctaaattacaggtttgattgcttcactgtattttcatgtctcattactacctttacgcttaaaaccagaaactttgccacagcgttaaagattctgctaacttttaaaatacagaactctggagatgccataattagattgcagatttatgagtcttctggatataagtgctatttaaagccatgagaataaccaagatatctcaaggagagcatatgaaaagcaagaaaagaagaggtacttcttgggagaaaagcagactcctctagaatcccacaatttataaggcagagaacaaaaccattgtttaacaaacaggaaaaaaaaaaacctcacagaataaccatcactgaagctaatgaaggagaaagtttcaaggaggaggaggtaaacattgctgaaagttgagatgagggagagaaaaacaaatctgagattaaacttttggacttggcatgtagaaaatcacgggtgacatcatttggaggattttcagagtcattagggaaagaattcagattgttactgaaggtgaaggaataataaacaaaagcagactgttctccaaaggaatttttatccttataaaagatacagcaggaaattgagagagaaacagggcttatgtcttgtatccctcactatcaaagcacaaggctaattatgaaaactattcaatatatcctggttgaaatgaattgtttggaaatatctatacaaaactgtgggaagcttttattgttgagttagagtaaaacttgagtattgcagacttcaaaaaagcaaccaatggcactaaacaagatactaaagagggaaaggaattttgttggcattaaatgagaagagatggaaaatgatttatttattaaaagcaaagctccttgcttccagtggtcaataaaaggtgaataaaatgttagaaatgtctggctcttgatgctctgcaaaaatttaagttcattacactgtccatggaattcaagattttcatgatttgacctctggtgctttctctagcttcatttcccacagcacctagcctcacatttaagacttcgatataccccttctcttgtagttatccaacaaactggcttatgttattctttcattcatgtctctcctcattttatcaacggcactgcaaaagcacacttcccctgtttttcatccttataaactcacatttacccatcaaaacttcacacagttataaagcatacattctgttaacattcttggaactagttcttcttgacacacacagacacattcatgtatgcacacactccaaatctgccactccacactattatctcttctgccttatcaattagatacatcctatccttatacactctacaactagtagcatttatctgtttgtttctgttactgctgatagacgctgtctggcatgtagtagatatttaaaattagtcattttttattttcagtaagagtccctagactcttgacacagcaagctcagctccctgcatatgtgtgtgtgtgtgtgtgtgtgtgtatatatatatgtatgtgtgtgtgtatatatatatacgtatatatgtgtgtgtgtatatatatatatgtgtgtgtatatatatatatacacgtatatatatgtatagtttagttcagtttgaactgaactaagtgtttctggttgataggagctaaagtggagttattggctaggaaaaagaataaggtaccctctgtctctgagcccagcgtgaacgtaggaaggatgcaggaagatatgcttgtaaagtgatggaaaggagagaagtcattttttttttgctaggcccaacacagatcaggtcaaaatatatacactatggttttcttttgttttgtttatgatctcttggcaagaaggaggaaaaaaactaccaagaagaatgaaaataggcaatgaataaattgttgaaatgaggtaatgggagatatgaagaagttaggatgaaagagaaattattcaaatagcaatttaatttttttaagtggttacataaaatgtcctacaacacaatgacaaaaattacaactcagatattgcgtaggaactaaaaatcatgaaagccagaattaattgacataaatggagcccctctgtactttcataaccatttttattattcatcgctgtatatgagatattgaaattattgaaaaacggttctgctctttctgcctcactggattataaactctctaagtggggttttatttgtgttgtcctttagcttctaaaatagcactatgtaagatccagatactcagttaatgtccctgagatagtaaagcaagatcaagagaagtgttacaagtgcactgttgctcaacagttttttgtttgtttgtttgttttttgaaacggagtctcgctctgtcgcccaggttggagtgcaatggcgccatctcggttcacctggaagctccgccttccaggttcactccattctcctgcctcagcctccccagtagctggaactacaggcgcccgccaccacgcccggctaattttttgtatttttagtagagacgaggtttcaccatgttagccaggatggtctcgatctcctgacctcgtgatccgcccacctcggcctcccaaagtgctgggactacaggcgtgagccaccgcgcccagcctgctcaacacttttacacatgccgttctgaaagcctgggaattcttcgtctcaacttacataaaacacagaaatctttcaagcactgctttttctagaaagccttctccaaatactacaaacctactgaatgctctctttctggtaattcctttttagtgtgttttggtttttcaaaatcattttatcttatttctagttgacaaataatatggtatatatttgtggggtaaaatgtgatgttgttatacatgtatgcattgtggaatgaccaaatcaagctaattatcatatccatcacctcaaatatttatcatttctttgtgctgtgaacatttaaaattctctcttttagtttttttgaaatatactatacattaactataattcttatttctctaagaggtttgatcatacattttagatattttcatcactcgcctgaggacactgtcattactgtaaatttcagaatctaaagctatagtttcattatttggccaaatcgtgtaatctataatttcttgtttttcatctagttttctgttaattttagttaaatcacacccccaccccccctttttttttcactaagacttcttccggtgatccttgaggtggcactttatcagggtgaatgtgtgagtctggatacgttgaggttcctctccatcctctcttttgtcaacacttactgtcagccacccagcaccctttcttttcctctgaagaagttaccctgcaactggctctctctcattgattgagccctctgcagccacaaccctaatctctgtttttccctagacccccgtcttcaactcaaccatacccatctatctacctttctgcaattctctactctatgaaaaaagaaatgtgatgtttgcaataaagttatatttttccctccgaaacaaaacagtaacattcaattaggtatctcctaagaagtatgtcttaacaaaatagagagattctgttctggagaactagtcttccagcagactgaagagagaactgtgttggaacgtggcagcacattatatcaggtgggggcagcctcctgtcttcctaagcctggtgggaggtctgtgttctaaccatctcttccaaatatgatgccgggtatcatattgtaagggtttctttaatggttagatgctgaagccatttatttgtcacttcctatgtgttactttgtattataatgatctctttcttcatattttctggcttcccaaattgtctgtaagcttctctgctttccacacttatgaccaatgtaatattgctgttccacagccccagtgtatttttctctggtgccaaccatagaggaaaaataatgcactacctctttagcacaatttaaacatgccataaagaatgaaatatgattggcaaactcagggtaaagtgtttattcttagtttggttatctatggctagaacgatcagaggagtggtcacatgatataaacatagctgccagcaaagggccctagagaagaaagattgtacactaaggcaaattcaaaaacaaaccaaagtgcccactacagcagttgaaatctgacattttttaatcaatttaaatgagccattcatagtttcatattatataaatactcatcagttttctgtacaataaaattattttaattcgatcaatacacaaatgaatgtagcttttttttgtttaagctctcatctcgttctgtacttttaattcatcacgtcaactttgcagaatatcacctccacttccatcattttcctgctcactggtgttcctgggctggaagccttccacacctggatctccattcccttctgcttcctctctgtaactgctctcttgggaaacagcctgatcctcttcgctaccatcactcagcccagcctccacgaaccaatgtactatttcctctccatgctgtccgccactgacctcggcctgtccatatccactctggtcaccatgctgagtatattctggttcaatgtgagggaaatcagctttaatgcctgcttgtcccacatgttctttattaaattcttcactgtcatggaatcctcagtgctgttggccatggcttttgatcgttttgtggccgtctctaatccccttaggtatgccatgattttaactgactccagaatagctcaaattggagtggcaagtgtcatcagggggctcctaatgctgacaccaatggtagcacttcttataagactttcctactgccacagccaagtactccaccactcctactgctaccaccctgatgtgatgaagctctcatgcacagacaccagaatcaacagtgcagttgggctgactgccatgttctctactgttggtgtagacttacttctcatcctcctttcttatgttttgatcattaggactgtccttagcgttgcttccccagaagagaggaaggaaaccttcagtacatgtgtctcccacattgtggcttttgctatatattacattccattgatcagtctgtccattgttcacagatttgggaaacaagccccagcctatgtacatactatgattgctaacacctacctgctgatctcccctttgatgaaccctgtcatctacagtgtgaaaaccaaacagatacgtagagctgtgataaaaattctccattccaaagaaacataaaattgtagaattctagcactagatggacccctcaagatggtatacttcaggtcatgtttccaattaaaaacaaaaaacaaccaaagaactggtgcccattgaagctaagcacataatcatttaaagttaaagctggaatgtatctagaacatcagctagtttgactactttattttccagatgaggaggtgaagacatgggatggaagagatgaacagcctaaaattagccttatatataaaatttctccttctcacaccactgttgggtccaaactgttgttgccttctgtccctgccaacaccctttctgttattatctcatctacttcatagcctttagaatgacacattacagaaaagtcactcctttgtgagaaataggtagtattttccaactgttctagtaatttcgattgccatttattatttgctctgacaagtcatggttctaagtgttttttgtatgtattaacatattttatatctaaaacaatgttataagataatcactttaattatcaataagaaaattgaggcatgaaatgttaagtagcttgcttaaacagctagtaactggtgttgctgatggcagagcacatccatgcagactgactccagagtcccccacactcttaattttaatgttatattgctacctataatataatatataggtatataatttatatataatttatatttgtaaaaattatatgaacttatatatataaacttatatttataaattatgtacttatatgtgtaaattatatttatatttataaatataaatatagagagaagttcaggcaatttttactaggaaacataaagaagtaaaaaaattaattaaaaaaaaccacaactctatcctctagaaattttcagtcaaattagggagaaaaagcccaaatcaaatcttcataccttacagatatatttctacctgatgatctttcctgactcaagcatatttcagcatttctgtcaaccctccatcaacattctgccccagcagaaatggaaagtgactacaaatgaattatggtcatttacttatgaatttttaaatttgtgtcataatggtcatgtaatggctcaattcagaaagataattcattccaccctgggtgtgtccattaattctcaaaatttttaaagcatatatttcaatgccacactaatatcactaatttaagatgggctgtatagttggtatcaggtccagaaaggaagtagaagtaatcattcgtatctacaggcttgccccctcgctttatggagatctctgccaactgcaccttattacagggcccttgatgttataataattataatagcaatacctctccctcagtttcttcctgtattcactctcatccttacctgccttatttttaatttttagcatttttattccccaacatattacatataggctgtttcttttctggtttcctcatcattccctgtaggaaatttattaagtgactatagtatttatagtactgtaagaattatgtcaaatcctcagcctgtttgacaacaacatttcagtttcaattattgttactcttcatctttatatgttgcaatgtcctgggactttgttctcagacctttttgctttgtcataatcccttccttggtcatcccatccagtatcatgtctttaagtaccatctctatgctgacaaaatccaaattaatatttgtagttcagacttatcccactgcctgtgtatcaatatcactacttgaatgtttcataatcatcttagaatcaacgtctaatatatactaatatccccatcaaggaaaaagcatgctcacccacagtcttctctaactcagtaactctaccttccaatgtgttgagacaaagcacttggagttatccctgatgcctttctatcaccccgatgctacatctaaccttttagtaaatcctggtgaccctttcttctagatctctctgatattgatgtctaaaatcaagtcaatttataccatctctactgctaccactgtgatgcaagccatcatcttggacctgaattattataacagctttctggtggtccttccttcatccacgtttgctttacagtctatttccccccacagtgaagttagactgattagtttaatgcacaaggcagatcaagttcaatataccccaagggcatcctgtcttacccaggaaaaattcacagtcactataaaagcatataaatatctatatgatctatatttcctccatcagcccaatatcatcttctactactctgccagtgattcactctatgtcacccacactagcttccaaatattttcttaaactcatcaagcatgcttcaacatcagagttcacacatgctattctcacaacctggaatgttcgtcctccagagacccacgtgacttacacctcactttagacagatctctgctcaagtgcaccccattacagggcccttgatgttataataataacaacaacaacacctctccctcaattcctcctgaattcactctcatctttatctgccttatttttaatttttagcatttttataccccagtatatcacatatatgttatttattttctagtttcattactacaacatgatgtttttgagaataaagaatttgttccatttatgctatctcccagccctaaaacagggcctgcctgccacatagtaaaaatagtaaaatgtcttaatgatctggctctgtttacctcttaagcttcattgcttcccctctgtacaatgccccagagacaacaaacaacctgcatgtcctaagtcccagcaaagaatcccctgacccttttaagcctacctccacctagaatattctcactcccttccttctcctgacttagaatagaaggggctctccttcagggacttttcctgacctctctggtctgcctggtgccctttccaggtgctcctacagcaccttgttcttctctctcaagacaactctttccaaactctcttgtcaccattctccccacaacaaactctgagctcacttctcggggccaggcactgggtctgttcactgctgtttccacatttctatctatagtgtctggtccattgtaacttttactcttcattgaattaatgaagaaatactatctttgatgtgtaaggattcagatggcacacaagaagataacaaagttcttttataccagaaagttcttcatatctacaaatatactttcatgaaatttcacattttggagaatactgtgccaagtactgccatttagtataaaacgtttgctccttttcatatgacctagtataccctgatcctaatcttgtgaagctttatttccacttcccaacataaaacttgctttgtctagtgaatgaatgtaggtaagagtaaaaattaggaggccactttaaagaggtgttttatattttgaataaactgccagtttatttctacatatttctttccccttctattccctaatacgtacccctgcagatcatcttttcatatctataactcacaatgaagcaaaaacaaaaatccagagaagctacaggcaggtccaaagtggaaagatggaaaagctcagatgatacaggcctacagactagattttttgtttatttgtttctgtacactactactacaaaggatagcaaatagagctgaaggaaaaggatggagatactcaaagtcctaaaaatggaaaggagaaaagggaatgtcaacctcaaggacaactgagatgttcacagaacttctgcagattctcgtcccccacctcacctcacaaatgctaacctgtggacagtcctcctgtccaacagtcctggcagcttataagcttccatctataggaaattggtaatgtagacaccgagactgggtgggttgcagaacaaatgtcatgctctgaccaagatggataagctcacaatgagttggggactttcctaaaagccagagcactagtagtcacatggccactgttgtagctacgtgaacatggtagtggtggtgaagatggaaataagaggaaacatgcaaaagatttttagaaggaaaaatagacaagatcggttgaataattggatgtgaaggatgaggaaatgctatgtatcttaagttcctgtctcacatgactaaattcataagcacttccacttcgtcctcctcaaattcaccctcccaacagcttctggaatagcaatctgaaacacatgtctagttgtgatgtccctgcttaaaaccatttattcacctcccaattcctacaggatgaagtccttgagttcacagcatatcatcagttcacatccattgacctctccagtttctctttcctttttggttgactctatgcttcagccaagctacaactcttcgtaattcttctatagaaaattctgtttctttcatgattttctgcctgctgaaataccctctttttggacccacccaatgactaaataaatacccttctcaagttcctataaaaatctgtggcattcactgctctttcataccatttcaggtttgtttgggtaggtgtgtatgaccaccctgaaggcaaggactttgtcttattcacctctggcaccctaaactcagcacagtgcctgcacaaaactagccttgagaatgtgcttattacacaatgaatgaattaattaactccattgccagatatagatgaccaataaatacttaatggctgatggaagtacttctgtttctgtgttcaaagattacagtgacaatgacaaagcaagactcatgtgtgaggcatacttagaaaggatggcagatagaacaggttagtgttaaatattaataaagtatgaaggtaaccctgctgggtatgacgtaggggacacgtcactggaagacagccatcaagcatcatgaggtactgaggatacctcaatatcctggagaaggtagttggggtgagttttttttatctattttgcttataacattgtaagcctttgacaaacatttgtttaatgtgaataaacagtcggaatacctggttctccaaccaatattatcactaattaactatatgacctaggacaaaaagctgtcatatcatctgggctttatctgtaatctaggagcaatgaagagcagctttgatacattaagggctgttttgttaaccagaagaaaggttagggaaagatatggagaattgcatgcccctattttgaattatggaactatacttttgtatttttagagaggatgcaaactcctaaagcccaaggaccatgcctagtcacatatgatgtctgctgcgtctagcagagtggcacatgaagaaacacactaatcctgtggctgactgtgtgtgcttggtttagcttggagaagtgggagcagattgtcgagagccctgtatatgtgagtgtggaagtgatggaagaggcagtgggtgctttgaggttgctctccctggacaggaacagtgggaagcccatgggaatggcacacaagtggacatggagatgtttttcctctgtctgccaagtccctggggcctcagttcatactctcactgcctgttcccatgggctttctgagtggcattattaaaaaggcctgaaccagaaagcaaaaccagctccagctgctctttctaagtaggactgtaccattctcaggtgagtgcacccttacctggggtcaggcaggcttagctcctgccatcctaagggaccttgaagaccccacatactgtttcaagtcagggcagggagaagcccttgtgtcccatccacagctttatgggctgggaagaaatgtcccagagtcttagctaacaatcaggaaaggcaagtgagaatgaatgcaacagtcacattcggacccaaagagaaactgaaattgggtttagcagggagtctactttaggcaggatgccaggcaacatgggaaggtgacgtgaggtctttcaggacaggtattttgggaaatgagatgatagcctaaagtcctatactcgagtaagcatgtgcaggtaccagcaaggcagaaaatatgctctgcagagagagggcttaagaaagtacccagctctgggtccaataaagactcttgttatctgtcagcactgcatgtggtagcatgggcaaaaggcattaagaaagtaaatatacgtccctgtgttccccttgctctccctccatgcctgctcttttcttcaccctgggtcccatttctctggaacacagtggtctagtgatctgacctctcttcagggaaggttccttagttctgtcccatatatttcagtatgatttgtttaaagttctatatccccttccccaagctatgacggatacagaaatggatggatggatgcaagatgcaaactatcttgtatctcactaaaggatgcaatcatctgcttctgaaaagggcttttcatgttctgatagcaactgggagccaaatatgggatttaatatttgtcaaggagcttagctgttttgtctgcacaagttctgaaggtggagaagagaaaatacaggcagaagtatgggttttgtaaccttcaaaccccaaatctgtccttctttgcttatccaagatggggagaatccagttcaaatctctttgtactaattttatcatattgtactttaagatcactggtatctaacccctctacattaaggccaaactgaagggcatctcccagctgcagtaagaactcagatgatgagtgaagaattctggggttgggggagtgcaatataagcaagctaacctgtttcaatgaaacagatgatcaatgaagacactgcatcatttgtttccaaaagttaggccttgcagccaaggctttggctttttagagaaaattagctctaaagaccagggcacctaggcaacctagcagagaagaagtttcatgaagtcagagcccaggtgtttgggtgagggtagggagttggggcaaagcaacactgggcttctaaaaaagaaatgtctcccctgagatgaatgacttgttggcacaagtttcaggaaagacaaagctctaaaaatatcattgtaaaattaataatacttctccaaagtaaggactcaactcaaactatccttggatgcaattaaaatggccttggaagaagctttcaggtgcggaggtactcaccagtgtcctgccagcaccttcatctctgaagaagtcatcggagggagccactaccttgattttatgaccacagatgagtttcctttaatccgaaagagattgacttttggcatttttttcttagtttttgtttatttatattcttttaagctttaaaaaaaagtgtcattgctgtgcttcttattcctctggctgactttagaattgaggactgggaatcctgaaaatttgcaaagttatctcctatcctcactgccttggaacacccattattccactctgtctaatttctactcatgtttcaagtctaaacaggaagattcctctgtgatcatgcctctccctttctcatgaattaaatgcatatattatgctagtaatgcttctggaatgaatgaataatagaaagaaagaaagtggggggagggaagcagggaaagtaaaatgagaaaggcagccttatctggaaggagctcccaaaagtgtatctcttaacacctatcagaaaaaaaagggccaacaaatatccaggcaacgaaggtatggaccagtaggaagaatctgagggaattacattttggaaaaagcattgctctcccaagattcccttttaaaaatttaaataaaccttgagagtagtgatgcataaatgaatttgatctgtcacagtcccgcctttggaagagggcctcagagcttatgaaagaccctaagtgggggtgggagaagacaaaaggggtgggatgtcagtttcaagtttccagggcattctctgattgtgctctatgtccctgcagactgccagtgtgacctcaccctctccagtcacccctcctcagttccagctatgagttcctgcaacttcacacatgccacctttgtgcttattggtatcccaggattagagaaagcccatttctgggttggcttccccctcctttccatgtatgtagtggcaatgtttggaaactgcatcgtggtcttcatcgtaaggacggaacgcagcctgcacgctccgatgtacctctttctctgcatgcttgcagccattgacctggccttatccacatccaccatgcctaagatccttgcccttttctggtttgattcccgagagattagctttgaggcctgtcttacccagatgttctttattcatgccctctcagccattgaatccaccatcctgctggccatggcctttgaccgttatgtggccatctgccacccactgcgccatgctgcagtgctcaacaatacagtaacagcccagattggcatcgtggctgtggtccgcggatccctcttttttttcccactgcctctgctgatcaagcggctggccttctgccactccaatgtcctctcgcactcctattgtgtccaccaggatgtaatgaagttggcctatgcagacactttgcccaatgtggtatatggtcttactgccattctgctggtcatgggcgtggacgtaatgttcatctccttgtcctattttctgataatacgaacggttctgcaactgccttccaagtcagagcgggccaaggcctttggaacctgtgtgtcacacattggtgtggtactcgccttctatgtgccacttattggcctctcagtggtacaccgctttggaaacagccttcatcccattgtgcgtgttgtcatgggtgacatctacctgctgctgcctcctgtcatcaatcccatcatctatggtgccaaaaccaaacagatcagaacacgggtgctggctatgttcaagatcagctgtgacaaggacttgcaggctgtgggaggcaagtgacccttaacactacacttctccttatctttattggcttgataaacataattatttctaacactagcttatttccagttgcccataagcacatcagtacttttctctggctggaatagtaaactaaagtatggtacatctacctaaaggactattatgtggaataatacatactaatgaagtattacatgatttaaagactacaataaaaccaaacatgcttataacattaagaaaaacaataaagatacatgattgaaaccaagttgaaaaatagcatatgccttggaggaaatgtgctcaaattactaatgatttagtgttgtccctactttctctctcttttttctttcttttttttttattatggttagctgtcacatacaactttttttttttttgagatggggtctcgctctgtcaccaggctggagtgcagtggcgcgatctcggctcactgcaacctccacatcccatgttgaagtaattcttctgcctcagcctcccgagtagctgggactagaggaacgtgccaccatgactggctaattttctgtattttttagtagagacagagtttcaccatgttggccaggatggtctcgatctcctgaccttgtgatccacccgcctcagcctcccaaagtgttgggattacaggtgtgaaccactgtgcccggcctgtgtacaactttttaaatagggaatatgatagcttcgcatggtggtgtgcacctatagcccccactgcctggaaagctgaggtgggagaatcgcttgagtccaggagtttgaggttacagtgatccacgatcgtaccactacactccagcctgggcaacagagcaagaccctgtctcaaagcataaaatggaataacatatcaaatgaaacagggaaaatgaagctgacaatttatggaagccagggcttgtcacagtctctactgttattatgcattacctgggaatttatataagcccttaataataatgccaatgaacatctcatgtgtgctcacaatgttctggcactattataagtgcttcacaggttttatgtgttcttcgtaactttatggagtaggtaccatttgtgtctctttattataagtgagagaaatgaagtttatattatcaaggggactaaagtcacacggcttgtgggcactgtgccaagatttaaaattaaatttgatggttgaatacagttacttaatgaccatgttatattgcttcctgtgtaacatctgccatttatttcctcagctgtacaaatcctctgttttctctctgttacacactaacatcaatggctttgtacttgtgatgagagataaccttgccctagttgtgggcaacacatgcagaataatcctgttttacagctgcctttcgtgatcttattgcttgcttttttccagattcagggagaatgttgttgtctatttgtctcttacatctccttgatcatgtcttcattttttaatgtgctctgtacctgtcaaaaattttgaatgtacaccacatgctattgtctgaacttgagtataagataaaataaaattttattttaaatttt

SEQ ID NO: 38656 - DNA, 9887 bp, Homo sapiens
cactacggggccggggggcggcggcggcagtggtggcagcggcggcgggggtgggcgccgcagctggcccgggtggatggagttggaggggcggggtgctggcggtgtggcgggggggccggcggcagggcccgggcggagccccggggagtcggcgctgctggacgggtggctgcagcggggcgtgggccggggggccggcggcggggaggccggggcctgcaggcccccggtacgacaagatccggactccggcccggactacgaggcgctgccggctggagccactgtcaccacgcacatggtggcaggcgccgtggcagggatcctggagcactgcgtgatgtaccccatcgactgcgtcaaggtgagacctgcacccggcttcgaacccgacctggggctgacccgacccctgggtcttgtccggagccaggatcccggctgagagccggagccgacatgggttccttcctggctcctgccactaccacatgattcgaaccgacactccattcaagcaaggtcccagctgggagttgatcccagtcaggaaccaggacctatttctaaccgtcagtgaaatctgaatcgggactcaggatcgaaaatctgtcagccaaagccctggaccccacctgggactaaacaggaatagggtgggatggggtatcccgaagctcaggtaagtgctactaactcgattaaggtgaagccaactggcgtgaaccagaccctgaaatggatctaacggcttgagatgttttctgggctagtgcttttacaaactccttgctgtatcttcccttactgacggggcaggaacccgaatctgggatctctcagctagataaaggacttacatgttaaatcttaacacatgagtgattggaaatcattgtgcagtgagaatgcagaattccagactggaagtaatgtgggaaagatcgtattcaggaataggtttcagtttctctgtgaagcaagcatgataccccacctatttcctgaacatgaaaattgagctgggattaggactgtatgttcagggagcacatcagcctccaaacaagagagatgaaactgatagcatatttctttggccacctgaagttggcaaaaagggagaagttgcctagaaaggaagtgtgacggtattagaaagtagatgtaagtatgaagaaaatggaaagagatcaacaagaggacacgattcttgtgaaagtaaaactaattgcattcacaaccaagcaggatgatttatgtgtactgaagtcaggtccttctgaagaaagctgggtgaagaaagaaacagattattgttctttacagttcttattcttgtacattagtaaaggtgccagccattaaaggtgaggactgaattgagggagaggtaaactagaggggactgttgatatgacaaagaccgatgcctcctttacatgtgaagggtaatagtcaaacagtgacctggcagctttttgatgtatgttttctcttcaaatcaggaaagtgttatgtattcaaaaggaggagagaatcaacttgggaaaggcaaagtagatcccttttacttccctttggttccagtactgtttcatgtttttcattagaatgtggataaggaaatggggggagcgctcattaagctttgtgaatgacagcaaactggcaggagtattttaacacaaggtaactcctaacaagggccatatccattgaaaacggggtaaatgcacttgactaaaatggacattagaatgttaaatgtccttgtcaattgggagaaatagaaataaactgtaaaatccatgagagagaagtaacaacattgaaatgtaaaacaagtataaataaaaaagatgcacacattatatgtatagactctaggttgaatgacttgtgagttaataatgccgtatatccaaaagttaatataatctagctgcagagtaacctccctagacttagactgtgagtagagtgcagggtttaggatgctgtttttctggatgagtattgaatggaaaacagatcaatgaaaacagtgaaaattatgtaatggcttgaaaaatacagtgtaataatttgtcttagaaatattactgtaacttatcaatttaaccactgttccattataacagaacgggaggttatctccttactccatatatttacatagtgctattgttgctataaacattttataaatccctgttaaaaatgcttctagaatatttgggtgcatgtccttaagggaggcaaatctttgccctgtgacaagatggaattgattttgcaagaacaaagactattcagaatcaaatatggtgaataaagtgggaggtcaaaatgggtaatactgcttggcatcaaaataaggtgggactggaaagcaaggagactgctttacttctgaggcctataaacccgttgaggaaacacctctgaaagagaagttccagaaaggttttgcataaccacagctttgctggaataagtcaattgtagccttccaaggtaactattttgaagaacagttcttactcatttacataaactttggaatttttgttttttaaaaattagtcatacaacatagcagttatgcctgaaagccctctattaaggaaataatgatttgagaaaaaaatgctcaggagttgtcaacaatacgaaagcttattttagaaggctcattttcacttgcacttaatgctgggatttaaatgacttagagggaagaactaggtgaggccagtatgatttagtgtcagtgagtatgttaaacacttttgtgcaggcatgaaagtaaaattcaaatctcttccttcagaaaagacttcccagtttgcttgtccccagcagctatccttcttcttttaataagtggatgagtggggaggaaaagcagcccagtctttaagactggaggcagatatccatgttgttggagcctaaagggcaaccacaatgtttgcaaatgaaagctgacattgccttttgacatgcaggcctgtccatcctcagctacttatcagggtcaagttgactttaaatatccttgagagggaccatgagaagtcagtgtagccttgctggatcatggttattcaaccagctatttccatggctataatggagaggcttgggagcccagataaatcccagtttccttttctgggcctcaaaggcaagcgccagactttatctatggggacattctgcaacccaaaacagtcagaacccttctcaaaatcctctggcgaagtacccacctatcatcaagctgctgttgttggctctgaagtggtaaagcaaatatccacttatataataaagaggggaagagcagagggagataaatctccaatttccagatgtaaatggtatctatacatattcacctgtgaaagattaggaaatggaaacattagcttatttgattttcttgcatctagtaataagtattcagtgatcttgtgtgccaagcactatctgaagtaccttacatacatttattcatttaatctgtgaagcaacttcatgaagtagaaaccattttcattattttacagttgaaaggaggcttagggaagttatataacttgtccaaggtcacacagtttaagtagcacagttatgatttgaactcagtgtatcagactctcaagccttccatatagcttcccaaaagcagattacaagaaccaggcaaggcacagaatttcacagtaaagcttgtccctgaacatatgaccttcagattaatagtgggacatgtaaatcattatagccacagagaaactttaaaaggaaaacaaaaaatacaaaattaaccctgatttattggtggctaaggacagttagttgcccatgtatatttgtgaaatgacttatacaggaggcaatgctaccatgatctgtaaattcttagatatgaacaaatatagaatcattttgaatacaataaaaatctttgtatttctagcatcttataaattaccaatggcttttacatatcttatctcttttaatccccacaacagccctgtgagccagtcattcttggcctcatgttatagatgacaattttgaagcttaaagaggttaagtgacatacccaagatcacacaactagcaaagctgaggctcagactcaggctttttgactcaaatgtggcttgtcttttaccaaaccacttacctctctactgggttgtttggcttttctccaaagccaggtagaagtttttcacattgaggtttttcagaaattcttacttagatatttcatctttctgtaaaaggcagatttattggcccacaaatttggggagccatattcatttttatatttggcatagcttatgcccaggtcctctccataagggtgtacttttatcgagttagaattgttgagttagatttagatgtgtatatagaatgttcaaagtagcttcccacagtccggttttctcttgggggtgaggagttccaggcctccgaagccaaaccgttcagaattggtagccaaatacaccattgactgcagcagagcaatgcaattgctgaacattccccttatacaagatcagttttgaataaatgcatggaaacacgataagctaagaggctcaatttatctttgcttattagtagctctagccagcatatgacccgtagtctctatgaacaactcttctgatggattttatatgccttgtgtgatgtgaaagatgagtaaacaaaccctttattggaaatacatgaggttttgtggggggaagtaggaaagaatgtgtcaaattgtgataagtgatactgtgtagagtatttctgattgaacatccagtaactaaccttttaagcttccggttttttgttggtagcaggcaggagaaaataaccagaggaatgtggattgcttgcagctaaccgggacctgttcatctggttagtttcttttctcccatgctcttgaggaaaggtattactcttggattccagttggccaagaggaaggttcaagctttttttttttttttttttgagatggagttttgctcttgttgcccaggctgccgtgcagtggctcaaaccagcgaaggctcactacaacctccgcctcacaggttcaagcgattctcctgcctcctgagtagctgggattacaggtgcacaccaccatgcccggctaatttttttgtatttttaatagagacggggtttcaccatgttggctaggctggtctcgaactcctgacctcaggtgatctgctcgccttggcctctcaaagtgctgggattacagacgtgagccaccgtgcctggccgaaggttcaagcttttaaatccaaatagaatctagtgattagattgatgcagaaatttaaactgtacttgggcatcacttgcttccattggctcaccagtgattgtagctgatacagttatgtgacaaaagattcattcatttagcaaacaaatcagaggtgcttattgtgtgtcaggcaccagacattgatttttctttttagacattgattttatattaactattagtttccatgttactttaccttgaattgggtcagtagatgagaaattttcctggggagacacactcttcagaaaaggtctaatttagggaggtgttttgaataagattaatttcccaaatttcaacaaaactttgtccaagaacatcatacaaagtgtctaccctacgcttttattccaatcatcaaatcctttagagagattccaaggattatgtttcactgagactgattttatttgctaatgccaattttgggattcaatcagtttaaattagaaatctggaagggcccttcaggattggagactagattggtttctagctagacactcccacctttgcagtttcagggtaaactttctttcccaagaaataaaagcatgtattaagaatgctgcttctgccaagactctgtgtagacccagccaccattgccagatagtctgaaaaagtataaaaaaattagccgcccctcagtgtgtggtcatgaagcagggccaggggcactctttaggtatacagcataaagtatgtcatagatagtaaatactggagtttagaatccatttgtaaagaactgtcagcttgagtgtattaaggcacaaaagcaacttctgaaacacaggcttgatatttgttgctggggctctgaatcattttggagtaccaggacacttagcaataggtgggattattttttcagggaaaataatggtgttccattcttagggtcatagatgactagaaaaagaaaggtccaaggcttagaagaaagatcagctatagattggaaataagctgaaagccagatatccctctcacagattggcacagctccatgtagaaggtctgcccagtgtgttgaggtggggcgagaagttggcattgctgacattgcgcttctccttgctgtaatttcagacccggatgcagagtctacagcctgacccagctgcccgctatcgcaatgtgttggaggccctctggaggattataagaacggagggcctatggaggcccatgagggggctgaacgtcacagcaacaggcgcagggcctgcccacgccctttattttgcctgctacgaaaagttaaaaaagacattgagtgatgtaatccaccctgggggcaatagccatattgccaatggtattgagccttcctgtgctggttcccccactttcccaactctttgggctttgctgctgtcagtgctttccagtctcagcatggtttggagctgaagctttgggctgggataggccagattataagggagggacttccaaacctgatgttctcagacaacgggccgcttcaaccctgccttttcctttggggcacctcaacaaagggttacagtatcctcccttacctaccagcttgacttgttcctctcatctccctggcatcaacttctaatgccctggtaatgtggagacacactgaactacccccagtctatgtttgacagttgggtggtgtcctgctccttagggcaggattggaggcgacccagccagccacccaaggaagatactaatgaagcccctgctttttgcctcaccttttcaggatcccaactcaccagaggcagtttgtgttgagaacatgacaaagcctcatgacaaaatgaatgggggtggggccaaggaactgcatgaagaaaccagaaggttgtgtggaagtaagagaaaggatagcagcctagggctttaggaccggctggaaaccaagttgagtgtggagaggatgaggggtagagtagttcaggacctgaacgaaagatctttgtagacaaatgttaggctctgcaaatgggttctgcggcaggactgaggtgggattctgtggtgaggttctgtgagatctgaccacctggcccccgtatctccctccactggtggcaggtgatgtgctggcatccctaggcagcagtgtatctgcttcctgtctggggtgtgagctgcatttattctcagaatgatctttattgataagacttgagctggccttcctatcatggatgtggaatacattagtgaccttacaaagttggtgggaacagatactttaccttcttaaacaggagtttaggagcagtgggtccccatcttttggactagctcttaacgttacttttccccgctgtagtgtagcacagccactccccttcactgggggacctcaatgagttggtcagctctcttggccttacatgtggcagttgttttcttgtttgcaggtgcggccgggtgtgtggcaacattacttcatgatgcagccatgaaccctgcggaaggtaatgattcctcaacctatcactctgtgggcagctgcacctgtatttctttacagtttgcagaagaaagcacatcagttttggtgggaaattctgttaccttgttttaccactagagggtgctccctccatgtttttggtacctaacgaggcaccctcttggacaggaagcagattcactgggattttactaatccctggggcttccctagaaaaagatgtctccatgtggcctgtttttgggctttcctgggagcctcctttgtcgtagatttgatctgtcctgaaagtttagcagattcatttttcttcaaagaggtgaagatggattctgactttttttttcccccttatgatttgcaggaattgacacttaaatatattgcctttcttattggaatgaagctagttgggataggaatgaaaggttaaatcatagaactcagtccctgcatttctgctgggatcttggcttttcagtcggaggaaaattctccaaaaacattctccatgtgaggatgagcaaatatgaagggatagcattgttgccacgttcattttctgtctgggcaaggccatggggtggaaagagccaaagctaagctgaagctccacagagctcacaccatgttatctacttgagggagtgggaggtgtttgaagactaaagccaactctttttggctaagaatcttttctttggtagaacttctgtctcctcccctctaggaggatcaccatctcacattttaaaagttaggtgctctttgtatgcgaggattgggattgttaggggcctgtgttcgtgatgatcactatcatggagtcatttcttgttgggaattgttagagggtaagatcagagataggtacttagttcaagaagactctctgaagctcccaaactgtagatatgtcctgtgtgcgaactggctggctttacagaagtcctgatggaagtgggtttattgttttttgactcgttaccaaccctctgcttactccttcccctcaaaaaagggaagctgacttctcaggttagccagcagctcactcatacttttttctctctctattccattggctgatctgctgacttggggctctgaatctggatactctccatcaccggttggctgctgtcaccatttccttcctcgttgatggcactactagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaatt

SEQ ID NO: 38657 - DNA, 9512 bp, Homo sapiens
ggctcgagaaggtgctttagtctgaagatggcggcctcagcagcgagaggtgctgcggcgctgcgtagaagtatcaatcagccggttgcttttgtgagaagaattccttggactgcggcgtcgagtgagtgatggagatgtgggagtagtggaatttttaggtccaagtgatcctcaaagcttctgctttttgcagggtacttaagtcagcgtggtggctgaattaggagactgctcctgagcatgcaagtgagcagaaagaaattttgtttgcagttaaccgtttagggatgtcccttgagcttttggggtcacgaatgcaccggctcttgcctttaggagtgatttggtgtaaagatttattacttggtaaccaagatttacaatttagaagggataattttgactgtagtgtggaggatggattcaaggtggcaagattgtaggcgtgcagaggagctaaaaggcaatttcattaatttacttaaaacgtgaggacctgaattagggcgatggtagaaggatggtggtcagatgcattaatgttttaaaagcaaattagatgccgtttcgtgatggcttaagtgggagaagtgtacggaataaaggaaagggagaaatgatttctgggtttttagcattggtgaattgtttgtttagaagttaggagcaggccaagagaagatgagtaaagtttgaatgtgttgactttgagaaacttgtgaggtttccgtcaggcaattggacaaaggttgtatatcattgtggctgagaagtggactccgaagctagaccgttggggttagaattccaacttggccatttaatcgttgttatcacttgaataactgaagttagtatgggaaaagggctcacaactgggcctcagtttactcatcgataaaatggagtcaataatacccaactcataggattgttgagaggattgagtttatatgcaaacttcttagacttgtgttagatacagtgtaagtactcagcaaatgatagttattttcacggtaactaaaattgaaacttacgggagaggcctagtctacagataaaggttggaataattagttctgaaatctttcaccaccttcaatttttgtcagctgcagttttgagatgaggtttttatatttgcttaccaacatgtaaacattcgtggtcactctttttgtagatattcatgtttcaggtcaacccctggaaacaaaatggagcaagatttagtttcttctaagtttttagtggctcagatgtgagtagtagaatgggaaataggttggtttgtgccccgtgttttaaacatgtggttggtgaagaccaagcccagtaaagtctcccgtagtccctgtgaaactttatggaaaggctgaggagtttcattagcatcttgcggatgcaagtttccagacaataaagggctagtttaaaacccttaaaaagagtcagcattatgtacagcttcgaaacagtttctctttgttgttccattgattcagcaaatatttatttgagtatctattctgtggtaggcattgttcttggtgcttgcagctgtttttccttcaccattttaggcaatttaggaagagggttaccttccagagctggtttgttttgaaatcagtgtcttctaggactttaattatctggtataaaacatatgtttaacattattttgttctccagtatcatattctgtgagaccttgatcttgccagttggtttgacttaaccattagagcccttcaaaatttagtctctgtggattgttggaaggattagtggacttttacttattcatttagccaatattgaggccctgctgtttattggtcactgtaaacatagtggtttatatgctgagggagcttacaattagtggtggggatgaagagacttagaacaaatataggcaattgttgaaccagtgaggttttggtgaactaggagaactaaatagatattataaaaagtaaatcagtgaagtacaagcactgtagttcagaagagaaacagatcgtgtagtttttagtctttaagattatatactctaaatctttgaagtctcacagggctggtacattgtcttgtactgtgataggagcccaataaagtaatactcagtggatgtacttggtttgggtcttgaaggatagttatagtgttacaagttagccagggggagataggattaccaacatatggaggggagagaacaacatatgcaaagagggtaacccgcaggacagataaagataattcaattagttgtactagagagtaactaggggctagcagtgggaaataaggcaggaagggtaggtgagggcaactcaacacattttactaaattgtgaaagaccagtaagttgggattttatttggaaatcttcagtataccgggaaacacactggattgtaatttgtctttttcttcattgtgatctgctcacagggatcatagtccacatagcacagtaactggtatgaaaacactcgatatttgctgaggatggagactgcagccaactcaacaacttctctgtccatctcaccaccaagtctggtacattatggctttatagtcagtaccatagctgcttcctaaatcttaagcctttaaggaaatgcaaagtagttcctgtccacaagaaatctggtgaccctgtctttctacagtctaagatagagaatccaaaatatagtaactacttttaatgttttcttctgccacacaggtcagctgaaagaacactttgcacagttcggccatgtcagaaggtgcattttaccttttgtaagtattaaggaaaagtaggtgggaggtggggatggctaatgggtacaaaaaaaatagaatgaataagacctatttgatagtacaacagggtgactatggtcaataataattgtacattttaaaataactcagagtgtaattggattatttgtaactcaaaggataaatgcctgaggggatggataccccataagtcaaaggataaatgcttgaggggatagataccccatgctccatgatgtgcttaatttacattgcatgcctatatcaaaacatctcatgtactccataataaatatacatatttatatatataaatatataaatatatacacctaataatatataaatatatataaatatatacccaaataaatatatacacctactatacactcacaaaaattgttgaaaaaaaagcttaaagtgttttaaaaaattcttatcttgcaacagggtctcgctctgtccccctgcaggggtgcagtggcctgatctcactgcagcctctgcctcccaggcttaagtgatcttcctgccttggcctcctgagtagctgggactatagacatgtgccaccatgcccagctaacttttttggtattttttagtggagacagggtttcgccatactgtccagactggaaaatttttttaattttcattttctttaagagacagggtcttgttctgtcaccccaggtggagtgcagtgatgcagtcatggctcactgcaacctctgcctcccaggcttaggtgatcctcccacctcagcctcctgagtagctgggactacaggcatgcaccaccacacctgggtaatttttgtattttttgtagagatggggtttcgccatgttgcttatgctggtctcgtcgaactcctgggctcaagctatccgcacacctcggcctcccaaaatgttgagattacaggtgtgagccactgtgctggcttatttttgtggagatgggggtcttgccatgttgcccaggctgatcttgaactcctggcttcaagcaatcctcctgcattggcctcccaaagtgctgggattacaggcgtgagccactgtgcccggcctacagtctttattgattacattttgagtgatacttgattaaaaagtgaaaaagctttatcataggtatttgtgttagtttttttattgttgtataacaaaataccacaagcgtaatggctcaaaaacaacacatctctcacagctgagcacagtttagctgggtcctctccttaggatctcacatagctatatattccaggtgtcagctggggctgtggtgtgtctcatcaaagggtcaactggggaaaaagactgacttgcaagctccctcatgtggttggcaaaattcctttttttttttttttgagatggagtctttctcccttgcctaagctggagttgcagtggtgcagtctcagcttactgcaacctctgcctcctgggttcaagccattctcctgcctcagcctcctgagtagctgggactacaggcatgcgccaccacgaccggctaattttttttttttttttttttttgagacggagtctcactctgtggcctaggctggagtgcagtggcgcgatctcggctcaccacaagctctgcctcctgggttcacgccattctcctgcctcagcctcctgagtagctgggactacaggcgcccgccactacgcccggctaattttttgtatttttagtagagatggagtttcgctatgttggccaggctggtctcgaactcctgacctcaagtgacccgcccgcctgggcttcccaaaatgctgggattacaggtgtgagccttcatgcccggccataattcatctttaactgtaggactgaggtctgttttcttgttgacctttggctctgagttgggagctgctctcacctaggaactccctgcagttccttgttacctagtttatctgtaggctgtcttacaatatggcagcttgcttctttaaagccagcaagggcttctccagtctgcttaagatggcatcttatacagaacataatcacaggagtgacatcccattactttcgctgtattcttttggttagaagcaagtcaggtttctcctccacccaaggaggggaggagattatatagggtgtaacatggggaatgcatggagatcatggggcccatcttagaattctgcctactacagtattctaataaggacttgagatttctaataattggcagaggatattttaagttttatcttcattgagtaccattttcttttttagatttataactaataaaacaatatttttatattaattacatttcctttgctttcttgtgagggtttagaaatcagcctataaatttatcctgggctgtatttttctgtgggcttttttagggtgtgatgtgagtacatagagttcacacacacttcactgaaacccttttttccttgcagcactgtaagggctgtggtaaaataacaacataaaggaacttaaattcttaattcttggtttaatgttacttgactcccaaagactaacagattagttatatatagtgccggtgaaggtgtagggaatctggcactcaagttgttgagaagttcaactggtaccttcagttctgttgtgtagttggcaaaataccaaagttaagaatttatatttgctttgatctagcggttacttttctaagaatttatcctacagaaatgtgtggtcaagaatattccaaagcagcattatttaatgtcaagtaagaagaagaaacttaaatgttcatcactgggattgattagatattaagtcactgatgcaatggaattttatatagttgaatagaaaagttgggcacatgtattatggacatgaaatattttctgtaagtttgaaaacttcaattttttcaagagcatttaaataaaaagttccttgcaaaaaaatgaatagatttttattggtccataaataaaataggacctgcaaagaatagatcttagatttaaataaaaggcggctttgatgttggtaaaacaaaataaaatatgacaaaaaaaatatttttttgttccattcattgtactctagttggaaatcctggttccttttttgagacaggttctctctctcactcaggctggagtgcagtggcacaatcaagttcactgcaggcttgaactcctgggttcaagggatccttctgcctctgcctcctgagtagctgggattagtcgtgtgccaccacacctgactaattttttgtactctttgtagaaatggggcttcaccatattgcccaggctggtctcgagctcccgcactcaagcagtctactcacctcagctcccaaagtgctgtgattacaggcatgagccaccacacctggactgagttattttttttgagacagccttgctctgtcgcccaggctggagtgcagaggcgtgatctcagctcactgcaatcgctgcctcctgggttcaagtgatcccccttcctcagtcacccagatagctgggactacaggcatgggccaccacacccagctaatttttgtatttttagtagagatggagtttcactatgttggccaggctggtcccaaactcctgacctcaagccatccatccacctcagcctcccaaagtgctgggattgagccactgcacctggcctatgttttaatataaacaaatttcttaatgcctttgactgtggaagtggtcacatgacaataaaggaatgctttagaaattgttgtatctacaatgaatggatcattgggacatcaccagaaactttccgtcttctaggttaatccttataaagttatccttgaagtagaggagcaattgtaagattttgttttttttggcaaagcacagcatgacttgaatgagactaatgaggaccagtttgtcatctacagggactagacatcttaatatctgttttctgtcgaagggctggaggggcagggtacatccaagcactctagaatctgttttccgtatgcgatgtataggttgaaacttttgcacaagggaaaatagcaaaattgtttaaattaaccagaagtctgtaactaggttgagtaagggctaaatattatcttttcttgtttttcattaggaacacgtgatgatagtcgtggtggtggtgagggtgactggattcagaaatgagtgcaacaaggctttgaggcttaattttctagtttctagaaacgaagcttagaacaagagtactgatcaaaatttcccttagctattactgttagtatggtttgcatctagaatgacacagaaagctcatgacccgtatcttctctaatggcagcaaggaaaacaggaagcttaacaacacagggatttagccttgggtaatcaggaagggtgtaaagcaaggttactgacacttataaatgtctgtgatccgatttttggctgggcatggtggcttatgcctgtaatttcactactttgggaggcccagatgggaagattgcttgagcccaggagtttgagaccggcctgggtaagatgggaagaccccatctctgcaaaaaatataaaaaatgaggcagacatggtggtatgtacctgtgatcccagctactgaagaggctgaggtgggaggattgcttgaacccaggaagttgaggctgcagtgagttgcgttcataccactgcaccccagcctgggtgacagagcaagaccctgcctaaaaataaaataaaattaaattaaaaagtccgatttttggcagatgaaaaagttggtagtttgatttggaactcatggaaactttctgaagttcatgattaatcttttcctatattttgaatttttaggacaaggagactggctttcacagaggtttgggttgggttcagttttcttcagaagaaggacttcggaatgcactacaacaggaaaatcatattatagatggagtaaaggtaaatttatttctatgccagatacatacatgatatacatgtaggtactatttaattatgtatcaattaaatagatcataaatgtggaatgatggggacttggagagatttgtaactgaagctgccttaatgcttgttaagaatggtggggtggaggctgggcacggtggctcacgcctgtaatcccagcactttgggaggccgaggcgggcggatcacaaggtcaggagatcgagaccatcctggctaacacggtgaaaccccgtctctactaaaaatacaaaaaattagcctggcaaggtggcgggcgcctgtagtcccagctactcgggaggctgaggcaggagaatggcgtgaaccccagggggtggagcctgcagtgagccgagattgcgccactgcactccagcctgggcgatagcgagactccatctcaaacaaacaaacaaacaaaacaacaacaaaaaaagaatggtgcggtggtaggccaggcgcagtggttcatgcctataatcccagcactttgggaggccgaggcgggggggatcaccagaggtcaggagtttgagaccagcctgaccaacatggagaaaccccatctctactaaaaatacaaaaaaaattagatgggcgtggtggcacatgcctgtagtcccagctactcaggagactgaggcaggagaacccaagagacagaggttgcagtgaactaaaatcgcgccattgcactccagcctgggcaacaagagcaaaactccatctcaaaaaaaaaaaaaaaaaaaaaatggggggtggtagagtgcccagttttaaaaggtccaggaaagtacaagatgaccctttaatgggtagcaagatatgtaacacagtggacataacagtctacttttcttttttctttttgagagtcttgctcttgttgcccaggctagagtgcaatggtgcaatcttggatcactgcaacctccgcctcctgggttcaagcgattctcctgcctcaacctcccgagtagctgggattacaggcatgcgccaccacgcactgctaattttttttgtatttttagtagagattgggtttcatcatgttggtcaggctggtctcaaactcctgacctcaggcaatccgcccacctcggcctcccaaagtgctgggattacaggcgtgagccacagcgcctggccagcagtctgcttttcaggtcaggcaagctggggctgaaatcttggcttacccaccatgtgatcctgggccaaactgatttactattttattttaaattttagttttaatgagacagggccttgctatgttgcagggtggtgttgaactcctggcctcaagcaatcctcttgcctcagcttgccaaaatgctggcattacaggcctgagccactgcccctggtctgatttacaatttttaattgagggttagggagtcataataccaacaaagatggtaaaaggaatttgaggagaaaacgaaagaacaagggacaaataaaaactgcctgggttattcattattcatactgactccctaataaagtgattttcagtttgaatgtttttgcagacattgcctttcctcccttacagtgcttatttttttaaggtccaggttcacactagaaggccaaaacttccgcaaacatctgatgatgaaaagaaagatttttgagactgcagcctattaataaagttaacataactgag

SEQ ID NO: 38658 - DNA, 8615 bp, Homo sapiens
cctgggccagcatggcggcgcccatgtaacccggtccgtgccgcaaagcgaacggcggccgcggcgcgggccccgcgggggttagaggtcaccatgctgagggtcgcgtggaggacgctgagtttgattcggacccgggcagttacccaggtcctagtacccgggctgccgggcggtgggagcgccaagtttcctttcaaccagtggggcctgcagcctcgaagtgaggagctgagaaatgggacggcgggcgtagggaaacagggttcggcgaagatagggaataaggaagcacaggagtaggggagatatacagcggtcaggataagggggaaagggcggtggttgcgcaagaggtgaaacaagatgtgagagacaaggggtagggaagaaatggggcagcggttaggttcagaagcgcatagaccgtggcggacgggcaatgcgaggggcacagaaaggaactgaggggtgggctatttaaggagatggtcctcagccctctcttttctgcgtaggtctcctcctccaggccgcgcgcggatatgtcgtccggaaaccaggtaggagttcctaaggtgggacttggggcggaagagagacctcctggaaggctggggtgggtaaggggaccgatgtggcgaattagagccactagatgaggtgagccagaggtcctgagcaaaagaccccacgtccaccttacacaaagccctaggcctgcagcctgtatggggacagaggggtgtgaagggcgggagcaggagctttccaggtgaatgagtgaaaatgagcttcccagagggagtgcatggctggcaccacccaggcctacctagagtatggcactttgtgtctgcgcttctgagatgcaggatgtaatttcccattgcaactcagtatgcatagtagttaagatccttcttattaggtaaatgatatggggcaaggtacttcctctctctgattcttatttctaaaatgagtgtgaaagtatccatttgcaaggattgttaggattcagcgataatacacgaaaagcacccttaacgctgtgctcaattaaatatattgatagtatatattagaatttattatctggggccggacgcggtggcttacgcctgtaatcccaacactttgggaggccaaggtgggcagatcacttgagttcaggagttcgagaccagcctggccaacatggtgaaacctcgtctctactaaaaatacagaaaaaaattagccaggtgtggtagcgcgcgcctgtaatcccagctactcaggaggctgaggcaggagaatcgcttgaacctgggaggtggaggttgcagtgagccgatcgtgccactgcactccagcctgggtgacagagcgagactccatctcaaaaaaacaaaaaagaaagaaattattggctggacatggccccaacattttgggaggccaaggctggaggatcacttgaggccaggagttcaagaccagcctgggcaacatagcaagacccagtctctacaaaaaataaaataagtagaatttattgctattaatatatttttaatataattcttttctgcctccctatcagaatcaacttgagctgttacagacagaagaggcccattaatgttatttgcatagcagggtctgactggagaggataagtccatctactctatgcctcttcctcatctccaagggatagcaggggtgcacacaccaagactgaggttttcctgtgatctctacttggtgcttacatttcaggcatcgtacagctagctgcctttcctcaacccccttaattcatacatgcagtcagccagcaagtgtttgttgagtgcctagtctaggctgagccatgggccagactatggtggattccaagggagtcaaactctgtcctatccacaggaggacccatcctagtgggggatctgagaactgtagagccagataggtgtgtgaaaggtgcaggcacagtgtagggtcttgggaaaagccacctactcgcaacatgaaatatcaaagcaggtgcccacggagtttgcaaaggagaaactgagccgagagatatccagtgctttgcttgagaccctgaatgtcccttctggagttggagagtgggtgaaaagagccaggtctgggagggtgggcagcgagagttgactctgggtgttttctatccccatatttacttgacagcccagtctaggctggatgatgacccacctccctctacgctgctcaaagactaccagaatgtccctggaattgagaagtaagcaggaagaaacctagtagaggaggcagggggccctgggaggattgtcggggagtggggaaagacagtggctttgagacttggcttgctgtagctgaagcttgatctagaaggaggcaggggcccaggtgtccaggtgtggtgagggtgggtggtcagcaaggcagatggcactcatggagctcggctacttgggggtttttttgtactctagatgaacaccctgtaccactagattccaaggagctaacatacttcacaggtctttgtagaaatctctcatctcttgttcctcacaaaagctgtatgtccccattttatagattttcaagctgtccagtgtcatacagttctaaagggcagagctagagtttgaatccagggctgactgacaccaaagccagaggccctctgctcagctcctatgcagtgtggtgggagctggtcagtccctcccactgtgcaatttaacttgaaatgtctcaaaacagattgaaccatgttgtagctaaaatggaaatcctctccttgccctccctgtgatgagaccggaacagtcgagctgacagccccagtttctgtagtttcagcccagcaagccagatccacactgacttttaatccctgggaaatggctccccacctccagggagattcatttgctacagaaggaatttttcaatcatctttgcttttcaaactaaaatgaaaccagcattgctttcctctcttctcccccaatgtctgtctcattgctgtggtttatccacagggttgatgatgtcgtgaaaagactcttgtctttggaaatggccaacaaggtgagcagcctctgccaagcctcagcctcccgcagtcttctcctctgggactcccttctaccctgattagcaccccgcatctcatgcttctccagtcacagcacttagcccactgtcattctgcctccatttgtcaatatccctagacagagcatcttcagggcagggacacttttgttcccccaccatacccctagcacctgacaaacaggtgctcagtgaatgaatgaatgagcataaatgaatgagcaagctttggggacattcatgcaacaagtcatttcctctgtcagtggctttggctttgggctcacctggatgtggatagccatgtggttggtcaaggccacagtgagcagagtgaagtcaggccctgagccttatggccctagttgctataactgtagccagggcccttggggggaggagggctagttcttagagggtggcagactccacagattttctctgtctctgtcttcaacagaaggagatgctaaaaatcaagcaagaacagtttatgaagaagattgttgcaaacccagaggacaccagatccctggaggctcgaagttggtcggggacccttggggagtgggggtgtagggaagcctgctagctgggacctgatctagggctcttgtctacaagcacatgcacatgggctggggaaagggagagacatgaaggacctagggcaatgaaaattggaccctgtatcccaagctctgatgctggagtcaacacccagttggaccttgtaccactgtgtgagcttgggtaagtcaccaaccctctcttggagcccctgcttcctcatctggaaatgggggaataagggagagcagagcagaggtaatgttacccacctcatggcagcattgtgagaggcagctaggggatgtaaacacaccttggaaactaaagctcacgatgtgtgataataatagtaagactaggccaggcgcggtggctcacgcctgtaatcccagcactttgggaggccaagcaggtggatcacaaggtcaggagatcaagaccatcctggctaacacggtgaaaccccgtctctactaaaaatacaaaaaattagccgggcatggtggcgggcgcctgtagtcctagctactggggctgaggcaggagaatggcgtgaacctgggaggcggagcttgcagtgagccgagatcgcgccactgcactctcgcctgggcaacagagcgagactccgtctcgaaaataaaaaaataagaccaacattttgaaccctcttgtgccagacagacaccatggtgcattcccaagggaataatgttgctactttggttcaggctagaactggcagtagtcctcattagatgtgagtgaaaagcaccaccatttccccctctctctgggtgcagtttctcttcattgcccactgagagcaagtgaggtagactagtggacctgcagaggatctgcacactttctctcctttgccattggcctatattatagcctcctcctcctcttccaccctcctgccttcattcttctcccttcattcttttcttctccctctgccagggattaaagtctggtgagttcatcttggatactaaaaccccattgagaactggactcaagggtcctccatagcctcttttgagaagatgagtttcagcttcccttgccctgctaaagccctgggctagggaccagctcagccacaaaaggcctgcttatctttcctcacctgtttctgcattatcactactgaaatccccaggttggcaggaacaaatggcctggactggcaaggtggttactggggtcgtctttaagcacaagttttgattctttttttttttttttttttttgagaccggatctcactctgtcactcaggctggaatgcagtcagtggcaggtgtgatcatggctcactacagcgcaacttctggggctccagcaattctcctacctcaggctcccaagtagctgggaccaaaggcatgcacaaccatgtcaagctaatttttgtgtttttggtagagacaggattttgtcatattgcccaggctgatctcgaactcctgagctcaagtaattcacctgcctcagcctcccaaagtgctgggattacaggcatgagtcaccacgcccagcccacagatgtcacttctgcctttccattattactcagttttctgaatgccagttgcttctagcatagtgcctgctctagagaacccctcaggaaccaaggcctatctttctgtgttgttccactctacacctaagttgctgtgatggagccatgtggtcggggtcagggttcccactgcactttctgcagtgctcccagaactcagtatgtactgggaagggcctgctgtcgtgacagcctctctttggggccagcttctgcttttgcccccatctttgcagtacagggggtaaattaaacaagaggatgcctgaatgaacgatatcctgggttcttgagagacaagtgggagctgataattctgaaaattcattagtcaaagcatggagataaaggtggcagcaggaaggggagaggcaaggagtagacccgtgacagttttagaatcttatttgtgccaaaatactttactgcattggcttggacctctaatacaatgttgaattgttaaccatgatagcactgtatcctggtctaattcctgaattgaatggctagtcttaccattaagaatgctatttgcggccaggcacggtggctcacacctgtaaccccaccactttgggaggccaaggcaggtggatcacttgaggtcaggagtttgagaccagcctggccaacatggtgaaaccccgtctctactaaaaatagaaaaattagccgtgtgtggtggcgggcgcctgtaatcccagctgctctggagtctgaggcaagagaatcacctgaacctgggaggcagaggctgcggtgagccgagatcgcaccactgcactccagcctgggcaacagagcgagactccgtctcaaaaaaaagaatgctatttgctatgatttttggatgatatctttataatattaagggatgtcccttccttggattttgctttttaagggaaggtaatgtctaagataagcctttgaaatcttgaaattcagagtgatttgggatttatagagagctgtacagagcattggtgattgttattccttgagttcttaaaacgtaaaccaggcctgggcccttccttcctctgtgcccaactctcatcctctgtggtttgtggtttcagttattgccttgtctgtcaagatccgcagttatgaagaacacttggagaaacatcgaaaggtaaactctggacgtcattcacagttaaacagcagcagcctgggggaaaggggtccggaggggaagggctctgggtccagagaaggaggcttagaagccactgaaaatgcttccctcctgcctccagaggacttggagccttacaaggccatgctgagtgtcaccaggggttaagaacacaaacttgagagcatgatcactgtgtctggcacatgctgagtgctcagtaaatatttgttgaatgcatgaatggagtcagattgccctgggttcaaatccgagctctgccacttccacttaagtagctgtgtgatattagggaagtacaggtctcagcctcagttttcttttcaataagatggagatcatacaaatacttgctcacaggattgcaaggattatgtgaaataataataacagccaatgtgatgcatataaagtctttaggccctgtgctaagtacttcacatgcatcttcttatttgactctcatgacttttttttcccatcttaacgaggaataatctagtcatggaatgattaagttattccttaaggcatagcactgggaagtgatgtactgagaccttgaaacaaggcagtcttgctccaagacccatatatatatatattttttttttttttttgagatggagccttgctctgtcacccaggctggagtgcagaggtgcgatctcggctcactgcaggctccgcctcccaggttcaagcaactctcctgcctcagcctcctgagtagctgggactacaggcgcatgccaccacacccagctaattttttgtatttttagtagagacagggtttcaccgtgttagccaggatgatcccaatctcctgacctcgtgatctccccacctcggcctcctaaagtgctgagattacaggtgtgagccaccatggccagccatattcttaaccattataccatatctcagcacagtgtctggcacagagctgctgtaattaggcaaatgctgttatttttaataaacaaatgattgtgaatacagactggtccagcaccatgcctggcacctcagtgttccctggagcctgcttcttaaagatcacagttttgcttatttgaggtgtgggacagcagccctactgcagaggtccttcacagggcagcagccagctgtgggtaggcatttccaggaagagcacaaggccttccttcctctctaccccagctgacagtttgctaagctatggagagtctgagtgggtagtgtaggagaaagagcatgaggtttgaagtcagaccaatagatagagattcaagaccctatctcagcactcacagttctaaagaccttttgtgaatcagataacatctttaaacctttgttttctcatctgtaaaatgggaataacaatgataatacctccttcagaattgcattaatatttgcataagattactgagaaatttcagtgaaatgataaaatgaccattgtttgttactgtgaacaacagtaacacttatataatactaaaagtaatgagaatctcttgcaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggtacgagtcagaattgcggctttgcttggccccactcagggactgggatggaggaagcagaagggagggatcatctgtttctgttagaggcatggaactggccccaggccctggaatggatccagggaggtcacaggccaccaaccccatggagaaaggctggggttaccatctgggggaaatagttcccatcccacttgttccaagtctgaggttttgcacaggattacaaggtctttttctgccccttttcatccccaggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatcatttctttctgtcttgaagaa

SEQ ID NO: 38659 - DNA, 75197 bp, Homo sapiens
acaagcaacgtgagagaagctcgggtagaggttcgaagagctgggagcgcagggcggggacctcgcacgggagggtgcgggcgggagcctgcctcgcgagcccgggccacggcggctgctcccgaccgtgactgggacccgggcagggaaggtcgctacaaagcctgccgggcgaaccgaaggcagctttgtgcggagccatgccaggaagcttgggaaccgtgagccacaagaggtatttttggtttgtttggcttaagcagaggagagatggttttctaggtttctgtttcattgctagctaacaagtgagggctgtccacagcctggcatgccctaagtgcctcatgtgtattaactcatgtaatccatccagcaatccagtgtggtggctcctgttatctccctttcatggacggggaaatgaggcacagtgcagtaaggtaattttctgatggacacaaaggagaggtgttgaaaaaaaagactggggccaggattccaacacagggcttctgattccagaacccccaagcccttatatcatataccatactgcctctgatagcagtcatatccaaccattataccatactgcctctggtagcagtcatacgcaactctttatttttatttatttattttagatagggtctggctctgttgccggaatgcagtggcgcgatcagagctcactgcaagctcgagctcctgggctccagtgatcctcctgccttggcctcccaaagtgctggaactacaggcatgagccaccgcacccagccaatgcaacacttaataaggcctagctgccctgtgatttggtcctacacataatcacacaagtccattaggaataaaactgcactgcatatgggattcatgccaaatgagtagattttagccactcttgccacagagacacaaaaagggttggtggtaactatatgagatgatggatatgttaatatgcttcactatagtaaccttgtgactgcctgtttcagctgtccccaacctttttggcactagggaccggtttcatggaagacaatttttccacggacttggcaggggagtgggtggtatggacttggcaaggggatgggggctatggttttggcatgaaactgttccacctcagatcatcaggcataagattctcatagggagtacacaatttagatccctcctatgggcagttcacagtagggttcgagctcctatgagaatctaatgcgcggttgatctgacaggaggcagagctcaggaaggtcatgggggttccgaacaggccgaggactggttgctggggactggggacccctggtctatatgatatcaacttcatattgtatatcttaaatatccacaatacaagttattttttaaaattttaattgaaaaaggactgggcatggtgactcacacctgtaatcccagcacttttggaggctgagacagaaggatccactgatcccaggagtttgagaccagctcggtcaagatggtgagatcccatctctatttttattaaagagagataaataagagatacaagtccagtggaagaaaaaattgaaagcaatttaaatccctacctcagattctcaagaggtactcaaaggagaacacagacactgtatagtaaatttcctaaaactcttttttcctcttattttaccattttcaatttctcttatatgcctcattcacccaactcccttaaacctcagcatgcttctccaccttctcatctatctaagctttttttgagagataactctctatgttttaaaaaggaattctcaggacgggtgcggtggctcacacctgtaatcccagcactttgagaggccgaggagggcagattacctgaggtcaggagttcgagaccagcctggccaacatggtgaaacccatctctaccaaaaatacaaaaattagccgggcgtggtggtgcatgcctgtaatcccagctacttgggaggctgaggtaggagaatcacttgaacctgggaggcagaggttgcagtgagccaagatggtgccattgcactccagcctgggcaacaagaacaaaactcagtctaaaaaacaaacaaacaaacaaaaaccccaaaaggaattctcactattttttttagcttctgcttcttaaattctccctctcactgagtattaacccatttttttttttttttttgagatggagttttgctcttgttgcccaggctggggtgtaatggcgccgatattggctcactgcaacctccacctcctaggttcaagcaattctcctgcctcagcctcctgagtagctgggattacaggcatgcaccaccacgcctggctaattctgtatttttagtagggatgaggtttctccatgttggtcaggctagtcttgaactcccaacctcaggtgatctgcccaccttggtctcctaaggttctggggttacaggcatgaaccactgcgcctggccagcccaatttcataatatgtccaaagagaatttggaaagggagggagaaataagatgtctgcgaacagaaaagaggttatgaatatttatctattaatatttttctatgtcacatacataacataggaggctcttaaatgttgccataataaagtttttatggatttgaaataaaactggaagagttggaataaagcagtgagtttttcataaaacccaaagtgtttaatttaaagaactgtactttgttctgagagttttgtgcctagatggtagtttttttctaatgcccttatagcacaaggttaaaggaaaaaatcaaacgttccaaccctaatgttgaacttcaaatttaaaaaaactagtctatgatatttgaaagcccaagtacccttgaactaggagaaaaattaaggcaaaatatttttaagacaaaagagattgcaagctataactggtggcttagatagggagctgcagggtgatgaggaaatgtgtactagtttcctagggctgctgtgaaacaataggaatgttttgtttcacagttctgaaggatatataagtctgaaatcaaagtgtcagtagggctgtgatccctgcaaaacctgtaggaaagaatgcttccatgcctctttctagcttctggtggcagctgtcaatccatggcagcccttgacttgtcaatgaatcactccagtctctgactccatcacatcatcacgtggtgttctccctgtgtgtctgtctcttcttttttttttttctttttgagacaaggtctggctctgtcatccaggttggagtgcaatggtgcgatctcagcttgctgcagcctccacctcccaggcttaagtgatcctcccacctcagcttttggagtagctgagattataggtgtgcactaccatgcctggctagtttttaaattttttctagagatgaggttttaccatgtttcccatgctggtcttgaactcctgagctcaagcaatcctcctgcatcagcctcccaaagtgctgggattacagatgtgagccactgcgcccagcctcttctcctcttattataaattcactagttatattggattagggctcatcctgtgatctcatcttaacttgattatatcagcaaggatcccatatccaaataaagtcatattcataggtacagcgggttaaggcttcagcatgtcttttgggggagatacaattcaatctatgacaaagtacataatccaatgggaaagatgttttagtagagcagttttgagtaatctgtccttgagggaggcatctaaaataggtccccatttcacagtaaagtaccttcaatctctgaaacttcaagaatgtagtttggaaacaacaacctaggaggagagtttggagaagagggatggaaaatagcaccctgaagaagccagcattgatggggtaaagacaagaggaggcactcatgaaggaaatagagaataggtagccagagaagttaaaagggaactgggtgagggtgatgtcaaagaagccacaggcaaagagggtttcatagaggcagaagtggtaaggaaagccaaaagccacagagaggtcagggaagaagaggacgaagaagcaactgttggatttgcaaattaggaggttagtagtggcctagaattaaaatgttttcaatggagtgggagggaaagaagccagagagaactgaagcatgagttagaaaatgcggataacatgtgtagtctattctttacagagacttggccatgtaaggaaagaaagaacaatggctggcaaggagagagaggtactgtgtaaattgttattattttggatggtgagacttgtgggcccagaagaaggatccagttgcaaacaaaaggtcggaagagcacaaccagcaatcatttccaaccttctccttgcctgcctctcattattgaggctgggaaggaaaaaaacaaacaaacaaaatacaaacaaataagaactttcccagactactgtacccactctccttcaagatctgctctccttttcttttcagtaacagaatctggactctgagctgggcacatgaccattctaaataaaaactaatttcccaagcttccctcaacttgttgtggcctgtggctaaatattgacctatgggttgtaagcaaaagtaatatatataattccagaatgtgttctagaggagggaagcttcctttctcttactctttcctgctgtctggaatgtagatgtaatggctagaactggagcagccatcttggaccatgagctggaagaagcctaatttcctgagtacttagtgaagtagagcagctccactggaaattacatcccatagggcaagtagatctgttcagaaagagctgggatttggtggatcaaagtcctggaggatcaagaaaagatggatcctgaagtccatgtatacctacatgtataccagggttgaatagatacattaattctctattatagattatataaatattatgtattctatacatgtacaggaatccctctttagccatggtttcacttacccacagtcaatgcagtctgagaatattaaatggaaaattccagaaataagcaatttgtaagttttaaattgtgtaacatcctgagtcacatgatgaagtcttgcgctgtcccgctcttacctgcctgggatgtgaatcatcctttgtccagtgtttccacactgtatgtgccacctgcccattcgtaattgagtagctgtcttagttagaggtatataggatttggtgctatccgtggttttaggcatctctgggggtctttgaatgtatcccccttgggtaagggagcatctgttgtgttatagaaagctctattggacagtgctgctctagactttttaggcatatgttagagaaggtactttcatctctcactacttcctctcctctctgcccactcctccgtatcaaacacccaccagagtcatttacctggactgtttcatttggggttaagatcaagggctttaagacccaataggttgtagctacttaactagttgtatggccttggtcaaattatttatcctctttgaacctcagattctttgtctataaaatgggaataataagagcatctgcttcttagggttagtcaaaggattaaatgagataatatggttccaaagtggcagcaaggaagcaatctggcttcacaccccccaatggaaaacccaaaactaatattcaacactgaaattatcaccagcaatatccgagaactcaaatatgaggatgagacatttgctggggccacagagaagtttaaaaaactctgagcagatggtaagagaatcagacttccatatctgtaatcccctccccacaatctgccaggcaccaactgcatgaaaatttcccccaactcacagtctgtacactgtaaaaagtgagatcaaggcatagacaaccagcttctccacaatcttgggttcccttgcaggagacttgtcccagcctcaaccactagaagcatcagcagtccctagaggagaaatatccctgagaacagccagagacaaaggggagaggtgagactaccatcccagctctggaaactctgctgtgtaacttgacaaaaagagatggagacaccaaatcatagtggctgttcagcagcaccacactgtaggaggttgggtccataggtcccttggacactgaacccctagctagccttcccaaactactgggatatcccccattaaggatgaggggcactgattatttattagaatggaggcaaacgtgggtttcagcaccatctagtgctgaaaatggggcagtgacctagcaaggggggaaaaaaagaaagaaagaaataggtaaatgaaataatacatgtaaagtacaggcagtcttcactttgcatgataacactgttctgtaaacatgatatgcaagccaacacccttcaaagtgatctcaattatcagtgggaaaaattacaattgttttgtgatgtttaaaaacttttgtcaaaatattaaaaactttcttactgttggatataaatatatagagaaatgaaaaaattgtaaacctaatatttctttattatgccataatttaaaacagaaatattgagaattaatgtgttttgcttttttttttttgagacagggtctttgtcacctgagctgaagtacagtggcatgatcacagctcaccacaaccttgacctcccaggctaaagcgatcctcccacctcagccttctgagtagttgggaccataggtacataacaccacacctggctaacttttttattttttgtagagacggggtctccctatgttgctcaggctggtcttgaactcctgagctcaagcctcagccttccaaagtgctgggattacaggtgtgagccaccatgcccagcctcctttctaagttttcctttgtgctttcaatgttgtgagatatctttcagcattcctttaatgtgaattttttgcccatgtcactttctggaacatctttatccttttccttacaacttccttccttatttgtgttcataagtttacctttactaagtctctctggatgcccatctggagttgaacagtggcaatgtcaacattcccatggccaccaatttcttctgtaactccagtgatctttgatttgaacttcactgccacaataatcactttttgtttctttgcttcacttttatctttattggcaaattctatcgtccattttttacaatgttacttggagataaagaggcaacacaactacatgctttgctgtctgtgcataactaaataacagatgtccagtgaccagtcaccagcagactagaaatgaagtgatgtgctgtggtcactgaccatggcgtgcatctgttatttacatagtaattttgtggactgaaaacctggcagcaaagcttgtatttatgcaattacttacagtgaatatactgtggtaactgaaatttgaactgtattattgggggacttgtgttatataactaaacggtgctaattgaaatctgtgctgttaccatgccaagcaaggactgtgctatacttacgcaatgtctgacatgtagttagcatttaataagtagtagattgttttatttctatcattatcatgattttattatatttctacactttctattcctcctcctgagctgcaggccaaaaagtcaaccctagagtgagaatctggtgctggaggtggcagacagtcctgtgttttcagccaagagtgtaaattgcaatgtctttaatctcaattgaggactcaggccaagggccaaaggcttattgccagaggtctgagaagaggttctggggagtgctagcaagtgggcagaactcgatagcagagatcctgggcagggactgttgccaaggtgagggaaacagatggtgtctgagaggtctgtttacagattgcagggctccagccatggatcttggctgaagctatgtccaaagcatagagagggcagctggcaagagcaaggcagggctccaggctagatagaacctaacttaattgccagaacagggaactgggccaaggaagaaaaacagttaccgcatgcgggagagagggaactcaagtgtgagactcaggtgctggagcaattgctgcagttcagggagtagcaggggaaagcaagagcaccgaagctcagggcaacaggaagatgacctgcaactgaaccacaccaggcaaaagagagggaattgaggctgctatggtaattcctgccccatatgtgtgatcttggagcccagccatgggagacaaacgtggcaaagaggcttgtcagcctgacccaatgtggtaattcatgtactactacagaagacttattcctttcctcccaggcaaacttatcagctttaatagattttatctaggaccttatctaaaagttatatactcagtaaaggcagacccagttagcaagaagaaatgatgaacatctgaccttcaactagtaagaaataaacatggaataatagagactaagatacatgttttgttgacaagtgataccacaaatataaaatgcatgtgaaatgcatacatattgcatggggttgcactcaggcatgtaactaaatctaaccaaacttagttgaccacttaagggtttattttcctcacatagcaagattttccatgagtagttagttcagggctgctgtggtgattctctgccatctttagcatatgccaggctgcagaatgacagagtgccagggaccccattcatataatgcaaggatattttccatttacttctacagatctactctccacccttcaacctgttcagtgtcctgagaggctgacctgaatggattatagcacttgagcttcttgccctctgacttctagttggatttggtcaatgggagacactaccaacaggagactgtgaggctggggtaatcagcccctcgtcccttttgtgcagagcaccacaggttggctgtatcccagtgggagggccgctcttgctggccaccctctccatatcctctctccaggtcctggaaaccactctctcttgttgcccttcagagtttggggtggtaataactccctgctattgctagccccagggtactgcatcatctcttaaccatgtttccctgacagtgattacaccttttcaattagtgcctttttaaaaagtctccaccattaccctattggagggagctgtctgtatcctgccaggaccctgactgattcaactctatagtcactgtgcacaaccagtgtggccatatgcagcagcacagtgcaggcctcttatccccatggctgcaaggtggctacttcacacgcaagcttcaaggttggattttaaacaggaagaaagggcaaaagacaccaaagagctctttgccaggaaaacactagctttcaaggaagtactagacagcagatgtctgctcacgtgccactctagctgcaggacatccaaggaggagaatcttttcaaataggcattttgctgtccatatgaaatcgtgtttctattagaagggaggaagcagagcaatgaacatggggaggcaggtatccaaaggaaataaaatcagtatttcaatggggaggcagatatctctttgaaatactgattttatttcctttggatatctgcctccccatgttcattgcagcattatttatcatagtcaagatatggaatcaacttaagtatccattgatgggtgaatggataaatatattgtggtacatatatgcaatagaatattattcagccatataaaggaaatcctgctatttttgacaacgtggatgaaacttgagggcattatgctaagtgaaataagccagatacagaaaaacaaatacatacaattttacttatatttgtaatctaagaaagtcaaactcatagaagcagggagtaggtggaatggtggttgctagggtgaggggatggggaaaatggggagatgttagtcaaacagtataaactttcagttatcagatgagcaaattctggggatctagtgtagaaaatgggtggtgttggatgtgttaattaatttgattttggtaatcattacacagtgtacatgcatatcaagtcaacaccgtacatcttgaatgtattcagtctttctcagttaaatatttaaatttaaaattaaatattcaattatatattattcaataaaatcaattacatgttatagttcaatttcaattaaatattactttttttttttgagacggagtcttgctctgttgcccaggctggagtgcagtggcgcaatctcagctcactgcaaactccgcctcccgggttcaagccattctcctgcctcagcctcccgagtagttgggactacaggcgcctgccactgtgcccagctaattttttatatttttagtagagacagggtttcactgtgttagccaggatggtcttgatctcctgacctcgtgatccacccaccttggcctcccaaagtgctgggattacaggtgtgagccaccgcgcccggctaaatattacttttgtttaaaaacaacagcaataataacttccatttcttgagtccttattgagtgccttacatgcatgatgtcttttaacccacacaagagtcctattagtagtccccacttaacagatgaggaaactggaggtaagacctgtgctcacactaggtatgtctgtctccaaaggccactctggtgtcatgcatatcctctgtttcttttctcatttcttccccagggaaaatctgtgcatacagtgtggacatctaagtcatacataacaagcctatcgcatccttggagcatggcacagcaggaataaaggagaaagaagctggaatcagacagtgggggtcagggagaagatctataacattctgctaggtggatgagagattcaaaggagatgacatgatctgtgaaggaaattgcactgggcaggtgtcagctcaggctgctgtccacatgatgcctgggacatgtctgagggactagcctgctgcaagttaacagcacataattctggaagggcggtgggaaaccctgagccagaagtggttcttattttcgctcatgtgtgtgcagtgagtatttagagcataggatattgtgctgcccctgaaccttatgacttcccagaggtgaccaacgttttagctaaaaacatttagctaaatgtttgaatggaattgtgctttaaaataaggtacaacttgctgagcatggtggtgcatgactacagtcccagctactcgggaggctgaggagaaaggcccaggaattcaagtccagcctgggcaacatagcaagacacgtctctacataataataataataattaatacataaaataaggtacaagatgctgggggtaaagagagaagaggaggggcatcatgtcaagcctctccaggagaaaggacacacctgctggattgtgtgagggatttagaataggggcatataagggaacacagggcagtcaataattctacacaggcagcaaatttgatgctgaaggatgaccaatgtggatgccatgccacttaacgctactgttgcagccgcagatcctagtatttgaaatatgcctcaagaaggaaacacttaagaagtgctgaataagaattccaatcctggcttcatcgctaacttgctttgggaacttgggctttaatttgctcaaagcctcagtttgctcatctgtaaattggggcaaataacatctgttcaacttacctaccagaaatgttgtgtggctaaaaagaaatagaagatatgaaaatgctttggctatattcaaagttctatatacatggaagatattcaggatcctcccaccttcaaagttcatatctaagaaaacccctactaaatcctttagaatggaactgctcaatatagtagccactagccacattgactactgagtacttaaatgtgactagtgcaactgaggaactgaatttttaattttatttaactgtaactaattttaattgaaaaactgatactctattcaattactggaaaacttttaagtacatttggaccaacctggactcgtgaatttacttttgttcccagtgtttttttctatttttttattgataacataatagatatacatattttgagtgtgtattcaaacatttaatattaatacattcatataatttgtaaagatcaaatcagtgtaactgggatatccattaccttaaatgaatctactttttaaatggtatttataaaatctaaatatatgtgaagtgtttctgcttaaatttagtgtttgaattgagatgtgctccaagtgtacaacacacaccaaatttcaaagacttagttaaaaaaaaaacactgggaagggcaggaggaagggagagatagggagagatttgttaaaggatataaaattatagctagataggaggaataggttctagtgtagtatggccatagttaacaataatatatagcttcaaagagctagaaggaggatattgaatgtttccaacataagcatcaatatttgagattatagatatgctaattacagtgttctgatcactatacattgtatattgaaacatcaatatgtaccccatgaatatgtacaattattacatgaatatgtatcaaaacaaattaaatttaaagacaaaacaaagaacataaaacatcttcttaataatgttttatattatgtgttgaaatgataacatcttgtatatattgggtaaagtaaaatatatcattaagataaattttacctctttgtacttttttcttaatgtggctactagaaaattttaaattatagccaggtgtagtgatgtgcacctgtaatctcagctactcaggaggctgagacgggaggatcgcctgaaccttgaagttcacggctgcagtgagctgtgatcacgccactgcactccagcctgagtaacagagcaagaccctgtctctttaaaaaaaaaaaaaagtaaaattggccggatgaggtggctcacgcctgtaatcccagcactttgggaggctgaggcggcggatcacctgaggtcaggtgtttgagaccagcctggccaacatggcgaaaccccatctctactaaaaatacaaaaattagctgggtgtagtggtgggcgcctgtaatcccagctactcgggaggctgaggcaggagaatcatttgaaccggggaggcggaggttgcagtgagccgagatctcatcactgcactctagcctgggagacagagggagactccgtctcaaaaaaaaaaaaaagtaaaattacagggtggcttgcattttatttctgttggagagcaccactttagaaagagacagtgagcagggagatccttatatccttataggaaataggaagaggagccattgcagaaataaattctgtgatcccagacaaagtgctggcaccatctcccgggtttgagaacacaccgcagagatacagaacagcgcagattgctgttgaggtcagctcccagctccctgcctcattcctctctgattcctcttttgttcaggcacaaaaacactccatcctgaaacttttgtcattattgccttggtagaagaagaccacagttgttacctgggttttgatttggggacaacagcatttcaatgactaggagatttcaggagaagctagtggccatgaagattctcaaaatcagcatgaactttatttttcactggtgttctttcaaagtttgccttcgactcaacgtgtggtagaaattcaccctgaaagcatttgctcttctctggttttgtgtcttttcctccagaacagcgttgttttttgcatgttttgcacttagccagaggaagtctggcgcatccgagccggccagccgagcacatctggaagtggtttctggggccgcccctctctgccagcgcaactcctgggttcccagcggcttcgcgcagaggtggaagaaacccgagacgttccgaagtcaacgcaagcaaaggggagtgcgggtcggggaggaatattcttttggaaacgtaatattggccttggggctctccagccctttgggacttccaatgggatcttagaagcagccgaagcagcgtgagggcggcagcccagggccagccacgatttgaacgctctgccttgcagctcttctggaccgaggagcccaaagccctaccctcaccattcaccaggtaaatagagaaatttacgagcagtgtgcagtcgttccgttttatcctggccggtctgcagcagttctttattctgctacagacccaagaaagtaaatcagaggtgtcagattgccccacacaaactttgccttcagaaacttcccagtccgaactggtagcattccagcggaacccttttcggccatttccagcaaatccagtgtgcaatgtttttcacatcctgggctgcttttccagacctgggtttctcctccttctctccacaaatatgataatttactatttgtatcagattttaaacataaaaatcagcagttaggatgtggatgaatgctattatttaatgaaggtatgtcctgagccacaaattatttaactgagcatgattcatgttttcagaatctgccttaggaagctgttctgaggatctccatccccccagaaagaactggccgttgtggaaacccaagtgaggcttattgtaaatacagtagtcgtggtgtttgggttgaaaatgctttttaaacattaaaaaagatcttatgtttactttataagcaagtgtcacacattggacaagcctggtatataatttatgaaataagaaggatagttaacatgagagtaaaaaaaaaaaaacctgagagagagtgagagaaagaaaacatgatgatatctgaatgtctggatgtgctttgaaaaaaaaaatcagtcctctcgttgtttggcccctgtgcagccaaatatccaaagtgatattggttggtttttgtcttttccttttcctccaaatgttctggtgtggcacttctgtgtaatatcctttctatattacataatggaattccagttctccctttaatgcacttggaagtagactgtgcaatgcagtggtaagaacataggctctggggtcaggcttacaggactgaatctacatgctgccacttacacaccttctaagctcgactccgggtgaattgtttaactgcatgcaccctagttcctcatctgtaaaatggaaattacatgacctaatgtctatagaggacataatacaggacctgcaaagtagttaggcctcaggaaaggttagcttctctgatggtgctgatgatggcagtggtgacaaaagtgatcatgcatcctgtttttggcaacacctctgcttttgaccatggttccctctgacagtccagtggtccaagtgttcctcataccctaatatgtcatctctccagcactttgctttcttcctttcttccttcagacacctctctttcttttatttcccattctgtctttcattatttcttctttgtgcttcctctttccttgctgagaaaatgtgaggttcattaaggcacagccctcatagttttcatttctagttcccgaggaaaatgattctaaatcctttttaatttcagcattttccaaagaaagttctgagaaaacatagtcccatgggaaactctgtgaactatattaccctcttagagatcgcaaggcataatagcattttaaaggtcctgagaagtcctgtagtagagaaatcctcttaaggttgtttaacgcaatgattcccaaacagttgatcgctgaaccaccttatcacataatgtaggttaacatttctaggagcacactctgcggtgtgctattctggacacacttgttttcattttggttcctcttttggacatcctattctccaccttccctggagctcatccaaggggatgccttgtttttccttctcaagttaaggacataagattatcatgtgtgttgtactggtatatagaaaatctggcctaaattggagatcagaagtcagcaaactttttctgcaacgggcctgataataagccatatggtttctgttgcaactgttcaactctgctgttgcagtattaaaacagcagagaaacaaaaaataagcatggctacgttctaacaaaactttatttacaaaaactagtgtcaggcaggatttgaccaggggtcatagtttgctgacccctactctaaaggctttttgtgaaagaatttctcatgctagcacaggagaaagcaagacaaattctctataaactgaagactctcttgtcctgcacccctagtgctatggtctgaaggtttgtgtccccccaaaattcatatgttgaaactctaacccccaaggtgatgctactagaaagtggggccttttgggaggtggttgggtcatgagggcagcaccatcaccaatgggattagtgcccttgtaaaataggcctaagaggctgggcacagcggctcacacctgtaatcccagcactttgggaggctgaggcaggtggatcacttgaggtcgggagtttgagaccagactgaccaacatggagaaaccccgtccctactgaaaatacaaaaaattagccaggcgtggtggtgcatgcctgtaatcccagctatttggaaggctgagataggagaatcacttgaacccaggaggtggaggttgtggtgagctgagattgcaccattgcactccagcctgggcaacgagagcgaaactccatctcaaaaaaaaaaaaaaaaggcctaagagagctggttcaccccttccaccatggaggacacagctagaacgtgctatctatgagccagaaagtaggcccccaccaggcactgaatctgccagcaccttgatcttgggcttctcagcttccagaactataagaaataaagttttgttgtttagaagccacccagttcaggctggcatggtggctcatgcctgtaatcacagcactttgggagggtaaggtgggaggatctcttgaggcccagagttctaaaccagactaggcaacatagcaagactctgtctctacaaaaaaaatttttaattagctggatgtggtggtggtgcatgcctattgtcccagctatttgggagactgaggtgagaggacagcttgagcccaggaattcgaggctatagtaagctacgatcatgccaccacactccagcctaggtgatagagtaagaccctgtcaaaaaaaaaaatggagtaagacacctgttctatgtatcttggtgaatcttgagtaaacctttcattatagcaaaaagttaaaaggcaagagatattttgttagaggacagactcctgagtcctgatcttgtcctttctctttcctttagtgaattcttactcttgtcctgttaatgactttgtagcttgcatagcttaaaatgaagtgctctgttaaatgtgtctatgcatttgagaacttcagggtgcaagtcttgcagagttaactcacagagcttatgtcagttgcttgacacagtgatagcaaccatagcgatggaaagtggttggctgtagtaactatcaaggtggttaagaatgtgaactcagagccaggatgcctgcgtgtaaatattagctctgccacttattagttgtgtgacccttagcagacctcttaattctctgagcctcagttttctcacctgtgtattggaataataactttaaggagttgttgtgataatccgtgaatgaatatttgtaaaagtcgtagaacaatgcctagcacatagaattgctacgtaagtgttaaaataataatagttaatacttatgtagcaatagctttgtaatatgcagaactatcccgttttacacatagggttttgtaagtcaccccatgattacacagctaattaggattcacagtcagctctgtctaaggataaagcccatatttccactaacctacacagctctcatatttaagtcattcaacagtacttttaggaaccccctcttttatcttgctttttgattcccagtcatttcctattactccctaccatactataaccatggcagacatgattaatcaatcactttctttctttctttctttcttattttctttctttctttctttttctttctttctttctttctttctttctttctttctttctttcttatctttcttttcttttcttttttaactgaatctagtgatggcttcagatttcttctcaatctagcaatcccaacagcccataccatagccaatcagagctggcatgtaaaatgaaacacaggggcactgatttttggagtatttttctgaagagcctttcccactttgctttttgttccaaggcagagcaaattcccttagccactgccaggtctcaaaacattctttccaggtttggccacatgcctaaactctttggcatctggtaaaatggctccccatgcaaggtcttcaggggcttatttttaaacttacaggcctcttctcatgcccagaacaactctctgtactctccttttcttcctactcacaggccctagaacctcaaccttcttttctcccctctttgaagatgctactgcccagtgccttgcctgccctgcagtggctcccagctccacctctctgtctgtcctgaagacaggcctgcaggcaatttcttgttaaaggcttggctatttattaccacagagaaaccacacacacggaagtcactagggctaggaaagctcacagaggtgtaaggggcacagttctggggctctttgttgtgacagtagcaggaaggctgatgagatgaccagagccctctgcttttattcctggagtgggatcatcagcagttcccctccttctggctgagtcctttctttctggggctgaagagcagagcaacaagagcctctcgccttttctttctctctcctgattctcattgattcaacacacatttattgagttcccaccttggggcaggacaggcagatggaagtgaggaagccacagtcgctgtcctcagtggtctgtctggtccttcttttaaagatagatatgctgaaatatttagggggagaagtgtcatgatgtttacaacttccaaaaatatatatgtacatatgaagttcaattaagtaaatatgtcaacatgttagcaactggtggatctggtgaaaggtatatgagtatttattcttcagacttttcagcggtcttgaaatgtttcaagcgaaaaaaagaaaaaggaaatcaaacaaaaaattaaggctactcaagctgcatttgtgtttcaaatgaacttgatatgattatcgaacaacaaaaaagttactatggccgttaggccagtgatggattgaggaagggcagtgtacagaaattctaaaggcaggaaggccaggtgggaggttattgcagaggtgtaattagtaggactcggtgattgaaggaggaattaggagggagaagttgaagaggaatctgagaaccccagagaaggagtttctgtaggggaggtgctaatttcagttgtgaatgtaggggctttgagatacttgtgcagcaccctgaggagacagttgcacattcatccctttggtccataaatgttttctgagggcttatattgccaggcacttgtctagatgctgggtgtatggcaatgaatgaaacaaaatttcctgccttcatggggcttatagtctgtcatttggatggcagccagtacaccggtgatgacgaggcagtctgttggaagatggtaattgctgaggggatgcaatttgtgcattgttggggttagaggcttttgactaagagactgagagacatgagggggcaagccatgtagatatctgggaagaggattccaggcagcaggaatagcacgtggccaaggctctgaggcaggaggctgtctggcaaggaggccggtgtgatcacgcgataccttatggaaggatgctgtaatgactttggtttttgctctgagagagacaggaaggccttggaaggttttgaacagagcacagcacaatgcgactcctattttcacaggttcattctggctgctttgttgaaaatcagctgaagggagacaaaggcagaataatatagtcaaaggctaatgtgccagggtggagccacagaaggtggtaaaaattctggatctattttgaaagtggaactgacaagatttgctgtcagtgcacatgggaataaggaacagagaggggttaaggaaacaccaagctgatttttttgtggagcaatttaaaaaacggagtcacagccgggcacagtggctcacacctgtaatcccagcactttgggagaccaaggtgagtggatcacctgaggtcaggagttcaagaacagcctggccagcatggcgaaactgcctctctactaaaaatacaaaaactagctgggcgtggtggtgcacacatgtaatcccagctactagggaggctgaggcaggagaattgctctaacccaggaggcggaggttgcagtgagccaagattgtgccactgcattccagcttgagagacagaacaaaactccatctcaaaaataaaaataaaaactaaatggagtcacccgaactgatttggggaagattatgggaagggcatgtttcgggggaaataccagaagctcagttttggacacgtggattactataagtgcagatgccaaatggcatctggagtctggaatccatgtgagatggctggcctggagatagaaatttgggagttttcagcatataaattatatttaaagccatgagtcaggatgaagtctcctaaggagggagtttagagaaagaagagaagaaatcgctaaggtgttccaacatttagatattcaggaggtaggagcaaccagtgaaagagactgagaatgagccatcagaaaggtggaggaaaagcaggtgagccgagtcccccgggccacgtgcaggaagcatgtaaggaggagagagcgggcacatagtctgcatctcacgcacccatgcctcaaccctagtgaggaacaagtcctgtggtgcagttctttgcatgccgggaccttgttagccagaagatgttctctcagactctgccccattccagtttctcttggttccagatctctgccttttactctacctcaagcttgtccaacccgtagcccacaggccacaggcagtgctggacagctttggatgcagcccaacacaaattcatcaactttcttaaaacataatgagatttttgtgtgtgtgtgattttttttgtttagctcatcagctatgtttcatgttagtgtattttatgtgtggcccaagacaattcttctttcagtgtggtccagggaagccagaagataggacaccccaccctacacattcttaagctgtccagcatcacttccttggttctccagttctctatccctgacttcctatcagttttctacctctttataactctgatccctctcttaattccccacaatcagcttatccccaggacttcagttctgcaaaaatttcttgagaacctacttaatctactggaatgtctttgacttcaaataccagaaacactgatttacggcagcttaaacacatgggttgattctgtcacataagaagtttggaggaggtaggtattgatggcattgattcagcagttcgatgacataagagctgaccattctgtgtagctcttgacctctccctcatggtctcaaggtggctgcctagctccagccattatggccccatgcaaggcaggaggaagggggagttgacacttcatccagaaaggaaaagctttctcagatattcccagtagatttccacttaagtctctgtgcatcagatctatattatgtggctactactagctgcaaagaaggctggtaaaatctttatttggattttcctctctctcatatggaaacaggcaaaggagaaaaggatgggaagagctgttggatcagccagctatcaaggctgccacactaccaagtgccaaatgcttgccatgaactggaaatacagaaatgattaacgtagtacccgtcctgtccctggagcttgcgttctagtaaggaaacataagaatgaacggagtatcttggtttggtttggtggagaccaggagccttccctgacccccatgatctggtcaggtgcccctccttgatgctaaaacaatatcccatgcttacatctaccaaggcatctaagcacactgtattgccattatatatttactggtgtcttcccctcccttcccccaaatgtggactaactggggacttatctttgaatctctagtgcctgggtgcctggtatattcgtagaggttgagtaaatgtttgttgaatgaatcaaagaaatgtcaagggaaccccctaattaccttcttgtcctgggttgggcccttatcccatcttagctttgttgttgttgctgttgttgttgagaaagagccttgctttgtcacccaggctggagtgcagtggtgcgatctgtgtttactgcaacctccgcctccctggttcaagcaattcccctgtctcagcctcccaaggagctgggatcacaggtgcgtgccaccacatccaactaattttttcttttttgagacagagtctctttctgtcgcccaggctggagtgcaatggtgcgatcttggccgactgcaacctctgtctcgcaggttcaagcgattctcctacctcagcctcctgactagctgggattacaggcgcctgtcaccacgcccagctaatttttgtatttttagtagagacagcgttttaccatgttggccaggctggtctcgaactcctgaccccagatgatccacccacctcagcctcccaaagtgctgggattacaggggtgagccaccacgcctggccccacacccagctaatttttgtatttttagtagagacggggtttcaccatgttggccaggctggtctcgaactcctgacctcaagtgatctgcccacctaggcctcccaaggtgctgggattacaggcgtgagccaccgtgcccagccccttagcatttttagctagttaactcatatttacattctaatagcaaaatctctaacaccttgccagaaaacagtgctgactccccaatcacttttgtaatgttaaaaataaatttatttattctcacattcagtagaactctgaacttacaaatttacacccagtaaagtcacaacacagcatctaaaaagctaaaagtacctatatactcgagtctcatagtacttagaaaatgggatgcttaatttttcaatttgttaggctgggcgtggtggctcacgcctgtaatcccagcactttgggaggctgaggcgggtggatcacgaggtcaggagttcaagaccagcctggccaagatgctgaaaccccatctctactaaatatgcaaaaattagttgggcatggtggcacgcgtctgtaatcccagctactttggaggctgaggcaggagaatcgcgtaaacccgggtgccagaggttacagtgagccaagatcaagcgactgcactccagcctgggcgacagaacaagacttcgtcccaaaagaaaaaaaacatttttttttcaatttgttgttttttatttcaaagagatgtatagttaatctgactcatttgaataacagtgagtgaattgcagatactgttatcaaagatagcaattctacaggcataaataatttttttattattatactttaagttctagggtacatgtgcacaacgtgcaggtttgttacataggtatacatgggccatgttagtttgctgcacccattaacttgtcatttacattagctatttctcttaatgctatccctccccctgctcccaccccatgacaggccctggtgtctgatgttccctgtcctatgtcctagtgttcttattgtttaattcccacccatgagtgagagaacatgcagtgtttggttttctgtccttgtgatagtttgctcagaatgatgatttccagcttcatccatgtccctgcaaaggatgtgagctcaccttttttatggctgcatagtattccatggtgtatatgtgccacattttcttaattcagtctatcattgatggacatttgggttggttccaagtctttgctattgtgaatagtgcagcaataaacatacgtgtgcatgtgtctttaaagcagcatgatttataatcctttgggtatatacccagtaataggatggctgggtcaaatggtatttctagttctagatccttgaggcatcaccacactgtcttccacaatggttgaaccagtttacactcccaccaacagtgttaaagcattcctatttctccacatcctctccagcatctgttgtttcctgactttttaatgatcgccattctaactggtgtgagatggtatctcattgtggttttgatttgcatttctctgatggccagtgacgatgagcattttttcatgtgtctgttggctgcataaatgtcttcttttgagaagtgtctgttcatatccttcgcccactttttgatggggttgtttgtttttttcttgtaaatttgtttaagttctttgtagattctggatatcagccctttgtcagatgggtagattgcaaaaattttctcccattgtgtaggttgcctattcactctgatggtagtttcttttgctgtgcagaagctctttagtttaattagatcccatttgtgtattttggcttttgttgccattgcttttggtgtttcagacatgaagtccttgcccatgcctatgtcctgaatggtattgcctaggttttcttctagagtttttatggttttaggtctaacatttaagtctttaatccatcttgaattaatttttgtataaggtgtaaggaagggatccagtttcagctttctatgtatggctagccagttttcccatcaccatttaataaatagggaatcctttccctatttcttgtttttgtcagatttgtcaaatatcagattattgtagatgtgtggtgatatttctgaggcctctgttctgttgcattggtctgtatctctgttttggcatcagtaccatgctattttggttactgtagccttttagtatagtttgaagtcaggtagcgtgatgcctccagctttgttcttttggcttaggattgtcttggcgatgtgggctcttttttgattcatatgaactttaaagtatttttttccaattctgtgaagaaagtcattggtagcttgatggggatggcattgaatctataagttaccttgggcagtatggccattttcacgatattaattcttcctattcacgaacatggaatgttcttccatttgtttgtgtcctcttttatttcgttgagcagtggtttgtagttctccttgaagagatccttcacatcccttgtaagttggattcctaggtattttattctctttgaagcaattgtgaatgggagttcactcatgatttggctctctgtttgtctgttattggtgtataggaatgcttgtgatttttgcacattgattttgtatcctgagactttgctgaagttgcttatcagcttaaggagattatgggctgagacgatggggttttctaaatgcacaatcatgtcatctgcaaacagggacagtttgacttcctcttttcctaaatgaataccctttatttctttctcctgcctgattgccctggccagaacttccaacactatgttgaataggagtggtgagagagggcatccctgtcttgtgccagttttcaaagggaatgctttcagtttttgcccattcagtatgatattggctgtgggtttgtcataaatagctcttattattttgagacacgttccatcagtacctagtttattgagagtttttagcatgaaaggctgttgaattttgtggaaggccttttctgcatctattgaaataatcatgtggtttttgttgttggttctgtttatgtgatggattacgtttattgatttgcatgtgttgaaccagccttgtatcccagggatgaggccaacttgatcgtggtggataagctttttgatgtgctgctggattcagtttgccagtattttattgaggatttcgcactgatgttcataagggatattggtctaaaattctctttttgtgctgtgtctctgccagactttggtatcaggatgatgctggcctcataaaatgagttagggaggattccctcttcctctattgattggaatagtttcagaaggaatggtaccagctcctttttgtacttctggtagaatttggctgtgaatccatctggtcctggacattttttggttggtagactattaattattgcctcaatttcagagcctgttattggtctattcagagattcaacttcttcctggtatagtcttgggagggtgtatgcatccaggaatttatccatttcttctatattttctagtttatttgcatagaggtgttcatagtattctctgatggtactatcggtggtgatatctcctttgtcattttttattgcgtctgtttgattcttctcccttttcttctttattattcttgctagcagtctattttgttgaccttttcaaaaaaccagctcctggattcattgattttttgaagggttttttgtgtctctatctccttcagttctgctctgatcttagttatttcttgccttctgttagcttttgaatgtgtttgctcttgcttctctagttattttaattgtgatgttagggtgtcgattttagatctttcctgttttctcttgtgggcatttagtgctataaatttccctctacacactgctttaaatgtgtcccagagattctggtatgttgtgtctttgttctcattggtttcaaagaacatctttatttctgccttcatttcgctatttacccagtagtccttcaggagcaggttgttcggtttccatgtagttgtgcggttttgagtgagtttcttaatcctgagttctaatttgattgcaatgtggtctgagagacagtttgttgtgatttctgttcttttacatttgctgaagagtgttttacttccaactctgtggtcagttttggaataagtgcagtgtggtgctgagaaaaatgtatattctgttgatttgtggtggagagttctgtagatgtctattgaggtccacttggtgcagagctgagctcaagtcttggatattcttgttaaccttctgtctcattgatttgtctaatattgacagtggggtgttaaagtctcccattattattgtgtgggagtctaagtctctttgtaggtctctaaggacttgctttatgaatctgggtgctcctgtattgggtgcatatatacttaggaaagttagctcttcttgttgaattgatccctttaccatgacgtaatggccttctttgtctgttttgatctttgttggtttaaaatctgttttatccgagactaggattgcagcccctgctttttttttgctttccatttgcttggtagatcttcctccatccctttattttgagcctgtatgtgtctctgcacatgagatgggtctcctgaatacagcacactgatgggtcttgactctttatccaatttgccagtctgtgtcttttaattgggacatatagtccatttacatttaaggttaatattgttatgtgtgaatttgatcctgtcattatgatgttagttggttattttgcccattagttgatgcagtgttttcctagcatcgatggtctttacaatttggcatgtttttgcagtggttgatactggtttttcctttccatgtttagtgctcccttcaggagctcttgtaaggcaagcctggtggtgacaaaatctctcagcatctgcttgtctgtaaaggattttatttctccttcacttagtttggctggatatgaaattcttggttgaaaattcttttctttaagaatgttgaatattgccccccactctcttctagcttgtagagtttctgctgagagatctgctgttagtctgatgggcttccctttgtgggtaacctgacctttctttgtggctgcccttaacattttttccttcatttcaaccttggtgaatctgacaattatatatcttggggttgctcctctcgaggaatatctttgcggtgctctctgtatttcctgaatttgaatgttggcctgccttgctaggttggggaagttctcctggataatatcctgaagagtgttttccaacttgattctattctccccgtcactttcaggtacaccaatcaaatgtagatttggtcttttcacatagtcccatatttcttgtaggttttgttcatttctttttactcttttttcttttaacttctcttctcactttatttcattaatttgatctccaattgctgataccctttcttccacctgatcgaattggctattgaagcttgtgcatgcatcacatagttctcgtgccatggttttcagctccatcaggtcatttaaggtcctctgtacactgtttgttctagtttgccatttgtataatcttttttcaaggtttttagcttccttataatgggttcaaacatcctcctgtagcttggagaagtttgttattaccaaccttctgaagcctacttctgtcagctcgtcaaagtcattctccgtccagctttgttccattgctggcgaggagctgtgatcctttggaggagaagaggcgctctggtttttagaattttcagcttttctgctctggtttctccccatctttgtgattttatctacctttggtctttgatgttggtgacctacaactgagattttggtgtggatgtcctttttgttggtgttgatgctattctttattgtttgttagttttccttctaacagtcaggtcccttagctgtaggtctgttggagtttgctggaggtccactccagaccctgtttgcctcggtatcaccagcggaggctgcagaacagcaaatattgcagaacagcaaatattgctgcctgatccttcctctggaagcttcgtcccagaggggcacccacctgtatgatgtatcagttggcccctactgggaggtgtctcccagttaggctacatgggggtcagggacccactgagggaagcagtctgtctgttctcagagctcaaacaccatgctgggagaaccactgctctcttcagagctgtcagacagggatgtttaagtctgcagaagtttctgctgccttttgttcagctatgccctgcccccagaagtggagtctacagaggcagctggctttgcggagctgtggtgggctctgcccagttcaagcttccccacccactttgtttacccactcaaacctcagcaatggtggacgcccttccacctgccaggctgctgcctcgcaggtcgatctcagactgctgcgctagcagtgagcaaggctccatgggcatgggccccaccaagccatgcacaggatgtaatctcctggtgtgctgtttgctaagaccactggaaaagtgcagtatttgggtgggagtgtcccgtttttccaggtaaagtctgtcacagcttcccttggctaggaaagggaaatcccccgaccctttgggcttctcaggtgaggcaatgccctgccctgcttcggctcaccctctgtgggctgcacccactgtccaaccagtcccaatgagatgaacgaggtacctcagttggaaatgcagaaatcacccatcttctgcatcaatcacgctgggagctgcagaccagagctgttcctattcagccatcttggaatggaatccaggcatacataatttttaaggaagtaagcatgttcttgtaaatattgtctgaataattaaaatgacataaagttattgataagaacattttatcaaatattagttctcaaataagagttttttgtttgctttcttcagctttattgaggtataattaacaaataaaaaatgtatatattcagccaaccctggtagctcaagcctgtaatctcagtgctttgggagaccaaggtgggaggattgatagaacccaggagctcaaggttacaatgagctatgattgcactactacactccagcctgggtgacaatcctgtctctgaaaaaaaatatatacatatatatatatatatatacacacacacacacatatatacacacacacacacatatatatatattttcaaggagtacaatgttttaatatacacattgtgaaatgattaccacaatcaagctaattaacaaatccatcaccctcacgtagttgccttttgcgtatgtgcagtgagaactcttaagatctaccctcttagtagatttcaagtatacaatacattattagtaataacagtcaccatgctgtgcattaggtctccagaacttgctcatcttataacggcaagcttgtaccctttgaccgacatttccccatttccccacctctctgtccctggtaaccacccttctactctctgtttctgtaagttcaactttgtagatttctcatataagtgaacatgctgtattcatttttctttacctggcttatttcacttagcataatgtcctccaggctcacccatattgtcacaaatggcatgattttcttcttttctaaggtgaaataatattttattttgtgcatatatatgtctacatacacacacatactcatatatataccacatttctttatccactcatccatttatggacacaggttaattccatatcttggctattctgaatagtgctgcgggctgggtgcggtggctcacacctgtaatcccagcactttgggaggctgaggtgggcagatcacctgaggtcaggagttggagaccagcctggccaacatggtgaaaccctgtctctactaaaaatatacaaaaattagccgggcatggtgatgtgcacctgtatttctagctacttgggaggctgaggcaggagaatcgcttgaaccccggaagcggaggttgcagtgagccaagattgtgccactgcattccagcccaggtgacgatataacgaatcactgtctcaaaaaaaaaaaaaaatagtgctgcaatgaacctgagagtgtagatctagctttgatactgattttctttcctttggatatataccctaaagtaggatagctgcatcatatggtagctctattttgaattttttgagagacctccatattgttttccataatggctgttccaaattacattcccactagcaatgtacaagggttcccttttctctgcatcatcaccaacacttgttatcttttgactttttgataatagccattctaacagatgtgaagtgatatcctattgtggtttggatttgaatatccctgattattagtgatgtttagtatcttttcatatacctcttggccatttgtgtgctttctttagagaaatgtctattctggtcctttgcctatttttttttttttttttttttttttgctattgcacatcactcctttattatactgatatggaaaaaggatttagtacagttatgctcagatgaacactggacccatgtggcagggtcaagcaactagaacatgattcagaaatcagtgaaagatacacttggacaggaccaagaggcatttcactgccatgaaacaaggcaggaagggattctaatacacaaaccaggaagcactcctgcccctcagaggtcaaggagctgatcctatattggtatgaggaatggcttattttctgatgaccacatgtgggactatttcaaccgccacaagaaaccccagaagggttattgttttgtattatttatatatactatacttttttaataaaagtaaattaacacataacgaaattcaggattgatcccaacctagagccagatcctctggggtcagggaggaaacagttgtcacatcaccacgcaggttacattcgtcttccactggaatgactagagcccccaggcagtaggcagtgacctgactgcagaagagcagaggacagactccgctcatggggacagacaggctctgttgcttctcctcactggtcatggcttagcatggttcctccccaaagtccttagtaaacaaagcactcgcaaaaacccaagtcactacttttaaactctgttggataaggggagcttttccatagcttagactgagaacctgtgctctagaactgctattctgactagattgtatgaagggagtgggtgcaggcgacaaaatggctaaaatgaaaatgggagccactggtccccatctgcagctacaactcaagatgtctacagatgtggtcagtgtgacatgtgcaggtgggaggggcagagggacaagatgggcagggagggtgctcctggggacagtatcttccccgccggccttcacttcttggccttgccctgggcagccacagcttccatggctttgcgcaccgtctcctcatcccccagaaactgcatgggcttgataggcttcaagttcttgtccaattcatagacaatgggaataccagtcggcaggttcagctccatgatagcctcttcagagagaccctccagatgcttgacaatgccccggaggctgttgccatgggctgcaatcagtacacgtttcccctccttgatctggggaactatttcttcattccagaagggcagagctctggcaatagtatccttcagactctcacaggagggtagctgatcttctgtgaggtctgcatacctgcgatccttactgatgttgctgtagaaaggatggtcgggctccatcggaggtggtgggacatcataggagcgcctccagatcttcacctgggcctcacaatgctttgcagcagtttctgctttattgagaccggttagacccccatagtgccgctcattgaggcgccaagtcctcaccactggcagccacatctgatcaatggcatctagcactgtccagagggtccggatcgctctcttctgcactgaggtgaagcagatgtcaaactcatagccagcatctcgtagcgcctgcccgccgcgcttcgcctcctcgtggcccgccgggctcaggtcggcgtcgtaccagccgctgaagcggttctccaggttccatgcgctctcgccgtgccggatcagcaccagtttgtaggcggccatggcggcgggctggggatgcggcaccgactgggattagcagattccggagtcctttgcctatttttaaatcaagttatttgtttttttgctattgagttgtatgagtttcttatatattttggatattaacttcttatcaggtatatggtttgtaaataatcgctcccattccacaggttgcttttttattttattgattgctcctttgcagtgcagaaactttttagtttgatgtagtcccacttgtttgtttttgtttttgttaactgtgcttttggtgtcatattcaaaaaatcattgccaagaccaatgccacagagctttccccctgttttcttctagttttacagtttcacatcttacacatttaattatgttattattaaattaataaataataaaaatgaataattacttatttaatatgtaattcattttgagctggttttgtgtatgataaagatccaatttttttgttgttaatatccagttttcccagcaccacttactaaagagactatcctttccccattgtgtattctttgtgccttatggaagaatagttgaccatatatgcgtggatttatttctgggccctctattctgtcccattggtctatgttccattgatctatgtgtctgtttttatgtcagtaccatactttttggattactataactttgtaaatataatttaaaattaggaaatgtgatgccttcagttttgttcctgctcaaaattgcttcagttatttgggggcttttgcggttccatatgcattttaggattttttttttctatttttgtgaaaaatgtcattggaattttgaaagggactacattaaatctgtagattgctttgggtgttatagacattttgacaatgttgattctttcaacccccatcacttttttgagggcataactatataaagttctagaatgttagatctaatagaattgtctgcttcagtcataataatgaggaaactgagacggagagagatggagttatttccctagaatcacacgatcataatggcttgtataagtggggttccaactgtttgccaagtactgttgtaagtacttaatgcatgtaaatgtattactgcatttaatcctcataaagccttatattaccttcatttcctcaactttttatttagaaattgttttaatttatagaaaagttgcaagaagagtataatggctcaaccaatttagccacattagcattgtctcagtacctctcactctctctctttctacacacaaacaaccctgaacctcttgacctttcacccctaaattaatgtatgtgtctcctactatcaatgatatactcctacataaccataccacatttattctctcaggaaatttaacattaatgccataatatttccccaatttcccaaaaataaactttgtagctctttttaaacatttggttcaggatgcagtcaaggtttacacttttttttttgagatggagtctcactctgtcaccaggctggagtacagtggtgcaatctcggctcactgcaacctcagccttccaggttcaagcgattctcctgcctcagcctccgaagtagctgggactacaggtgcacgccaccatgcccagctaatttttgtgtttttagtagagatggtgtttcactatgttggccaggatggtctcgatctcttgacctcatgatccacctgcctcagcctcccaaagtgctgggattacaggcgtgagccactgagcccagccaaggttcacactttccatttcattgttacattatcaagcttatagagttcccaacgtggtttttttttttcctttcatgatattgacatatttgaagagaccagggcagttcgtcttcagaatgatccatgatttggatttgaccatgacgttatccatgatagaatcaggttaaatatcactggcaggaacatattgatatttgtcacacctcaaggcacaggatttcaatttgtttcattttgttgatcttaagtgtgattactttgagaatgtgaattttctgtaccccaacaacattttaccccctatcactttagcattcattgaggttttttgcctgaattacttattaacatgttgattgtaaaatggtattacagacattttataagtgaggaatcttaagtttccaagggaaggggttcttatatggttcttatacattgtgcagctaggatttgaacccaggtggtctgactccaaggcccacagtttaatacactaattgtactggaaaaggatttccacatgattttccacttgactttagtgccctcagtcagaaactgtgtcttgtccacttgggatttttttgttttttgaaacccaggaagtgccaccatcagagatgagatgaaattgtaaaaaggaaggataggatgaaattcaggcatgccaaatctttatgcaattatacacacacacacacgcacatgcacacacacacatcattttttaaagcaaactttctgttgaaactgcatgcttctcaaggacaccactcctgccatatggcttaaggtttcctacaataatcagcttcgggaacttaccttcttggctcattactgctgtgccttgcaattggcatgcgattatctgcatcctaaagcttcttgtttcatcttaaagagatttcagagttggcaacacactggacggggaaagatgaaccccctgttcagatgaatcagcatttactattcctctgcctctggagtggtctcatagttacagtaaccgagcactcaggaaagagctgaccagcattgcctgtgagctgtaaagcttcatcaacacacggtgaaatctgttatctggaccccaattctcctaacctctggtgtagccgcaagggccctttgagagctcagcactttgtggttaagggctttgaagtcagagagctctaatttttaatcccagccccatcatttacaagatttatgattttgagcaagttactgaacctctccgagccacaatgtcctcatttgaaaaatggagatagtaatacatccacttgaaaggtgttagaattaaaggagataatgtacctaaatagcctggagctgcgtgcaaattaaattcgcaataaatgatagctatgattattatctgacccctacaaactgctccccatattcacacaccattctggccacagcaaatttatttgtaaagacttttgtttgtaagaaactgaacctcatttcaaaacagtttaaggaaaaattgtgaagttactggttttcataactaggatgtccaggaagtggatggcctgagggacttagagctcagcttccttctggtctttgccccgttctctcctgtgataccagatggcttctttcatggagtgggaggaggagccacatggccaaagaccattctaggcttccatcatccccgaaagttagatgcatacatatcacctaaaatcctaaatggataaaaggtacctgaaaccctatctcagaaaaatcctaagtagtgtgctgttttgacccatttcttttccaggtgcaaaaggggaagaggagaagggtcattgccatgcactcaaagctcttgggtgttcagtctatagcccgggaaaataaaaggaacattgtagctggttgtttacagtgaattaaagagttgaatcaaatctctgttgaagagttttcctagatgactgccagcaaattctcataacactttggttcatgaaactgtggggacctatgatatccttcctttctcaattacctcctcgggctatctctgtcatgttgttagtttctaaaggttattattcctggtttgcagtctgcagcctcccgtcaaatgtcaagttcagaagttccttttaaagaccatagttaagaaggatcaacttaattttaaaacaaactttgagttttcaagacaaattgtttttcatggcaaattaactttttttgtgtgagatagaggaagtcagttgccaactcctggggtaattggcaaaatgtcacaaacaagtgaatgaccataaaaatgtgacaatatttaactttagattttacagtaaaatgaatgttgtcatctaaaatccttatctaatggttaaattttattttttcatcaaacctgtcctatcctatgctttgcttaatgcctaccacttctcctaatgaatatccaaggtattgtattaagcatatagatagatacattgtaaattgggaaaaccgggaaacaaagtcttaacaggtatatttcgagaatagagggagggtgtcttagccttcttgatttcagagcacaaataaaatactccagaatataaagcaaagatcgaattagaatttggggaaatgtttggttgaaagtttttcatggtagatcaacccttttcttgcctgcttggtcctgatagtactctgagaacattattgaattttttttttttttttttgagacagagtcttgctctgtcgcccaagctggagggcagtggtgtgatctcggctcactgcaacccccttctcgcaggttcaagtgattcttgtgcctcagcctcccgagtagctgagattacaggtgtggcccaccacgtccagccaatttttgaatttttagtagagatggggtttcaccatattgtccaggctggtcttgcattcctggcctgaagtgatccgccagcctcagcctcccaaagtgctggaattacagttgtgagccaccatacctggccacattattgaatctttatttgatgatgtagctcactttttagtcactgatgactaatcatatctgtaattcttcctgtagaaagtataggagataataaaaaacctgtgtggatcacttgctcccttctttgggacacatgtcatcctctaggttcaaactccttgccagatttgaagtcccctttgaataccctgaaattggaacaaaatattaaagaaaaaaatcagttccacagaaggaataacaaatggtctcaacaaatggctttctcaacaaatggtcttggaacaactggataaccatatgctaaaagattaagtttaatctacatttcatgatatatacaaaaattaactctgaatgtaaatattaagtccaaaactataaaattctcccagaaaacataggagaaagtcatcatgaccttaggttaggccaaaatttattagatatgataccaaaagcatgatctataaaagaaaaaaaggccaggtgtggtggctgatgcctgtaatcccagcactttgagaagtcaaggcaggcagatcacttgagctcaggagttcaagaccagcctgggcaacatggcaaaaccccatctctacaaaaaatacaaaaattagccaggtgcagtggtgtgcacctgtagtcccagctgcttgggaggctgaggtaggagaatcgtttgagcctgggaggtggaggttgcagtgggccaagattataccactgtacttgagcctgggtgatggagtaaaaccctgtttcaaaaaaaaagaaaaaaataaaatgaatttgacatcatcaaaattaaatacttttgctctgcaaaatttattgttaagagactgaaaagacaagtcacataccaggggaaagtatttgcaaatcgcgtaacacagggcttttttttttttttttttttttgacaaagtctcactctgttgtctaggctggagtgcagtggcacaatctcggctcactgcaacctccacctcccaggttcaggcaattctcctgcctcagcctcccgagtagctgggattgcagacctgcaccaccacgcctggttaatttttgtgttttagtagagaaagggtttcaccatgttggccaggctggtcttacactcctgacatcaagtgatctgccagcctcaacctctcaaagtgctgggattacaggcatgagccacagcactgaggcctaacacaggacttgtatgcggaatatataaacaactcccaaaactcaaaaataagaaaataattctataaaaatgcacaaaagatttaaacagacatttcgccacatgtggatggtaaataaacacacaaaaagatgctcaacgtgagtaatcattagggaaatgcaaattaaaatcacaatgcaattcacccattataacagctaaaataaaaaaaataccggcaataccaagtgctgacaagaacacagagcaactggaactttctcaccatgctagtgggaatacaaaatgaaaatgtttccactcaggaaaaaagattgtcagtttctttctttttcttttccttttttttcagacaaggtctctctctgtcaccggggctggagtgcagtggtgcgaccatggctcactgcagcctcgacctccaggctcaaacaatcctcccacctcagcctcctgaatagctgggaccacaggtgcccaccaccatgtctggctaaatttttttctctaactccccacatttgttttttgagggtttttttgtttgttttgttttgctttcatacagacaggggtctcactatgttgccagggctggtctcgaactcctgagctcaagtggtcctcccatcttggcttcccaaagtgcagggattataggcatgagccacggcagccagcctagattggcaatttcttatagagttaaatatatatctacccaaaagacccagcaataccacttctaggtagttaccctctattcacacaaaaacctgtaaacaagtgtttacagaagtattattcataatcacaaaacaatggaaacaacccaaatgtccttcagtgggtgaatggataaactgtggtatatccattcaacggaataccattcagcaataaaaaggtacaaactattggtaaaggcaatagctagtatgaatctcaaaaacattatgctaattgaaagaagaaagtctcgcaaaatattacatcctgtaggattccatttatatgacattctggaaaagacaaaactacagagacagagaacctatcagtggttgccaagggctgggtgttgggcagggcctgactacaaagtggcggtgcaagggaattctttgagtgttggcattgttctctaccccatttgtggtggtcgttacaagaatctatgcatgtgtaaaagtccatagaactatagaaaaaaaaggaaattctaatgtatgtaaatttttaaaaacttaaaaatcagcttgtcaaattttgaagctgacatggtaatattcctttagtaaatgtgtcatggaaaagaagcctatttaaaatgaaaacagacatactgaatgtttattatacagaaccatttgtgttcccctgggtgaagcactctttctgattcttcaatgcagtctaaagaatttagaaaatactacctaataaaaaagaaatagtatgcatagcaattttttaaaattttattttattttaagttttgggatacatgtgcagaatgtgcaggtttgttacatagttaagtgtgtgccatggtggtttgctgcatctatcaacccatcacctaggtattaagccccacgtgcattagctatttatcctgatgctctccctccccctgatgcatagcaatttttaagaacatcaagaaagaaactcacagtaggaaatacgtgtaaatccagaagactggaaaaaaatttgcttgtcaacatgtatcaaataccttggcagaaaaatagttctcatgggccaattctttatgctctgaagcagcagctggtctcttttgttaaaagaagttgttcttggaatacatctagttaatatgcctcttagaatttgccctgcatttttcttatgcaaaggactttatgtaaaaagttggcctgatagaacatgagaatggttgatgatgtgacagttatagttcttgctgcttagcaaaatataatgcatcgtgtgtgtgtgtgcatgtgtgtgtgtgtgtgcatgtgtgtgtgtgtgtgtgtgtagaatctcctgtgcttacttatatatatgaatagataatacattagtatgatttgacattctgtagatgccaaagctgctatttattagtcagaacactcgtgtggggctgtgccagccatttatagctggtacccattttgattgatcagtgccaagggccatatgagttattaaatatgttcaatataagtcctgtaagactatcaactgaaaaaaatctccctttttctaccagctgacctctatattttctgtaatcttcaacacagagacaaaaaggccttttaatattgggttacttgaagttgggtagaggtgtgtattttaattactttaatcgtgtataacaatgtgaaacaggcatatctcatcgcaaatctgtccctgacagtcctccagcctttcttccagggatctctttctttccatttgtgttcccttctccttgcagtcactctgaaagcctgccctctcctgatatttatctgggaccagataaacatcctactgtgggatgagataaactttctcatcccacagtgaccatcccctggaatattattgctgtgacttggggctacaaaaagacacacgacaaatatggcagctcttctgaaaggagcagtttttctttttttcttttcttttcttctttctttctttctttttttttctttctttctttctttcccttcttcttcttcttcttcttcttcttcttctttttcttcttcttcttcttcttcttcttcttcttcttcttcctcttcctcttcctcttcctcttcttcctcttcttcttcttcttcttcttcttcttcttcttcttcttcttcttcttcttcttcttcttcttcttcttcttcttcttcttcttctttcttcttctccttctccttctccttccttcctttctctctttcttttcttttctttcttctctgtcttctttctttttcttttttaaaacagggttttgctctgtctcccagctggagtgcagcagccatggctcactgcagcctcaacctcctgggctcaagtgatcctccttcctcaacctcccgagtagctgggactacaggcatgcaccatgatgcctgctaatttttgtatttttttgtagagattgttgcagggggggtcttataatgttgcccaggcttgtctccaactcctgggctcaagcatctgcccacctcggcctccaaaagtgagccaccacgcccagtaaaacacttaaaatgtcactttaggtcctgtgggaagagcagcgtggaggtgggctgaggttagaaggtgcagagcgtggaagaagattgtgagctgagtattggacatctgttcttgaatagtccctgggcctgccataggaaaggaagttctccagggtaagtgacttggacttttccttttcctctaataacattttttcttgggctgtggccgaaccttaggattcggttcatcccttattcagaccaggttagcttttccctgctctcacctagccatcccacctaggcacagaagaccttgctttcataacagatagctttctccctgaggggggaactctgccagcagttaaaggagtgattcctttccactacattcttgcacagttcccatgaatttgaaggtaaaacaaaaaacatgaaagatactttgagctcattgtgagcaatgttgagtattcactctcctttaccatcagaattcccttgggaatgtttgaaaaacagtgctttagggctttaacaaagttaaacactgatggagggggtttaatgcacttaaaataaaatccaaactcctcttcaggcacagtagtatccggccccttggtacctctctgacctcttccatccagtctctcctttggtccactatgatccagccagtttgagtttcttgcagttcctagaatacttagagctctttccagccccagggcctttgcacttgctgttccctctgcctgggatgctcctctgcatgttctgcccttgactggctcttgctcttctttccctccaatgccatctcctcaatgaagtttttcctgatttctcctcctgatgcactccctacccttgttcgtctttatcccaacatctcctttgcttccttcatagcacttaccataatctaatacttttatgtgtcacattttaatatctgtttcccccactggaccaaaagcttcaggaggatagggaccagtactgttttgtttttcggtgcatcactgggaagtggcacagtgctgggcttttagtaggatctcaatatgtaaatactgaatgaatgattgaattgagtataatgcatgcccctccaagggattcttgaagatgtaaaatctgccttatcgaggaacgaagttatgatagtagaaagatggcatagggttgatattttagatcagggagatctagtgtgatacttccagtttctgccatctgctctgctgacccagaaggctgacagagctctttttacaagaggttaaaaaaaattctgggctgggcactgtggctcacatctataatcccagcactttgggaggctaagatggatggattgcttgaggctaggagttcgagaccagcctgggcaacatggcaaaaccccatctctactaaaaacaaaaaaaatttagctgggtgtggtggtgcatgcctgtaggtccagctacttgggaggctgaggaaggaagatcgcttgaacctgggagggggagattgcagtgagccaagatcgcaccactgcattccagcctgggtgatggagcgagactctatcaccaaaaaagaaagaaagaacttctgaagacaaaagattagcttttgaggacccttagtaaggtttgttcaaccagaggcattgcttttgaagacatgggctagtatttattttgtttccaaaattttagatttggagcagtaaaaaatgatcacacacttcacgatatatcagtctttcagggaaggcatagtccttaacacttgttgatgagttttaagttgattctcctttaaacagattttttttcctttaatccacaggttacagttcttatccgcgtgaatacacatggctctgttacgaaaaagtaagatttcaacttttgaaaataatgatttaaaaacatatttgggaggatggttttgaggctggggcttggctcttttcttctttcttggattgtgtttgattttcatggatagttttcccacaggcactttttggcatcatcatttccagatgattcccatggagagttgttcagtattttagtcagaagtggacttatcggctgggcgcactggctcacgcctgtaatcctagcactttgggaggctgaggtgggcgggtcagttgagctcgggagttcgagaccagcctgggtaacatggagagaccccatctctacaaaaaatacaaaaattagccaggcatggtggcggacacctgtagtctcagctactcgggaggctgaggcagggggatcacttgagcctgggaggcagaggctgcagtgagctgagattgcaccactgcatgccagcctgggagacagagtgagaccctgtctcaaacacacaaaaaaaaaaaaaaaaaaagaagaagaagtggaagtgaacttacagcagggatcatatatttctataaaacttgcaaaaataatgcattttctcgttcggaataaatattcatgttcatagctaatttagcatttgtaatttgtaattttgcgttcttagtcttaaagagtcatctcgaatcttcatacccatcagaacctggatttgcctctgattttagatccagtagtttgtgaatttgaggagaaacatagtaacctaattctgtgaccctcagggtagagttgccagattcagcaaacaaagactcagaacaggacaaccagttaaatttgaacttcagataaacaacaaataattttttagtataagtatgtcccaaatattgcatgagacatacttgcctgggtaatttttgtatttttagtagagatgggttttcaccatgttagccaggctagtcttgaactcctgacctcaagtgatccacccgcctcagcctcccaaagtgctgggattacaggtgtgaggcactgcgcccggccgtggcaggtgaatattaatcgggcctgttgataaactgtagaattttgtccattttctgtccattttctgcttctctgtagttttgttttaaatggagtctagtatctgattgtccctggctgaatctgataatccattaaggcagggaggaactgggtgtcagcaaaatagaatcacagcctcaggatgtagctttggagggcatccacgaagactcttttacaaatgggaagacaaaggcatagaggccaaaaaatagatgcatatgaagtcaatagattaagtctcttgatgcataaaaataataaaaaataatacaggccaggtgcggtggctcatgcctgtattcccagcactttgggaggccgaggcaggtggattgcttgagtccaggagttcgagaccagccttagcaacatggtgaaaccccgtttctactaaaaaatacaaaaaattagccaggtgtggtgatatgtgtctatagtcccagctacttcggaggctgaggtaggagaatcacctgagcctgcaaggttgaggttacagtgagctgagatcacactgctgcactccagccagggcaactgaggtgagaccctgtctcaaaaaagaaaaaaaaagataaaataataataacaatgatgcataaccatttgtaaagtctttattgggcctgcattgccttggttaactctcaaaacagtagtgcgaggtaatgcttattattacaatcttcattcagcagataagcacaccaagctcagagaggttaagatacccctcggccatacagctaggaggtggtagaaaagagatttgagtctgacttcaaattcacaccctcttcccttctaccaacttttcccaaactttaggtaggtgtgcactacacatgccaacatgccatcttctcaatttttcatcagctgtgttccttctgtcctaaacatttcttaatattttctttaggccaggcacagtggctcatgcctgtaattccagcactttgggagaccaaggtgggaggatcacttgtggtcagaagttcaagatcagcctggccaacatggtgaaaccctgtctctactaaaaatacaaaaattagccaggcatggtggtgggggcctgtaatcccagctactcgggaggctgaggcaggagaatcgcttgaatccaggaggcagaggttgcagtgagccaaggctgtgccattgcactccagcctggacaacaagagtgaaactccatctcaaaaccaattttgttttctttgactaattttaaaaatttataagtgtacttcataatagaaagtttttatccttactgcaaatgaaaacagaatgatttcctatcattaaaaaaaaaaggtagctttaaacacatatacaattaggagaatgtgattcaactctgggtagcttttgttgtgttcctgcacataaaatcagaaagattgactttctcatatgctgattaaatattaatgctatgaacatgaacttcctcagtcatttcatgcacaaccagtgctatatgttccatactcaagaaaacactgttttacaccactctacttctcaacagatctcaagggccaacatcactggaacaaacagagctggaggcttggaggcattgaggtcttctgtttaccagggcaagaatttctttctttcttcctttctttctttctctctttatttttctttctttctttctttctttctttctttctttctttctttctttctttctttcttttctttctctttctttctttccttccttccttccttccttccttccttccttctttctttctttctttctttctttctttctttctttctttctttctttctttctttctttctttctctctccctttctttctttctttcttttctttctctctctctctctttctttctttctttctctccttctttcttttttgacagagtctccctttgtcacccagactggagtgcagtggcatgatctcggctcactgcaacctctgcctcccaggtttaagtgattctcttgcctcaacctcctgaatagctgggactacaggcatgcgcaacacctggctaatttttgtatttttagtagagatggggttttgctatgttggccaggctggtctcaaactcctggcctccagtgatccacctgccttggcctcccaaagtgctgggattacaggtgtgagccaccacacccggcctgcacatcatccttgaccaagggttgaattaactgaaaagcagctgtgtcataatggctaagaacatgtatttataattactactggctcataagaagaatcacataaattcaacaaaataaaagccacatacggcagacccacagctagtatcatactaaatggggaaaaactgaaagcctttcctcttacatctggaacacgacaaggatggctgcgtttcaccactgttattcaacatagtagtggaagccctagctagagcaatcagacaagcaaaaaaaataaagggcatccaaattggaaaggaagaactcaaattatcctgtttgcagatgatacgtttttgttttgttttgttttggaaggaaggtcttgctctattgcccagtggtgtgatcttggctcactgcaacctccacctcccaggttcaagcaattctcatgcctcagcctcccaaatagctgggattacaggcatgcaccatcacgcccagctaatttttgtataatttagtagagatagggtttcaccatattgcccaggctggccttgaactcctggcctcatgtgatctgcccacctcagcctcccaaagtgctgggattacaggtgtgagccactacaactggccaatataatcttatatttggaaaattctaaagactccagcaaaaaactattagaactgatatacaaattcagtaaagatgcaagacccctgagcaacaatagtgttccaggttaattctttctgtttgtttgtttttgtatttgagacagggtctggctctgtcacccaggctggagtaattttggctcactgcagcctccacctcccaggctcaagccatcctcctatctcagcctccttagtagctgagactacaggtgcatgccaccacgcccagctaatttgtgtgtgtgtgtgtgtgtgtgtgtgtgtgtgtgtgtgtgtgtttgttgttgttgagacagggtcccactctgttgcccaggctggtctcgaaactcctgagctcaggtgatccacctgccttggcctcccaaagtactgggattacaggcatgagctaccacacctggccaggttaattctttattctatatgctgtctgcttatagaaaggtctcagataccactcctctgtgtcatggaaggcacctactcgcactaccattctaaactttgtcacgtgatttcaggttcataggttcaatgttaatgtgtttccatttctatttcagttaatcaggtgctgctgttccttctgatcgtgaccctctgtgtgattctgtataagaaagttcataaggggactgtgcccaagaatgacgcaggtgagcagacatggaattcattgagttgggatacccaggaatgtggtttgaatatgttcctctaggtcctttcaatagctgggttcagggacaagtgacagtttggtcaactcccaaggacctgctagtagaatatccgccctagaccaccttttcagtcgtgccctaggatggtcggtgctattcaaactttagcatgtgtgagagtcacatggagagcttgttaaaacacagcactgggcccacccgtgaggtgtaggatcagtaggtatggtgtggggcctcaagacttgcatttccgataagctcctggttgaggctgatgctgtaggttcttggaccacagggtgagtgcactgctccacactccatctctttggagcttctcaatgactttgcttatggaaaccaccctctttctcctctccctgctggttcattcccatcagtgcaagtcagcctcataactctcaacttgaaaatggcccttcattggccctgtggtctctcccagctgcactgagaaccatgtttccctcctcgggggtgaattgcctgagatggcaccttcaaaactccaatgcacacacaaagtcaacctccataaaaatcaggaagcactgtttattacatttttaattaatttacttttttttttgagacagaatctcactctgttgccccagctcaaatacagtggcacaatagcagctccctgcagcctcgacctccagggctcaagcaatcctccggcctcagcaccccaggaagttggaactacaggtgtgtgccaccacgcccagctaattttttgtagaaatgggttttgccatgctgctcaggttcatcttgaactcctgggctcaagctgtcctcctaccttggcctcccaaagtgctgggattacaggcatgagctccatgcccagctaatttactttttatataaatcaagcaaatacacacttacgggctggcgatggtggctcatacttgtaatccagcactttgggaggctgaggcgggaggatcacttgagtccaggtgtttgagaccagcccagcctaggcaacaaagcaagaccccatctgcatgcacacaaaaaattacctgggcatggtggggcatgcctatagtcccagctacttgggagctggaatgagaggatcacttgagcctaggaggtctaagcagcagtgagccctgatagtgccactgcactccagcttggatgacagagtgagactctgaatacagttatttggtgtgttacatacatttattccacagttttgttttttttttcagtcagacacttagggactggaaacacaacagtgaacaaaacaatatccctattcccaggaagctggcatttctttctgattatattttgtaatttaaaaattcatttaaaaataattaaaaacatgtataatctgatctaaatgaacatggaatctgcaaagagaatgattttcatacaaagacatatatacaaatgttcttagggtataattcatagtagccccaaactggaaacaattcacatgtacatcaactcgtgagggatacaaaaaatgtaatttatctcacacaatgaaatacttttcgacagtaaaaaggaacaaatgactgatacaagctgcaatatggatgaacctgaaaaaaaactatgctaaataaaagaagtcagacctgaaagaccatatattgtatgattccatctatatgaaatttctagaaaaggaaaatctatggagacacagagcagatcagtggttgcctagagctgggagtgggaatggactgactgcagaccaggcagctcaatggaactttctaaaattggatcttggtgatggttgtgcaattctataaatttactaaacatcattgtactgtacgcttacaatgggtaaatttttaaaaatctgtattcgtttgcttgggctgccataacaaaatagcacagactaggtggctagaccatagaaatgtattttctctggttctggaggctggaagtccaggatcaaggtgtgagcaggttttgtttctcctgaggcctctctccttggcatgcagatggccgccttcttgctgtgtcctcacgtggccttttctctgtgctgcattcctggctgtgaccctctgtgtgattctcctcttttcctccttttattaggataccagtcttactgggataaggcctaccaaatggcttcattttaacttatttgcctttttaaaggcaattaagtgcatggacatcctgagatgctggaagctaagacgttaacaaacggactctggaggacacaattcagtccatagcagtatctacacctcaataaactgttctaaaagagagagagagagaaggaagtcacataaagacaaatgtcatctgaactgactccactcttcatgcttcaatccctgctcataaaccaacacattcactcagctaatcccaccacagactcccttcttcaggaaaataagtggataggttttaaaacagctgttaaaacagctccaaagaaatgcacatcctgactgcctaatcagacctatacagagaaacaaagcatttggaccgcatgaatggatccattatcacatgtttatccattcagtgttaaaattttttaaaatcgatgttataaaataccattcaaacgaatgtagcattggcatggaagaatgcttgtggtatgttaaatgggaaaagcaagttgcagaagagactgaaaagtatgattccattttggtttttaaataataagtgtttaaggtatatatatatatatatatatattttttttttttttttttttgagacagagtttcgctcttgttgcccaggctggagtgcaatggtgccatctcggctcaccactacctctgcctctgggttcaagtgattctcctgcctcagcctcccgagtggctgggattacaggcatgcgccaccatgcctggctaattttgtatttttaggagagatggggtttctccatgttggtcaagctggtctcaaacgcctgacctcagatgatctgcccaccttagtgtcccaaagtgctgggattacagatgtgagccactgcgcccggcccaggtatatattctttagtattaccattaagaagggtttaaggggcacacaccacactggttgtgttatatattgttataaagcagaggtctacttttggagtgggagtgagaggtctgcagaaaacagtcacaatttaccaaatactcttctgtttgggctgaaattttttcaataattatgtattattttttataatttgaaaaacattaattcaaagaactagtgttctaagttgatgtccagaggccctgtgaagtcctacgttcaagtaaaacatggcggtattctctgtaatatccccattgtgacactccatgtaatctcccgatacttctcttgtgactagtgtgctggtcactcgcagctgtcccacttggggagaggtaagctgatacacttggctaaaacaatccttatttgaaatggaattctgagtcatggcattaggaaagcagacatttcctttcttctaggaataggcgtggcttgatcagagctgcttatggaatggacgaaggcagtatcatttctgttccattctgccagcattgtgatgtttactatttttgttaggcaccaaatagtttcccatagccaacattttaatgctttggctcaggcaccagttggtacaatgaatccaaataatggagcagataattcctaaagaaactgcaaggatggagcattgatgaagaaggtacagttgataagcctttctgccacatttctccagtgtgcatttgtccttcattctgtccagggggaactttttggcagagagcagtatttttggcttaagttagtgctcagtttctctacctggcagaggcccctaaggagtgtggcagtgtcatgtgttggcagcagagctggacactcaatgtttgacctttttctggagtgtcccctcttttatgaggacactttccttttaccttgtgcttcccacagtctgctgaaggcctccgtctgactctggcagccaggcacagccccagcttttttacccttccctcttattcctcaagggccctgttttctgagactcattcatcaattccatttagttcattccagcaaactttcattaagcacttccaaagtgccagactcagtggggataatataatgagcttacagtctagtggaggagacagacacataaatagattcttccaggcattgtggcaagtgctcaaatagagatatctaatattcacccatctattcagatcgtattgaaaatctactatgtgccaggcactgggacagctgcagaggatacagagatgaacaaaatacctgccctcacagagctcctagtgtaataggagaaagaggaaagacatgcaaccaaataaattccaacgcaattaataaattcaaccataggcaaggccacagcatagagaaggtgcgtgttaatttatgtgtagggaggtattaaaggcttcccagaggatctgatgtcagtactgcatttggaatgaatatgtaagggttagccatgcagaaaaggatattgaaatcattccaggcattgggaaggaacatcatgtgcaaaggcactgagataagagtagtgttcagggaaccacgagggctttggtgttgctaaaatagaaggaggtgaggctggagaagtgagcaggggctggatcatgaggggtcttgtgtgccaggcaaagaaatgtggctttaccttttaggaaccaatgaggaactttcagcagcaaagaaacgtcaaattctcattttttggcagatcagttcacagccagcaggtaacatatcacatgatacctccataagattacaacttagtccaaaaggaataatccttaagaaactttttttttggtttgtttataaaaataattcatggtttgtattagtccgttttcatgctgctgataaagacatacctaagactgaggaaaaaaagaggtttaattggacttacagttccacatggctggggaggcctcagaatcatgtgggaggtgaaaggcacttcttacatggcagcagcaaaagaaaatgagagatacaaaagtgaaaatccttgataaaaccatcagatctcatgagacttattcactaccatgagaacagtatgggagaaaccatccccatgattcacatcatctcccactgggtccctcccacaacatgtgggaaatatgggagtacaattcaagatgagatttgggtggggacacagagccaaaccatatcattctgcccctggtccctccaaatctcatgtcctcacatttcaaaaccaatcatgccttctcaacagtcccccaaagtcttgactcatttcagcattaactcaaaactccacaatccaaagtcccatctgaaacaaggcaagttccttctgcctatgagcctgtaaaatcaaaagcaagctagttacttcctcttcctagatacagtgggggtacaggtatttggtaaatacagccattccaaatgggagaaattggccaaaacaaaggggttacccctgtgcttgtccaaaatccagcggggcagtcaaattttaaagctccaaaatgatctcctttgactccaggtctcgcatccaggtcatgctgatgcaagacgtgggttcccatggtcttgggcagctctaccctgtggctttgcaggatacagcctccctcccagctgctttcatgggctggcattgagtgtctgtagcttttccagcaacggtgcaagctgtcagtggatctaccattctggggtctggaggatggtggccctcttctcacagctccactaggcagtgccccagtagggactctgcgtgggggctctgaccccacatttcccttctgcactgccctagcagaggtcctccatgaggcccccgcccctgcagcaaacttctgcctgggcatccagacatttccatacatcttctgaaatgtaggtggaggttcccaaaccccaattttttacttctgtgcactcacaggctcaacaccacgtggaagctgccaaggcttggggcttgcaccctctgaagccatggcgcaagccctatgttggcccctttcagccatggctggagtggctgggacacagggcaccacgtccctaggctgcatgcagcacaggaccctgggcccagaccacaaaaccattttctcctaggcctccgggcctgtgatggcaggggcagctgtgaagccctctgatatgccctggagacattttccccattgtcttggggattaatgtttggctccttgttacttatgcaaatttctgcagccagcttgaatttttccttagaaaatgttattttttttttctatcacattgtcaggctgcaaattttctgaactcttatgctctgcttcccttataaaactgaatgcctttaacagcacccaagccacctcttgaatgctttgctgcttagaaatttcttctgccagatatcctaaattatctctctcaagttcaaagttccacaaatccctagggcagggcaaaatgcccctggtctttttgctaaaacataacaaaagtcacctttgttccagttcccaacaagttcctcatctacatctgaggccacctcaccctgaaccttattgtccatgtctctaactggcttttggtcaaagccattcaacaagtctctaggaagttccaacctttcctacattttcctgtcttcttctgacccctccaaactcttccaacctctgtttgtcacccagttccaaagttgcttccatatttgttggtatcttttcaacaacgtcccactctactggtaccaatttactgtattagtccgttttcatgctgctgataaagacatacctgagactgggaagaaaaagagttttaatcggacttacagttccacatggctggagaagcctcagaatcatggcaggaggcgaaaggcacttcttacatggcagcagcaagagaaagtgagagatgcaaaagcagaaacccctgataaaactaccagatctcatgagacttattcactaccatgagaacagtatggggaaaaccacccccatgattcagattatctcccactgggtccctcccacaacatgtgggaattatgggagtataattcatgatgagattttggtgaggacacagagccataccatatcatggttactttagtcaatttggaaagtataagaaatacaaataaaatcaaaatcactcctaattccataaatagacataggtccatttgcaaatatgtatgtatcaaatagtgatcaaatactagagagaattttgtattcttttcctccttaacagtgttttatgagcattctctcatgtcagtaaatatattgtgaaaacaaaattattctagtggtggaaatttcagatgcagtagcaagctggtagaaaagacatagaaggagaaagaggaggccattcaatgtgtcttaaattacacaaaatgcagtacctggtagttaatttcaagaaatgcttattgaatgaaatatcagctagaactaccctggacctcagggatagaggttttccaaaaaggatctggaaagagaagggggagggggagagagcaggtggagagagcggggggagagagagagagagagagagagagagagagagctttaagtataaatcagatgagtactttatagtggatactgaatactctgcttatggatcattattcttctccatggctgaaagttgtattgcggtactaaagtatgatgttatggctttggtattttatagcatagccaggctcaaaagaataattaattatttatcttgtgcattagtcatgttctttcatttacctccttcctcttgctgtcaacgtttgagaaacttgactagaatggggataggagagggaaaatcacaaccagtatcttatagcagtgtaggcaaagtaaatattctgattcagggaagagttgaggactgttggacaaatgaggcttttcagttctttgtatgttttttaagtgtgtgtgtgttttaggctagccaactggctcctgtaagatagctccaaaataatagattttgtgttatgatcaaaagggctcacagccttatgtgctagaatccaacactatgaccccagattttgagaaaagcaaagctttttcttgtaaatcgtctaacaaggacacaggagcccagctcaaatctgtctccctgtgctggctttaaggcagtaattttattagaaaaggctcaggggtggattctgggattagtaggtgattgatggaagaggagaggaggtctaaaaggtcctgaggcatgcacagttatctcttcatgccacctcatgggtctcatgtgcaaatctgggaggagttagtttgaaatacagggtggaaatccaagctgtgacatcagcaagcttgttctgcacaaacttcagttgaccagattggttccaactgatttcagccagtttcttttatttatttatttatctatttattatactttaagttttagggtacatgtgcacaatgtgcaggtttgttacatatgtatacacgtgccatgttggtgtgctgtacacattaactcgtcatttacatcaggtatatctcctaatgctatcccttccccctccccccaccccacacctggtatgtgatgttccccttcctgtgtccaagtgttctcattgttcaattcccacctatgaatgagaacatgcagtgtttggttttttatccctgcgatagtttgctgagaatgatggtttccagcttcatccatgtccctacaaaggacatgaactcatccttttttatggctgcatagtgttccatggtgtatatgtgccacattttcttaatccagtctatcattgatggacatttgggttggttccaagtctttgctattgtgattagtgctgcagtaaacatacgtgtgcatgtgtctttaaagcagcatgatttataatcctctgggtatatacccagtaatgggatggctgggtcaaatggtatttctagttctagatccttgaggaatcaccacactgtcttccacaatggttgaaccagtttacagttccaccaacagtgtaaaagtgttcctatttctccacatcctctccaggacctgttgtttcctgaccttttaatgatcaccattctaactggtgtgagatggtatctcattgtggttttgatttgcatttctctgatggccagtgatggtgagcattttttcatgtgtctgttggttgcataaatgtcttcttttgagaagtgtctgttcatatccttctcccacttgttgatggggttgtttgtttttttcttgtaaatttgtttgagttctttgtcgattctggctattagccctttgtcagatgagtagattgcaaaaattttctcccattctgtaggttgcctgttcactctgatggtagtttcttttgccgtgcagaagctctttagtttaattagatcccatttgtcaattttggcttttgttgccattgcttttagtgtattagacatgaagtccttgcccatgcctatgtcctgaatggtattgcctaggttttcttctagggtttttatggttttaggtctaacatttcagtctttaatacatcttgaattaatttttgtataaggtgtaaggaaggggtccagttttagctttctacatatggctagccagttttcccatcaccatttattaaatagggagtcctttccctgtttcttgtttttgtcaggtttgtcaaagatcagatggttgtagatgtgtggtgttatttctggggcctctgttctgttccattggtctatatctctgttttggtaccagtaccatgctattttgattactgtagccttgtagtatagtttgaagtcaggtagcgtgatgcctccagctttgttcttttggcttaggattgacttggcgatgcgggctcttttttggttccatatgaactttaaagtatttttttccaattctgtgaagaaagtcattggtagcttgatggggatggcattgaatctataaattaccttgggcagtgtggccattttcacgatattgattcttcctatccatgagcatggaatgttcttccatttgtttgtgtcctcttttatttcgatgaggcagtggtttgtagttctccttgaagagatccttcacatctctcgtaagttggattcctaggtattttattctctttgaagcaattgtgaatgggagttcactcatgatttggctctctgtttgtctgttattggtgtataagaatgcttgtgatttttgcacattgattttatatcctgagactttgctgaagttgcttatcagcttgaggagattatgggctgagacggtcgggttttctaaatatacaatcatgtcatctgcaaacagggacagtttgacttcctcttttcctaaatgaataccctttatttctttctcctgcctgattgccctggccagaacttccaacactgtgttgaataggagtggtgagagagggcatccctgtcttgtgccagttttcaaagggaatgctttcagcttttgcccattcagtatgatattggctgtgggtttgtcataaataggtcttattattttgagatacgtcccatcaatgcctaatttattgagaatttttagcatgaagggctgtcgaattttgtcaaaggccttttctgcttctattgatataatcatggggtttttgtctttggttctatttatatgctggattacatttattgatttgtgtatgttgaaccagccttgcatcccagggatgaagcgcacttgattatggtgaataagctttttgatgtgctgctggattcagtttgccagtatttttttgaggatttttgcatcagtgttcatcagggatataatctcagaagcagaaagagtttcatcatttcagcattttattcttctaatctatcatcctgcaaactcgagaatttctattagtcattggtttctttaactctttgggggtatggtttcaatagcgacataaacaaaatagaagtttatttcctctctcaagtataagtctgatgtatcagttccacaattatccagatcaagattccttctatattatggttttggtgacctcaacaagtagcttccatcttgtggtctaagctggcaactctaactcccaccatcatatcaacagtccagctaatgggaaaggggaaaggcaagggggtgagtgagcattcctttgaagggtagacccagcagtggcacacattacttaaaccaacatcccattggtcagaacttgatcatatagagctgcacgggagttggtaaaatagtctttgtggttggctatgtaccagctaaaattccaaagttcttttctaagggaagacagaatgactagatattggagaacaatcagcagtctcttccacactatgccatcttcccccaggagtatggaagatgcattaaactggctctactgtgaaattctttcatgttccaagacaccagtttttatgtttccagatgatgaatccgagactcctgaagaactggaagaagagattcctgtggtgatttgtgctgcagcagggaggatgggtgccactatggctgccatcaatagcatctacagcaacactgacgccaacatcttgttctatgtagtgggactccggaatactctgactcgaatacggtaagttatgtcttacagactttggcactttctgtttccttcccctctctccttccctccctccctccctccctacctcttcttcttcttttctttctttcttgccttctctccctttctctctttctctccctctctctttctgtctctctctctctctctgtctttctctctttctctctttctttctgataggatcttgctctgttgctcagactggattgtgcggtggcgcaatcacagctcactgcagccttgacctccctggctcaagcaatccttctgtttccacctcccaagtagctgagactacaagtgcatgctaccacacccagctcattttctaatttttttgtggagagcgagtctctctttgttgcttaggtttgtcttgaaatcctgggttcaagcaatcctccctcctcagcctcccaaaatgctgggattacaggtgtgagccaccacacctggcctctactttcttatatttccttaaatagatttcctttctttttggattaagaaaaaataaacagaaaattaaaatttgaacatattataaaaatgaaagataattgtaaaatcttggtttggagagtgtctctctgagcccagaaatcatccagaaaaatggacagatttgactgcatcacatttaaaaactttacaatgatgaaaaatacaagtgaagctattcatacaatagattaggaccaagtatttttaacatgtattatagacaaaaaattaccatccaaaatatagaattgttacaaaaattttaaaaacatggttaaaaaatgggcataggatataaccagataattcacagaggaaaaaaatacaaatggccaataaacatgaaaaggtgttgtaggctgggtgaggtggctcactcctatatttccaacactttgggaagccaaggaaaaaggatgacttgggatcaggctcgagaccagcctgggcaacataacaagacctctgtctctactaaaaattttagaaattagctgagggtggtgatacatagcgggaggctgaggtgggaggatcccttgagcccaggagtttgaggctgctgtaagctatgatcgcatcacttaactccagcctgggcaacagagtgagaccttgtttcagctaaaaataaataaataaggctgggcgcagtggctaactcctgtaatcctacctgaagtcaagaatttgagaccagcctggtcaatatggcgaaaccccgtctctactaaagatacaaaaatttgctgagcatgttagcacattcctgtaatcctagctactggggaggctgaggccagagaatggcttaaacccaggaggtggaggttgcagtgagctgagatcgtgccactgcgcttcagcctgggtgacagagtgagactgcatctccaaaaataaaaaataataaataaaaaataaataaataaagtttttctgtgttattaataggaaaatgtgaattgaaacatttttgcattgttgaaaatgaaaataaaaatgaaaacatatatgtcacttcagtgacaatcttcactcatcaggttggcaaaaattaaacagaacaacattacccagtgcaggaaaatgggcatgcttattccttatttatacaatgtgcattttctaagttggtaagacatttggcaaggtcaacatggcaatatctatcaaaaggttgtatgcatatataatttgattcacatgccttttcctcttccaggaatctgtgctacaaaaattctagtacatattaccaaaatacgtgtacaacaatgctagtttcagcattatgtgaattagtgaaaacatttcaaagtgctgaaatgtccaccaatggaagaatatttaaatgaactgtgaaatatgatccagatgttaacgaaagaaggcactctgtctaagcagacataggagattcccaaggcatattgttaagtggaaaaaactagctgcagtataactcgtatagtatgatctactttaggaaattcaaaacccctaactgtaagtgtgtacatgtacatgtatgtgtttctgtgaagaaaaagaactggaaagctatcagattgttaacactatctcttgggaggacagaggaatcagggagggtgctgatgaaaggaagttcagggtgtttcagtattatttgatcattcaaaaggagaatatatttgcatactgcttttataattaaatgtttttgtagtggtgccatcaggaggtactgagatctgtaaaggtgtttgcctataatctaaatggcccttggctgccctgggttttgatgtcttgtgtatgctttctggattttctgtctcatttctcactctccttatcatactattgctcatcattcacttagcctgttgttaacagcccattaactatccatgggtatgaaaactagataaccaaatccaaaaggatggcatgtataaggtttctgggcaagggtttgtccttaacaaaaggcatgaacctcatgactttctgactttggccaggggctatttcccagttcttgctgtccagtctactccctgcccccttttacatactttaaagttttttttttcattgaagtagaatcccaaaacagaaaattgtataaatccagtgtgcagtttactggatcatcacaaagtaaacacactcatgtaacatccagcatgttctcactaacacttagtataaaatcaatctttttaagtttgccattttgattagtgtccagtggtatctagaaatttgaagtttcattatttctaatgtcattgaacacttttcccacacactttgtaaccatttggaagtaagtgttcaagtctcttgcctattttgctgttagtctatctttttttaattgatatgaccaattattttttcagattttgcagatctaaattttgttcacatttaattcttttgttgatttttagtcaacaacaaatactaccctaggtggctttagtcattcgacattttattttgagattatttctaccaagaacctcattatgaattggatacaagataaaaattctgcaagaccaagaaaacagaaggggagagggagggggaagagaagaaggggaacgaagacagatggggaagatcaagggaccaaatcaaagagacaaaggtaaattcaaatcagccttggagtcaaaacagcagagtaaaaatgacttcgatcaaagctgaaggttcagaatgtcctgtttcataatatttcagagctgttaccacgtggcgaagatagtaccagcaaccacagatgctgctatataagaaagaatacttttcattcttcctgtttcctggggaaattatttggatctggggagagatttggttattactattttgcttcatttcctttgcagaaagagttacgtgattgaggggaaaaaaagatttaaagtcagaccagatggggagaaaagtcagagggatttattggactaaactctactaaatttacgcacattttaattttaactttctagggaggcaacagattgaccttggggcaataggcaaatggaggaaagaattgaagggtatactagaggtttttttggtcatctttttagaaaatggattgaacattccaaactgagagaaataaactttaaaatcgtggaattcaacccgatggtcctcaaagggaagatcagaccagactcatcgaggcctgaattgctccagcctgtaagtagggaccacacaggtgctggggacagtccttggtgagacctttgttcagtaaaggagtgctagtcaccgggatgcatgtggaatattatttttgaagccatgtggagttgatctccaccaaactccgcttatgtataatttataagccagctgctacagaaaggatttaagatggtttatagaagcacaatgaagttattaaagaagaagtgaagcattaaaaaaatgtagaatgcatttatgggtgtgaatatgtctgtgggggtgggagctggaggagggccaggtagctgaggccaggaaaaagagtcccaaacccaccagctgttgggatatttaactgtgattgtacgttaaagctgcctcggagtgtccgacagctaagaaaaaacagtagtatgatggattatatacttcatagtattgactaagataatatattcaggagacaccatctcttttcctagcattggaaatcttaaggtattttactgcaagagttcttacaaaagggaccctctcctgcataaaaagtggtgtttttggctggacgtgctggctcgtgcttgtaatcccagcactttgggaggctgagcggggaggattgcttgagctcagaagtttgagaccagcttgggcaacatattgagaccctgtttatacttaaaaaagttttatttagtggccaagcgtggttgctcatgcctgtaatcccaacactttgggaggccgaggcaggcggatcgtgaggtcaggagttcgagaccagcctggccaacatagtgaaaccccatctctactaaaaatacaaaaattagctgggcatggtggcaggcacctgtagccccggctactcgggagtctgaggcaggataatcgcttgaacccgggaggtggaggttgcagtgagccaagattgcactattgcactccagcctaggcaacagagtgagactccgtctcaaaaaaaaaaatttttttttaattagctaggcatggtggcatacccctgtagtcctagctacctactcaggaggctgaggtgggaggattgtttgagtctgggagttcgaggctgtagtgagctgtgatcatgccactgcactccagcctgggcaacagagagagaccctgtctcaaaaaagaaaaaaaaaaaaaagagtggtgtttttgatagcagttctacagaaactgcagccaccttctacatatgattgttacttaaattcatccctgaaaatttacttaattctgagccctctgtctgtgatatgatcttcccccaattccagatgttgtcagagtacaagccatgacttcggaggaagcaatgttgtcagtaatgaaacttcgaagttcctacccacaggtcatgctgctcctttttctggttcaaggagctaaaaggttgagcttgctgttggaatgacacacgtgtgtgtgtgtgtgtgtgtgtgtgtgtgtgtgtgtgtgtgtatttaaggctgatttaattgacaattatcaaaattactgaatacagagaaaggcaggcgatttgtgccctaaaagtgactaacgagcctctgtgactcccactacagcagttcgcagagatgaaagtggcaacagcctcggcactagggggtttgtatctaggagaacggccgatccgtcagcgctggcttcagccccaggcctcagataagttgggcactgggaagctcagatgagacatcttgctagctcctgttttattccgctccaaacctggagctgagctgaggccatggtcaaagccgactctccagtacccccagaagacactaagccatatgcctctcccccaccatcatttcttttgtcgttttaacagctgaactttgttcgattttatctccctctacttatccaccaacacgagaaagtcatctatttggacgatgatgtaattgtacaaggtactctcgctaactgccaagaacacttggaaaagaagcagctgataagtagaataactgtctctcttcatttttcaaataactaattgtgcagcaagttttgactgcttatttaagttgtgagtacagtattgttgtaaatgtggaagtattttggaaacgggttgatacttactgagacaatccagttgacactctgattgtcaaaaccagcaataaatagcttggtagcctttcctttccctgtatgcctataatgtacggaaataaagtgtcacggatgacattcttaggagtgagctaagttttggtgtttaaatgttgtgttctatctcttccactacaaacaggatacgcattggtgtggtatctacttagcaacagaaataaagaaattagatcagtgccagtttgaactcatcatccagtggctttctaaatctgtaggcaagactcttaataaataaatagtcaagccacttgaaatcagggatccaatactcttctcccatagcaaaatcaagagctgtttaagctctaaggctctatctagcccaaaaacaaatgctataatgttttacttggtggtgtttctaaattcaggtgatatccaagaactgtatgacaccaccttggccctgggccacgcggcggctttctcagatgactgcgatttgccctctgctcaggacataaacagactcgtgggacttcaggtgggcatatgctgtctcagaaatcctcccttcactctacaactctggccccttctcccccctctgcaagtcaaaatgagtgtaacctccacctcaaaaaccttatgggccagtctggactgcagggaggtggaacagtacaggggtctgggactttggttcatatcttagctccatgccttaccaactctggggcaactttctttagccctgcaaggtcccaccttccttacctgaaacatgggaacaatcatgtctactttgttgtgtctttgtgagcagtaatgaaataacatggtgtccaagtgtccagcatgaaataaaagctccagaaatgatcattgttacctaggttgctcatcaccatgctctctgtcagagatgatgttttctgtaaaagagacttgctgaaccattggttctattttcagagttttgaccatcacttttatcccccttccagtagaagaaaatattgattttgttaagggtaaagatctccttaccctgatggaactgaggaaagttgaacctacatgcaatgctgaaaccgaaggggtagctttgaaatatgaggtgttattaagagttaaatgctgtttttcaaaaaagcttctagcaaataattttatgtatgtggcattttaaggcacttcaaggcataggctctgggaccagattcaattttgtcaaaatctgggcactatcacttggtagttttatgacctcgggcaagttacttagccagttgtttctacctcatttgccaaacagaggtaataatagtacttcctttgtagttatcgtgagaattaaattagttaacacatataaagctattacatgagagtaatgaggtagtacatgtaaagttcttagaaaagggcctggtgtatagaaagtactcaagtatttccatgactcctgtgtgaggtttgagagcatcacattaaggaattatagatgataacagtctatatgggtgaaagaatgtgtatgtcctgccctgtacaacattcattcaacaatgacttattgagtgcttactctgtgcctgacactgttttaggtactagtaatatagtgagcaaaacgaaaactcctgcttttgtgtatttcacattctagtgggaacagacagacagtaaacaagtaaaatatttaacagaggattggggtggaggcagggctgtattttaaatacagtaatcagggaaggctccactgagattgtgctgtttgaacctaaacttgaaagaattgagggaaccacctgtgcagatggttagaggggaaaccctccaggaagcgggaagaacaagtgtaaagatcttgaggcaggggtgagtctggttcattaaaggtggtcgctgttgctgagggatcaagaggagaataacaggagttggaaaggtattggagggtcagatgatatagggtatggcaggccattttaggaaatctggctgtttctgtgaatgagatgggaagctattggaggagcttagaggagatgagtgacctagagacagagtggggtggaaaatagtggaagcaaggatactggttaggaggaacttgcagaaatccattgagtggcaattatggcctgaacaggaaggtagcagtgtggtagtagtggcaagagaagtggttggcttccagcattttgaagatgggacctacaccatttgctgaaatatttggatgagaagagagtgagaaaaaaggagtcaaggaggacctaatgaccccaggttttttgcccaagtaactagaaggatagagttgccactgactgaggtggggcaggtgcagggaagcaggtttgggataggattgggatcaattttgggatgtaagttggagctgcctttactaagcatctgaaaggagacatttggatggcagatgtagcaggagttggaagtccagaggagaggtcagggctgtcagatgggtggtatttagagccatgagactggacaaggctgtttatggagttattgctagagaaaggcactagtgctgcactcagacttagggcattcagcatttagaggttggagaaatgagggaaaccagcaaaacaaaacaaaaacaacaaactacccagtggccagtgacacaggaggaaacccaaagatactgcacaagggtttcaagaaaatgatcattttccagaaacaaaagattcgctggtcaaaagcatgcacatcctgttcccttacagaacacatatatgggctatctggactaccggaagaaggccatcaaggaccttggcatcagccccagcacctgctctttcaatcctggtgtgattgttgccaacatgacagaatggaagcaccagcgcatcaccaagcaattggagaaatggatgcaaaagaatgtggagtacgtgaaggcttctctaccattttttccatgcttggaaacaaaatcattcaattaattttccacacatagttcaagggttagaaatatttcacagtcatctcaggtcagattttcttacagaggcaatgttaagaaagaaaagggggcagtcaattaaaacctttcctcaaaagatataaatcagaggaatcaagatcctgtggagcgaggagtccctgattatacattttcctagtaagctgttgaaaaatgtgacttgaatcttttccaccaaacaatcttcatttatcttagttgagtttcccctcctaacatagatttttttattaaggattattatataaagtcaattttgctttttaaggtttatttttataatttataatttttcgttatcggagttttaaaatagagaagataaaaataagtctaatacaagcactattatcccatcattgtattgcctagcagtcttgtgtatctggatattttaataccatcataaccttgaatttgcaagtaaagttattctaaataatgtaggattcgaatttgatctcctgtgtctactatttaaaaccctgggagttaaaatggcaaaatattaacactgttactctaggtgatgtatataggagttcatggtattcttactattttgtgtatgtttgacaattttcaaaatgaaaatttgggggagaatgaaaggccataagtcttagtacatagtgagataatgtcttacatcatttacaatatcagattcgactttatctgagtttgtgggggctccaggccaaatgttgtttttctatttcatttcttagggaaaacctctatagcagctccctgggaggaggggtggccacctccccaatgctgattgtgtttcatgggaaatattccacaattaaccccctgtggcacataaggcacctgggtaagtatttcagaaaaactgtttagaaaaacgcaaatgtccattttatttttgtatttttgagacagagtctcgctctgctgcccaggctggagtgcaatggcgtgatctcggctcactggaacctccgcttcctgggttcaagcaattcacctgcctcagcatctcgagtagctgggattacaggcatgtgccatcacgcccagctaatttctgtatttttagtacagatggggtttcaccatgttggccaggctggtctcaaactcctgaccttaggtgatccacccatttcggcctcccaaagtgctaggattacggcataagccaccatgcccggccgcaaatgtgcattttatagacccagtgagcaccatagcgaggagagggtgctacatacagcaccaggttgttcaattgaaatcctccaggtgaccttggacaaatgacttgaccctcagtgctcagattcagcaagtgcagctgatattctgagctacctgaggagcgtgtttctggagatttatggaaagccatcaaattcatgcttagcatatagtatgtgcttagtaaacatgaactattataaagagaactttcggccgggcgtggtggctcacgcttgtaatcccagcactttgggaggctgaggagggtggataacctgaggttaggagttcaagaccaacctgaccaacgtggtgaaacccgtctctgctaaaaatataaaaattcgctgggcatgggggcaggcacctgcaatcccagctactcgggaggctgaggcaggagaatcgcttggacctggaaggcagaggttgcagtgagctacgattgcgccactgcactccagcctgggcgacaggaccgaaactctatctcaaaaaaaaaaaaaaaaaagagagagagagagagagaactttcactgtcaaaacttcaaaaccttattgaactgtcaagccacacttttattttctcttgcagtaacttacagtggacaaaaccaaataaattagcataatggcttaggatgaattcagaaagctgccattaaaatttatcctttaaaaagcagttgactctgtactctgtgagttctctaagtcttttactcactacacaagtgtagggtttagagtatgaactggaatcccaactatgatttggggcaggttacggaatacatgtaaattgcttagcatagagcctagcatagaggacacattcacatccactctaacacatggccacaatccctgatccaaaaccgctgggccagacatgtttggaagtttagaaagggtttggattttaaaaaggtaatgtggtgctgagtgggatctaggttttactgccaaagaagttattaaaaaaccttttgttttcagacctttggggattatcttagaattgtaggcaatggatatgcacttatatttaccaagtgtccattacattgccaagaactggactaggttctgttaaggaaggtgaatattatttctaattctcacaacaaccctgcaaggtgttatgtcccataatcttttttttttttttttttttttaaaggacgtaattgtggaggctgagttcctgtatgctctcgatgattctgtgggttgcttctgcatcattcccagaatcctctgattttcctgagcatgtatatgcacaaaagagtgccacagggaagttagtgttgtgtctgatttgatttatagtcatgttgggttcaacattaggtcaaatatcaacctttccatgtgcagatcccatcaaagtagaaggtctatttttaaatatgtgtaggaacagttatgcagagcttagatcaataaggttacggcattttatgatcttgagacagactcagaattacattttatgaaacatgcaacttaggccaggcatgatggctcatgcctataatcccagtactttgggaggttgaagcgggtggatcacttgaggtcaggagttcaagaccagcctggccaacatggtgaaaccccatctctactaaaaatatgaaaaattagctgggcatggtggcacacacctgtaatcccagttattcgggaggctgatgcaggagaatagcctaaacctgggaggcagagattgaactgagcagaaatcatgccactgcactccagtctgggtgacagagctagactccatctcaaaagaaaaaaaagagaaatatccactttactgacaagtaggaagggacatactcttcccaaaggaaagatgtcgtttttctttgtaggacagagcttccatctgtgctgaaggttttggaatcagggatggtgtgcaaagtaaatctacacaaaaatcatttgaaaaatgaggtttcaggatgttctggaggcagaagggcaacataacactaatgggcattaagtttgggtctaaacaggcaggcttaagattttttaaatttacaaaatatatttagctaaaagcaatttcatcacccaaactgcaagcccctctgaggtagttctgcatagcccttcagttacgaagctgagaggtgaggatgtcctacttagtagagacttttcatgggaaggtgcctcttcccaaatgaatatttcctttgcatagactctgatgattgataattattccagttatgctgcgatagtttcaaacaactagtttctcttctgcagctgccgtcacagctatgtttattagtaacagaagccaggttgtgttgttgttaacgtcatacaatagaataacataaccctagcaaatcaaccctctcgtaattcaatggactttcagctgtttaaagaatatatatatcaaattccttttcatggaaagaaagtcgaacactatagagatttttaaaaaattgtacattcacgccaccttaatgtagttctagaataggtattctaaagagtattctaagcaatggcactgttagggtaaatgcatagtctctcgaagtcatgacttatgaggggagtaatgttcaggtggagatagatagctgtttgtttaaaaagtagatcttagtcacattttatatttagacaagactgttcaaaagcaaatgttgccatttttcattaaggaggtgaaatgcagagaaaaaagaacccctataaactcttgggtgggagggaaattaatagaacttcttgggggacaatgcggcaatctctatcaaaattgaaaaggcacacaaccttcaatctagcaattccacctacaatattttatcctacatatatatatatatatatatatatatatatatatatatatatatatatatatatatttgtacacatacactagacatacatagagggctgctcattgctgtgtttatgctaataataggatagaaacaatctaaatgtccttaataaggaacttggtcaataaatagtatcattctatacagtcactaaaaataatttggtaaatccacatgtactgctgtggaaagtttcccaagacagtaattttaaaaggcaatgtccacataaagaaacaaaataatttttttttaaaggcaaggtagcagtatgctctattttgtcttctgtctttaaatatacatatacatgcatacaggtcaaacaatgctataacactactagaaggattcacaagagactaacagtggttgatttggagacctggggtgggtagaaaattcactgtataacctttttatttgtttacctttttttaaactatgaacttgtattcaatttataatacaaaaatgttattctctaacaagcctattattttttctctatacacaatgaaggctggaatccagatgccagatattcggagcattttctgcaggaagctaaattactccactggaatggaagacataaaccttgggacttccctagtgttcacaacgacttatgggaaagctggtttgttcctgaccctgcagggatatttaaactcaatcaccatagctgatataactctacccttaaaatattccctgtatagaaatgtggaattgtccctttgtagccaactataacattgttctttatgaatattacctttgatacatatgatccacaatataaaaaccaaaaactactgtgtgcaaattataccttggaccatataggcattgattaacttctttaagtacatgtgataactatggaaatcaagattatgtgactgaaaaacataaaggaagagacccatctagataacagcaatcaacctgcttaattctgaatgacaattatatccacaaatttttaaaacttctacatgtatttttcacatgaagatctccttaacaggttgccaaccttttcttttataaaactattacatttaaaatatggacgtctgaaaaataaaatattcatcattttta

SEQ ID NO: 38660 - DNA, 305719 bp, Homo sapiens
ggtgctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagtcagtgcttgccgggccctccctctgttcgctgtccgtgtgcctctcccggtgttccccaaacccattgcccaatggccggtccttctgcatttcctggtccttctctcccagccctgtggccttccctttagcattcttaacagcttgtccttttgcaccaccctttccaaccccaggttctgacccagctaccctacagtttgacctaccctcaaaagccctgacagcacctcagttttgttcctaagaagtctgcggccctcacccagtcaccttaccccctcctccccatggaatcacctgttttccaaagtgcttcctgattcctaggaatctttgtagcttgcctcaacgttcgctcccaaggcccactcattcctttctattttgcttcagtcttccttccccgttgatgaacatgaaaaggtgcaacctgacaatctcttctcatagggggcttcttcttgcctccccacctacctaattcgcccacccctttctttgtcaaggccacaactttctatgaagcgaatgtacccttccaagggcctaaacactaaacagctcacacaagcattttgcagggaccactgataaacccaatgcctccttgggaaagcagtctcaaactacagaaatttctctcttgagctgcctgttctttcgtgtactccttcctcatcttggtcatcaccttagtgttccaaatgtctactttctttgctaacttgttcttggaaattctttgctttgacaatcgttaaactaacttttttgtaaatcttgatgctgacagtgggcattagggggtcttagggttcttgagtacctacagaagcaggtgctgcttaaagatcaatgctgtgaaggaaggaaggaagagctactcagagcttgcctgacaggatcctgaaccagacttcttggagcccttgcggggatgcaggaacctcttacaaaccctgaatattttcccaatctttttgactcctcattttgcagtgtactgccaaacctgttgctgctgtgtccaaactggatacagagagtagccttgactttaaagatggcctgtgtttgattaaacaattccaaaagtctgtctcaatgagtgctaattgagctccaagaatgtgtcaccctctggaggatggccccataggaggagggtcttggaggattcagcattttgtgctcacatgcttaattatgtctttgtcagatatctacaatgggagtccctgcatccttggtgtgatgcatctgtgtaatgaaccaaacagccttacaagggacagcattgctagattcggggaagacaagtcttgacatgtagtatagttataaggcatctttatatggttcttttaagtcaaccaatctgactcctcgcagaatccactggcttcagtttctcttgatcagctgctttttcccatgttcatcctttctatttctctgctactttgaacattgaacttgtgatataatgttaggcatctccattggactagtgggactatgcttgagagggcagatgaactggagtagaataaaagttttcttgttgagaacagtgcccagaaaccttcttgtaaccactgattagatatcttatcaacaaacatttttctaatatcatatatttgttttctttaggaaatgacttaatcgtctttttggcagaccagaatgcaccctattttaaacccaaagtaaaggtatctttcaagtaagtacaaatatgattattttgataaaactttagtcattaatataataatggatatgcagtagctgattggttgtctttaaagtcagccttagtgttgggatgcaaaaccactgtttgtgaggtatgagtagcaagtgattttttggaaaaatagtgaaaataccaaagtttaaaaatgactttaaagaaataaatttgagtggatccaggtttgtttctatataaacaccctttatttccttgcaatctcgtatccctcgtatcccttcttgaatgtgtctcgttctgtgcctcatcttgaggcagcagtcactcacagtagtctcattgtattagccatgtgttgtgttttgtggaagaggggcctattttgcagtggggaaaaagtcagtgttctaatttttttgtttaattgactgatggtgagtttttaaggttgacttggaaggaattcaagtttaattatctgaatttttaaaatgttcaagtaatagttatttttcttttctgtggttggcattgcatgaaacaatgaccactcccacacctctacctccatgatagtgacccaacacagttttgaaactacattcatttgaagcaagcattcgtggctgtctgaattcaagcaagaagagatgggtcagtgcaggccaaaggggcagcttccagagtcatggaacttgagcttgaccttagtataaataaaaagttaggtgaagacgttcaacttggaagttcaattttggggacagagcatttataagagataaaagtaagaacagcatgttatgaagaggaggtagaaagatctgcctgacaaaagtggaaggtacacttcggggagttaaggactaagaacatgagataagaagggcagactgggagccttcagatacaaaaaagagtttgaatgctgtcccattagaagaggggaatcatcaggtccttgtgcaaaggagagatgatgaaaacagtattttaaattgatttacttgtaaactatatgcagaatgaattggtttgtagaagattaaagactacttaggaagctgtatttaaaaagtccctgtgtgggctgattagttctcagactctacagtattttgagtaaactcaaactcatgttaaaaagaaaaatggccttgaactagaactttgaggggaaagttataaatggataaacaggaacttatttcccttgagaagtgtttttgggtagtgaatgtcagcatgcttggagtggggaagaaactgaagttgagtgtatatgagaagtgaactaactgcatagaggtgattttttttttattagaaattaaggaaatttaaaagatgtaaatggcatgtgttctgataagttaaaacaaatatcccaattaatttttttattaatgcaatgcactttcaaaatttagaaactcttgtttgtgttataatttaaaatatttttcaaagtaaaaataactattcttcacccttattctcccccacacccctgtttctctctcagatgcaaccacttttaaaacctgtagctgattcttctagtgtttattaccatattttaaaataaaattttacactaattttcttgaattatcatttttaaatattcaattcttgttttttaactaacataatttatctacattgtcccagtgtaattaaatcataattttttgttaaattagtaatcattgtttaccttttaaccatgtggtgtctatgtacttcagaaccaagtaatgtacagtatttcttttctttttctttttttttttttcttgagacagagtctcactctgttgcccaggctggagtgccttggcatcatctcagctcactgcaacctttgcctcccgggttcaagctattctcccacctcagtctcccaagtagctgggattacaggtgcctgccaccatgcctagctaattttttgtatttttagtagagatgggatttcaccatgttggccaggctggtctcgagctcccgacctcaggtgatccacctgcctcggcctcccaaagtgctgggacagtatttcattttttgtgcagcttgccctactggaataaatgattgctttttaaaaaatagattgcatagttttctatgtacatacccttaatttctttgcagatattccatcatatctgccatatacctatcctgcatttttgtttttcccattggatcctctacattcctatccagtctggattcattctccaggccttttgtagacttactatgtggggaatttccccatgtaaaaaaagaaatttcctcatttacttcacgggggtgtgtctttccagaaattcctgagaaaggatgcctgataagtcctgtcacatccaaaaagtttttctacccacttttttttttttttttttttagagacagagtctcactctgtttcccaggctggagtgcagtggcacaagctcagctcactggaacctccacctccctggttctagcaattctcctgcctcagcctcctgagtagctgggactacaggtgcacaacgccacgcccagcgaattttgtagtattttagtagagacagggtttcaccgtgttgcccgggctggtgtcaaaactcctgagctcaggcaatccacctgccttggcctcccaaagtgctaggattgtaggcatgagccaccgcgcccggcatctacccactcttaaaagtttggttagcttattgtgttctagcttcatgggttgcagttttaaaattcaaccctcttctttctcctaatcttttaaatgtaaattgttttaattttggaagctattggagtctcttctttttctattttgttctgatttcatgatgatgtgccttggtatagatttgtttttcttttttgataaagacagggtctttctctatcacccaggtgaaaaaggagtgcagtcacacagtcatagctcactgtaggcacctaatcctgggctcaagctgtcctcccaccttcgcctcccaaagtgctgcaattacaggaatgattattctttacttattatgctaggcattatgtgggccctttcaagctagaggcctctatccttgggagctttttgaaatactcttacattattaaatatttctttgaaaaatttttttgtctcttttaggagtttctatcagttgattagtctgcctgggttcatcctttattcctttatcttatctgtttcttatttttatcatttagttttgttttattttcctttgcaggaggttttctcaactttctcttttaaattctaagtccttttttttttttttttttttttggtgggggatggagtcttgctctgttgcccaggctagatagagtgcaatggtccaatcttggctcactgcaatctccacctcctgggttcaagcgattctcctgcctcaacctcccaagtagctgggattagagatgcacgccaccacgcctggctactttttgtatttttaatagtgacagggttttgcaatgttggccaggctggtctcaaattcctgacctcaagtgatccacccacctccacctccacctcccaaagtgctgggattacaggcgtgaaccaccgcgcccagccaggtgtcacatttttaatttccgaggtttttcttttgttttcttactgatgttgtcttttagcatactgttgttggtttgtttttttttttatagacagacttttttctcttaagtgtaattttgaagttttcttttgttgcattagttctgttttcttcaggttccttattgctatttgttttagctctctttaatagtcaaagttttcttcagaaggcaggtgtctactcacattttcaagtaaggtgcaaaagaaataattggaaatgtattgcctagtgggactagtctactatcttttgccctgcatgtatgttcttgacagactaacattctagaaatagggtagagctgtgggcaagggttaaattgttccttttgtagacttttggttaactcctgtgtctagcttaaggccaaaaccttacccattactgtaatttaaatccttaattcctgagactttccagaaatacaccacttggttcttaccttgctgagtgagagggagaaagaactaccactgatgcattaagaaagtaattatctatagtctaattggaaatttgctgtcttgctatttcatctgagtagaattaagtataaaatgaattaaaggcctaatttttgcttgggtcgctcagataataagactgcaggacgttaagctttcaagattcatataaataattttagaattattttgttaataaaaatatatcaatacctatgaaaaggaaaaaataaaaatatacatataaagttagatatatatgtttggatgctatattgattgccaagtttcgttaaaaaaaattccattcttaatttactagctttcagaaataaaatgattcttttaatttttactgtaaattttgaatttatgttaaaatccaaactaaatattttataaataatatcttttaattgaaaacatcccagtgataatgcttactgctttggcaattatgagcctccatttgttagaaacaccatccgaatgtcttggtgtccttgacaaaggaactatatagaagggctatactagccattgcttgaacataataaacacgttttctctcgacatatttcagatttgtcttgtttcttgagactattctgcattcattctgaactcttttttagaccaaagaggtctaaatacatgatggatgaaaagataggaaagagaaggcaatcagtcagttctgttaagttttaagtttttcattgaaaatatttttgtgtggtagaaatacagaattgtccttttccattacaacttgtctgatatttgtaaatgcttgtttcttttaggaatcacagtgcattgataacaagtgtagtccctggggattatgatggagattctcaaatggatgtccttctgacatatcttcccaaaaattatgccaagagtgaattaggagctgttatcttctggggacaaaatcaaacattaggtgaatttgttttaaaaatttttaatatttatcattgaatatgaaggtaaatgtaacaaaatattgttctgaaatcagttcaaaaatactgttcttgggtgtcaataattgtaaaaccttttttcaaagtttatttcctgatttttctttttcaaccctgaactgggcagggatcacttctactgacaaacttcattcttactagcttaaagaggacagagatttattaaaggattttagtggctcacagaatcattgagatggctaaagaataaactctaggttgagctttcaggagcaatcccaatatcatcaaaaaagctactgcctctttcccctatcagaagtggctagttacacaactgctgccagaatgatgctgtgcctgcagtgattctcactagcaaaatgaatgctgcacctggtctcttgatactcccaaattcagtgagcagacacagatagaaatagcagagaaacagcctttacctcattcatgcctttaagactcacagtgtatctgattggcaaggcttaacttttattcagcatctcagatgccacaatatctggaaaatgctatttttggtttctagtctccttagcacaggaaagcacaaaaaagttgaagtatggttcgagagtcagtctaccatacctagtcacaaatcatcaagccttatctgaaaagccaattagttatacctaaataggcaactttgttcatggagccaaatttcagtcatgttttctgcaccatttgggaatgtaaacagtaatcgcgatacattatattcattaagtcaataaatatttacagagggagtaccatgcacaaagcttgtatataagcatgtacattttagaaccaggaagttttgcatatgtggccttctttacaccaaaaccttgttaattgtcaacctctctagcactaaattgtgtaaagacaaagactcagctagcaaatatttagatgcatacctcaaaaggaggttattgtaatgctagtcttcactgtagaatgtattctcccaatattttgtctttgcaagcttgatgttcatttgaactagatttatagtatctcattaatgataatagttggaataaatcagagataaatctagaaaagagtagaagaatattttttcctaagcatagatatcaaaagtaatataaaatgcctgctaattcatatatatatatatcttttttgcagatcctaacaatatgaccatactcaataggacttttcaagatgagccactaattatggagtaagtatgggcttgcttcctttgaaacgattttaaacttaaacataaaataaaatcttcacataggaaactactttgcttagtaataaaaatactaaattcactcagaggcctgtacctttgattatattgtatttatttgccatcagataggacaaagaaaaatgaaatttattattttggaaagtagaagagatttgtgtttttatttcagtcgcttcaaatgtgtccattatggatctatgctgtcattactgaaagaattaagatacctgtttttgagtaaaactgttatatttgatatttaggatacagtttcctctagaaatttagaaagattcctatattaaggagaaatttttgttctttttataatataactcctgctttgtgttatcatttatattctcactgtagactcatgtaccagcataattgatttaaataattgatgtaaatttggatttgcaaatttctgacagcgtattttggtagaggtcgagatcattcccgggactagagcaaagtttggccacattcttgtttccagtactgtctttcttacagttattaaaatcatacccatacagcagtgtgtcagtggccattagaagtctgaactgtaaatccatggattaatcttcttaacggtgccccgctagatttctttcatagttgtgtattttttcattgttgttaaaatattcaatggccagtatgaagttttataccaactaggattatttttctaggttatttctcctaagcccatctaagtaaacaagttggcttaggattctgaagtaagtttctaggaattagtgctgtatccttatcattcaagggtagtctagataatgcaaagattacagagatacccaaaatctcacaaaacgaatttatttcttgctcttactatatgtccagtgtgggtcaacaacaggctctgctctgtgctgttgcttagagtcaggccatcagagagcccactgtctttgtagctagtccatctgaatcacaatgccttctcattgccatggcaagcctggagagggctggaggggctggtaacagaaattatacactttggcctaaaagtgacacatgtcacttgtgctgacatttgacttaatacttatcactagatactggcgagcattgtaatgtctaccacacttcccaaaagttactgcttcttttaaagctaaattagaagtaagaatttaaagaaatagctgcttattgttttaattttttttcagtttcaatggtgatctaattcctgatatttttggtatcacaaatgaatccaaccagccacagatactattaggagggtgagtaaatatggttataactatgtaattaatcgtatatattgcttctactttaaccattggagaaaaaatagctcattggaatccttgtttttaaagatttttaagtgggcatttggttaatatatataagctttctcaaatagtttggatttggcctgcacctgctttccaagggccagcttactccttttatctctttgaaaaattagagattgaaactttacgggtccccatttaaatattggttcattaaatgtttttgaaatggatagatttcacgtaaatagggaggatacctgcagtcttgagtggatcctccctatcttagtaccttagtcatgttagctgctagactttaattgataagatttgtttctttctgtcatttgttcagtgagcagtcaataacggtctagtaatataagcactcctctaagctctggaaacttgtcagtgaatacattgtccttcaccagtatgtgtgctaggcctctcttactatctaagtatgcaattcttagggaaaagtgcctggaatcttgcaattccaagatatccattgtaattactctggatttaaatagaactggtctcgtagcacaagaattcctgatagcaagatacttttcataagataccttcaacccggttaattttttttctgtatctgataaggtaaagtttagttcaagagtacagaacacatttatttacttttttgtctttctgaaagtacaaaggaccacccttatcaatctgtctttcccagctacttggaactctagtgacttttctctttgtgttttatagaaatagtttgtttttatgattcatttttgaaatgtgatttgtaggtatgcagaggagtaaattgtgaaaatttttaaggtattctgaagagacactttaacatttcctattactttttctggtttacagccataccaccctgaacgcgccccatctcttctgatctcggaagctaaccaaggtcagacctggttagtgcttggatgggagatcacctattactttttctgtaggtttttaataaagaatatgggtgctttgatgctagtaatagtgaactttgaaataattattgtgaatcctgaatgagaaacctgtttttttctccaaaatttgaaaaatatcttgaagagagtcttgctttagagacaaattggaaggagatcctgatttgcttttgtggccgtatccaagaggaattgagtgcaggtggggtgcagggaaaacacagtccactccccaccaccactccgctccttccacagcaaatggggactgctcagaaaaccctgtcctttcttttcctctcttcaaaggcaggcatgtgattgaggatgtgatggtgacttctggcctgttttattttgtggtaacttcactttagtcagggaaataattggaatatctttaatctgatgtagtttgacctttagaaattgaaagtgaaacagctattgttgataattcacaaagtattaataaaacttctattacctgtacagattttttacttaatctgcgagaaaactatttagaatattatggaattgtgccatagcttctttatttgttcttaattctatattagatttttttttctctgcttcatgaacaagttcagattttaaaacatcatgcctgaagacatgtccaactttattttttatatgttatattctggtccaatatactagagtaataatactctggtattttaggatatctgtcatttgaacctcagttacaaattaaacaatagtagctaaccatatctaagtgataagtttgcatctaagatttgtcctgatgccagtttgaagatatataagctgacagaaatttgcattgtttagaatgactgtagtctaacaatatcatggttcagacaacagaaagctgaatatgcccctgtggcagcaaatattaatatgttactaaaatatgaaaactacgtttaagcaatgtcagttttataaacaacagataagatatgtacataggtgagtaagtgaaaaagtcatcagcattgacattttgggttattcacgtgaccttgattggcagcctaatcttttatttatcaagaaatctaccttttacaacttaaatattatgctttatggatatgccaaacccaagattatctttaattgaatttgaccagcgctttggtttgggaagcatgcaatgatctttaaattcagtgtgaaatgcttctgtagaattatagcagaaagcccttgctataacctggcttagtgcagacatgcaaatctgagatagcacaaccagtttggctggactaaaggtgcagatgatcagtctaaacagcagtggtgataagcagaagaattccttataattggtacagtggggttatctaacagggacaggaagggcactcactgcatctaatgaggttcaggaggtaattgaagtgtgttaaatggtcaaaggtgagacttcagtttgagcttcaacttcacttataatgacttgaaataatgtaataatgtgccatattacttagaaataacacctagctgttaagtgtcacagcagcttctgcagtgatgtgacgttattgataatgagcattttctataagaggacattggaaactgatgttgcatactcattcagaatattgtttttaatgttgaagtgaaaacacttgtacctgtaattttagtcaaaaccaaatataatgttggtctgttaaaattttctgactcaaaaaaaaaaaaaaaaaaaaaaattttctgactcacgtactgagttcaaatacgttctgggtcaggcccaagttgtatacttggagatattaatgtaggtatgtgacagatatatactttgccgtacactgtttacatcacaagtgatcgcatgaaaatattgaatgtggtataagtagcactgaaagcaatcatttttaactgttgtgtgggtagattttgcccctccattatcaaaaaaactgtattctctatttaaatgtagtcagctactatcaatccagaagaaataaatctgcatttttccatttagcctttcatattttctcacattataaccaatgactgatttattaaatcacccttcagttttactgttgattttgtttgtttgctgatacattacagaaaatattataaatatttgttttaatgaagtgtgacattgtatcacttaaatctattgtttagtaagaatatgaaaattatgatgaggtttataacacaaaataaaaccaaataatactcaaggcagcttttgactttgtaatcagcgttaatacccataacaaaaaaagataactttgagatcatttatattttcttcagattcccctggcagcaccctccctctcatcccatacaacattcatatttttaatactattgttaaaaggaatctattaaaatctgagagatcaggtatttttttctaatcagtatttccatggaaacgttacatcagttttctaacttttctcttttcctaaaggaactgtgctattagagatacattaatttcttttcccagtgtttctcaccctaacctttttcttttcaaagttaaactgcagaaacagtgaaaaacttttagcagatgacttatatggtggttatttcaagtggcatgttcatttcttaagggtctataattttatttcctatagtcccaccagatgtgatggaggggtcaattaaattacctcagatttttgcttgaacctgggaggcagaggttgcagtgagccaagatcacaccactgcacttcagcctgggcgacagcagagtgaaactctgtctcaaaataaataaataaataaaaatttaaaagttaattacctcagatttcttggtgacttatactgctttattttatgttctgattggtagtattatatttaagtgaaattgtttgtttctaagtaaatggttttaagatgttatcaaaatttactcaccttttagttaaatcttaataatttttagatgtatatttgtaattcagaaagatcatcttcttttgagaaaagtatagtgttacagtttctgtgcaaaaaaaattgatagtaacatttccttttattggaatgtattaaaactttgtttccttgtttggggagaaaccattttgctttatttcattactgttaatacctgtgtatgtattaaaactagtataggctaggggcagtgactcatgccagtaatcccaacactttgggaggatgaggcaagaggatcacctgagcccaggagttcaagaccagcctgggtaacacagggagaccccatctctacatacaaagaaaaagaaaaaattaatcgagcatgatggtgcactcctctggtcccagctgcttgggaggctaaggtgagaagattgttgatccaggaaggtccaggctgcagtgagccgtgattgcaccactgcactgtagcctgggcaacagagtgagacgctatctcaaaaaaaaaaaaagaaaaaaccagtatagttgaaaaatccatgtatatagcaggctttgagtaagattagtatctattaccatttcaatttagggtgaaatgaatcagaatcataatttctgaaaatatagattaagtcctctttcattagattctagttgcattttttcaaagtgtatacactgttgaaaatgccttacaaatacttgatttttatcagtctggaggcctaagctctgagttctagctcctgagtgagtttcacagtagtcctgactggaggtgtgcgttcaactgtgggacgcgtgcttcttttcagactgcctgttcttccactgtatttgcctgtattagtagtcagtgctgtctcttaggtgtagtcttactgttgcaccccctaggaaggtagaaacattgggacaaagtataataaaacatgactgaaagaaatcttcatgttttctcttatgtaagaaatcttcgtattttctcttatgtacctgagacattattgctgagaggtccttaagatttatccagaactgcacctttgagttctcattgaagcccagagtgagtgattcatgaggaatttaccagggtgactttgttctctagtgatgcttttcccagtcttctgtgtatcttgctggggaggcacaccacggaattgtacagcttatctgtccctttggaggctcagagttggatagggaaataagagaacaaagagtatctcaagcaagcttgttgttgtttcattaaatgtttatcaagtaagtctggggttggcacttaacatcagttgcctcttttttttttctttcttacaacagatagcttgtgtggctaacagtgacttaagagtctaattcaaagattaagtgactaccacaggctcacaaatacgtaaataaatgctaaatctgggaattgaatctggatcttccaagttctaaaggctgtgcttttgccttcgttcttgtaccatcacaggggtacaaggggtacaagtcacagggggcctttggtggtgctccttcatatggcctccacctctctctccatggctagcttggacttcattgtagcataatgggtgcttttcaaaagcattccatgaaacataggcagaaactgcatgtctcttaagatccaatcctggaagttaaacaagtgtcatttcttttatattctcttggtcaaaataggtcatgggactagctaagattaagtggagttagtagatgatagactctacctcctgatataggcacggcaaaattgaatgcaaaagagcatgtgagatgggaaataatgtgaccatctttgaaaacacaatgtgctagcctgtgtttgtttactttatcataagtaaagacttgcaaagaaatatggaaatacagatcattttaagcatgtcaacttctagaatctcaggcttcataggtgttcttagctaaaattcatgtgcctgagagtgtacctgttttcactataactttctccttcacatgagaatgctgtcttccttacatttcctaaatcttactaatggtgatttgctgggatgtgaaaacccatagatatcaaacgtgggggaaatcttttttttttttttttttttttttttctgagacggagtctcgctctcccaaagtgctgggattacaggaagagccaccgcgcccggcctggggaatctcttataattaactaagatatctcaaactaatagaacttccagtttttcttttttttttttttttaatgtacatttctcttaacatgaagcttgcatacaaaagcagacatcatggtccatgttgatgtattctgaattcggatgcactggagtggggttgtggtagcatgacagtttttgttttaatgactttgccatttcattacgtgagtattgtcaaaaaatccattattgttgagagagacccttgggagagcaaagaaaagagagcatctgtaagaaaaaccaatttccaaaaagcagatcttataactgttcttagcactgtatcccaggacagatcattaattggaaagaaggtaactttcatgccaaagtgattttggaaggtaaaatgattgttgcagatgtgactggaatattctctaggaccatcaaattcgtagataaagcttttgcataatttgttgtatatttggtatctttttctataatgtagcatattttataaaatcatatcaagaaaattccatttaaagtgaagcatcttattttatcttatgaaattttatttttactattttctgtatcctgttaatgtaataatactatcacctaatatataaatttacatgttggcttctgagccaaataattttttacagtatatacctttttcttttattaaattcataggaaaagtttgtcatgtttaataaaatgagaaaggcatagtgttattcttttttcaatacactaagtactccaaaagccagaccccagagttgactatgcacataaatttactgaagagctattacatcttttatcatatttcttgtaacataaattattttagctgcattatattgcattgctgtaagttaattaatgagaaatagcatgttgctttacaatcttatttttataacctattttataaaagtagataaatcagttttatctgatttacattattgtactcttgactgcttttaacaatgtgtcctacaatatacattgagtcatttctcagcagtttttataatattccttgaaacacatattagcacatttatttgaattgaaaataaaaaacaaggtcacactcattctcgcagaaaatgactttcatttggaaacagcttttataggaaggactggctttgtgaattacgttatatggcagatattttctgtaaattgaatgaactagatcagcagttctaaatttctttttgttttttccttacattttattttatttattttattattattatactttaagttttagggtacatgtgcacaacgtgcagatttgtcacatatgtatacatgtgccatgttggtgtgctgcacccattaactcgtcatttagattaggtatatctcctaatgctatcgctcccccatcccgccaccccaaagcagtccccggtatgtgatgttccccttcctctgtccatgtgttctctttgttcagttctcacttatgagtgagaacgtgcggtgtttggttttttctccttgcgatagtttgctgagagtgatggtttccagcttcatccatgtccccacaaaggacatgaactcatcattttttatgtctgcatagtattccatggtgtatatgtgccacattttcttaatccagtctatcatttttggccatttgggttgtttccaactctttgctattgtgaatagtgtcgcaataaacatacgtgtgcatgtatctttatagcagcatgatttataatcctttgggtatatacccagtaatgggacgtctgggtcaaatggtatttctagttctagatccctgaggaatcgccacactgacttccacaatggttgaactagtttacactcccaccaacagtgtaaaagtgttcctatttctccacatcctctccagcacctgttgtttcctgactttttaatgatcaccattctacctggtatgaaatggtatctcattgtggttttgatttgcatttctctgatggccagtgatgatgagcattttttcatgtgttttttggctgcataaatgtcttcttttgagaagtgtctgttcatgccctttgcccactttttgatggggttgtttttttcttgtaaatttgtttgagttcattgtagattcttgatattagccctttgtcacatgagtaggttgcaaaaattttctcccattctgtaggttgcctgttcactctgatggtggtttcttttgctgtgcagaagctctttagtttaattagatcccatttatcaattttggcttttgttgccattgcttttggtgttttagatatgcagtccttgcccatgcctatatcctgaatggtaatgcctaggttttcttctagggtttttatggttttagggctaacatgtaagtctttaatccatcttgaattaatttttgtataaggtgtaaggaagggatccagtttcagctttctccatatggctagccagttttcccagcaccatttattaaatggggaatcctttcccctttgcttgtttttgtcaggtttgtcaaagatcagatagttgtagatatgcgacattatttctgagggctctgttctgttccattggtctatatttctgttttggtaccagtaccatgctgttttggttactgtagccttgtagtatagtttgaagtcaggtagcgtgatgcctccagctttgttcttttggcataggattgacttggcaatgcgggctcttttttggttctgtatgacttggcaaggcgggctcttttttggttccatatgacttggcaatgtgggctcttttttggttccatatgaactttaaagtagtcttttccaattctctgaaaaaagtcattggtagtttgatggggatggcattgaatctataaattacattggacagtatggccattttcacgatattgattgttcctacccatgcgcatggaatgttcttccatttgtttatatcctcttttatttcattgagcagtggtttgtagttctccttgaagaggtccttcacatcccttgtaagttggattcctaggtatttgattctctttgaaaccattgtgaatgggagttcactcatgatttggctctctgtttgtctgtttttggtatataagaatgcttgtgatttttgcacattgattttgtatcctgagactttgctgaagttgcttatcagcttaaggagattttgtgctgagacgatggggttttctagatatacaatcatgtcatctgcaaacagggacaatttgacttcctcttttcctaattgaattccctttatttccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatatgtcccatcaatacctaatttattgagagtttttagcatgaagggttgttgaattttatcaaaggccttttctgcatctattgagataaccatgtggtttttgtctttggttctgtttatatgctggattgcgtgtatttattttcgtatgttgaaccagccttgcatcccagggatgaagcccacgtgatcatggtggataagctttttgatgtgttgttggattcggtttgccagtattttattgaggatttgtgcatcaatgttcatcaaggatattggtctaaaattctctttttttgtagtgtctctgccaggctttggtatcaggttgatgctggcctcataaaatgagttagggaggattccctctttttctattgattggaatagtttcagaaggaatgttaccagctcctccttgtacctctggtagaatttggctgtgaatccatctggtcctggactttttttggttggtaagctgttaattattgcctcaatttcagagcctgttattggtctactcagagattcaacttcttcctggtttagtcttgggagggtgtatgtgtcgaggaatttatccatttcttctagattttctagtttatttgcgtagaggtgtttatagtattctctgatggtagtttgtaccatcggtggtgatatcccctttgtcattttttattgcgtctatttgattcttctctcttttcttctttattagtcttgctagcggtctatcagttttgttgatcttttcgaaaaaccagctcctggattcattgattttttgaagggttttttgtgtctctgtctccttcagttctgctctgatcttagttatttcttgccttctgctagcttttgaatgtgtttgctcttgcttctctagttcttttaattgtgatattagggtgtcaattttagatctttccttctttctcttgtgggcatttagtgctataaatttccctctacacacggctttgaatgtgtcccagagattctggtatgttgtgtctttgttctcgttggtttcgaagaacatctttatttctgctttcatttcgttatgtacccagtagtcattcaggagcaggttgttcattttctatgtagttgagcggttttgagtgagtttcttaatcctgagttctagtttgattgcaatgtggtctgagagacagtttgttataatgtctgttcttttacatttgatgagaagtgctttacttccacgtatgtggtcaattttggaatatgtgtggtgtgatgctgaaaagaatgtatattctgttgatttggggtggagagttctgtagatgtctattaggtccgcttggtgcagagctgagttcagttcctggatatccttgtttactttctgtttcgttgatctgtctaatgtttacagtgaggtgttaaagtctcccattattattgtgtgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgctttgtagatcttcctccatccctttattttgagcctatgtgtgtctctgcacgtgagatgagtttcctgaatacagcaaactgatgggtcttgaatctttatccaatttgccagtccgtgccttttaattggagcattgagcccatttacatttaaggttagtattgttatgtgtgaattttatcctgtcattatgatgttagctggttattttgctcgttagttgatgcagtttcttcctaaccttcatggtctttacagtttggcttgtttttgcagtggctgataccggttgttcctttccatgtttagtgcttccttcaggagctcttttagggcaggcctggtggtgacaaaatctctcagcatttgcttgtctgtaaagtattttatttctccttcacttatgaagcttagttttgctggatttgaaaatctgggttgaaaattcttttctttaagaatgttgaatattggcccccactctcttctggcttgtagagtttctgccgagagatcagctgttagtctgatggccttccctttgtgggttacccgacctttctctctggctgtccttaacattttttctttcatttcaactttggtgaatctgacaattatgtgtcttggagttgctgttctcgaggagtatctttgtggtgttctctgtatttcctgaatttcagtgttggcctgccttgctagatcggggaagttctcctggataatatcctgcagggtgttttccaacttggttccattctccccatcactttcaagtacaccagttagacgtagatttgatcttttcacatagtcccatatttcttggaggctttgctcgtttctttctattcttttttctctaaacttctattcacgcttcatttcattcatttcgtcttccatcgctcataccctttcttccagttcatcgcatcggttactgaggcttgtgcattcgtcacgtagttctcgtgccgtggttttcagctctgtcaggtcctttaagggcttctctgcattgtttattctagttatccattcgtctaattttttttcaaagttttgagcttctttgccattggttcaaacttcctcatttagctcggagtagtttgatcttctgaagccttcctctctcaactcgtcaaagtcattctccatccagctttgttccattgctgatgaggagctgcattcctttggaggaggagaggtgctctgatttttagagtttctagtttttctgttctgttttatccacatctttgtggttttatctacctttggtctttgatgatggtgacgtatagatgagttttttgtgtggatgtccattctgtttgttagtttcccttctaacagtcaggaccctcatctgcaggtctgttggaatttactagaggtccactccagaccctgtttgcctgggtatcagcagcagtggctgcagaacagcgaatattggtgagccgcaaatgctgctgcctgatcattcctctgaagttttgtctcagaggagtacccggccatgtgaggtatcagtccacccctactggggggtgcctcccagttaggctactcaggagtcagggacccacttgaggaggcagtctgcctgttctcagatctcaagctgcatgcctggagaaccactactctcttcaaagctgtcagacagagatatttaagtctgcagaggttattgctgtcttttgtttgtctgtgccctgcccccagcggtggagcctacagaggcaggcaggcaggcctccttgagctgtggtggcctccacccagtttgagcttccaggacgctttgtttacctactcaagcctgagcaatggcaggcgcccctaccccagcctcgctgtggccttaccgtttgatctcagactgctgtgctagcagtgagtgaggctttgtgggcataggaccctccgagccaggtgcaggatgtaatctcctggtgtgcggtttgttaagcccgttggaaaagcacagtattagggtgggagtgacccgtttttccaggtgccatctgtcacccctttctttgactaggaaagggaattccctgaccccttgcgcttcccaggtgaggcgatgcctcgccctgcttttgctcacacacggtgcgctgcacccactgtccggcattccccagtgagatgtacccggtacctcagttggaaatgcagaaatcacccgtcttctacgtcactcacagtgggagctgtaggctggagccgttcctatttggccatcttggctccaaccccaactccttacattttattatggaacatttcaaacatgtagaaagatagctgaatgagacagtgagtatgcttctaatagaatgtacctgtcacccagcttcagcagttaccagctcatacccagttattttttcatccacaacttttcttccattttcctttttttacaccttggacattttgaatctataaatatttcaacatatatccttaagagataaggcttttttttttttttttcaggagatggactctcactctgtcacccaggccgaagtgcagtggtacgatcatagctcactgcagctttgagctcctggccgcaagcagtcctcctgcctcagcctcctgagtagccgggactatggatgcatgccaccatgcctgactaactttttaaaattgttgttggagataggatctcactatattgctcaggctggtcttgaacccctaggctcaagtaatcctcccacctcagcctcctgagtagctggaattacaggtgccagccactgtgtccacctaaagatttgttttcaaaaatacataatcacaacatgttcatcacacctaaaaaactaagaatagtttcttaatattacatttccaggaatattttgatcaaaatatattaaagcataaaaaaagtagaaatattttattaaaccgtatattattggcaaagatacaataaaaagatttctcaaaccctttattagcctacttttacttgattaaatgaggtgcctctaaatgaagagtaattggtatagctaatagttatttttttagtggtgcttatagttatttgataaacgtttgtaatgcctttggtttacttctcaaaaattgagaagcaaatgggtctaatgaattgattatgcatccttttacaactcaggggctttccagctgcttactttgaacagcttaaaggaagaagacctaatggatagagcactgaaagttatttttgttgataagtaactgtgatttttttatatttgactacagaggggttcaaaaaactgagaatccttgctgtaataaaccttttttcattctaatctgccttttcacatgagcaagatttcttagcatttacatctatgaaaatgaaaagtaagagtagactgtatgcctggatactgtctcattctagcaagaatgcatattattttaaggataaataaactaatatattttaaagctttgttcatcactcttaaaaatgcgtttccaataaaattttacctttggcttaattatcaaactaataaaatgtattttcatcaattgtttgctgacagtttaaataattcaacttcaaagggagtttttttaaacgctgagatccatgagcaaaaccaattaaatgcaaactttattttttttagctgatttgtttttaattttattattattatactttaagttttagggtacatgtgcacaacgtgcaggtttgttacatatgtatacaaactttattttatatgatagttcatagatgaattttttgtttggagaattatcccagaaccatcactaaaaagaatccacatataaaatcattttacatcatgataaagttttctgagaaaaatggaatggaagtacaagttcaaggataaaagggaaagatgtacaatttctgaatattcaagtagacctttatgtgttttttttgttttgttttggaattcttttgtggatgatgggggatggatgacaattcaattatatttatattccactgtatgcatttttaaagtaatcattttattttaaaattttaataattataatagattcaaatattacctattttgcagctatttgtgctgatgaaaacgtttagattgttttcttagaaattatttaatgtgttagctggtatatagtttttcagcattcaaaattctttcgaagcatatctgggcaaagatgtttgaagaccgcaggactaaagaactaggcagcctggagaagtagattcttcttcatgccagaaccatctcctagtaactgcttttacctggataacttaaataatgataattcaatataagctgatcattcaaaagtgggtggattagcagtcatatgaagaacagttaccacaggcaaccaaaagctacagctgacattaattacatttaaattcattctttgacaaattcattctttgagattaagggtgatgatgcccacaaattagaaaactttgatataattttgtttcttgtgcgggaaaagctagtaattggaattttctacagaggtcaagaaatgtcaatgatacactcagtgtggcttagaatgacccactttttcctctgtttctctttttttgtaatcagagcagtttttatgtgtgaccttagccttcaaatggagttgggcacatatatgaaaatattatactttatgtgagttcagttgcttgaaaaatatggtatctgctttttattgctgaaaaactataatttgtacaaagagcaactttttttctttagcttttaagttcagggatacatgtgcaggatgtgcatgtttgttacacaggtaaatgtgtaccatggtggtttgttgcatggatcatctcatcacctaggtattaagctcggcatcccttacctattcttccctgatgctctccctccaagcctctgcctctcaaaagccccagtttgtgctgttccccgcaccctatgtgtccatgtgttctcatcattcagctccgacttataagtgagaacatgtaatgtttggttttctgttcctgtgtcagtttgctgaggataatggcttccagctacattcatgtccctgcagaggacatgatctcattctttttatggctgcatcatattccatattccatggtgtatacatgtaccacattttctttatcctgtctatcattgacaagggtttaggttgattccatgtcgttgctatcgtgcatagtgctgcaaggaacatatgtgtgctttgtgtgtatacccagtaatgggattggtagatcaaatggtatttctgcctctcggtctttgaggaatcaccacactgtcttctacaatgattgaactaacttacactcccaccaacagtgtaaaagtgttcctttttctccacaaccttgccagaatctgttgctttttgactttttattaatcaccattctgacaggcatgagatggtatctcattgtggttttgatttgcatttctctaatgatcagtgatgttgagcttttttttcgtgttttttggccacaggaatgtcatcttttgagaagtatctgttcacattctttgcccacttttgaatggttttttttttttcttgtaaatttgtttaagttctatagactggatattagaactttgtcagatggatagattgcaaacattttatcccattctgtaggctgtcagttcaccctgatgatagtttctttcgctgtgcagaaactctttagtttaattagatccctttgtcaatttttacttttcttgtaatgctgttggcattttcatcatgaaatatttgcctatgcctgtgtcctgagtggtattgcctagattttcttctaggatttttatagtttaggttttatattttaagtctttaatccatcttgagttaatttttgtatgtggtgtaaggaaggggtctactttccattttctgaatatggctagccagttccaaagagcaacttcaacggtagaaggattaatgaatattactttcaactataaacctattaacactttagttcttattgacaactatatatatatatatatatatatatatatatatatatatatatatatattcagtttttatttattcactttagttcttattgacaactatacgtgtgtgtatgtgtgtgtgtgtatatatatatatatatatatattcagtttttattcatcttaaaatgcaccacaaaaagaaacaactgttctttcattttctgtacacctttggtaaacatcagaacagtaaatagacaccgtataaaataaactcttaaggatcagctgctgccttttaagaggtgtaactgtaaaatagcaaaacataggcaataagtataaaacttaaaatactgtgaagaacttaagtgttgattttaaatgttcaaaatggcaagattgcaattaatatattgttaggagtggcaaattcatatttgttaggcgccaggaaggaaaccagagtgagtgaagcaatttgggaaaattaacacttgggttgtctttagacgctagctctgtctgaacaaagccagttggttgccagaccttctgatatttctgatatttccagagaagctgaaaatccagacttgtatatgaaatcagattttctttttaagttatagcaatgaattcaagattcttaaaggagtatatgggcccaataaaacacatctttatgctcaatttggctgatggtctgtccctttatgacttctgatttatcacttttctagagtcttcctttgaaataaacatttggtttaatagctcctaggaaaaaatgtcacaaggtagttgagtttttccaaaattctagccataatttatttcagagttagcctactaaaaaatttgtagggaatgagatcagtaactgctcaggttagagacagagccacgtgatcaacctcattgagctttactctataaaagtctgtgtttttaatcattcttggcctataacatgaatttgatggcaaaattaggaaagttttctgaaattactttgggttaaacttgtcagagaatctttaacccaagtctgattattttgttagtaatttaaaatactttaatgcttagaaattattgaactgatgaataaatggtctatcttaaaaataagttaatcagtcattattaaattggatataagtgaaactattttaaagatttctaaccttgtatatggtgaaagaataatcaaatcagttgcttggcgtgaattaccttacaacatatgctaaatgcaatttctcaattcattttaatattttcttattaccatgactttatattatagagttcagattaaaataatgaaattagtctgtatgaatactgcttggttttgattttactgtcttatttaggttaaagtgtgtttaggccctgcttgtgctaaaatatgtgtagaaggctattggaaagaggttgctgtttgtagaacacattttgtgtagagaaaattttctcctgatgaatgcttattctttttcccagattccacctgccaagaacaaattagtccattgtgtcttgctgatttccaaagacatcaataccaaattcacaattataaaccttgtttgctatccagtcagttgaatactgcgttgacaattaagttggacttaaatagccttaaattgctctatggagatgacatatctgtggtttcatattggactggaacatattactatgaaaacggtagtgacttctaactgcagtagagaagaataggaaatgctgcttgagactgaggttcagtctagccggcattcactgacatttcatgggagccaggtcctggttaggcattgtggctacagatattgatgagtcaaggtttctggggaagctttacagcatcaaagagaaagttcctaaagtaactttaatgcaaaccaaaatgctgttaggaaggaaaagtgtggcaggaaaacagagaagagagaagatcttttggagaaagctgatttgagtagagccttggtaaatgggggaattctcacctagtgagaaattataggggaatgactttatttaaacttgctctttcttctatagttgatagaagtactaccagtgttaccttctggttttgatatttatactgtggttgtataagatgttaatattaatggaaactgaatgagagataaatggaaactttgtgctatgggctttccttagtaagataaaattcacataacataaaactttaaatttatcatagaatccctaggtgtataattgataaagtgtacaatttagtatcatttagtacatttacaattttgcacaaccatcagctctatctggatcccacaccattttataactgcaaagggaaccctgtacccactaagccagcagtccccaacctttttggcaacagggaccggtgtcatggaactcagtttttccatggacagggtcagaggccaggtggtgggggtggtttcgggataaaattgttccacctcagatcatcaggcattagattctcataaggagcacacaacctagatcccttgaatgtgcatttcacaatagggttcgcagtcctttgagaatccaatgccaccactgatctgacaggcgacggagctcatgaggtgatgctcacttgcctgccgcccacctcctgctgtgtggcccagttcctaaaaagccatggacctgtagtggtccacagcccaagggttagggaaccctgcattaagcaatcactcccttttgtctctcagcacctgacaaccacaaatctgctttctgtctctatagatttaactattatgaatatttcacataaatggaattctccagtacgtaaccttttgtttctgccttttttcacatagtatgtttttaaggatcatccattttgtactagtctgtattgtattagtaatttagtcatttttatggcttaataatagtccattgtatagatatatgacattttgtttatccatttatccactgatgggaattcgtgttatttccacttgtgggctattgtgaatagcactactaggagcattcatttttcaagtatttgtttgtttacttatttttaattatcttggatatatagctaagcgtagaaatgcaggatcatatggtaattctgtgtttaactttttgaagaactgccaaactgttttccagagatccttttagttctttcatccattctgagttaaattttgtatgtagtgtgaagtagggacttcaatttattcttctgcatggtccaaaactttagaattaatatttgtaaaagagaatcattattattttccacaatattagaaaaccttgtatgacattaatcatttattttctgattcatttaaaaaagattaaagataataaatatgactgctaaaactataaaactcttagaagaaaacaggcaaattttcatggccttgcattaggaaatggattctttgatatggtaccaaaagaacaaaaaagaaatgaaaaattgatatattggacttaatcaaaattaaaaacttgtactatcaagaaagtgaaaagatgtccgggcatggtggctcacgcctgtaatcccaacactttgggaggccgaggcgggtgaactgcctgagctccagagttcaagaccagtctggccaacatggtgaaaccctgtctccactaaaaaaaaaaaatacaaaaaattacccaaacatggtggtacatgcctataatcctagctacttgggtggctaaggcaggagaatcgcttgaaccctggaggcggaagttgcagtgagcggaaatcgcaccactgcactacaacctgggtgacagagcgagactctgattcaaaaaaaaaaaaaaaaaagaaaagtaaaaagacaacccacagcctaggagacaagtcatatactagataaaggcctaatgcccagattatataaagaactcttaaaacgcaccaacagggactgagggtaatggtcttataatcccagccctttgagaggccaaggaaggaagatccctttaagccaggagttcaagactagcctgggcaaaaaggtaagacccgtgtatctaaaaataaatggatggatggatgaatggatggatcgatggatggatagcagtaaagcaatacataacatacataacacaatttaagaatggaaaaataatttgagtagacatttctccagagaatgtatacggatggccagtaaccacagcaaacatgttcagcatcattagctatcaggaaaatacaaatcaaaccacagtgaaatactgtatcacaccctctaggatagctgtaataaaataaatggacaagaataagacaggatttggagatactggaattctcctacattgctgggtacaaatgtaagatggtgaagtggaaaacagttcaacaattcctcaaaaagttaaacatatattcctctatgacccaacaattccactcctaggtatataccaaaaagaattaaagacatatgtccacataaaaacttgtacatgaatgtttgtagcagccaaaaagtggaaacaagccagatcttcagatgaatggataagcaaaatgtaaacccatacaatggaatattattccgctatagaaagaactgaggcactgatacatgtttcaacatggatgaacttgaaaacattattctaactgaatgaagccaaacacagaagaccacatagtgtatgattttatttatgtgaaatgtcctgaatagagacagaatgcagatttgtggttgccaataaggggaaatagagtacacaatttcttttttggtgtgatgaaaatgctttggagttatatagtagtgacgattgtacactgtgaacatactaaaaaccactcactgcactttaagagaatgaattgtatgttgaatatatcaatgaaaataaataaatttaagtgttttgcatgcagagatttttattttaaaataatgctcatttgatgtttgccttaagaaaagtatttttattttattttttaggaatttatcatggcatccagcattgaccactacaagtaaaatgcgaattccacattctcatgcatttattgatctgactgaagattttacagcaggtgagttgcacataaatctggaattgttttgagttaccaaagaagtatgggattttatttactgtacactttgtatttaattgctaatgaagtaaatgttgaaattaatgtttaaaggatgttagaaagtcagtgatttggaaacatggaaaaagtactgactgtaataaataagtctttagctattgttgtttttgttgttcattaataactgcctcagaatttgaattctctactttttatgaattcatgataatttcagcacatgttgcctgctgttttttttaccttttttattaaaaatttttaaaataatatgtgctacaaatttaacaataagaaaaatctttagcttatgtacaagaataatttcacaggcttttaaaacttgttatcatggaaaattttaaacagaaaattggacagaatattataatatatgcacatttaaccgtcacctagcttcaacaattatatggcccaatcttgtttcccctgtaaatgcacctacaagttcctcctatcaaagataattttaaagtaaatcccaaacatataatttcacttttaaatatttccatctgtatctcagattacaaggacttttttatttaaaactgccagatcattttgaaatctaaaaaaattacacaataatttctttttttgagagggtctcactctgttccgcaggctggagcacagtagtacatgcgatcacagctcactgcaacctctgcctcccaggctcaagctatcctcccacctcagcctcgagagcatctaggactacaagcatgtgccattatgcctggctaattcttgtattttttgtagagacagagtttccctatgttgcctagactggtcttgaactccttggctcaagcaatccacccacattggcttcccaaaatggtgggattaccagcatgagccaccacacccaatcaacaacaatttcttaatgtcattgaatatctagtcattattcaaaatgcccagattttctccgacatgtttttatcaaatcaggaagttaaacaaggttcatgccgaagtagagaaaccatctgtgctgtacacatctgtgctgtacagttgtgtggatttttcagattgtatcccaatggagttaacatgttactatgttcctagaatcagaattcttttttttggagacagagtctcgctctgtcgcccaggctgtagtgcagtggtgcgatctctgcccactgcaacctccgcctcccaagtagctgggactacaagcgcatgctgccacgcccagctaatttttttgtattttagtagagacggggtttcaccatgttggccaggctggtctcgaactccagagctcaggcaattcacccacctcagactcccaaagggctgggattacagacatgaaccactgcgcccagccacagaatcagaattcttttgtgggtggtgggagtgggaatatcaagaatatttcctaggtgttgctgtatgtttcagttcattaggtgatacagtttaagttctctctcttctgtgatattaaaattgatcagtaggttcagttttcctcagcatagatcatccattacagtattctctaatggttaggaggtatgaatgattattgtcagccccattatttcaacaggagttgcaaaattgtgacacactaaatctgtcactctactgcaggtataattagctaaattttctgttaaaaagaactcccatcctcagttctttagtcacttgcagtacagttgagacaggcaagataaatacttgatttccccacctccgcccccacttcccacctgtttttgtgagcattcaaacacttaacagtctgattttacagttacatttttatataatgtactaattgcaaatgagtaaagcaggcctagtggctgtgagatgtaataaaacttattttctttaaaagtattccatgatgcaaaacctaattttcattgagaaacaggtagaaaataatattgcataatttaaacctcttaattctggattgattatgacttttgctacaacattttcattattgacgtacgattttcaaagttaaaaatatttagtgcccaaatacactgtggattttactgacttaaaaccacaaatttaaccttttatctagtaaattttttatgaatctaagattctaggtacttcaatatgcttggtatgttttggtggggaggagaggggagaatttaagaaaagaaaacatattatttttagtgtggtttatctggtatgccaaatcacatgaaaacctcaataataaggtgttgactacattgcaatggaagttgtcttagaaacttgcttttcaagatgagaacattctatacttataggttcatttttttaatcttatttttgttatacacacacatccaaacttttgtttcttacaattcctttttaggaaaaatctatcttaatgaagctttagaaatgtacttttagttcaatagtatgagacttccttaaacaatactgactttgcatttaagtaagccgccaccagggctactgctacccatctgcacaagcaaagtgaatgaagaagaaataagtctttcctagacatgcaaaagctgagggaattcattaccactggaatggccctacatgaaattcttaagcgagtcctgcatttggaagcataaagacagtatctaccatcatgagatcacacaaagtataaaactcactggtagctcagacacacaaataaaaaagagaaaggactcaaatgttaccagtaaatgttaccagtacagaaaaccaccatatctcattgataaacaataagagataaagaaaggacaaaggatacgtatgcaaaacaaccagaaaacgattcataaaatgaaaggaataggccaggtgcagtgactcactcctgtaatcccatcattttgggagattgaggcaagcagattacttgagcttaggagtttgagaccaatctacgcaacatggtgaaaccttgtcgctatcaaaaataaaaattagccaggcatggtggcacacgcctgtgaccccagctactcaagaagctgaggtaggagaatcacttgatcctgggaggcagaggttgcagtgagctgagatcatgccactgcacttcagcctgggtaacaagagtgcagaccttgtctggaaaaaaaaaaaaaaaaaaggagcgtcacttccaagatggccaaataggaacacctctggtctgcagctcccagtgagatcaacgcagaagacgggtgatttgtgcatttccaactgaggtacctggttcattgcattgggactggttggacagtgggtgcagcccaaggagggcaagctgaagcagggtggggtgtcgccttacccaggaactgcagggggtcaggggatttcctttcctagccaaagggaagccgtgacagactgtacctggagaaacagtacactcctgactaaatactgtgcttttcccacggtcttagcaaccagcagaccagaagataccttcccgtgcctggctccacgggtcccacacccacggagtgttgctcactgctagcgcagcagtctgagatcaacctgcgatgctgcagcttgacagggagaagagcatccaccattgctgtggcttgagtagcttacagtgtaaacaaagcggcctggaagctcgaactgggaggagctcactgcagctcagcaaggactactgccactagattccaccactgggggcagggcatagcagaacaaaaggcggcggacagcttctgcagacttaaacatccctgtctgacagctctgaagagagcagtggttctctcagcgtggcgttccaactccgagaacggacacactgcctcctcaagtgggtccctgaccccaatgtagcctgactaggagacacctcccagcaggagccgacagacacctcaaacaggcaggtgcccctctaggacaaagcttccagaggaaggatcaggcagcaatatttgctgttctgcagccttcgctgttgatacccaggcaaacagggtctggagtggacctccagcaaactccaacagacctgcagctgaggggcctgactgttagaaggaaaactaacaaacagaaaggaatagcatcaacatgaacaaaaaggacatccacaccaaaacccaatctgtaggtcaccaacatcaaagaccaaaggtagataaaaccacaaagatggggagaaaccagagcagaaaagctgaaaattccaaaaaccagagcacctcttctcctccaaaggattgcagctcctcaccagcaagagaacaaaattggacgaagaatgagtttgatgagttgacagaagtaggcttcagaagatcgttaatagcaaacttctccaagctaaaggagtgtgttctaacccatcgcaaggaagctaaaaaccttgaaaaaaggttaggcgaatggctaactagaataaacagtgtaaaaaagaccttaaatgacttgatggagctgcaaaaccatggcatgagaactttgtgatgcatgcacaagcttcaatagctgattcgatcaagtggaacaaagagtatcagtgattgaagatcaaattaatgaaataaagtgagaagacaaggttagagaaaaaagagtaaaaagaaatgaacaaagcctccaagaaatatgggactatgtgaaaagaccaaacctacgtttgattggtgtacctgaaagtgatagggagaatggaaccaagttggaaaacactcttcaggatattatccaggagaacttccccaacctagcaaggcaggccaacattcaaattcaagaaatacagagaataccacaaagatactccttgagaagagcaaccccaagacacataattgtcagattcactaaggttgaaatgaaggaaaaaatgtcaagggcagccagagagaaaggtcgggttacccacaaagggaagccgatcagactaacagcggatctctcagcagaaaacctacaagccagaagagagtgtgggccagtgttcaacattcttaaagaattttcaacccagaatcccatatccagccaaactaagcttcataagtggaggagaaataaaatcctttacagacaagcaaatgctgagagattttttcaccaccaggcctgccttacaggagctcctaaaggaagcactaaacatggaaaggaacaaccagtacaagccactacaaaaacatgccaaatggtaaagaccatcaatgctaggaagaaactgcatcaattaacgggcaaaataaccagcgagcatcataatgacaggatcaaattcagacataacaatatcaatcttaaatgtaaatgggctaaatgccccagtttaaagacacagactggcaaattgaatagagtcaagacccattgatgtgctgtattcaggagacctgtctcatgggcaaagatgcacataggctcaaaataaagggatggaggaaaatctacctagcaaatggaaagcaaaaaaaaaaaaaaaaaaatcagggattgcagtcctggtctctgataaaacagactttaaaccaacaaagatcaaaagagacaaagaaggccactacataatggtaaagggatcaattcaacaagaagagctaactatcctaaatatatatgcaccaatacaggggcacccagattcataaagcaagtccttagtgacctacaaagagacttagactcccacacaataataatgggagactttaacaccccactgtcaatatcagacagatcaacaagacagaaggttgacaaggatatccaggaactgaactcagctctggaccaagcggacctaatagacatctacagaactgtccaccccaaatcaacagaatatacattcttctcagccccacatcgcacttattctaaaattgaccacataattggaagtaaagcactcccacagaaatacaaactaccatcagagaatactataaacacatctatgggaaaaaaaaactggaaaatctagaaaaagtggataaattcctggacacatacaccctcccaagactaaaccaggaagaggttgaatctctgaatagaccgataacaggcttggaaattgaggcaataattaatagcctaccaaccaaagaaagtccaggactagacggactcacagccgaattctaccagaggtacaaagaggaactggtaccattttttctgaaactatttcaatcaatagaaaaagagggaatcctccctaactcattttataaggccagcatcatcctgataccaaagcctggcagagacataacaaaaaaagggaattttaggccaatatccctgatgaacatcgatgtgaaaatcctcaataaaatactggcaaaccatctcatgccagttagaatgtccatcattgaaaagtcaggaaacaacagatgctggagaggatgtggagaaataggaacacttttacactgttggtgtgagtgtaagttagttcgaccattgtggaagacagtgtggtgattcctcaaggatctagaactagaaataccatttgacccagcaatcccattactgggtatatacccaaagattataaatcatgctactataaagacacatgcacacgtatgtttattgtggcactgttcacaatagcaaagacttggaaccaacccagatgtccatcaatgatagactgggttaagaaaatgtggcatatatacaccatggaatactgtgcatccataaaaaaggatgagttcatgtccttcgcagggacatggatgaagctggaaatcatcattctaagcaaactgtcacaaggacagaaaaccaaacaccacatgttctcactcacaggtggcagtggaacaatgagaacacatggacagggggcggggaacatcacacaccagaccctgttgctgggtgggggactgtgggaggtatagcattaggagaaatacctaatgtaaatgacgagttgatgggtgcagccaatcaacatggcacatgtatacctatgtaacaaacctgcacgttgtgcacatgtaccctagaacttaaagtataattttaaaaaaaaggaataattaatcacctatcaaatataaccttgattgtaaatggcttaaattttccacttaaaaatatagactggctagtccgggcatggtggctcacccctgtaatcccagcactttgggaggccaaggcgggcggatcatgaggtcaggagatcaagaccatccttgccaacattctgaaactctgtctctactaaaatacagaaagttagctgagcatgttggtacgcgcctgtagtcccagctactcaggagcctgaggcaggagaatcgcttgaacctgggaggcagaggttcagtgagccaggatcgcgccactgctctccagcctggtgacagaacgagactccatctcagaaaaaaaaaatatgtatgtgtgtgtgtgtgtgtgtgtgtgtgtgtgtgtgtgcatatgtatgtatatatgtgtgtatatatacatatatatacacacacacatacgtttttagactggctaaatggattcttttaaatgacctacctaactttatgctgcctacacaacactcacttcacctgtaacaacatgtatagactgaaagctaaggggtgaaaagagatattccgtgaaaacagaaaccaaaaatgagcaagagttcttatacttatattcgatgaaaggtaattgaacaaaaaagagacatataaggtctttatataataataaggagaacaattcagcaagataatgtaatcttaatatatacgcatctaacagtggagcacccagatacataaagaaaatattattatatctaaaggcagagatagactctgtcttaatccatttgtgttgctataaaggagtgcctgaagctgtgtaatttgtaatggaaaggggtttaggtggctcacaaatcttcatgctttacaaggaacacggtaccagcatttgcttctggtaaaaggctcagactgcttccacttgtggtggaaggtgaaagggagctgatatgcacagagatcatgtagcaaaaaataggacacgagagagagggaagtaccagtctctttttaacagcaggatctcgaggatatttttatggaaattaatacagaactcaatcattaccgtgaggatggcaccaagacattcataagggatctgcccccatgatcctcacgcttcctcttaggcccacctccatcattgtgaatcagatgtcaacgtgctttctaaactatagtagactccatccagtacattaatagttcagcacttcaacatcacactctcactgttgcacagatcatctagacagtcaataaagaaacattggatataaactgtacattagaccaaataggcccaacagacatttacaaaacattttatcccacagctacagaatacatatttttctcatcagaatattattacttttccaggacagaccagatgttaggccacataaaaaaaatcaactaatttttaaaaattggcatcatatcaagcatcttctcatgccacaatggaatacaactagaaatcaatgacaagaggatctttggaaactgtacaagtacatggaaataaaacaacatgctcttggtcaaccatttactcaataaattaaggcagggcatggtggctcgtgcctgtaatctcagcactttgggattgagctgcagtgaaccatgattgcaccattgtactgcagcctgggcagcaaagcaaaagctggtctccaaaaaaaaaaaaaagagaagataaagaaaaaaaggtgaaagagtctgcccaataagacctgaagtagggcgggcgtcgtggctcacacttataatcccagcactttgggaggccggggtgggcggatcacttgtgatcaggagttcaagaccagccttgcccacatagtgaaacctcatctctactaaaaatgtaaaaattagccgggcatgactgtgggcatttgtaatctcaggtacttgggaggctgaggcaggagaattgcttgaacctgggaggcagaggttgcagtgagctttgtgccaccacactccagtctgggtgacagagtgagactccatctcaaaaaaaaaaaaaaaaaaaaaaagacctgaagtaaggccgtgaaagtgcaagggaacaggtgcagtggctcacgcctataatcccagcagtttgagagtccaagttgggtggatcgcgtgaagtcaggagttcaagaccagcctgggcaacatggcaaaactctgtctttacaaaaaagtactaaaaaattagctggacttggtggcatgctcttgcagtcccagctgcttgggaggctgagatggggggattgcttgagcttgggaggttgaggctgcagtgagcaatgattatgccactgcactttagcctgagtgacagagtgagaccctgtctcaaaaaaaaaattaagaaggaagtcccttggggccaggtggccaaagccacaatacactatgattgcagctgtgaatagcaactacgctccaccttggacaacatagacagactctgtctctaaaaccaatcaaaaaaacttagcaagccaaatccaagaacacatcaaaaagataaaacaacgtgaactagtgagatttatctcagaaatacaaggatggttcaacatatgcatgttagtagattaaaaatagatatctcatgctcatggaccataagaattattatcattatatgaccatatttccaaaagcaatctacaaattcagtgtaatctctatcaaaataacaatggcattcttcacagaaataggaaaaacaatcctaaaatttttatgaaacaacaaaatatactgagtagtcataacaatactgagcaaaaagaacaattctggaagcatcacactgcctgagtttaaaatgtgctacagacatatactacaaagttatagtaaccaaaacaacatagaactagtataaaaacaaacacagacacaaagaccagtggaacagaatagagaacccagaaataattccacagccaactgaattttgagaaaggcaccaagattatacgtcatggaatagaaactttctttaataaatagtgctgggaaaactgtacatcagtatgaaaaagaatgaaattagtccccccaccatgatatacaaaaaattaactcaaaatgaatgacccaaaactataaaattactagaagaaaacataagggaaacacttcaggatattggtctaggcaatgattttatggctaggagttcaaaagctcaaaaacaaacaaacaaacaaaaaaatttcaaaaacaaaaaaaagataaatgggactatgttgtgctaaaaagcttctgcacctcaaaggaaacagtcagcggagtaagaggcaacctgtataatgagagaaaatatttggaaactgttcattaggcaagggacaaatatccataatatacaatgaactcaaagaattcaacggtaagaaagcaaataatcctattgaaaagagggcaaaggatctgagtagacatttctcaagaaaagatatacaaatggccaataggtttatgaaaaaatgctcaacatctctaatcatcagtgaaatttaaactacagtgaaatatctcattgttattcaaatggctgtcatcaaaaagatcaaaaaaaaaatctcaaacaaatcctgctgaggatgcagagaaatgagaacacttatacattgtttgaaatgtaaattagtacagccattatggaaaacagtatggatgtttcacacaaaaactaaaaatggaactaccataccatccagcaatcccaccaatgggtatttatcccagggaaaggaaatcagtatattgaagggatatctgtacccccatgattattgcaatagtactcaaaataggcaatatatggaatcaacctgagtgtccttcagctaatgaatggaaaaagtatggcatatatacacaatggaatcatattctgccataaaaaaagaatgaaagcctgttatttgcatcaacatgtgtattgagatcattatgttaagtgaattaagccatgtacagaaagtcaaatatcacaagttctcattcatatatgggagctaaaagagtttatctcatagagatagtcaataatagttaccagaagcaaagtgtagagtgggagatgaaaaaagagtggttaatgggtataaatatacagttagaagaaataagttctaacattcaatagcacatcagggtgactgtagttaacaacagtatattctgtatttcaaagtagctagaagagaagaattgaagtgttcctgacacacagaaataaatattcaagatgatagatgtcctaaatatcctagtttgatcattatatattatacacatgtatgagaggcatttgcttaatctgttgtataaaatgtatagcaattatctttgatgagtgatctttcagaaattatatgaggaagttttaaaatgttaattattgtagttgtgttatatagaaccctgtttctgcttttgaaatcatttcagcaaaccttcagagtacctgcctcatgcaaaggcctctctgctattcattgtatgagatacaaagatgacaagaagtgccatcagccatcaaaaacaatttagtttactgggagtagctgacaagtctagccattatgtgtggcagaatgaaataagtgcatattagttatgaactactatgtagcaataacaggtaatagtaagcagtagtcccgctatcttgggactgtcatgtcctacaaatttagctaagaatttggccaatttttataaaatggtatacacttctcattgtccagaatatattcattcctagaacactgtgttagtccttttgtgttgacataaagaagtacctgagactggataatttacaaagaaggggtttattgtggctcatggttctccatgcttcttctggggaagcctcaggaggcttccaccaatgttggaaggcagagggagagcaagcacatcatattgtgagacaggaacagagagagaggggggaatgccaggctcctttaaacaatcagctcttgaatgaactcagaaccatggggagggcaccaaaccattcatgaggggtccactcccattacccagatagatacttcccactagggcctacctccaacattggggctcagattttaacatgagatttggaggggacaaacatctaaactatatcagacatacaaaacttttgcaaacaataagctttagctgaaattcttaatataaagagaacttcctgttgaagaaaaaacaagtaatgtatgaattctcagttttttctttttaaatatttttagttcttaatttttttaaatagtcaaatctatatgacttctaatgacttatccactatatgattataacaatttatttaacatctctttttttttaagttatgtatgttgtttctggttttttaaatttttattttatttttattgctctggtgcctgattttgtggacatcgctcataatctcatgaagagtttctgcatatgaaataaatggttaaacaagtataaaggtgttttttgttttgttttgttttgtttttgagacacagtttcgctcttgttgcccaggctggagtgcaatggtgcaatcttggctcattgcagcctctgcctcctgggttcaagggattctcctgcctcagccccctgagtagctgggattacaggcgcccaccaccatgcccagctaatttttgtatttttagtagagacggggtttcaccatgttggccaagctgggctcgaactcccaacctcaggtgatccgcccacctcagcctcccaaagtgctggggttataggcatgagccactgcacacggcaagatttttaaagaggtgaaacacttatcttgccctgaagaaaggctcatgagagtgcttatttctctcatttttgccagcactaggtattaccttttttgaattatcattggatgattggatccaatcattatgattggaaaaaatggtatttcattatgattttgatatgcatatcttacattattgaaatggaattcctttttcatatgtgaaaaccatttctgttttttctattactgatttttagcttttcctaaattctctgctttgcaaattctgttattctgacaaccaaggcatttatatacaaccacaggcaattccgattcatctctgctacagttttccaaatagtcttcaaggactgaagttctttaataccacattctttatagtaacctgatcatgtcattctgattgtctcactttcttcgataatccactttaagaaaataaattctgtcttttagtaaccccactcttccatgcatagcagaagtggccatctgttacctaaagtcgactctgttatattcctttattcttgcaaaggaaactcaaccttatcttttcacctcatttcataactaaagaataagcatctgcattgaggaaacaatgacaaaatatcagcatccaggttcttgtccaacaatggaatatatgtatcatgaggacggctgagaatgaagatttttatggttgaaactgcagacacatgggaacattaatatcccttgatattcttgatttgaagaatttgattttagacaacagtgtatttgaggcaatggatgggatattcatgcaggcacccagtttcaatttgtccctagagcctgaaaaacagatcaaggtcagagcctaaaaagtgtagagttcttccatattgttgaagccatgaaaatggctaagcttcaataaggtgaacttatagtggtaaaaacagaaggctatgaactcaacatttattttattttattttattttgaattatttaaaagtagtataattaaggtaagaaattaaaacagttcaaaagtatataaaggagaggcaactactatcttcattttcttcttcctgaagtgttctttgcagatacatgcacattttccttttttatccgaatggaattgtgtatagaattgtgattctttcttaattcagatttattagtatattgacacatatggattgacctgggtttttgttgttattgttttgggggattttgttgttgttgttgttgttgtttgttttttgttttttgttttttgttttacgacagagtctcactcagtcacccaggcttgagtgcagtgtcgggagctcagctcaccgaaacctctgcctcccaggttcaggcaattctcttgcctcagcctccctagtagctggaattacaggcatgcatcaccacacccagctaatttttttgtatttttagtagatacagggtttcaccctgttggccaggctggtcttgaactcctgacctcaagtgatctgcccacttgtgcctcccagaactgggataaaaaaaaaaaaatagatccttggtattattccattacatatggattgtaaaattcagttaaacattcatctcttggtgggcatttatgtatttcttttgtttgtttgtttgcagcattgctctgttaaacctttttataagtacatctcggctgggcgtggtggctcacgcctgtaatcccaggactttgggaggccaaggtgggtggatcaactgaggtcaggagttcgagaccagcctggccaacatggtgaaaccccgactctactaaaaattaaaaaattagccgggcatgggggcaggcgcctgtaatcccagctactcgggaggctgaggcaggagaatcacttgaacccgggaggcagaggttgcagtgagccaagatcgcaccatcacactctagcctgggggataagagcgagaataagtacatctgtatgttcttgtgcaatcctaggagtattagacagtccctgcaccttacggttttatttttttgcaaatcaaatgatattttatttgattttggagttgctttattgtatctgtgggctatgtactacagtatttttttcagacaaagtcttgctctgttgcccaggctagagtgcagtggcgccaactcagctcactgcagcttcaactttctgggttcaagtgatcctcccacttcagcctcccaagtagatgggattacagatgtgtgccatcaacaccaggctaatttttaaacgttttatagagacaggatttctccgtgttgcccaggcaagtcttgaactcctgggctcaagtgatctgtccaccttggcctcccaaagtgctaggattacaggtgtgatccatttgacctggccttaagtgtttttgtggttagcaggtcttattctttcatttctatatttagcactcccttaaagaactcttgtaaggctggcatagtgggaatgaattcccttaacatttgcttgtctgaaaaggattttgtttttccttagcttagaagaagttttgtttggcagaatatcaaattcttggttggttctgctctttaattatcctgaaaataggcccccagtctcttcttgctcgtaggtttctgctgagaggtccactgctagcttgatggggtttcctttgtatgtgacctgacccttctctctagctgcttctttctttcatgttggccttggagattctgataactatgtgtcttgtggatggtcatcttgtatagtatctcacaggaattatctgaatatcttaaatttgcctgtcaacctctctagccagattgggggaaatcttatggactgcatcctcaaatatgctttccaagttgcttacagcctcctactggctcaggaatggcaatgtgtggtaggttttgtttctttataaaagcgcatgtttctcagaggttttgttcatttttcaaaattcatttttctttatttttgtctggcagagttgatttgaaggaccagtcttcatgctctgggagtctttcctcagtttgttctattctgtttttaattcttccaactgtttcatgattttttttttttttttttgagacagagtcttgctctgtcacacaggagggagtgcagtggcgcaaatcttggctcactgcaacctccacctccttgggttcaagtgattctcatgcctcagccacccaagtagctgggaccacaggcacacaccaccatatcctgctattttttttctttttttttaaatcttcagtagagactgggttttgccatgttggccaggctggtcttgaactcctgacctcaagtgagccaccgtgcccagcctttgtagtgaattttttgacttgagaagttcagtttgtttttttcttaaaatgactatgtcgtctttcaactcttggatcattttcttggattccttagattgggtttcagttttctcctggatctcattttttttggccatccagattctgaattctatgactgtcatttcagccatttcaatctggttaagaagtgttgctggggatctagtgcagttgtttggaggtaaggagacactctgactgaattaccagagttctgtgctgattcttactcatctgagagggctggtattcctttatctttttgaatttgctgttgtttggatggtgctttttgtttttatgttctgtatttcccttgagggtttgactgtggtttaagttgaatattggctttgtttctgggttatttctgaggtccaaagctctgtacaggatctttatttgtggctagatttctgcattgggtttcacagtcaatgtatgctggaagaattttttttggtggtgtaatataggttgctatgcagtagatggcacttaaaagtaatgtgtagcaggtaaacttactcagcagtgcgcctcttttgtgtttgactacatttgcaagagcgctctgtgattggggagactagggtggcaatgatgacctccttgccagacctgttcccaggccgtatgggagccacctccaatcattaggactgcacccatctttccttggctccagtgggggtcctggcgggctgtacctcccctttccttagtggttgtccgagtcaaaggtgggtcactatgagaccagcattcagagtcctgctggtcgtccatctttgcttggcagagtcagagcaggttatagggtatgtctgcaagtggtctgttcatgcagtaggtcaagggcaggggacctctgggcagggcgttatttccctgagtgtgcagccggtatggcgcccacagcccaaggttttgtcactcagcaagacagtttttgggaccacccagcacaccctccctccaccagtctccttctggtggcctccccggtatctgccccaaccagctagttttgtcttccaagcctcctgcccccaaatcactggggttgtgttgtggttgtaggactacttcagtcacaggctgtggctggcatatgggcgacacccttcctggcccatacctgtggaaggaggcatgcccagttcccatgccagtccacaaatctgtgtctcatttttctcagtgttctgagagtggagctcctcctccattcaagtgccagccacagatctcagtttggcactcctgagctgtgtgctctcacctggggcctgaacctgcagctttgtccactgtccctgggtcactggaaagcctgcaggtagggctggcagcaaagcacttgaactgctcagcggaggttgtgctgtgggcatgctctggtgggagctgccaggcaggggccttgggagaggctggcggatggggtggcaaacaaacataccctgctctttccctggccctggttagagctacccagaagaagatggagagccttggggaatgggtccccattgctatgttttgccacagatgccctgcacgcaaaacccctcaacctctgcgcaggctcaatctctgtctctgcctactctccaggtagattgcctgccaattccaacgtctatgggggttgtggggtgtcttgtagccaagatccgagaggttcgtgttgagagcgggctgtgccacagttccttcactcacaccttccttaggagctgtttagggccaggaactcgtcaaggtgctcagtaaggccaggcaagggttccagcttcctccctcttcagacctgttgtctgcgtcacctctctgccaactctcagtgttttctctcaaaagacctgttcaaagtatgttgatttactcaatattttagtctttctcagtgggagaggcgcttcctggctgtgtctagtcagccgtcttgtgctgaatcactctatatcttattttgattaccatttcctgaattatataattaatattattaaatagcttttcatatactaactggccatttacaattatttttcttggaattgcttatttactacatactttgcccatttttctattagagggttttctttttttagagacagggtctctgtcacccaggctggaatgcaggggcaccatcacagctcacaggagcctcaacctcctgggctcaagtaatcctcccacctcagccttctgagtagctgggactacaggtgcatgccaccatgcctggctaatttttctttttattttgtggtagagacgaggcctcactatgttggccaggcttgtcttgaactcctaagctcaaacgatcctcttgccttggcctcccggagtgctgggattataggcatgagccactgcatccaacctgagtttttttcttgtcttttaataatatttatttctaaaagttctttgtgtcttaaggaaattaatcctgctttttgatgtatgctctacatatctccagcttgttgtataactttttactttgcataacaggttttttttggctatatagaattgttaaatatttactaatcaaattcatcttttctgtcatgatatgtgttttgtgtcatgcttggaaagtgccatttgtatgtaagattttttaaaacaagttttaaaattttttttgtggggtcaggtgcagtggctcacgcctgtaatcccagaactttgggaggccgaggcgggtggatcacaaggtcaggagatcgagaccattctggccaacatggtgaaactccatctctacaaaaaaaaatacaaaaattagctgggtgtggtggtgtgcgcctgtaatcccagctactcaggaggctgaggcgggtgaattgcttgaacccaggaggtggaggttgcagtgagccgagatcgtgccactgcacgccagcctgggggacagagtgagactctgtctccaaaaaaaaaaaaaaaaaaaaaaaaaaaatatatatatatatatatatatatatatatagtgtgtgtgtatgtgtcttgttatgtatttgcatttaaatctgtgatccagttggattttttttttggtatttcggttatatctttagatattcatctctctgttttgatgaccctgaggattccttatttagcagcacagatctaatttttccatagtttttctctcgagagactcaaaaacttcattgcagaagtcaaaagctgaattttggctctttttgcagtcttgttatgataaccctaattttcccctaggccacaagccctttgaaaggatccaggaggtcaaaataatttttcataaaacccataaaaaattgtttgctttttttgctctttttctttcacaagtatatattagcattttcgagagacttcataacatttaatgacttcattactctgacacgttacgtatatgtgtttgtattcatatgttttaaaaatgtcttttaatttttaatatggtaaaaatcaacaggtatagatcacataaacaaaacctctctgaggtcctcaataatttctaaacgtataaagaggtcctaaaactaaaaggcttgcaaactcctgccctacgcagttacctttggctgactgggatcactgtcccaaataatgagaaagaataatctaatatcttcaatatagacatatatccagtcaagataagatctcagctgtgacaagtcacataaattagaactgtctctctgagcaccacgcctgtttttgctttctttttttttggaaaatagttatcatggttctgactatggccctgagataaaggaattagagtctggtctattgatgagatattaaatatatagtcctcaaccccagggactctttacctttttctttattagatcatttctctacttcttgtaaaactggaaagatatcactttacatggcctttagcctcacctttattggtcaagccaagcatatgttttacttttagaacttgtaagctcacactcagaatgcctgcttaggaacttctttgtgcagagtggatgggacctgttggacatttaaaagggcaagtgttatgtcatcggccaagggaaacataacctgaaaatttctttaatatcacacatacttttcattcattcattcatcaaattcaaaattatttactgagactttactcttccaagcattgtgctaggaaccaaagacgaaaaaacaagatcaccagactcaaataatactaaagcataaacctcaaggaagtggttatagcctggcatcactctattcattctgtattgaaaattttaaacttgatttttaaagacactgatttgcgttttaaaatgcagtggaatttcagctccagatgtacagtaataccctgagtgtcagttgtttgtagtatatttagtggagctatacaggagtcttatttttctttctttgcacactcttggtgatctcatggctttaataagcaccatctactgggtcataaccctgcatactaataacatatgtatgtatatgtccaagctagacgtcccactatgctccaaagccacatagcaactgcctactagccatgtccacttttatgtccatgtctgatagacagttcagactatttttcccaaaatgaatccctgatctttcctcctaaaccacctcaacccttaagcttcccgtctcactaaatggcagtcccgtccttccaattctgtcaaaatgttgagttggctgggcgcagtggctcacttctgtaatcccaacacgttcggaggccaaggcaggcggatcacatgagaccaggagttctagaccagcctggccaacatggcaaaaccctatttctactaaaaatacaaaaagaaaaattagccaggcatgtctgtaatcccagttactagggagctgaggcacgagaatcacttgaacccaggaggcagaggttgcagtgagccgagatcacaccactgcactccagcctgagtgacagaggaagactctgtctcaaaacataaaaaacattggagtcatccttgctgcctctttctgtcacacccaatatcaagtctgcaaggaaatcctgctcattcttcctttgaaatatttccacaacttgttcacttcttaccacctccactgtaacctcctggttcaagtcgccatcatttctcacctggattgtttcagttactggtttccttgcttccacccttgtctcccattatccgttataaatgtaaatgactcttcccaaaatcttccagtggcttcttcattacatttggataaatagccaaagtccttaaaacagcctactaggccacacttactcggcccaccattatctcctcgaccttccattctattttcccgcttgatgccttgagctagcctgccagcctccttattgtttcttaaatacaagacaaggtccaaccttaggacttgggttgaataactattttctctgcctagaatattattcctgcggatatccagatcacctccctcaagttatttctcaaaatatactttaccttcttcacatctttatttaaatgttatgttccttctcagtgagggtcgctatattcaaaatcacaactttcaaacactctcctttgcccttacccttctttagtttttcttcaaagccctttcacctgctaaaatactatatacttaatgtttttattgcttcttcccatactagaatgcaaactccatgagggcatagattgtttcttcggttcactgtcatttctccagtgcccagaacagtgcctgccaccaaatagggacttgacagatacctgttgaatagccacattttgggggagaaaagagaaccttaaggacagctagcatatttttaagtactcaaactgtccctaattggtaggcctttttcagctaaagatttaacaactaacaaaaggagctcttgatgaaattggcgttagtttgcagaagttcaaacatacactattgaatgagcttccttttaaaaaccccagaagattttcagaaatacatacaatgcttagatactttggctgtgggaattttatctaagcagacatagaaaataacagacacatttttcaagaattttgtttcttttctaaaaatacaaattaaatcactccaaccttaagatatcataaggttatcatataaatcgcttctaaatgcatcatttgaactgattcaaattctgctctaaaaaatagttgatctttatcagcaaagatgaagagacctgtttactaaaaactgcagttgtttctgatattatcattatgttctctgataaggaaggggcaccagagagacaaagtaatggaaaatgttttatttcaagtatgccgtaacttctgtatgtgtacacacatatattcctggactaaacacttctgagagaaacttcacagaaatattctgttgtagctatattacatcttgcttatttcataattataagtatctattattagaaccaggacttaatccaggaaagtaccccccttattcatccccccaaaaagtcagagcatcaaacctgcaacaaacgtttagtctttatctgaaatacagtcatgaataaataatgagaataataactaccatttgttgagcatttagatgaggctagcactgttctaagcactgtatatgtatttgctttttcatcctcacaatcaccttacagagtaagttctgttattaaccccagtacacatattgtaaaactgacatacagaggttcagcagcttctccatggagcccaagggcctttctgcctctaaactttcatttgatataaaataaatgttaacataaaattttttaaccattaaatgcacatgtacgttttcattggctcttaaacaaagaaggaaagaagttgtgaaagatatttttaagacaactgggaaaatatggatatatattgcccacaaaaataaaatgttctattcataaacagcctaaaacctatttttaaactccctaggtggtcacctggttaagaatggactagtacatgctcactttaaatacttagacattacagacatatggtggagaaagcaaaagtttcatattaactgaaactctagatattaatatagctactgctttggtctgtgtataccagattgatcttctatgtgtattctctacatacaagaaaatatacgaggtttttgttttatggagtttttttaaatgatatagggagtatatcaaaatataaaaccacttttcatcagatgatgtcattacaatataatgaaaggaaagccacaaattgggagacgatatttgtgacatatattatatgaccagccatgaattgagttccaaagtggagaactcctataaatcaagaaaataagataaactactagaaaaaaatgggaaaaaaatataaatgggcaaatcaaaaataagaaaggccaataaacatatgtgtttaacatgtatggaaatcagagaaattaagttaaaaccacaagataacattttacatttgtgacatttgcagaaagtattaattggaaagactgctttgattacaagtgaacaaaattaaagaactaaagcttaaacatattaacatggatgagtcacagaaacaatgctgagcaaaaaaaaatttcagaaaagtgataacatttaggtaaagttcaaactcatgcaaaactaaatactatgtatatgtgcatgtgtgtatgcatacgtgtatgtgtcataaactatagagaagaagggaaataataaaaagaaagtaacctttgtagaggaggaagaaaaaagatttatcagagacatgctagaattgagtggcaaaggggctacctgtttgttaagggaatagggtatttattagtctttatatctctaatatgttgtttagcttatatgagttatttcacattttttaaatgattaccaataaagggggccctatactattttgtaacttcatttttcactaaatttcttagaagtcattccatgccagtacttagatgtaccttatttatatcatagctgaattatactctcttatgtgttatgtatatttcttttaacttatcaagtcttgccattaaaggcagattggaaaggctcccagtaataagtgcacttaccataatctggtctgtgaagggactgtctgtgttcttgaggatttttcatgttgtctctagagcactagcccccaacccttttggccccagagaatggttcttgatagactatttttccacagacgaggcctaggtgatggtttcagaatgattcaagggcgttacatttattgtgcactttatttctattattattattacattgtaatatgtgatgaaataattatacaacttaccataatgtagaatcagtgggaaccctgagcttgttttcctgcaactagatggtcccttctgagggtgatgccatgcggctcagttcctaaccagttctggtccatggcctgggggttagggacccctgacctagagaaaccacctagagtaagcgtttctgtctctccctctgtgtgtgtgtgtgtgtgtgtgtgtgtgtgtgtgtgtgtgtgtgtgtaccaagagagatcaaaatcaacttttttccctgaactgtctaaaagtgagtattaaatatcttaacacttcacctataaaatacttgcacatgcatctctgaagagtaaggatgttctcctgtacaactacagtgccattagcacatctaagacaattaatggtaattgcataatgtcatctaataaccaacatatattcatattttcccagttgtcttaaaaatatctttcacaacttttcttctcttatttaggagccagtgaaaacatacatgtgcatttagtggttatttctccatagtctcttttaatgtagctaaagcgtcaccccctaacctccttttttttaaaaaaaaatgaaaatgactttttgaagagtccaggacacttgtattatagaattggcccatatgggccaattataatataatacagtggaccctagaacagcccacattctggctttatctggttgcttccacacagtgtttaacttttgagtccttacttacagttaaaaaaaaaaaaaaaaggtaggtaaccttggtattgttggcttggtgtaattaagtgactgaaccaattattttgtgtgttataaggaaagggagggggcaaattctataaatactgcaaatatgatctttttaaaaaaatttgtcaagtacaatgagttcttattacattactataattttgcagacagaactttgttgaccgtaagcatttatagaccctctttatgatcttttaaaaagcagtaaatttatattgttatttttcttattataatagtgcagtatattagttattgcataggaataacactggaatttctgtggttcttgcttcggttcagatagtttgtagttgttgcatgaagtatggttcttttcccatgtgtttaaaagaattatatttcagcacacaagataataatgttgtacatttattctttggtcctatgcaaagatatttgacacacatttatattatataattttagaattaaaaaacatagcctccttatgtgcgtgattaatttggtcatttaaatcactgaccagcaaatcgagtctataaaagctgttgagatagacagaatcattttagtcaactgggcatttgataccaagtggaaatagttctcagatatttgtcatcccagagggataagtgaacatgaacccccatgtgcactgggtcgggcagccagagccgggatgctgtggggagcaatggttgtgacatccaaacagggcacagtttaggttctccccacagccttgattttgggcaagtcccttttgagactgtctcatttgtaaaagtggggataatatcatgtaacttgatgtggtggctttaaaatgtttctgacagaactataataagaatttattttatatcataacctgtacacacatagttacaccatgcacttttacagatatatacttatagacatataaacatttttatataacaatgcttatttatactgtggtacaagtgaatttttagatgttgataagatttatttcatgaccttctaaaggataatcatcttcagtttgaaaacactatataaagattcggtgagtttcagattctgctacaaaaatgatgctgccattttggttattcagtcaccggatatttatgcacagttgtcatgtgcctatatgaacaaaactagacgtctctgccctgtggagtttgcagccccttggggatgagaaaataaacgagaaaatatgtcatcatgaagagtattctgagttgtgaaaaaacacataaggggctctgtgaaagaataccaaggaggatcggctttagagtggacatgggatggggggtagtgggagtcagctgatgccagagtgaaaaaaaaccaaaggaaccagagcaagaataggggagagattcagtgggatgctagtgaccagacaagcttgagaattgtgctttaagtcatgactccagaggtctctgatttttttttaatgaatctgttataatcaaacacataaagagtgctttgcacagataattttcaaaattgattttaatatttatctgttccatttaatagttaactgcattgtccatcacctccaccttgtttcagacacccagtcccatggacacacctagtccttacctcccagaacttttcacaacctcctgcccttctggctcttaattaacctctaggtagcatctgacacttcctacttttgtgtccctttttcttttcaatgtcccataagtgtgggtaaagctcaggattttgtactcagcccttttccttttttatgtaatacactctccttgagtacttcattgacttggccacttccacagcttctgtcagttacattagttatgctaccagctcccaaatttatgtatcttattctagacctctcacggatttcaccccatatcccacagatatttcaacacattatctttccttaaaacctcttcattctgctgtttcctatcctagtgggtgacagcatcttcacagttgtcaagtcatttccaagagtcactcttgactcctctctttctcacacctcacatccaatcagttcccaaatcttcctgataccccctcctaaaaactttttgaaaccatcaacttctgtgcattccattgcagctactctggattcggctgcaagtacctcctgcttactttatcatgacagttgccagactggtcttatagccaccagtcttcttcccttcctgttaaatctccagatggccaacatcctaacatctaaattaaagatgagatcttatcacaccctttcttaaaatctctttgtggcaccttataaccaacagaaagaatcgcatgctttttgtcatggtgcacaaggccttttctggtctggtccccgccaagtgctctagccgtaactctcttgaacccccatctcttcctttgtgctcccgccacatggagcttacatgctgtttcctctgccccagatcctcccctacctctttgcttcccctacctctttgcttcccctacctcctttcgctgaactgacttttacatacccttcaggtctcaactgacacctcttttttctgggaagcccccagaatacaatgaccactattctgtgtacttggttatttacttgtctttgtaccctagtagaatgtcagctcttggggaaggtgactctgtcttccctgttaactggttttgctccaactcctgacacaatgctggtgtctagtggtgtgtgtgtgtgtgtgtgtgtgtgtgtgtgtaaagtgactctgtcttccctattaactggttttgctccaagtcctgacacaatgctggtgtctagtggtgtgtgtgtgtgtgtgtctgtcacccaggctggagtacagtggtatgttcatagctcactatagcctcaaactcctgaactcaagcagttcccccaccttggcctcccaaagcactggaattacaggcctgagccactgcacctggtctctagtagtacatatttgaatgagtgaaggaaggaaagtacaagcaagccaattgcaaagaaagacagtggagcctcatggttaagaatgcaggctctggggtcaggtggatctggatgccaatcctgattctaccactgaccagctgggcaaatttagcctcatctgtagaaatgggactgttagtagttcctgccttgcaaggtgaggaatcaaatgagagaacacatgcaaagtatccagtacagtatctggagcataatcagtgtatcataaaggttagctgtgatttccttccattctgatctataaacaaatagaatccagaagccttccagttatcactgtattattttttacaataaaagcatacatatgtagagaaataaatgaccccactgacagagattgcctaagatacgaggcatgttattatatatggccttcaacccctgaaaatattagaaaaaggtaactgacttcccagttggataaaaatacaattatcttatgagacaaaatcttcactcattgtaggggaccatgagactacattaaattaaaaatatgctttataagtgtattctgcacgaaatggaagggagaatttattgtagctgataacagatgggaaagaatgtgagctctctgaactttttttttttttttgagacggagtctcgctctcttgcccaggctggagtgcagcggcgtgatctcagctcactgcaagctctgcctcccgggttcacaccattctcctgcctcagcctcctgagtagctgggactacagatgcccgccaacacgcccggctaattgtttgtatttttagtagagatggggtttcaccgtgttagccaggatggtctcgatctcctgaccttatgatctgcccgccttggcctcccaaagtgctgggattacaggcgtaagccactgcacccggccactttcttaactttctgtgatggaaaccactgtctacaaaggtgtgtctcctaaagtgttctttcttaaagaaggaaaataaaatgtagctctcagtaaaaattcgcttagtagaatccctccatttgcctttatctcatttttgctgaatttattatctattagtagatgataccagttaatttatttacactttggtaacatttcttatactctgcaatctctctgagtgcctctagccctctttttggtctgtaaagagagggaagcacttctcagagctgattaagggtaaagggagggatgtactcttgtctccttcctgataatagaagattcttcccattgtaggatttatctagcttgatccatgcatgtggtttgaagaattgggcttctctctctaataaatgttccctgaaatattgtctggtgaataagccttcccaaagtataaacaaagtgccattgaaatagtattagctctttaacgtcactagggcttcatttggtacactagagaaggaataagtgactttttggtattgtgatatcattctgaacagaaaacctgccagcagattaaattctttacctgacagaaaagatctgattcattttaggacattattgccttgctgaccttgtttggtgtctaatttatttttagagagaagaacaggaaaggaaacttaaatcaagtttaatattttctttttagaaacagattgccttgctttttataaattaccatcatcactgaaagtaatgctgactgaagtgatccaaacaaacttacagagcagctaaaaactggtacaaatctagaagcttaagttgttagtaatgatttccttcttgaagaggagggttaaaataattgaagaatagcgagccatgttttagctttagtgaatatttccaaaatctagcagtatggtttatgctcactttttcaggaggaatccagatacttcttgattcaggcctttttttttgtttttctggctcatgcttcctgccacttcttttcttcatcagcgcctgtaaatagacactggggatgaagacagaggaaattaaagtttttcatattttctctgttgttagtagttgaaggaggtgtgtgacaggctgttaaaagccatgcagctttaagtctgaatttcaagctagcctactgtgtgtgtggtcaaatgtgggacatgatgtgtctcatccagggcttgactgctctaataaggagatgagccattaataaagcattaaagaatgattaaatacatacttgagagtgcttgtaaactgaaaagataaattattgataaggctccaagtgtatataaagcctcccaactcagtgatattgtaacattgatttgctcaaagaccttcagtggctcctcttcatcctctaaggtagaggctagttcccgtggctgcctgcagtgtgatcctctcttcctttctagctttctctcctggtcccctgctggcatcctgtacttaagccaaactctccttttcccagtttcctctagttttcctcattgccttgcctttgctgcttcctctacctcagggtttcttaatcgtggtactgttgacactttgagcaggatccttgtttgttgtggggagctgccatatgcattgtaggatgtttagtttagcaccatacctggcttctactatctgaatacctgtagcaaccaaaaatgtctttagacattgtccagtgtctcctaaaaggcaaaatagtccctggttgagaatcattgttctacctagtaagctgtcaacctgtctacatcatacttgtctttctttcaagctttatctcaaatgctatttcctctaagacttgttactgttttctttttgcttacttatcttgttagccactctgtttcccatgcccagtaagagtgaccattcccttgagctctgtctcctaacttacccatccctgacccctgtgctccctccccaacacttccactctgtcttctggaacaccagctccaccatcagctctcatctgcattcttgcttcttttcacagagttcctttcacagttgtggaagcatcccccgtagctgcctctaatggaatatgccacatgcctcatattttggtgtttagagatcagcaactttaatccccagtaccactttcaaattatttctccccgaaatatctgcaaatctcctcctatgaggtttctgccaccccgttacaccaaacgtcatcttcctttttttattactagcatctatcaatttctagttcactggagacataacatcttctggacagttgtctaactcttgtcatcattttaggtgatttcagtgtctgcagagatgagtcagcccagcaccaggacctccccacctcagccagctcagttcgttccctgcaccttgtaggtaccagaaaatataccatctccaaaaccaccagtcacatagccactctcctactaccaccccttatccctctaggttacatgcttaagtgccctccctgcaacgctttttggatctcactggggcctgcagtccactgatcctgctactttatatccactcatccctcatccagcctccatttccctcctatccatggtaaattattactaaccctctcttgcaaatatgcttggcttctctcattctctcacattcagacaccctaattctaggtaaacccagccaccttccttctttctctttctctctttcacacacacacacacacacaaaataattattaggttaggagactgtccttgatctcagtctcacattctaaattcaagtcctcattgtgttctttctcatagttcctgaactttttcttcatttcttcatttctatcacagtttgaatttgaagttccctttctcatcttcatgtatggccggtgttctgtcttgctcctttcttctgctcttctcctcccctccccctctacttcctccctcccttttgctcccattggagaagcaagcaatgcatacattttagcaacagctaacagctgtacctactccattttggcatttaacaatgtatttgctctgagttgcagccgattaacttttcttcagaggcaaatgtagacttatctctccttctcctgaccacccaccacactatacttaagaaaatggaaagggataggtgagtgttttctgctactatcacgtagactaaagtaaaggaatatcctttggataacagattagatgtaaattgggtcttcagatatctaaaacattaggcaggcttttaccaagagactgatatgacatttagcagcagattgtgttacatggtttgatatttcttcacacctgctttctgaatatagatgtgttcttaatttgatatctaggattgcatactgctgacgatagacatgaggcaataacattgtattttctgcataaatgcatgaaagtgtttgaaacttcacttctttgacattttgaaattgtatattttcattattaagagaactctagaagagaaactccatttaaaaacagtatatggtgccggtaaatactcggctcttactataaagtgagggcacattttttaaataacaaagtagaattactgttttgcttttattatacagtgtttcccatctattaatttatccccaacagtgatccttagtcacctaaggggattgctttcaatcataattgacagatttgttctgacattttaacttttactagttacttttttcatgggtttagactgtaatacagatttttgaatcaagctttttgcctaggcatgaaacatgattaaacagtgtgacctgccagatgttttaatcagaatgacaatttacggcatccctaagcagcatatattatgccaatgaacataaatgatcatggtgtctcattgatattttcattttctatttttatttttatctaattagactctttaatgagctgtatatattgtggagcaaaatgtcatcataattttaatatacaatataatgaatatatggtaaatagctttaaattgtttgaattcttatctagttaggttgaagatgaactaagtctgtttctatccaatatagttagtttactgtgaactaaagtctattaatactaaatgttctagaccactgatgtggttaagaaggaaataaaattagcatgcaacttcaataagccatgtaaaaatgttttgtccaagatgttcacatttctcttagtagaaattgtccataatcataatggactcttcatattgtatattggcatgaaaaacaaaaaatatctaaaaagtattatttagctgcaccactcctgtctatctcccaataccaacagaactaatttttttcataaatggtcttttgaaaactagctgaagtcatggagtaacatgaaactttagtttttaattactggagatctcatttcaccctttgcactcaggatctcagataccattcataggaatcaggtgcttattacttgagaatgtttttggtatacatttttagaaatacaagttaataaaatatgggataaaatgaactgaaattatgtaggatgaccttttacaaattgagagatttatagagagatgtgtctttttttttttccatttagatttttggaagcaccttaattatagtgcttctggcgagtaatgaaaacttggcctttctgctctaggaaaacatagtccacatgacacagtacttttgacagaattctcaaagacagtgtgtgtttgtgtttttgtggactttacctaaagataaatagaattttgtttctgaaaaagctttaaaaagtgaaaatagtgtatgtcgatgagtcatgagcgattctcaaacaaatctaccaggaaggcaaagtgagctaaggttgagggtactttttgacatcttagaattgctcagctgacttaaaagtatataatattttctcatcgatttagtaattctgatcagtatgctacatgtacacacacacactttttcttaaaagcagcacagactgtatcttccagatggctttgataaatctaggtttaaattcttctgtcctcttgggccacagtgaatcttttgtgaacattaaaaatataatgcaatgagttctcttacaaaaacatgtagaatctgtactaaataagttcttaaatcctgctgctctgcagtatatctttcccattgctcacaagcatttctagcattatcctgaaattaatgctaattccagcatacagatccaagtattttaaaaagttgagttatcctttaggatgagtcctaacctattctgttgaccaaattttaattcacataaagagacttaaaacatatgttttaaatgacactgatatgttagtgtgttatgtttacctataggcaaccccttaatctccaaaacatgtaatagccaaatgtttgatgaagtctattataattacatggtcttgtatttagtgacttaactttgtcactgtagaaaaaccaaaaaaaatttcttttttttttttagacagagttttgctctgttgcccaggctggagtgcaatggggtgatcatggctcactgcaacctccacctcctgagttcaagtgattcttatgcctcagcctccctagtagctggaactacaagttcttgccaccacgcccagctaatttttatatttttagtagagacgatgttttgccaagttggccagtctggtttcaaactcctggcctcaagtgattctcccacctcggcctcccaaagtgctgggattacaggcatgagtcaccacactcggctgccactgctcattcttgaaggatctttccaatctaccaaggaccttctccttaacacctaggagttcaataccagtatagccccttggatagtgtatggtgcactgcctcatagcatcgcactgctagttatctaattatgctaaaggaatacaggctcaggcaccctcgagtacagtgtagtcagaaaaggagcagacaccttaaggggtattgttggctcttgttagagggccaggaaactctggggaccatgtcaccttccctatctcttcctaagcatctaagttctagttgccctaaaatggcagtgctacctcttttctagctctgcatctcttaatatttgtttctcctccctctactagctggtcaaatttatctgtctttctccatttagaattctggtccaacaaatagttattatccatctttggacatagcttctcatgcttggcctcttctttagttacctgccagttgtggaggggtggccttggattaagacacctgtgagctagtcagtacttttctgatcaaaaacctgtggctgggtgatttttctattacttacatttaggttgttaaatattttgtcccagagggctctgtaaattttgtgagaccagtgtcagatattgttccttactgtacatgagagcacctcaaagaagctaagatttattaagccccttacaacagagcattgtgttagacagtctccatacattatttcatttcacccttttccgattcatgcgtgaaatcaacttactataaatggtgatattacacccacttcattgataaattaattaagaagtagagaaaacaaaggcccataagtcacatagctaatgactggcacagctgactctgattcccaaacctgtgttctttgcagtctataccataatgtgtaaaactcaagtccttacaatagatcacagggttctgcacagcctgatgcctcacatttcagacctgatctcctcctctcctgctctatttccctgtcccagccacacagacctccatggcctgtgttcttgagacacactgtcacctccagcctttacacggctgaggcccagcaggacgctcttcccccagatatccacagggctcacttcctcatctccttcacatctatttgttttgtggtttttgtgggcgttcgtcgttttgagggttttttgtagagacagagtctctttatgttgcctggtgctgatctcaaactcctgggctcaaacgatcctccctcctcagcttcccaaagcgctgggattacaggcattagccaccgcacccagcctccttcagatctttactcaatatcactttgtaagtttgctttcattaaattccaaacacccctcccacatggacacttcttatctttatttttctctttagtgtgacctattttacttacttatatgtaaaaataaaggagcaaaagtttccgccaagaaatactcttgtatttccagttagaacagtacttggcatatattaagcacccaataaatattccttgaaaaatggacgaagggataggtgtatatgtctatgcatatatgtcccaataatgaaataattcctaggatattaatgcatcaaaggtaatataactgaattctgattcccatatgagggtgtcagagtgggcagaaaataatttaataaccaaatccttcagtaatctaacaagatgcatgcacatatatatttctaatatttatcctgactttcaaaaaggatcttcagaagcctttcacataggtcacataagcataacagaattatacttagtgtttttattactgtttctgaaagaatttgaaagaactttaaacactatatatgctgcaaaatatggacaaaaaatttaaaacgtctcagagatgatctgaaagatcccaagagttgttaggcccagggcattaaatacgacctaaacatttaagcaacattaaaaattagtgcactaaattttactctgagtaaattggtagctaagacaaaaaaggaaagttatttgaatgtctcatagaagaaagtacccacattcatctacagagatacgtttacttggaacttcaattctgtgaaaatataggtgtctttatatagactctcttcaactgtaggattataaaacattcagaaactttgctcaaatgtacactgtgtataagtgccttgtatagtagttgagggcataatattaaattataactaagtcaacatatttccctgagtaacctgatctgaagttctctgccatgtccctttcccacctttgtgcctctgcttgtgggttctccgtgcacctgtatgtgtccagatagtccctgtgcttcaaagcctgatgaaactttcttaatgccccccagctactaagattctctacaggctcgggattcccatggactttatttgtctcttcctaaatgatatttttcacttcaacttcatataaaaattatataaaattgaattacaagtatttgaaatagttgtctaatcactcaaactagatttttctttaagtataatgtattatatgcagttatattcattaaatatttgttaagagagcaaatgagcctatttcagtattggatttttaaagtaataccttatacagttcaggcaaaatatttctgttaataagcattattggccgggcacggtcactcactcctgtaatcccagcactttgagaggccgaggtgggcggatcacctgaggtgaggagtttgagaccagcctggccaacatggtgaaaccccatctctactaaaaataaaaaaattagccgggcgtggtggcgggtgccctgtaatcccagctacttgggaggctgaggcaagagaatcgcttgaacctgggagatggaggttgcagtgaaccgagatcgcaccactgcactccagcctgggcgacagagtaagactctatctcaataaataaataaataataataaacaagaattattatatctggttttatttcattccgaagttatgtcagtttatgtaaggttatttgcagcattcatctgttttttccccttgatttcacatacagaactcattaccaaataaagagcaaagacttaaaaacctcacaacaaactttcagctaatgatgcttccttaggaattctctgtcacaatgactggtgatgtcagcccatgccatgcctatgtcagattcagtcctgatcctcagtgattaccacctttatctaagtgtgtataactgtccatctggtgaactgaatggatgagctccagtcttaacagactgaaaaggaatgcttctccatacacatctcatgctgcttttctttccacgtggaagttcatggacctgaaaatggcttattttaagctttgtacccaaactaaaatctttgcattcgataggcattttttgtccagtctgacaagctctgtcttttggtgaacttgtttaattcactgacaagttattaatgttcttattgcaacagttgagtttacatctgccttctgtttactatgcctcagtcctttggtcctctactcctacgttactgctttcttttgctttcagtgaatattttctattgtaacatcttaattcctttagtaacttttttaactttttattttgattagtggttgctatagggcttactacatatatcttatcagaatctacttcagatatgtactaacttaattgcagtgagacatggaaatgtcacttgtttatagctctattctctttcccccttattgtaatacatattacatctatatatgttacaaacccatcatactttgttataattattactttatataattttatgtctcttaagcttagagaagacagtagacagatattatttacaatgtttattatattaaccttcttagttactgtttctggttctcttctttattcctgtgaattcaagttaccatctggtgtcattttcttggtccattgcagttttgctcccactcaccttcttggtgttgctggcaaatatattacatttctatatattatgggcctagtgatacaattatatacatattgttttattacagttgcatttttaaatcagttaagaaaggagaaggaatatacatttaaactgtcttttttaactacataattcctttactaattgcaccattttttcctatggatttgaattactatcaggggtcatttgctttcatcctgagcaactttagtattttttataaggttgttgcgggacagtcagaccgaaaaaggttcaggagagtttattaaattaaggtgatcaccggctcagccagacatatgtccagaaagtctgagccctgaaaaagggcttttcctacttttaaacatcttaaggtgggagctaacatgaggcgggaagcgagttacagaagcaaggaacaaaggcagcattacaacattccttatatcttgagggaaacatgtcttgcaacctaaacttaccagtcttgtgaccctgcagccgtgcaggaacttcctgggcctgtaataaactttgaggaatatggagttggggagtacagataaggtacactgtccacagagagaggacaggctgttaatattctcttttaacttgagtgtaagacggggtcacactttgcagcaactttaagaggattttaaaatttctgttactactactattaggttatagttgatttcattaattccttcttcaaggtgagtctgctagcagtgaattatctccgtttttcattatctagaaatgtctttatttcctcttaaattttaaaattagttttcctgaatgtaggacttttggttgacaggagcttttttcttccgtcatttggagtatgtcatcccactgccttctggtcttcattgtttctgatgagaagtcacccattaaacttattgggattctcttctatgtgatgaatagtttttcccttgcttctttcaaaaattttctttttctttggttttcagcatttttgctatgatttatctatctgggtctcgatctctttgcatttattctgcatcacatttattgagcttcttagatgtgaatattaatgtttttcatcaaatttgggaaggttttagccattatttcttcaaatttttctttgtcttctctctctctcacttctactagagaacttccattacgtatatcttggtgtacttaattgtgccccacatttctttgagattcttttcattttttccttatcctttttttctctctgtttttcaggctgcttaatctgtcatgaagtttgctaattcttctggcagttcaaagctaacgttgagcccctcaagtgaattttttatttcagtatatttactttcagttccataatttccatttggttttttatcatttctgtctatggatattttatatttgataaggcacacttcacttctttaagcataatttccttttttttttttaacatatttgtagtggctgctttaaagtttttgtctgtgaaatttacatctggtccctctcacagcactgtctgttgccaggtttttggttttctgttttcttgtatatggattatactttcctgtttctttatgggtctcataattttttattggacatttaggtaattgttatggtcattccacagaaaaagtatgcacagtcttccctccgaaatttggctcaaaagccaagaaggtatgagaaggtttatcaatcacataaagaggctttgtgggaaccgcaaggcaggccttccaaactggtctgaaaatgatttgagagatcaaggacaggagactgccttggaaggttatttgtgtgctgtttggaggtggggcctgggtgaggttcctatgcatgagtagggcttgaggggcatgaacctcccaccagcaccaaaggaggctggcttttttaccagcttgcccagatatagggcacaagaggaaaagggaggggtaagatttaaaagctgtcaacagacaaatattaaaaaatggagccagattcttttccacaataatatactgtagcaactttggatactgccctccactccccaaagcttgttattgttgtttgcttgcttatttgtttagtgactggctagactatttcaataaagattattttccctgtagtgtgaagcctttgatgttgctcctcagaggctacagctttggagacgtaccttgtcatcctggtatgacagtggttttagcagggctctctttgtctccttctggatcacactcagctgttaggcttcagtaattgccagctgattgctctatttttgacaataccttgggtcataaattgctccatggtctgatataattaagtttggattcctttgcaggtttgttctgtaggttggtgttgtaggtttgtccagacttcaggaaggttatctgtagatcttcattccctagttctctctgttaagccctggtctgtgatttagtttgattctttcatgaggctgactgccttctctctattgctttccatcaaacctccatttgttttgaatatacccttaggcttgaacttccccacactctgttttaaatattaggggacagctttgtagctgcctgttacagcctgacgcttctcctgggcagaatccctgagcatggctccagaggtgagagtgaggacagtgacacactttccccctgagaggcatccctgctttaggatcagaacactgcattggagtggtagcttctgatctttgcttccctttccggcattgaaccaaaggcctacaaaaggggtggtgtgtgagtcgctaggcccctgccattcttagtgtgctgcacgagagatggatcctccacctttgtgagtaggggctggattgaagaaggggtgtccccagcctcttgacctcacactcttggaatttagcctctacagcatatagcaggaggagatgagaaatggtggcctgccccgcaagaagttaccacagtccttgactaggagctgggtggagggggagccctgtgtttttggctgcagcttcctgaagcagagtttccttcacactgagctaggaggaggagagaaagagcaggtagtagttcaaaagttacaggctcttgctcttcttgtctgatttcagtatattttcttgaataaatgtttcttcgtttgttatatgctctcagaacaatttccagagactgtaaatttttttttaataatttcccccagttatgcttgttttactggagagcaggtctgtagggatcacactgtcattccagaagggaatttttacaattggtaggcatttgctgacctaaaactcatcagtcctaatgccggataacagatgtttttttgtttaagtcaatggccttgaattttgcccactgttttggctgtggctttttttaggatgaaggttttatcatgtatgctccaaaggaatattcttccatgttatagattagtctgtaagttaaatatgatcaatttacaaaacagcattagaactgtcctgtctagcttaacagcctttccttgtttttagtgcagtgttttaagtcttcagttttaaaagctcaaagttttggttctcttgtaaggccctttgacattaaaaaagaaaggttgaagtcttctcattgaagtgagcactcagcatgacctataactagcattctgctattacagcaggcagagaaaactgaggaaaaagaaggttcattagaagttcttagtcactgtaaggtttactctttgctgcattagaatgattgaagataggctttcagagttaacattgtttttaaaattatttcatgtagcttttgaaaggaagccttaatatttttaatatacattttattttcatgtttaatcactattatacttgtttctgcttcaagagaaattttttgtagtttcacatattaagtttagggactactttaatcaaatgccatatgctggggaaattatttacttctcagaattaccaacttcagattgtgtaccactggaatgcatataagagcaatttttataattgttaagtgtatttagtgtgtattttacattaataaactttgtttaatttttttgaactaattttattagaggccatgagtgtgcctcattattttaataaattactttaacctgaagtttcttaataatctgattatttgattttaacttatttcaaacatacagacctttataaacacaatgtcacgtgttggtaatgttagcatttcactaatgtgaatataataacttcttaaaacgaattgcacagtttctgaccagtgcaaatgtcacttcctcagtgaagccctcctcaaattcgtccaacaagagagtacctctgccagctctgttccaatagtatgtattcataattctagcagagccattaccacatagtatttgtcaatttccacatctgcctcctcaaggaaggagtagagagaagtagtagagacagtaacctcaccacattggccaggctggtctcgaactcctgacctcaggtgatctccccaccttgacctcccaaagtgctgggattacaggtgtgagccaccatgccccgccatcatttgtgtttatctctccaatacctagttgactgccacgcagtcagagatatttaaaagatgtttgaatcagttggtggatatgacgtggaaaaaaaatttgatgatcattctttcacatcattttataggcaagtaagtgaagtccagaaaggtaacattttgctttactttttccaagttatcagactgtattacttcaggcattttatcactacagtgctctagattcaggaaaaatattcccttccagtatgttccagaaataatgtgcggaaaccttagagacaggttatttcattaagaccagggttattctagcagaaaatgcctctctggtgtgtagaaagtgaactaagaatagttaaaaaaagaagacagtacacaaatcaggtttccagactagatggagcgtaagtgcctactgttagaggtttgattttcagttacaatgagtttaaatctttttaaataactaactttgtatttttaaccatccttcccttggatttacaagagaaataaactgctaaccttagctgaccacctgtatcatgttttgcagttcagtctgaggtagcagttattagagagaccagcaacttctcataactcttggagcattatcaccttgattgaattgtgccacttaagaaataaatcactttgaagttgaatttgattttaaatgtctggccacaatttttgtgaataaaattaagagtttttttctaacacataccccatgactaggagtccatcatgtcatgaaaatttagagttctgtcaaaaatgtttctctcaggagacagaaatgcattaaaaaatgtaattttgggaagtcctttaacatcagtataaactgacatacagtcttttcttttcttttgagatggagttttgctctcgttgcccaggttggagtgcaatggcacgatcttggctcactgcaacctccgcctcctggattcaagcaattctcctgcctcagcctcctgagtagctgggattacaggcatgcgccaccatgcccagctaattttttgtatttagtagagacgggatttcaccatgttggtcagctggtctcgaactcctgacttcaggtgatccaaccaccttggcctcccaaagtgttgggattacaggcgtgtgccaccatgcccggcccagtcttttcatttggaggaaataaatactcagaaatccagcatgccatgtttcagctgctaaaaaaaccatttttggatagtagcgcttgtgtaggcagctattgagcaactagaaagtgtaacatctttgtaaatctataatgaggcacaggtggacaagataagaaagcatcaggattttggaatgaaagtgatgaatgaaagttaagtaaccttagtgcataaaccaaattattgcagactgatttcattgccctaagaaaacgcgtcagggcaaatataattctaaaatttatattttaaaaccttcatttaagttaatttacataaatgaaagttgatgggaagtcagaaaatcttagcaattattgatgccagggtcctgttctccagttatttccatcattaagtattatctctgttgacttctttaccttctggaacatagaggactttttgagaaaggggagagtcttatgtttgaagtttgtattaatgtctattaacccatataaacattccaatattgaaaatattaaatctacaaaatctccctgaaattccttaaggtcctgacctcacaggggtagaggaaatatgtgacttcacttgatacatatatttaacaccagaattcaaaatattgctaagtctttggggaccattaacttaccacaattgtcttgattacatttctcctaacaattcaacatacaagttatgaaaaataaattcctatgataaaagtgtagtaattggaaaatttttactcctcatttgttaataaccctcatcaagggaaaattataatccccttagacattccatttcagtgcagttaacaggttcctatcattatttgctgccagcagcctgttacttggaatttattggttttgcctaaaatttttagtttatatacaatctgaaataaataaagccagtggtttccaccacccacccccaccccccgacttctgatcatgatttcactgacgacggaagacagggtaggaatgtgttcattgttaccattagtgatttcagccttgtgtgcctggattccagagtgtggtgtctgcgtctctctgtaacttgttgtgtaccgtcttgaattagagatcatcagagctgtctgctaagtatggtgaatcttcattttggaccccatgtttcaggaaatagaaagaaagtctagatagaagataatgaacttaaaagttgaaattttaaaatgattcttggaaatgtagacttgtgaatggggaacaattcaagcacgtttctgatatcatcttactaaattagtgcatctttataaaatatgatctggcagaattatttgatataggaaatagggttgatcttctgcaaacaaaaatataactaatgcaatcatctctatcagaggtttcaaaccaatactcatgagcaaaatcagcctggagacatgttttgagtttttttgacccatgctgtgtttcatatattttgaattaagtttcagtatttcaaaagtttgatttttcatattaaaaatcatatttctgtaacaacaacaattgtctggagctaattaattctgtccctctggtcagtgatgatctcttttgcttcatccagttccctcacttactactgtctgtcttatcctgagatgctttttcagtttgtatgcccttgcctttttactatttgatcatcttgtttgtaccaggccttcttaacttatttaagttaaggccttatgccttatagcatttcaattgatgacctctgagctacagaatgcaattaaactgctgctgcaaagagtgagagctggcatgacctggtttgtcttagtgatttcagaagtcatatggccttcagtatactttttaatgaataagtggaggaaaaggtgttttattttaaagatatttttattctacattgttatgctgcccttccactaatataactaggcctaagagaaactggatactactatagaacaaatataaacatgagcttggcatagcctcctagcttgagcatagaaacagtataagttatgatactgctttgagccattctttgtggaaatgtctccagacatttcagcttacagaaaatactacgaatgttttattaactatgtttttctaaaataacccataatattactcctctgtgaatagtaactattactatccaaggagaatttcttcatgcaggaactcaaaataatattatgaatagttttcttttaatttccatcggaatatttttcttaaaacttgagacatcacactgaaggatatagtgcctgaaatcacaattttcaacatcttcttttataccatagtgtatcaaaaggatattacatgctcatgattaatcattaagctttgttttgagtttttctaatatgatttagttcatttagacttccaatttaagtttctaaaactcctgaggcttccttttaatgccaactttaaccagagagctcttcatttgaaaggaaggctaagctgcagttgacaaagattaaaatgcagtagcttactcctttcaagctatgaatggagataattgaagcataaaccatttaatgtttttgtacacacttgtctatgtctctgtagtttctgaggaagaaactgcatgtgcattgaatattttcactattttacttgttaaatgaatctaatgaaaaagaacttaattgagtttggagtttaaatcctgaatttttcatgaaatcatgatgtgatcttttgttatggagtatttgttcaagtgaataccagtgatatcagctatcattatgttgtttctattagcatttttaaacttagttttgaaaacaggaaagacaaacccatatccaaaatatatatggttcctgtaaatgaattgctgccacttccagggtgaaaggggtccaatatagtcgccaagccaccaaatctttattccaagccacaactcaccccactctccctataccaaccctgttcttccaactcccaccctgccttgatcaaatacatgcagaacttagtctcatgcacactcttctggctcctgccagtacgtgtccactaggtccttgacttaattcagagtgcagtccctttctcctacctgtccatcacattcctggctaagtttacactgtaatttaaccttactttttggcgtagtgtccaggagataaggtgggcagagcataggaatgggggtgtgtgtgaatcacataatgaggggaggaacttctccgtcatcatcatcaaacaggaaaggagactagctgttaacagcaaagagtgggctacttctgcagactatgaagttttgcgtgaatctgaggactcagagtttctgcttcatcaacctagatgttccctttccatgaatcatgtattttgtttccaacctagggatctaaccttagcatagcagagctgctatggttgagaatttaaccttcttgggttcccttcttctgctcttactggtcaaagtcctccttgcccttttggtgtgggatgtgagaacctctttttttttttttttttttttggctacccaagagaccctcttcctttcacatttagcttttaatttcagatcaatcatgttcagcctttgtatctgtcttgtactgcctcaattgagcttagcaatagctgtctaattaccctgtccttagcattagtgtttgcctcatatttctcaaaaaagaaaacacaaaatatcacacccccactagtgtatttcctcccaccagaatactattgcaagacagcagcagtaaaagataagtgggggaaaaggtgttttatttgggggctgcctctgccttatccccagtgaaggaacccatattgcctgccccatgaaaggtgatccaactacagaatctcttttttttttttttttgagatggaataatctcgcccttgtcacccaagctggagtacagtggcgccatctcggctcactgcaacctccacctcccaggttcaagcaattctgcatcagcctcctgagtagctgggattacagatgcacaccaccacgcctggctaatttttgtctttttagtagagacggagtttcaccatgttggccaagctggtcttaaactccttacctcaggtgatctgcccgcctcggcctctcaaagtgcagacattactggtgtgagccaccgtgcccagtccagaatctcatcttagtgtctgttttctcagatcacttttggtatcaactattgttggttgggtttcctgggaagcagactttgagactgagattcatgggcatgaagtttcattttagagtcaaaaccagtggacggcatgagacagaaacagagttgggctgcaattcagtgtcagtaaaagcctcaaggggacccctggggagctctgaatgtggaatggccctgtagagttgtcctgagttgtggtgagtgggtccagcctttatacctccaaattgaccattgattggatgcagactagtccagaaagggatgcaaccttctgcaaggtagctccttttcagccgaagttgttccaaagagggctaaccacttaggattgtctaccagcaatatttctagaagctgagagaataaatccttaattcccaaaagggcatctgggtggcatgtcacatccatgacagtttctggagtacatttccttaattttattttgtgaattactcttagccatgtgagagggtgagaactttattgcttcattgattaaaaattttctttaggagtttcttcattcccatttcattcaaagtctgaggcatgattctttatatttaattactaataattaattttctctatttttgtttctctgtgtaatgaatcatttattttttctatgcccctttacataattgaatagtaagatgatatatttttaaaaagtctattttacaagatacttccagtccctcaactagctttactacttttcaaagttttaataaatagctagcaaagccatggaaatagaatcagcattgtgtgttatagttcctaaattctttaaatatgcatgaaagaagagggcataattttcaccttctatgcaaatatagattctgactaatagaacaccagtggaaaaaaatttttgaattggttttcaaggagcggcgataaattgctggtagttacaccactccctctaactatcccccttaaccatatcttaaccatatgtggtcacagagtcattcttctaatcccatgacgctaactgccttatcaagacaccagacctttgatttcttgttgaaaacatgtctccacatttattctattttcaaatgggttaagagtttcaaaagttggatattttcagtttgaacaaattcacctgtaatgtagtagcatgcttgccccttttctcagttttagttctttcaaataggtcagaacttgcactcatgcctcccttagtgattcttagaattctctgtggctgttaatccctaatcactttcttatgctgattattcccattttcagatgctataaaaatgtaacaccttttaaacatacttagtacagtagtcactgtgattatttttaatgaaacactttaacgtagacccttctttccccaagactttccatttaaagacataatagagcaattatttttagacgtccaagcaaatttgcaagaactacaatatacatatagcatgttgtccataattatccagcaatcatttgaacatgttatatttcctagctcatagaaacagcagggatagaaaaatccgttaggcatgattcctgccctcagggagctttggacaggcagatgtgaagccagaataccatggtaggttgtaatcactgccgtgacagaggtagcaaaggagaataacagcggagggaaagctatgtctagggagaggaaggaactctagaaggaagaggacatttcagccaattttgaagaatccattcaccaggtggctgtgaggtggaaaggtactacagagacaaggaatgacatgtacagaggcaaacagaggtcaaaaaacatgataaaatctggcgactactttgctctgtctgaaaacaatcttcttgtgagggagtaacacagaattgaggctggaaaggtaggtaaggtagccttcacataacagctgaggtatttgcccttcatcttggaagaaaaggaatgagatcaaatgactttggaagtaacacgtcattgggagtgcatgagtaacagtaaacaaatgacgttcatagaggactacatttgcatatccacaggcaaagcattttccttgttgtggaaataaatacagagctatttgatacatggacaaaagaatggttccacttggaatgaggagttttgagttcaactaattataaaaataaattccttagcttttgggtgattccatgaaaatctttattattacaattattagataaattagcttcatcaaattcatatgacacccttacagaaaacacattaaaatgtgaatgatagttttctgagcatatctaatgtaggaagggaaaaaaaaactctttttttcagtagtcatggccttcacatcactctgaatcttttttttttttttttttttttttttggggagacagagtctccctctgtctccaggctggagatcagaatcttggctcactgcaacctccgcctcctgggttcaagtgattcttctgcctcagcctcccaagtggctgggactacaggtgcgcaccatcacacccagctaatttttgtatttttagtagcgatggggtttcaccatgttggccaggatggtcttgatctgccacctcggcttcccaaagtgctgcgattataggcgtgagccacagcgccctgccagtaatttgtttttcaaagcataaaacagtaatgttattttaatattcctataagccacctcatcgttttaataccttatatattcactaagtaaaattgccatgatacaaacataataaatgctgctactagaatagatttgtttgcagtaataggcctttacaataataggatgtttcatttgactgtgaacctattttttttcaaagaaattttattaaaattattgtacttttcaataaaacaaccattcgttagctggaatttatgaagacaattctattactgaaaatttgaaacataatttattcatttaacatgagtgcaaaaacttttgggtggtgaaatactgttatttaaaataatgctgaaaactatgatatataggtaagtgttgcttgctttcagggtgagaaagcaaatgtgattgcgatcagaatatctgttttaaaaaatatagtacactttggaataaaaaagattaaaaggcacatgatttaaaaaaagtgcgacacataactattcttggaaataaggaatattcttgaaggactaataccaaatatcctcgttaaatacattttctttaatgcagggtcatctgcttttttttttaatgggatgaaacttgttaaaatataatttaaaatatgtttaagtagaattgtgtcaattcttttaatgtattgcattttttttctgtttttaaatgtacacatcagtaagactacaaaactttacgtttttattatttttccttctagatttattcctgacgacattgaatgccaccactagtaccttccagtttgaaatatgggaaaatttggtaagaaatcttttccttgaagcattttaaaatgatggctttcagtaaaagcacacaattttagaaaataaaatgaaaataatcacttggttgatttcaacaataaatagaaaactttaagagcctttggttgcattgctgcattcaaactactgaatatttctgaaggaagtgattcattcagcatcagttactctgcaggtttttaggcatgactgccaattaaaccaatcaggctgccctaatgtgcatgttaacaggacccctgctatgctgtcagctgttgagagagttactgtcatttaatttgtcagcatgatggtttatgaaaaaaaactattttaaaaagaccaatttttcccctttgcctttaggcttatataaagaaataagacaacaaacaccaaacttactgccacgttgactaggattaagaaatctttcccaatagggtttttttttttttaattgtaagtagaagattcccaaaccaatgtcatgattttgttttacttttagcttgatgtgagttatatgatggattaattaatgaagaataaacaacctgaaattttaaagttaaatttcaggctacatagtagaagacaggatctgagaccagaccaaactggccatcacagtgacattcgtgaagtattggccaagtatcgaaccccactttccacacacagaaaatgggcgtaagagcctctgcttcacaggatctttatgaagatcaaatgaaacagtttgtgtaacatgcctgacatgcagtaggcatttatcgaattttaattttaggtctgttgatttcccatctgcaactcctgattgtattttattcaatccaaattaaacccataaccttttataaattttattaaaatgctgataaaaaataagcagatttttgaaatgtaaagcacaaacttatggaaggagactcagactcattatcagccatccctcataatatggtaagtgatgctggtcatgactcagatctcttcatggaaggaaactacgatggggggttgctttgtttagatgaaatcagagcttccgactacttctaagctcagcaatttgattctttttttttgtttttttaaatggggcaaggggaagtaagacatctaaatcaaaaaagacttatttaatgtactactttttaaaaaaatgcagttatatttgtttttctgataatagaaatatggttgctatatttttatgactgccgtacattaagtccccactgctgggagaagtttgtttgcaggtggcctttcattgctaccacaagtgaatcttctagtattagaaaatgagaggtgtatttgattaacttgtatctgagggtcgggggaagcctcattataaataagtagaatatctatagaacataatgaaacacccttaagtatctgaggttctttcagtctaggctgatttaaacttaatggaatgaagcaactcaataggagaagattcttgatgaataaaatagattttgactgggtcttttgttattgttttctttaaagaaaactaataaattcactgttagaaaatggggactaagggtttttcttcttataaagggctggatcagtaagtaacttttaaagaaaaaagtatttttaaactcttgttaaagatggtaaggcagattttcttcaagagtgctcctacagtggggttttgcagtagggggaagagattggactcacctccaaatacaaggaaaatcaggatgttataaccaatgagcaggatgggggtcagtggaagggaaattacttgggcagggtagtggttgggataagttaagcagagttctcagaggagcctaaccaaagtttggtcaaggagataatctttctcagtttccacagtaacaatagttaatcattagtagattcagaattaactaggatagataaagttttgttttcataaaatgaatgatcattttcaattagagattggacagagactttgcagtcacatactaatttgccaaaaaaacctcaaaacctataaaaccacattagccagtagaagaatgaaagctcaacaaatcttcttacatatcagttgcatgtacagccccatggtagtgctctggcagttacagaagtgaatagggcttgtaggctaggagctgggatgtgagtgtggatgaccctggctggtatgatgagatatacattatgctacaggaattcaaagagcagttgcttctatctgattccagaattatcagtgaaggcctcaagaaagatgtggtatttaggccaggtgtggtggctcacacctgtaatcccatcactttgggaggctgaggcggccagatcatctgaggtcaggagttcaagaccagccttgccaacatggtgaaaccccgtctctactaaaaatagaaaattagcttggtatagtggtgcacacctgtagtcccagctattcggaggctgaggcaagagaatcacttgatcctgggaggtggaggttgcagtgagccgagattgcaccactgcactccagcctgggcgacaagagcaaaactccatctcaaaaggaaaaaaaaagatgtagtattcaacatgactagtatgaattaaaggattttagtgatttggaagtgagaaagaaagaggaaaaggcaggcaaggaattgcacaggagacacaagacacatccagatggtataaagtggctgatttaggccagaacatgaaagagatattgaaatgtaagactagaaaaattggtttatacaagatcagcaagagctttgatctctaaactaagtaatatgatctcttaaaaatctactgagaagctattgttttaggactgagagtgagatgaacagagccttcattattgcaattaaattggccactgcatatcagataggttagcatgcaacatctggacgtagggagattaaagtttatagtaaatttaggaggaatttataataacctgggaaagagatgaatgattaaagaaggaaatgttggaaatagacaaaaagggttagatatgagaatatgggatgaccattaacacagtgcttacttgtgttttcttctggtgagcaataagagaaatagaggccaggcacagtagctcacacctgtaatcccagtactttgggaggctgaggcaggcagatcattggagtttgggagtttaagaccaggctggccagctggtgaaaccccatctctactaaaaatacaaaaattagctaggtgtggtggcacatgcctgtagtcccagctacttgggaggctgaggcagaagaatcgcttgaacccaggaggcagaggttgcagtgagatcatgccactgcattccagcctgggaaacagagcaagactccatctcaaaaaataaaaaaaaaaaaaagagagaaatagaaaagacgaaagaagtaactaattttgggcaggaaaaaaattattttagaatagagatatgtctcccaactactcaggaggctgaggcaggaggattgcttgagcccaagagtttgaggctgcagtgagctatgattgcaccactgcactccagcctgagcgacagagcaagacctcatctctatattaaaaatttttttaaaaaagcaaaaaacagagacatgtcaaggaattggttagaaatgtaggaacagaactcaaggaagaaagtaggtaagtgtcgtggaggaagagtgaagaatggcaaaaccagagaccatcctggctaacacggtgaaacccctctctactaaaaatacagaaaattagctgggtgcggtggcgggcgcctgtagtcccagctactggggggctgaggtaggagaatggcgtgaacctgggaggtggagcttgcagtgagccgagatcgcaccactgtactccagcctgggtgaaagagcgagactctgtctcaggaaaaaaaaaaaaaaagagagagtggcaaaaccagatccttgggcaccctttatgtcagaatttttcagcgttggcacatcaccattttgagccagataattctttctgtgaagaactgtcttgttcattgtcgattgtttagcagtgtccctgacctcttctcactagttcatagtaaccacctcccacttgtgacaatcaaaaatgtctgcagacattgccagatgttctcaggggactaaaattccctcagttgagaaccactgctttacataaataaagataggggcatgcagtcatcattacatactgcttcatggtcagtttttacctttataaatatggcagttttaacattaaatattaaacatgaaagccaaagcattgatagtcatctatgaaaggctacttgctaccacatgacacatttggttggaattcaagtagaaaatggcagaaagtcttcctgtcaacaggtgtgggttaactgcttcagtggttttggtagttgtggtagcagtagtaacagcattactactagtgttcctactactattactaacattaaatgcatgctgtgtgctaggcactatactgagcattttatatggattatctccttaatcctcacaaaatccttgtaaaaatacattttttaataagtcaaggaatgcttaaagaaggactaacttattcctgcctcatggctagcaaacagtggagctgcgagttgagctaggaaatctgtttctaaactttctacccttaagtcattgaaattagtacacaataattccagaaaccaactcagaaaagaaaaggtaaagagatgactgcaacagaagcccctagtgagttcgttgaattttggattgcagggaaacagtgcagatcggtaagaacatcacagtaagaaatgctgcagtcaaaggatccaaaattgcagctaactaggaataatttctagtgttccatagcactgcagttgacaggatgactgcgattaacaataatatatagtttcaaatacctggaattgacacaggattttttcagtgccacttcgccagctagagacctccaccgctggtggggcctctgctcaagtttcacttacaacctctgggctggcactgccctctcgacccggcaggctgtgtttggctcgcactaccagtcctaatctcacacccactgtgggcaagccaggcactgcgtgatgaggggtgtataagcaagcaagtgcagggcagctgccccaggcgccaactccatgcaaggctgaggctcaaccgggcatactacaagcagcttctgacttaggcgccagcgtttggacaacgggagcatagtggcatctaaaaacttggagacaccagcaactgcagggccctaaagggggtgttacagtggacaaccagagattgagcaaggtggagaagagttttatttagcaacagaatagctctcagtggacaggggacctgaagtgggcagcccctacccaaaagcagggaatccccacgtgtggctgggtctggggtttttatgggctcagaatgggggagtgcatgtggattggtccatggcggcctcggaaaagcaccattttattgtctaagaggcatcaaggaagttctcactctggtcggggactttacccggaactggctgcttggtttcaggctttagtttttctttggtttgaaggtcgggtttcaccggggacccatccctatttgcctaggaatttgtctgcctcctgccgctattagaaggaggatattgaggccaggcacagtagctaacgcctgtaatcccagcactttggaaggccaaggtgggtggatcacgaggtcaggagattaagaccatcctggttaacacggtgaaaccccgtccgtactaaaaacacaaaaaaagttagccgggagtggtggcaggtgtgtgtagtcccagctactcgggaggctgaagcaggagaatggcgtgaacccgggaagtggagttggagtgagccaagatcgcgccactgccctccagcctgcacaacacagcaagactccatctcaaaaaaaaaaaaaaaaaaaaaaaagaggatattgaatattctgaataggaagaaatgataaatgtttgagatgatcgatatgctaaaaaccctgatccaatcactatacaagtatcacaacatcactgtgtgccccatgagtatgtataattatttatcagtttttaaaaaatagtacagtataaaaaaaagtagtattgtttgtttcataacaaaattactctcatactaaagaacataaatatacaaataggtggagattccaatccaaaagtaaaagagagagtcagaccatggagtaaatgagtagcaaatggcatcctgtgaaaaaagtacttgcagatcataagcacaggactgccattatgacagtaccatataggtgcctgatacgttgcattttgcagaacactgttgcctttcattccatttgacctctccagaaccctgcaagtagacagtatgtttaatcccttctaacaactgaagaactgaagcctagaacgatgaatggctgtcccaaagtgacataacttttcagtgaaaaaggactggaacccacctcaccttactccaattctagtgttctttgcaccagactgttctcccagaatatgttcaaaatgaaaaacagtattgatcatgtttctcctgcctcattaatagctaccgagcagcttcatctttgaaaatgagcgtagttatgctgcactttaaaatgtattatctattgagataaaatatattgatgatgcagtttattaaatcatttcattacatattaaatatgtaaataatctgaatggaaatgaagttatatatgtttatactgctaagcaaagtaaagaacaagtgatgataataatggaaaagttgtctaataaagtgttgtcttttcccccaactctgtcacatgtctaatgtgttctgcttactctcactatggccagaacgtattcttttcctccagcaattggaagtgggcattgctcttctattgatgctcagtgtgaaagtggcatcttagaagacatggaaggctgttacttcaatatttcttgatagagataaatcatgaggttatatctatatatttctagatatatttaccaaaattcatagaccttcagtggggtaatctgttcacttcagttagtatattgagttgatattcagctttatctcatagaaggctgatatattttaagagagatttttccattcattcatgaaacattctatccactctacacaatgctgaatgctgtgatcttttttttttttttttttttttttttttttgagatggagtcttgctctgtcacccaggctggagtacagtgactcagtcttggctcacttgcttgctccacctcccaggttcacgtgattctcctgcctcagcctccctagtagctgggattacaggtgtgcactaccaaacccagctaatttttcttgtatttttagtagagatggggtttcatcatgttggccaggctggtcttgatctcctaacctcaagtgatctgcctgcctcggccttccaaagtgctgggattgcaagtgtgagccaccatgcccggccaatgctgtgatcttttttttttttttttttttaattgagacggagtctcgctctgtcacccaggctggagtgcagtggtgcaatctcggcttactgcaagctccgcctcctgggttcacaccattcttctgcctcagcctcctgagtatctgggactacaggcacccgccaacatgcctggctaattttttgtatttttagtagagacggggtttcaccgtgttagccaggatggtcttcatctcctgacctgatccgcccgcctcgacctcccaaagtgctgggattacaggcatgagccactgcgctgggccaatgctgtgatctttctaaaatgaaaaagcacttgacacttcagctagggatttggcaactatgacacatctctagtgcagtttcaggttctaggtaagactggagggaaagcctgaggcttaatacacttactaaataagatgtctatagaaaatcattgaaaaatacatcagatgctttaataatgggaggggaaacatgtttctgcacagggacaatggagtgttaaagtggttggaacattgcttgtcacatgaaaaatcttatttccttactcatggtcctcaagcatttgggttttgtgcttttgttatagcatttctctgtaaagatcagcagtgatttcttaagaaaccaacttgcagattgtgataatatgaaatacaaatttggcgttagtccccacttcctaacatagaacttctgaaagacctagaatctccaaagggatgtctgtttgtatgctaatgagttgattggtggatggcaaccccaaaataacttcagaatgtgactggtcaccagaatgaccaagacatgattagaggattgggacttttagcccttccccacagcctccaggaatgggggagagtctgaaggttaaagtaatcaccagtggccagcggtttaaccaatcatgcctacataatgaaaccatcataaaaacctaaaagaactaggttctgagagcttcctgatagctgaacaggtggaagttcctggaggttggagtgcccagagagggcatggaagctctgtgacccttccgtacctcgccctactcatctcttcatctgtatcctttgtaatatcctctataataactaagtaaatatgtttcccagagttctgcgagccactccagctgtgaatccaaagagggggtggtgtgagtcccaacttgaagctggtcaggcagaaatactggaggtccaaactttggactggtgtctagggtaatttgagggactgagccctcaacctgtggaattagaggacagccaggtagtatccactgcagaaatgattgcttgtttatggtggggagaagtcccccacatttagtcacagaagtcttatgtctgttgattcttgtgagagagcataagggagaaaaccagtgctcatttttttactcagacagatctacagtatccttagaggagcaaagaaggaaaaactcattttaaagtatacagatatcctgtatacagtatgtaggaatcagagtcagtatctcaaacagaaaatagagaggtcagtgataagaagaactctgtacaaacctgagagctcagaatttcaaattcattgttttgatttctttttcttgtgtaataatctaaaattaagaagggaaaggcaataatttaaagaaatgcatattatttttggtaatcagatgtgtgctgtttttgtttggaaagagtgagtgaaacaaaggatcgctgataagctctccttttctatttagcttaggcacctctgcttctcagtcagcacatggctgctgttgcaatcctttgcttctcttctcattgatatgtaaacttgagttgatggattggccctttaaggatcaatgaaattctcctctcatttcaatatcttttcttaattgttcccaacagaatcttcttcccttaaaatctgcaaaacatgtctttgtacttatactaattatgtgttaccgtcagaaatcctatttttctgacttatattctatctcccaactggactgtaagctctttgaggataggaactagttttataattctttacatttccaaagccttccacagtacttgaaattattactctctgaaattatggtgatgatttggtaaaagatactagaattgacagcaaggaaagcataccacattcatattttcttcctcaactcacaggagtttcctttgcttcaaaataaaagtgaaacaggagattggaataatttttgtgcaatacaacaaaatactgaagttatttatttccccagttcagttagaatgctttgttttacacttaacaaatgagtggattaagatggtctaattcaaagttttcttcatttaacaggatggaaacttctctgtcagtactatattggaaaaacctcaaaatatgatggtggttggacagtcagcatttgcagactttggtaagatttggtaaaaaaaaaaaaaaaaggcttttgcctttccaattctctccttctttctgttctatttatattaattccccatagcaggaaataactccagggtcttcagagctattatagcttcaaaagatgcctattccataatagtattgtatgtgacatgtcaattccttaatgaaataaggagaaatttatgatgtgtttaaaaaatagtttgatactgtttgcagaagtaatatgcaaaacaagaaaactactgagactttttctagagaattccaggtattaattaccgtaaattcttcacgtatatacaacatatggaacaaatagaagtgaaggagttaatatgacctcttaaaaccaatactaaaagccatttttattacaacttaattttaaagcagattaatgtctattatgaattacccaaaagaggacatatgaatttctgttttccgtaagattctgcacaatcaagttcacattggtcaggaacttccaaagcatatgtggctctttttatcatttgtcagagtaattgtatgagatgggaaagtggtctgccccacctaaaagctgttcagtgcttgttcccatcctgctgatccttcattatgccaataaaccaccgtaggctttcctcaaaatgtagatgagacatcaccatgttcagatacctcagcttcttcatatataaaatgggaatgacagtaatatccacctctaaaggctattatgaatagcacaatgtaaatgaagcacagtgacaggcttatagcaagagcacaagaagttagagtttgagctgggtacagtggctctcgcctatagcccgagctacttggtaggactgtttgagctcaggaattcaagtccatcctgggcaacatagtggaacctcatctcaaattgtagtttgagtctattcattggacttacatgttttttgttcttgttgcctctgctgctctgtatgcagctgactaaatcaagtcactgttcagtgtcatatggatgtatcccaacacagctaaaccaggaggtttgataatgtcatatcatggaaattttaacatgaatctctatgttgtcctgtattttagttatattgaatattatgttaattttaagtaaatttctgttgcctttacagtttttaatgccaatagtcaagtgatagaacacatgatgttattttttggaattttctggctaatttgattagctagattaataacagctctatctgcaagtctctctttaggaaaaaagtgtatatgtactacataattttcagggagtacagagatctctctgacccccttaagccctggttaaaaactccaaattaaagttatatcttttatgatcgtgtgttttatatcataaaatgccttacttttaacaaaattattagtagctttactttgaggattttttacaattttgctaaacataaacgtttgcatgttagtgtttttaagatatgcagattataagacacagtcaaattaagaaacatatctattgctccatgtttttaatagctttgggtagttcatcagtaaacttttttaatagtacacttttaataaatatcacacattggctttttaaaagttcatgtatttttagttgaatattggtaaaaaagactgctgggtccaaaaatatgaatattaacatatcaaaaatatgcatttttcctgtgaaaagtgtacatttgaatatatttgtgaattgcatccagccctccatcttcctttccacctacttcctttgaaccaaaacaagggaagtgactgaccgccaggaagtcagcatgattcaagaaatttaccattcagttgataaagagtgcacatgcttaaataagtgatgtaagtgacaagaagtctgtaccaaagagaagtgtttaaatggctcccagctcacttgtctaaaaaaaaagagaagactagaaaggaacagagccaaagggtaataatggttttgttaaagtaggaaaatagattatcttattccctattttccaaattttgttatgtggctagaataatatgttaatttaatagcaaaaaagtaaattatagagaagtagtagtcaacaatggcaagaaataaaccaaagtatatacttactgcccagtaaaaaaagtgttatttttatcatagaacttttgagttcatgtaaaattgatactattttctgagtggcatgaacgactcatttagaaaaggttgtgtatggctgggtgtggtggtttgtacctgtagtctcagcttctcggggctgaggcaggagaattgcttgagcacagggggtcaaggctgcagtgagctgtggtcaagccactgcaccctagcctaggcaacacaagtgagacctcatctctaaaaaaaatttttttaaagaatgaaagaagaggttgtgtagtttcacagggtctttaacaccaaataaaatgtaaaagttagacctctgaaaaaaattaaacttctattatgctttaaatattgtgctgaatactatgtaagaaaactgattttaaaggtaacatccttgtctttaggaattttacaggcctggtgcaatagttcacacctgtaatgccaacactttgggaggctgaggcgggaggatcacttgagctcaggagtttgagaccagcctgggcaacatgatgaaaccccatctctaccaaaaatacaaaaaaattagctggacgtggtggcacaagcctgtggtccaggctactcaggagactgatgtgggaggatcacttgagcctgggaggcagacgttgcagtgaacagtgatcgtgccactgcactccaacctgggtggacagagtgagaccccctctcaaaaaataaataaataaataaataagaaagaaagaaatttatagtccagttgggaagacagaatatgaatatgttaaaaaaaatacaagagtaaagcaacaagtaactgccacaatataagagaaaccaaactgcatttcattgttgattatgaaattaatgccatggaaaaagtgctaataagtcttgtggaaacatagattatcctaagctgagaaagggtacaaaagcctcatggaagtggtgagattttgtactggactttggctaaaaatatgtggagacataaaaatggtttggttagtgactagtgaataaaccactttgggttgaatcgacagtttctgtaaaaatatagaagcataataaatggcctgggaatccattggattaccaaatgaataacagatgaacaaatgttgattttattctgtagaagtgatgggaaatagtagaacaattttgaacatctctttgttaataccttttttattaacttcagaaagtaaagttgaacaaaatttctggtctggtgggatatgcataatgtaatgcttcttgagcatgcagtaggagttcagaggaagattattagaacctctgaggtgcctgagattttgatgttaaaagagaggcagatttaaacagtcttaaaatgcagtattttctaaaggtggaaaccactcaggagacaggtcagggcatgaggtggtgagagccggagctggactacatcagtatgtggagggaatcagtaaatttgctgattggtttgacactagagagagtaaaaagtaaaaaattgactctgaattacctaaaaaagggtgatactattcacaaagataggtaaatcaggagagggagctggattgggtactgagacgctttaaagttatcacattaatcgtgctgtaaagacaacaaagccatcacatttagcagacctaagatgagggaaaaagccagggcaggtgtgagagccctttaagagggaagaggtcaagactgagatgagccctccaaacaagaaggtgtaaaatggagattgacagagggctaagtagggagaaaaatgggtgctaaaaggtggtcagaaaccatcggcagatactaaaatataatgcaaaagaagaccaagaaaagacctttagattttcattttagcagggtattagtggcccaaaagttatcatttgcagaattcttagagcagtcccttagtcatagaaattacccaataaatacttgctgctactggtaagtgtcagatgaggttctgggccctggtctcatatttggaacatctgcaacccataaatgtctctcatacctaagaaataatcaaggaaggtgtatcttctagaagacatgttttctgtcttgccctactatatcttccttttaaactgtattttaatcttgagtctctttctacgtaggctctgaatatcaaattctagaattcctataaataaggtgttatctcttattaaattatataggacaaaaagtcaatagaaattagagaaaatgggtatcaattttgtatgtaatactaggtgtagtggaaatcaataaaagctataaaactgaagggaaaacagaaaccttatacagaatgtcagcattttttatagattgaattattgtaaatgtcatataaatttatttataaattatacagatctcatgctaactgctgtgtatcacatcttcagaaggagatcacactttcttcttcaagtaaagggagaatactgggcatgatgaattgggccttggaattttcagtcagatctaaataatcctataaaaaataaaggaactaatgaaaatggaaaactgtcattcgtgaaagttataaacatactagaaaatcttgaacaacttaaagatagtgtcattgatggttaaccccaaatatgattcaatgagtacacccagtacctagcacagtaatcaatgacatttagtaaagtaaaggagaaaggtagggacaccccacattaaagttgttttgtgaagccttataatatttggtaaagattcagatgttaattctaaattaaccatcgtggagctgatttcaaagcatttatagcaattatgcttcctttgttttatggctaggtgtattgagtaaccatctgacaaattaaaattgtttcttgttcatgtttgatctggaaagtaaatcagatgcgccgtgtgtggaaatgtaaattttatatttagtctgaatgctaattggtaattgaatgttcatattctctctcacaaaagaattttaaaaatcaaatgccttcaaataaacaggtgatgattatattataaaagaagctagaaagcagaaagttctgggtgctatgctttctgtacttggtcttattatgtaaatcatttaagattggcttttggtccacagtcttacattaatggcactcttgtttgtttgtatcttatagttgaaaattggctgctgtttcgttaagtagcccttttcattgaaaagggacattgaacactagtcaaaaaatcaataaaacagaggaatgtttgaagttgcagatattctctcttaaatgtactactgtaccatatcactgtcattgccagtcagaaattatcaagtaaatacagagtacattaatatgtataatatgggcaaattagatgtaagtgctgcattataatactttgatattcttcaaattgtatggtacatacataggattcagtcaaatagctcagtcaaatagcatgtttattctttaaaattgtggagcaattcattttccttccatttagttgcctttctgttttataatgaaatatttttattgtgtacaaggcattggttaatgaattcaaaaaacgttttagagttcctactatttggactggctgtgtattatatgcttggcatatagccaagcctcaagcatacaaaaaccctgttctcatgaagtttaaattctattgagggaagaaagacaaaaacaattaaattaataaggaattattagaaagttgtaagagctctgagggaattaaacaaagggctataataggaaatgagaagggctattttaagtagctcgttggaggttacatctgatctgagacttgagtgaagttgtagaaggtttttggggaaaatgctccatgcagacggaacacataagtgaagattctaaggcaacagtaagcttgatgttcaaggaacaaaaagaaggctggcacttggccaggtcttgtagtgctttgtggacaaaggtaacaaggagtttggattttattctaaatgtaactggaaacttcaaggggactagttaagagggaaaagctatggtgacttggaccagggaaaccaccaggaaatggatagaaatagtcttatttaggacatattggagacaaagttgacaagaaatgctgatggattagatgttgaggggaagagaaaaagaagactgatttctagatttttggtttgaacaactcagcgccatttgatgaggtaggaaaggagtaggaagaggaactctggagttctgttaattgatagttctgtttgggacatgttaagtttgagatgtctgttagaagacaaaatgaaatacaaatgggagataaaagctctggagagacacagagttggatattagcatgtccttgtttaactgccatttagaagacagataatggataaatgaaggagcgcatgtccaaagcatcctgcctttgtttctaacattataaatgcacctgtgctccagtcacattgcctccttggtgttctgcaaattgtccctcctgaggcctttgcccttgcttatccctctgcatgatattcctcatgactcacccccataccaccttctggttttgccacatcaccctctcctggaggccttccctgaccactctatttaaaactgtaaaccctacccccagcacttccgccctgctttcctgctttatttttctccattgcagactattgctgacatggtattcattctactcatgtgccctcaccagaactccattggtgtattttgtccaccattatatctctcaagcctatagcagtgccagtcacattataaatactaatgaataatattaaatgaattatttaattaaatgaaaaatactctattcaattggatattaactattcagtattaacattgaaaatttcaaaatattataaatggtttttaagaattaagtttaggaaatattaagaccttcaactataatcctaaaccagaacttctgagattcattcatatgataaagattaacatatcattacttttgcttattttgattaaagttaagtgattaaaaattgttctgaatctaaaatgcatgggtgctggtttcagtaggagacatcctggatccttataaattgttaattcttagtcttcctatttacattttctaattcatgaattctgaccagtagataacaacatacattatctacagtatttactgttatttagcatttaaatagacaactgtatttgtacagcttcttaatatccttttgttttttcatagtgccaattctgtttccatgtattcgaagtcatcataatcagttaaaacagttctccctctaacctgcgggacctttgtctcccttagcctactctgctcctatcccatcaaaaaaggacaatgctattagaaatttttggtaaaacaaatattttatgtgcactcattgccacaaagcacccaaagtggtgaggtgttcttagagtcctcttctaatatttgcaatactctttcaaacaaataataaacccaggtcattagtatttccttttcattccatgtctgtgatgattgcagtgcaatagttaccacagcaaaagtgattagttcctgagtttctaccttgtagcaaagacttctctgaggcatctatcttggtgagtcatggatgccagatgtgattctgataaatattttgaatgctttttgattggaaatcataatttatataaaaattataaaatggctgcttcatagtcttgactttttacatattcaacatctaaagcagactaggctatattagtttcttttaaggtatacaaatatgaggaaaaactaggactctatatccctggagccattttgtacaggtttgcatataataaattcatgcctttctaggtaagagtgtttttttcctaaatatacctctgacatattgtattctcaagactatactgtgcattgcatttaatttttttttttttttttttttgagacggagtcttgctctgtcacctaggctggagtgcggtggcatgatctcagctcactgaaagctccgcctcccaggttcacgccattcttctgcctcagcctcccgggtcgctgggactacaggtgcccaccaccacgcccggctaattgttttgtatttttagtagagacggggtttcaccatgttagccaggttggtctcgatctcctgacctcacgatccgcccacctcagcctcccaaagtggtgggattacaggcgggagccactgcgcccagccgcatttaatttttttaatgatgaatggtattatgaatgtatactcagccttttcaatattaaatttagcatacttaaaaatgctatgggataatgttgtattttacattattatattgctattttgtaatttaatagatggtatgtttaatactttctaatataacccacaaattaattggaatatttgtcactctaagcctaccctagttaatataattgatctatgataaatggagcaccccatgaaactgttctgttaactatgcatagctctttcttttttttttttattgcaacagtactatgaaagtgattattgcagataacttggctattgttagaccttacagatacatatagctaggaaggaccaaaagatggtgagatttatttctctatggcacattacacctgagaggaattccctgccatgagtcagagtggcataggagctcattatgaagagcctaatgccactcctaggcagaaaatatcctgccctattttcaaacacgtctgacttccatttcaaccccatattttcccctccgtaactccacattttcactctgtgtaaatgccccattcattgataagtcatagttgtgcttcttggatgtaggcatgtacacagcttttctgtgcttaaccttaacccaatgaagagctgaataatgaattgatgggttgaatgaatggtgggtgatggatggatagtgactgaatggatgaaagtgccctttactacttatcacttattcacagcaatccattccctccgactctctcacaaagcaatcctattttcctgttcggttccctagtagcaagacagttcccttttagtccttgttacacacagacaagtggacattctctgtatttaacttgcccctgcctatcatcacatcaccctctgtaactaatatatgttgaatttaatcaagagaaagctttcaaatttttgttaatcagtgacgttgaaaggatttacaagttttgtatattgcaaatgtctctttgcttctttttcataatgctcaaaaatagttatttttggcagaaactatttcatagaaaatattttacatttatctcaagtaatctttccaaacctttctgaggtgaacaatattgtttagccacattatagaatgtggtaataggggttcagagaagttaagaaacttgaccaagggcacatagctagggagggagtggcagagctgggacatgatctttggctctgtctcacaagctgtatccttaccttaaacactatacactccttcttcatctgcattagtttaaattttaaaatatgttatcatcttcagtaatggtcaccaacagtgacctactagtatatatgctgtttgcttttagaaccatgtgttttgatagtgaatcttctccatctgctccctgtggttttcacatattatttttagaatttttatactctttgaccactctcccaagtcatccatctcaaaaatatgattatgtatatctataattctagaatatatgtttatggattccagaaaaaataaacccaagcaatagtgattttgatataaaatttattaaaaattgatttctgttggaataaaacaagctttcagaatataaattttttgtaggtttttgtaaatttttagttaacatgtaatacttatacatatttgtgggatacaatgtgatgtttcaatacatgtatacattgtgtaacgttcaaatcagtaattagcaaatctatcacctcaagcatcgtttctttgtggtgagaacattaaaaataatctcttttagctattatgaaatacacaatacatcacagctacctatagtcaccctactgtgcagtagaacaccagaaagtattctgccagtcttaactgtaactttgtgccctttgaccaagctctctccatatcctctccccagcctctgataatcactattctctctacttctatgagatctacttattttagattccacatatgagtgaattcatatggtatttattttctgggtctggcttatttcacttgacataatgacctccaggttcatccatgttgtcgtaaatgacaggactacattccttttcgtgtctgaacaatatatcattgtatatagataccacatttttttttatccattcatacatttgatggactcaggttgtttccttatcttggctattgtgaatagtgctgtaataaacatagggatatagatatctcttgaaatactgatttcatttcctttagctatatacccagtagtaggattgctgaatcatatgatagttctattcgtaatatttttttaggaaactccatactgttttacataatggctgtactaatttacattcccaccaacaatatgtcagggttccctgttctccacttcttcaccaacacttgctatcgtttttcataatagccactctaactagagtgaggtgatagatatctcgttgtgattttgatttgcattttctgatgattcatgatgttgagcattttttcatatacttattggccatttctgtgttgtcttttgagaaatgtccattcaggtcttttgcccatttttaatcacaattttttttggtattgaattctttgggttccttattaattcttatattaacactgtcagatgtatagattgcaaataccttttccattttttaggttgtctcatcactcttacttgtttcctttgatgtgcagaagctttttagttagctgtaatctcatttgcctacttttgcttttgttgcctgtgcttttgaggtcttatctaaaaaaatccttgacaagaccaatgtcatgaagtatttccccatgtatttttttagtagtttcagagttctaagtcttacctttaaggctttaacctattttgaattgatttttttaatatgatgagaaatgggggttgactttcattcttctgcatgtagaaatccaattttcccaacaccatttattgaagagactgtcctttccccagtgtgtgttcttggtacctttgtcaaagatcagctggctgtagatgcatggatttatatctgtattcatattctgttctattggtctatgtttctgtttttatgacagtatcatgctgtattgattaccatagctttgtagtatgttttaaagtaaggtattatggtgccccccagctttgttctttttgcttaagattactttggctattcaaagtctgttgtggttccacacaaacgttaggatttttttccctactattgtcaagaatgtcattggtattttgatagggattgcagtgaatctgtagattgctttgggtagtgtggtcattttaaccatattcctttggttatatttatgaattcttgcgattcatgaacacagggtatcttttcattatttgtatctgattcaatttctttcatcaattttctagttttgttataaagatctttcatctccttaggcttaatctcagtatcttattttttttgtaaatattgtaagtgggatttttttcttgatttctttttcagatagtttattattatgtatagaaatgctactgatttttgcatgttgatttgtatcctgcacctttactgaattcatttattaattctaaaagggttttttttgatggagtctagggttatataagataatgtcatctgcaaacaagaacagtttgactgcctcctttccaatttgaatatcttttaatatctttcacataattgctctggctaagatttccaatttttttttaatacaagtggtgaaactgggcatccttgtcttcttccatatcttaggggaaaagctttctttcaactttttccttttcaattgatgttagctgtaggtttgtcatatatggtttttattgtgttgaggtacatacctgctatacctaatctgttgagaggtttttatcacaaagggatactgaattctgtcaaatgctttttcttcatctattattgtcaatctcatttattgatttgtgtatattgaaccatttttatgcctctgggatgaatcccacttgatcgtggtgattcttttttttaattttttttaattatactttaagttctagggtacatgtgcacaatgtgcaggtttgttacatatgtctacatgtgccatcttggtgtgctgcacccattaactcatcatttagcattaggtatatctactaatgctatccctcccccctcaccctaccccacaacaggccccggtgtgtgatattccccttcctgtgtccaactgttctcattgttcaattcccacctatgagtgagaacatgtggtgtttggttttttgtccttggcgatagtttgctgagaatcatggtttccagcttcatccatgtcgctacaaaggagatgaactcatcattttttatggctgcatagtattccatggtgtatatgtgccacattttcgtaatccagtctgtcattgttggacatttgggttggttccaagtctttgctattgtgaatagtgtcgcaataaacatatgtgtgcatgtgtctttatagcagcatgatttatattcctttgggtatatacccagtaatgggacggctgggtcaaatggtatttctagttctagatccctgaggaatcgccacactgactcccacaatggttgaactagtttacggtcccaccaacagtataaaagtgttcctctttctccacatcctctccagcacctgttgtttcctgactttttaatgatcgccattctaactggtatagatggtatctcaatgtggttttgatttgcatttctctgatggccagtgatgatgagcattttttcatgtgttttttggctgcataaatgtcttcttttgagaagtgtctgttcatatccttcgcccactttttgatggggttgtttgttttttccttgtaaatttgtttgagttcattgtagatttgggatattacccctttgtcagatgagtagattgcaaaacttttctcccattctgtaggttgcctgttcactctgatggtggtttcttttgctgtgcagaagctctttagtttaattacatcccatttgtcaattttggcttttgttgccattgcttttggtatttgggacatgaagtccttccccatgccaatgtcccgaatggtattgtctaggttttttctagggtttttatgattttaggtctaacatttaagtctttagtccatcttgaattaatttttgtataaggtgtaaggaagggatccagtttcagctttctacatatggctagccagttttcccagcatcatttgttaaatacggaatcctttccccatttcttttttgtcaggtttatcaaatatcagatagttgtagatgtgtggtattatttctgaggggtctgttctgttccattggtctctatctctgtttggtaccagtacatggctgttgtggttactgtagccttgtagtatagtttgaagtcaggtagcgtgatgcctccacctttcttcttttggcttaggattgacttggcaatgcgggctcttttttggttccgtatgaactttaaagtagctttttccaattctctgaagaaagtcactggtagcttgatgcggatggcactgaatctataaattgcccggggcagaatggcaatgttcacgatattgattcttcctatccatgagcatggaatgttcttccatttgtttgtgtcctcttttatttcattgagcagtggtttgtagttctccttgaagaggtccttcacatcccttgtaagttggattcctaggtattttattctctttgaagccattgtgaatgggagttcactcatgatttgactctctgtttgtctgtttttggtgtataagaatgcttgtgatttttgcacattgattttctatcctgagactttgctgaagttgcttatcagcttaaggagattttaggctgagacgatggggttttctagatgtacaatcatgtcatctgcaaacagggacaattcgacttcctcttttcctaattgaataccctttatttccttctcctgcctaattgccctggccagaacttccaacactatgttgaatattagtggtgagagagggcatccctgtcttgtgccagttttcaaagggaatgcttccagtttttgtccattcagtatgatattggctgtggttttgtcataaatagctcttattattttgagatacatcccatcaatacctagtttattgagagtttttagcatgaagcgctgttgaattttgtcaaaggccttttctgcatctattgaaatgacgtggttttgtctttggttctgtttatatgctgggttatgtttattgatttgcatatgttgaaccagccttccatcccagggatgaagcccacttgatcatggtggataagctttttgatgtactgctggattcggtttgtcagtattttattgaggatttttgcatcgatgctcatcagggatattggtctaaaattatctttttttgttgtggctctgcccggctttggtgtcaggatgatgctggcctcataaaatgagttagggaggattccctctttttctattgattggaatagtttcagaaggaatggtaccagctcctccttgtacctcaggtagaattcggctgtgaatccatctggtcctggactgtttttggttggtaagctattaattattgcctcaatttcagagcctgttattggtctattcagagaatcaacttcttcctggtttagtcttgggaggacgtatgtgtcaaggaatttatccatttctactagagtttctagtttatttgtgtagaggtgtttatagtattctctgatggtagtttgtatttctgtgggatcggtggtgatatcccctttatcattttttattgcgtctatttgattcttctctcttttcttctttattagtcttgctagtggtctatcaattttgttgatcttttcaaaaaactagctcctggattcattgattgttttgaagggtttttttgtctctatcttcttcagttctggtctgatcttagttatttcttgccttctgctagcttttgaatgtgtttgctttgcttctctagttcttttaattgtgatattagggtgtcaattttagatctttccttctttctcttgtgggcatttagtgctataaatttccctctacacactgctttgaatgtgtcccagagattctggtatgttgtgtctttgttctcattggtttcaaagaacatctttatttctgccttcatttcgttatttacctacctagtagtcattcaggagcaggttgttcagtttccatgtagttgaccagttttgagtgagtttcttaatcctgagttctagtttgattgcactgtggtctgagagacagtttgttataatttctgttcttctacatttgctgaggagtgctttacttccaactatgtggtcagttttggaataggtgtggtgtggtgctgagaagaatgtatattctgttgatttggggtagagagttctgtagatgtctgttaggtctgcttggtccagagctgaattcaattcctggatatccttgttaactttctctctcattgatctgtttaacattgacagttgggtgttaaagtctcccattattattgtgtgggagtctaagtctctgtgtaggtctctaaggacttgctgtatgaatctgggtgctcctgtattgggtgcatatatatttaggatagttagctcttcttgttgaagtgatccctttaccattatgtaatggtgttctttgtctcttttgatctttgttggtttaaagtctgttttatcagagactaggattgcaacccctgcctttttttgttttccatttgcttggtagatcttcctccatccctttattttgagcctatgtgtgtctctgcacatgagatgggtttcctgaatacagcacactgatgggtctgactctttatccaatttgccagtccgtgccttttaattggagcatttagcccatttacatgtaatgttaatattgttatgtgtgaatttgatcatgtcattatgatgttagctggtaactttgctcattagttgatgcagtttcttcctagcatcagtggtctttacaatttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttgtgaagcttagtttggctggatatgaaattctgggttaaaaattcttttctttaagaatgttgaatattggcccccactctcttctggcttgtagagtttctgctgagagatccgctgttagtctgatgggcttccctttgtgggtaacccgacctttctctctggctgtcctgaacattttttccttcatttcaactttggtgaatctaacaattatgtgtcttggagttgctgttctcaaggagtatctttgtggtgttctctgtatttcctgaatttgaatgttggcctgccttgctaggttggggaagttctcctggataatatcctgtagagtgttttccaacctggttccattctccctatcactttcaggtacaccattcagacgtagatttggtcttttcacatagtcccatatttcttggaggctttattcatttctttttattcttttttctctaaacgtctcttctcacttcattttgctcatttgatcttccatcactgataccctttcttccagttaatggaatcagctattgaagcttatgcatttgtcacgtagttcttgtgcatggttttcagctccatcaggtcctttaaggacttctctgcattggttattctagttagccatttgtctaatcttttttcaaggtttttaacttctttgcgttgggatcaaacttcctcctttagctcggagaagtttgatcatctgaatccttcttctcttaactcgtcaaagttattctccgtccagctttgttccgttgctggtgaggagttgcgttcctttggaggaggagaggtgctctgatttttagaattttcagtttttctgttctgttttttccccatctttgtggttttatctaccttttgtctttgatgatggtgacgtacggatggggttttggtgtggatgtcctttctgtttgttagttttccctttaacattctggaccctcagctgcaggtctgttggagtttgttggaggtccactccagaccctatttgcctgggtatcagcagtggaggctgcagaacagtgaatgttgctgaacagcgaatattgctgatcagcaaatgttgctgtctgatcgttcctctggaagttccgtctcagaggggtacccggccatgtgaggtgtcagtctgcccctacttgggggtgcctcccagataggctacttgggggtcagagacccacttgaggaggcagtctgtccgttctcagatctcagactctgtgctgggagaaccactactctcttcaaagctgtcagacaggaacagttaagtctgcagaggtttctgctgccctttgttcggctatgccctgcccccagaggtggagtctacagaggcaggcaggcctccttgagctgtggtgggctccacccatttcgggcttcccagctgctttgtttacctactcaatcctcagcaatggtgggcgcccctcccgcagccctgctgctgccttgcagttcgatctcagactgctgcgctagcaatgagcaaggccccatgcgcgtgagaccctcccagccatgcacaggatataatctcctggtgtgccatttgctaagaccattggaaaagcgcggtattagggtgggagtgacccgattttccaggtgccatctgtcacagctttgcttggctatgaaagggaattcccttaccccttgcacttcctgggtggggcgatgcctcgccctgcttcggctcacgctcagtgcgctgcacccactgtcttgcacccactgtccgacaagccccagtgagatgaacccggtacctgagttggaaatgcagaaatcacccgtcttctgtgttgctcacgctgggagctgtagactgcagctgttcctattcggccatcttggaaccgccccaatcgtggtgaatctttaatgtgttgttgaatttggtttgccagtgttttgttgaggcatttttgatctatgtttatcagggacattggcctgtagttttgttgttgttgtgtcctgggctggttttgatatcagagtaattttgttcttgtagaataagtttgtaagaattccctcctctccagttttctggaatactctgagaattggtattagttcttctttacatggtttggtagaattcagcagtgaagccatcaagtcctgggcttttctttgatatgagactttattactgattcaatctcattgctcattggcctgtttaaattttctatatttcgtcatgattcaatcttggtaggttgtgtatatccaggaatttatcagtgtcttctagattttccagtttgttggcatatagttgttcataataatctcttatgttcctttgtatttcagtactatcagttataatgcctgcttcttctctgattttaagtattctctttgtttcttagtctagctaacagtttgtagattttgctcatcttttcagaaagctaactcttccctttattgatcttttgtcttttctgagatatgtgtttattgctgtagtcatccctctgactactgcttctgctgtaacccatgtgttttgatatgttgtatttcattttcatttgtctctagaaatgttttaactacttcattgaccattggttcttcaggagcatgttgtttaattcccatgtatttatatagttttccaagttcctcctgtatcaatgagtatttttatacagttgtggttggaaacaatacctgatacaatttcagttttttaaaatttattaagacttgttttgcagcctaccatatggaggagggaattcttccaaactcattctgtaagaccagaattactctgatatcgaaaccaactggacacatcttggagaatgttccatgtgtaccagcaaagtatgtgtattttgctgccattggatggaaagttctgtatatatctgttaggtctgttttgttctaagtgaagttcaattctggtagttccttattaatgttgaaagtgggatactgaagtctcctagtagtattgtattactatttacttctctattcgtgcccattaatatttgctctatatatttaggtgctccgatgttgggtgcatatatggtcattttctacattgtgccattttggtcaaccacggaccgcatatacaatggtagtcccatgaaattatagtaccatttctttgctgtaccttttctatgtttacatatctttagacacacaaatactcatcattatgttacaaattgcctacagcaaccttgtccaacctgcagcccgtgggctgcatgtggcccaggacagctttaaatacagctcagcacaaatttgtaaactttcttaaaatatgagttttttggctgggcacagtggctgatgcctgtaattccagcacttttggaggccaaggtgggcggatctcttgaggtcaggagttcaagaccagcctggccaacatggtgaaaccccatctctacaaaaaatacaaaatagccaggcgtggtggcacgcatctgtaatcccagctactcaggaggctgaggcaggagagttgcttgaacccaggaggcagaggttgcagtgagccgagatagtgccactgcactccagcctgggcgacagagtgagactctgtctaaaaaaaacaaacaaacaaaaaaaaaaagagtttttttgcaattttttttcttttttagctcatcagctatcattagtgttagtgtatttcatgtgtagctcaagaccatttttcttcttccattgtggcccaggaagccaaaagattggacacctctgagttagatgacttgccagttccttttttgtcctgccttacctactgttttaacccttgctaaacactatagtaattatttgtttacttcttttttcccccactttcctgggagttccttgaagacagagaccataacttttcatatttctatttccagtgtttagaatagtggctggctaaatgtccatcaacagatgaatggataagaaaatgtggtacttatacacagtagagtactattcagtcataaaaaagaatgagatcctgtcatttgcaacagcatggatagcactggaagtcattatgtcaagtgaaataagccaggcacagaaagacaacatcccatgttctcacttacatgtgggatctaaaactgaaaacaattgaaatggacatagacagtaggaggatggttatcagaggctgagaagggtaatgaggtgtgtggggaaggtggggatggttaatgcctgtaccaaatatctcagataacccattaatatatatgcctactatgtacccacaaacattaaaacttaaataaactaaaaatagattggtggatgacacatagtaacccttaataaatgttgaccaaataattcctttggaaaaaactcttgctaaataaattattttaagtttttaacagttttattgtagtaaaatttacatatcataaaagtcttccattttaagtgtagagttcagtgagttttaataaactatgagacagttgtataagcataacaacaatctcagttttggaatacttccattaacccagaaagttcccttctgcccacatatagtcagtctccactcctaccacagtcccagatgactactaatctacttttttaaaaatttggttaaaatatgtacaacataaaatttgccattttaaccatttttaaatgtattaattcagtggcattaattacattcacactgttgtgcatcattaaccactatgtattttcagaactttttctatgcctctaagtagaaactcaataaccgttaagcaataattcctcattctgataacctctaatctattttctgtctcaatgaatttgcctattctagatatttcatataagtggaatcctacaatatttgcccttttgtgtctgacttatttcacctagcataatgtttttgcggttcatccgtgttctgtctggtatcagaacttcatttccattttgattatctgtttctgttgatgaactcacgagttgtttttacctttaacctattgtgaataatgctgtagtctatgtgaatccctgctttcacttatttttagtaggagggaaattgctgggatataaggtcattatatgtttacctttctgaggaactaaaaactatttctataatgtaaacattttacgttcctaccagcagtgcggaagggttccagtttctccacatcatcactaacgtgttttctttttaaaaaaattattagagccttcctagtagatgtgaagtggtttttcgttgtggctttcatttgtgtttctctaatgactgatgttgatcttctgtttatgttcttattggccatttttatatcttctttggataattgttaattcaagttctttacctattttttaactgggtggtttgtctttttattattgaatttttcaagtaatttatatattctacatattaaatcctttatgtgcatatttaaacatatctatgtaaacagatgtgatgggaaaatattttctcccattctgtgagttgtcttttcactaagggttttatgattttagcacttaaatggagattattagaatctagtttaaggtagtttttgtacatggtatgagtacaaaaagatgctgggtcctttttcatgtggaaatccagttctaacatctgttgaggagactattctttctccagtaagtggactgggtacccttgtcaggtggccatacgtctatgtgtttatttctagactgtaaattatattccattggtctatgtctgttcttatgccaatactatattgttttaattactgtagtttttagtaagttttaaagttcagaagtgtgagtcttccaactgtattcttctacttcagaattgttttcattattcatggctcctgcaattccacatgaatttgagaatcttcttttccatttctgctaaaaaggctgttgaaattttgagtgtgattgcattgaaagtgatggctttgagtagtattgacaaattaacaatatttagttagttccaacctctgaatacagactttccatttatttaggtctttaatttgaattttcaggaatgttatatagtttacaagcatttcaactcttaggttaaatttactcctgggtgttttgttcttgtacatattattgtaaatgaaattgcttgctaaatttttgggggatttttcattggtgttttatagaaacacaactgattttttcttgtgtgttgatcacaagatcaacctgcaactttgctgaatacatttattttaattctcttagctttcttctggattctttgggattttctcaatatagcatcatgtcatctctaaatagagatagttttctttctttctttgcaatttttataccatttatctctttccctgtctaattgctctgactagaatttccagtatgttgaatagcagtgcttaaagtgggcatccttaacttcctgaacttagggggaatgtttttagtttttcaccattgagtatattagctgtgggttctttataaattcatgttcagaaaatttcactctacttccatttttctgagagatattatgaaagtgtgttgaatttgtcatgtgccttttatgtgtcacttgagatgatcatgtgggtctttttccttcgttccattactgtgatgtattacattggtcaattttatgttgaatcacccttgcatttctgagataaatcccacttggttatggtgtataatcattttaatatgctgagggtttttttgcatctattgctcaggaattttcctttgatgtcattatctgactttgatatcagagtaatgctgccttcataaaacgagttgggaagtgtttcttcctcttctttttctggaagaatttgagaaggtttgatgctaattcttctttaaatgattggtggtattcaacagagaagccatctggttggacttttcttagttgggaaatttttgattcatggttcaatctctttacttgttataggtctggtgagaatgttaatttcttcttgagtcagtttaggtaatttcagtatttttaggaacttgttcatttcatctgagttatctgatttgttgtcacacaattgttaatatttttataatgcattttatttctctaaagtcaacagtaatgtacccactttcatttgctactttagttatgtacatctctctttttgtcaatctagataaaagttcatccattttttaaatcttttctaatggtctgtctatcccgttttctttatctttctctagttttattgttttctttcctcatctttgctctttggactttgttctttttctggtttctcaaggtgttcttgatttgagatcttttttcttctaaagctatgaattgcccccaagtactgcctttgtggatcttgtaaatctgggtatgggtatgttatatttttattttcatttgtctcaagtattttctttttttttttcttttttttttttttttcagtggcgcagtcctagctcactgcatctccaactcctgggctcaagggatcatcccacctcagcctccagagtagctaggattacaagtgcgcaccacacctggctaattttattatttatttatttatttatttatttattttttacagatggggtcttgctttgtttgttgcccagtctggtctcaaactcctggccccaagcaatcctcttgcctcagcctctcaaagtactgggattataggcctaagctaccatgcctggcttttaagtactttctcatttccctagtgattcttctttgacccattggttgtttagagtgtgttaattttcatgtattcgtgaattttcttgtttctcttctgctattgcttttttgcttcattccattgtgattagagaatgtgcttcttacattttgagcctatgtttttaggtgtatgtatgattacagttgttatatcttcttggtgaattgtccttttagtcattatacaatgttcttatttgtctctcataacaatttttgacttaaacttttgtctatatgaatataacctctccggcattgttgcccattctttcactttcaacctatttgtgtttttctatgtagagtctcttatagacaacatatagttggaccatgtttttttaaaattcattctgccaatctcctttttgatttgagtgtttatgtacacttaagatgattaactgataaggaagattttgcttctgccattttcctgtttgttttctatatgtcttttcactttttttctctttcgtttcctccttttatgtttagttgatttgtagtgaatggttttgattcttttctcatttctttttgcacatattctatattttcgtgtttgtggttaccatgggtattacatttaacaactaaagttgtagccttctaatttgaattgaaaccagcttaatgtaataccacacaaaaactctgctactatatagctcttttattcctgtttatgttattgatgtcccagaatatatctttatataatttgtgctcaatacataatatttatacatttgtcttttaaatcatatagcaaataaaaagttgtgttacagataaataatacaataatactggcttttatacttgcccaggtatatgcttttaccaataattttttttctttatatggctttttagcatttctcatatagcaggtctgatagtggaaaaaaaaattccctccgcctttatctgggaatatcttacatttcttctttgttcttgaaggaaagttttacattatataaaattttgggtttactgtttttctttgagtgttttaaatacatcatcccactgcctgctggcctctgtcgtttctgatggactgttaatctgagtatccctttttcatgatgaattggttttttgtttgttttttctgttctcaaaattttctttctctttggctttaatagtttggctgtgtgtcttggtgtgggtctctttgagagtatcgtatgtggacttctttgagcttcttggatttgtagattcatgttttttctcaaatttctaaaggtttttggccatgatttcttcaagtgttctctttgttctcttttcttttctggcagttttataatgcatatggtgatccacttgatagtgtcccttgggtcccttgtgctttatttatttttcttcatcgttttttctttgtgctcctcacacttgatgtcatttgtcctattttcaagttcactgtttcttgtgcctgttcaaatctgctgttgaggccccccatttctagggaactttatatttcagttatacttttcaggtccagagtatctgtttggttcatttataatctccttattgatattctcattttgttcataaatcattttcctgatttctattagctacttgcctatattttctttagccctttgaacatatttaagatagttgttttaaagtatttgtctaggaatatacattattacagtcattatagagaacagttcggaggttcctcaggaaactaaatatagagctaccatgtggatcctgcagtcccactgctaggtatatgcccaaaagaaaggaaatcagtatgtcacagagatatctgcattcccatgtttattttagcactcttcacaatagccaagatatggaagtccatcaacagatgaatggataaagaaaatgtggtacatctatataactgagtactattcaggcataagaaagaatgagattacatcatttgcaacaacatggagggaagtgaaggtcattctgttaaatgaaagaagccaggcacagaaagacaaacttggcatgttctcacttatttatgggatctaaaaattaaaacaattgtgaactcatggaaatcgtggaaggatggttaccagaggctgggaagaatagtagtagggaagtggcgatggttaatgtgtacaaaaacaaatagaaagaatgaataagacctagtatttgttaatgcagcattgtgactatagtccataattaattgtacattttaaaatagaagagtagaattggattgtttgtgcacaaaggacaaatgcttgaggtaatggaaaaaccccatttaccctgatgtgattattacacattgtatgtctgtatcaaaatacatcatgtaacccatgaatgtatacaccttctatgtacccacaaaaattaaaaatttaaaaaaaaaaaaaagtaaagtttttgtctggtaagtctgatgcctaggcttcttccaggattttatctgttggttaattttgtttctttgaataggctataaattttttgttctttgtatgccttgtgatttttttgctctaaaccgaacatttagatattataatgtaactctggaaatcaggttctcacccactcccatcgtttgctagggttttttttctttgtttataatgccatttttttttgtttgtttggttttgagaaggagttttgctcttgatgctcaggctggagtgcaatggcatgatctcagctcactgtaacctccacctcctgggttcaagcaattttcctgcctcagcctcccgagtagggattatgcgcgcctgccaccgctcctggccaatgttttttatgtttactagagacagggtttcaccatgttggccaggcagttctcgaactcctgacctcaggtgatccacccacctcagactcccaaagtgctgggattacaggcgtgggccactgcgcctggcctatagtgccatttgtttagtaattttccaaactatttttttgaaagactgtattccttgtcatgtgtgtcactgaaatttctgttccttcagttcgtgttcatctaatgttttgacagagatttccttgaatagcaggaactaaaaacaaacaaacaaacatgaaaccaagaaataaaacaaacagcaatcatatttcccagtctttgcagactggctctgtgctagggcacttctacagcacttgcactggggctcgcacagagtctagggaacagcccatgtgaaaactcagggtcttctcaggtccctttctgagcacacatcttgccctggcaatgcatgtggttttctgaacgccaccatacctctccccgcaaccctcccccactgcatctcaccatacacgagtgtttttttaccttctgtcgcaattgcgattttattggttgtgttgaggatcactacacagacatttcagtttgttcacaatccttaacgtatgtaccaaaaatctaaaaagccatgcattgtgattctttttttatttttattttatgagacagagtctcactctgtcacccaggctggagtgcagtgacgcgaccttggctcactgcaacctccacctcccggtttcaggtgattctcctgcttcagcctccccagtagctgggattataggttcccaccaccacgcccagctaagttttgtatttttagtagagatggggttttgccacattggccaggctggtcttgaactcctgacctcgtgatctgcctgcctcggcctcccaaagtgctgggattacaggcatgagccaccgcgcctggctgtgattcttttttaaagttattccactgaccttccagctgaaagtttggagtcaaaatttccacaagaggatatcaagtacctatatcttcagcattcatcagctgtcctaatttctttctttttttttctttttcttttttttttttttttgagacagagttcgctcttgtcacccaggttggagtgcaatggcaccatctcagctcactgcaacccccgcctccctgtgattctcctgcctcagcctcccaagtagctgggattacatgtgcccacaggcatgagccactgtacccagcctctttttttttttttttctttttttgagatggagtctcgctgtgtcccaaaagctgaagttcagtggtgtgatcttggctcactgcaacctccgcctcctgggttcagacaattcttctccctcagcctcccgagtagctgggattacaggcatgtgtcaccatgcccggctaatttttatatttttagtagagacaggattttgccatgttggccaggcaggtctagaactcctgacctcaggtgacccgcctcctcggcctcccaaagtgctgggattacaggcatgagccaccatgcccgacccctaatttcttaacgaatttcccttagctttttctccagtgccttatatgccgttgtatgacttgatccatcatcttttgcctcaggtatctgtgggctttggagtgttttgagtaatgtctgctgcttttctgtccttagtttcaagttagccaaaagagaatcaagcaccttctgtccatcttccagatagtccctagacacgttagaacagacatacacaatgatttataagtgagatctgctgtatttcctcaaatccagggaccagtgttgtcactgcttcagcactgctaccacagccgagagcagcaggacaagggcaaggaaaaatgctgtcaaattttcctaccattttcaagttgcctgtttcttgattcagcatttgcttggttgctgtcaacctttgaccgttttccagagttctgacagttatttctgatagtttcagcttgttttctctgggtgtctgtgagagatccaggagctgcctactctgccattttgctgacatcatttgatctactttttgtctctatactttggcctattctagacattttatgtaaatggaatcatactgtatttctggcttgttagcatctaaggttcactcatattgtaatatgtattcgtaatttgttccttttaattgctgagtggtattccattgtatgagtatatgacattttatttatctgtaaactgttgagggagactttagattatttccagtttggggttactaggaataatactgctgtgaacatttgtttaaaagactgtgtgtagatacatggtttcctttttcttagtaatacctaggagtggaaataccagatcaatatgataagtgtatgcttaacattttatgtttccaaagtggctatccatattgttactaccaggaatgtatgagatttctattctctctacattcttgtcaacagttagtattgtcattcttttttattataactattttatttggtgtgtagtggtgtcttattttgccatttatttgcatttcccttatgactaatgatgctgaacatcttttttataagtttatttgccatttgtaggtttttctgttgtgaaatgtctattccaattctttgtccatgttttagaaacccattgtgtgacatcttaagttatagtacttctttgtatattcttcaaacaaatcctttataagatacatgatttgcaattcttttattctccactctgcagcttgtctttttatgtcttagtagggttttttgttgttttgggggacttttgggtttgtttttttgtcttgttttgttttgttttttcttagagtctcgctcttgcaacccaggctggagtgcaatgggcatgatctgggctcacagcaacctccgcctcccaggttcaaatgattctcctgcctcagcctccctagtagctgggattacaggtgcccaccaccacgcctgactgatttttgtatttttagtagagacagggtttcaccatgttggccaggttggtcttgaactcctgacctcaggtgatccaccctcctcggcctcccaaagtgctaggtttactggcatgagccactgcacccagtcatcttaatgggttttataaaagcatgtatgtgtaatttttatcaggtcaggtttatccaattttgcttttagtatcatgtttctcatgtcatatctaagaattctttgcttaataacctaaggacagaaaaattttttcctgttttcttctataagctttctaattttagctctgtaagtctgtgagtcattttgcattaattttaaataaattcttggtagttaacaaaaaaatttttctcatctcagaacactataagaatattttctaattataatatttgcatgtatagagagtaatatcataaaatgggacctgtctgaaaaattagactaatgttgactgatgattatttgctataactcagggtggggaaggagctgcaggaatttcttgtttgtcagagttgaaattatatagacccaaaagtcagcgttataatccagctaacagttctccacctatataaaactgtgtaatttgccttgacgcatgacttcaaccaagcagtgaatcattgaccaaaaacacaatgaaacaaaatctgagaaatcacttgctctaggaattttttggcgttcactgctcctatatttaagtgtttgtttaatatagaataaaatgtattttcttttttattcttttttaagacagggctcactctgtcacccagtttggagtgcagtagtgagatcatggctcactgcagcctcaacctccccaggtcaagcaatcctctcacctcagcctcttaagtatttgggactacaggcacacaccagcacacccagctaacttcctttggccatgttgcccaggcttgtcttgaactcctgggctcaagcagtccacctgcttcagcctcccaaagtgctgggattacagatatgaaccgctgcacccagcctaaaatatattcattcatgtattgagaggttctttgaatgagagtaacattcatggatttcattgtatttagcaaaatcaatgattaataaaatagaacatgattaaaagccttttcacatactaacactattatttcacaactttcttactggtgggccaaaataccaatatggtaaatggtgtgccagatgatattgtgggtatctaaattgaaaggtactatttcatataaaatgaagtcatgtaaatgtggtatcacagttcattgaattttaaaatctcagttgaaaccattatatttttcagtatttaatattgcttagtaaagacctagtccatgatgaagactgttttcctgcttgaagagcaaggtaaaaagagcagttccttaaagcacgaaacgggtcttatgtccactctgcttcttttgtggattagaaaactgaccatagggaagtacggtaacatacctctagtcctaaagccaaacagctcttggtatgaatcccagctctactgcttaccaacttcatgaacttataaaagttatgtggccattttatattatggttaatacagtgcttatatacttcattaaaagaaaaattttataacgaatgtttgcttttcttatttctaaactaatcaactcaaaataaggtaaaaagtcatatttaagggcatattctccagtattgtccatttaccttcaatccagagaaaaaccatatttttcagctgcttgctaggtctctaattctggatgaacctttgacaaacacttttcagtttcaggaagagaggagacatccttggataatgaacttaggcagacttgagttaaaattccacttttgcctgccatgtattggctttttccttgggtgattaatattaccaagcatcaatgtcctcatctgtaaattaaagataatactctgttattcatagtttttgtcagaattaaatattaatgtagtacatataaaataacctctactaggacttagtagatattcaggaattatcaatttccttcttccatcccaggacatacccttcatgtgtataggaatagaaaaaaaaaataagaacagctttgggcattgtatatttattaaaattgagacaactgcatgtgtaggtgtttttctccctttcggtgattaattcagtgcttatgaacacaattaaagtatgtttataaatatgatagtaaatgatgtttcaattatttcatagatgaataacctcgtaaattgctctagtacctttgaataaactgctgctttaatgcagaagttagttggaaagactgacgtgaaaatcctgatgttgttcactgacttatgcctaacaaattgaataattacctggttctgggccattcctaaatagagcttgcatgggttgaaggaccccatgactggagtcaagtcttgcctctccctgtctgtctgatcccagacaaatggcttaacctttctgggcctccattttctcatctataaaatgatggagataaaggacataatttctatggccttttatagttctaacatatgtaatttgaaatcagtgagaaataagtcaaagctgattgttatattctgttgactgattatttaaattaaaaggattgatcattaggaaaatatgaacaaaatatgtaaatgaaacaccaagttacagggatctttacgcttgttaatagttagaacattttacttttagtggccgtgaagtgcttgtagaggtaaaagctgctatagaattccttgtgcaccttgcttttgaacatagcagcttcatatttgattccctatttttcccttgaaaggatggataacaaagattttaatcttgaaaatgaatattctgtgaaatccatggaatatcattgttagcagctgtttatttcatctacctctacccttctttttttattttattttattttattttattattattatactttaagttttagggtacctgtgcacaatgtgcaggttagttacaccacctctacccttctggcaaaaagttcacagctacttgtgaaacaaggatttagtcagagtgagaaaaccgcaacactggttcagacatttcatacataagagtcttttattgaaagaacaaaatgagcttcttaaagacaaggtgctttgacctaagaatttgatgtcctaataatatttggggtatttgaggagattatgtatttagctgtttcataggtgatcaaaaatacctgcaagtggaaattataattacagctttgaagggaattaaagatgtttatcgtctgagtaaaagtactaattagctcatagatcgtacaacaaaaattactaacaacacctaaactacttttctcatgaaaatttcaaaattagcatgacgagactgttcttttatttttcaaaaggctatttcaagttagtctacttatttctgaaacttgacccttcttttacttttaaactaacccatgtttatttagaatattatgggttataaaaggatctgaaaggtaaatctcacaaagatagatatttcaatgaaagaagagtataagcagaagttaggataacctttattcgcagtttttatcaacgttcactgtaatggagcccttttctttgggtttctgttttgttttatttaattgttaattttagtttagattcagagggtccatgtgcagatttgttgcatgggtatatttgcatgatgctgagatctgggcttctattgatcctgttacccaagtagtgaacacagtaccccataggaagtttttcagcccttgccctcttccctctgtccctcccttcctccttccttttggagtccccagtgtctgtttctatctttacgtccatgggtatccagggtttagctcccacttgtaaatgagaacatgcagtatttggctttctgtttctgtgttaattcacttaggataatggcctccagctgcatttacgctgctgcagaggacatgattttgctcatttttatggctacatagtattccattggtaccacattttctttatccagtccaccgttgatgggcacctagattgtttccatgtctttgctattgtgaacagtgctgtgatgaacatacaagtgcagatgtctttttggtagaacaatttattttcctttgagtgtatacacattaatgggattactgggtagaatggtagttctcttttaagttctttgagaaatctccaagctactttccacagtggctgaattaatttacatttccaccaacagtgtgtgctaagcattcccttttctctgcagccttgccagcatctgttattttttgacttcttaatagccattctgactggtgtgaggtggtatctcattgtggttttgatttgcatttctctgatgattagtgatattgagcattttttcatgtttgtcggctgctcgtatgtcttcttttgagaagtatctgttcatgttctttgcccagtttttaatggtgttatttttgtttttgttgatttgcttaagttccttatcgattctggatattagtcccttttagaatgcatagtttgcaaatattttctcccattctataggttgtctttttactctgttgatagtttaggttttttgttttttgggtttgtttatttgtttcttggctatgcagaagctctttaatttcattagattcaacttgtcaatttttatttttgtttcacttgcttttgaggacttagtcataaattcttttcctagggacatgtcccaaagagtatttcctaggttttgttctaggattttttaggttgaggtcttacatttatgtctttaatccatcttcagttcttttttatatatggtaagaggtaggggtccagtttcattcttctgcatatggttagccagttttcccagcaccatttattgaatagagagtcctttttcccatgctcatttttctcaactttgtcaaagatcatttttttatgggtgtgcagctttatttctgggctctctattctgttccattggcatgcctgtctattttttaccagtaccaggcattttcagccctctttaaaggtcactctttcatttatgttctccagaagaaactaagaatctgtaacctatccctgcccaaatgttgacatttggcttatgtaaaagcaactgtctttgatattgtagtgtcaccatttgacacttctgagtgtcttattctaacaattactaccacatatttagctcttatgtgccaagaactatgcaaagggaagtagacgagaatatgggctctcgacgcaggctgcctgagtttgtattctgattctgcctcttactaaatctgtgttcatgggcaaggtacttaacctcttatacttccatttctccttctgttaaatggaggtcataatataggataataacacaatttgagttgttatgaagattaaaggagataatacatgtataaaactcataactgttttgcacatagtaaacactcagtgactgcttattagtgtgatcattgtcatcatcatcatttaatctttacaagaaaacattgggatagtatgcattttacagataaagaaactgaggcttagaaatcataaataactttcccaaggcaacactgctagcaagtgatagctgagatttgacctcaagtccttgtgatgaacttaagcccatgctcctaaagtagactgtggccttagtggaagtggactgctggtagcattttagaatgtcatacatggaatctagccttctcattttgtggatagaaaaactgaattgactaagcaccctagtaacagacagtcctgaaagcagtatctttcccattgtcctttctgctgcccccaagcatgacttcttttcttaagaattctttagaatagctttaatcatttgcattttgattctcgtcttctgcccaaatataaaatcctagattgttaggattaaatgaaagcttttgtgtgtaaagatttcattttacaatgatattactttaccatcattttatggtgctttattctaatcataataagaaggaaccatttttcagtccttgctgccttaagcgtggatttttatatttaaatacgtttctgttcttttggtcttaggctttattttgaatgcaggatcgtactgacgaagagactagcagccacctttgcctaccttgtatcatgggtgtgaataaatgtataaagcaaaaaataggattgtatttcagtttcttgcttatttttagaattcagattatgggtttgagttagctagtagtttgtcataataggttagtttattagtaaaatgagagactgttgacggaaaaaagtttgatctctttcatttaaatgtgctaatcttaaaatgattccccaacggaatttattttctgtcatattgagagcactcagaagtaaatagacaaaagaattaatagcccttaagtatcactctgcttggtagaaaataagaatgtttaagctaattagttatataacaaggatatactaagtatttttcttctgttttaacaccgtgtgtaagaaatgtgtctaaatttccttcttctcaactatcacatttactccaaattttaagttatatatggtttgattttttttattattattattatactttaagttttagggtacatatgcacaatgtgcaggtttgttacatatgtatacatgtgccatgttggtgtgctgcacccattaattcgtcacttagcattaggtatatctcctaatgctatcgctcccgccttcccccaccccacaactgtccccggtgtgtgatgttccccttcctgtgtccatgtgttctcattgttcagttcccacctatgagtgagaacatgtggtctttggttttttgaccttgcgatagtttcctgagaataatggtttgcagcttcatccatgtccctacaaaggacatgaactcatcattttttatggctgcatagtattccatggtgtatatgtgccacattttcttaatccaatctatcattgttggacatttgggttggttccaagtctttgctattctgaatagtgccgcagtaaacatacgtgtgcatgtgtctatagcagcattatttataatcctttgggtatatagccagtaatgggatggctgggtcaaatggtatttctagttctagatcctggaggaattgccacaccgacttccacaatggttgaactagtttacagtcccaccaacagtgtaagtgttcctatttctccacatcctctccagcacctgttgtttcctgactttttaatgattgccattctaactggtgtgagatggtatctcattgtgttttgatttgcatttctctgatggccagtgatgatgagcattttttcatgtgttttttggctgcataaatgtcttcttttgagaagtgtctgttcatatcctttgcccactttttgatgaggttgtttgtttttttcttgtaaatttgtttgagttcattgtagattctggatattagccctttgtcagatgagtaggttgcaaaaattttctcccattttgtaggttgcctgttcactctgatggtggtttcttttgctgtgcagaagctctttagtttaattagatcccatttgtcaattttggcttttgttgccattgcttttggtgttttagacatgcagtccttgcccatgcctgtgtcctgaatggtattgcctaggttttcttctagggtttttatggttttaggtctaacatgtaagtctttaatccatcttgaattaatttttgtataaggtgtaaggaagggatccagtttcagctttctatatatggctagccagttttcccagcaccatttattaaatagggaatgctttcccctttgcttgtttttgtcaggtttgtcaaagatcagatagttgtagatatgtgacattatttctgagggctctgttctgttccattgatctatatctctgttttggtaccagtgccatgctgttttggttactgtagccttgtagtatagtttgaagtcaggtagcgtgatgcctccacctttcttcttttggcttaggattgacttggcgatgcgggctcttttttggttccatatgcactttaaagtagttttttccaattctgtgaagaaagtcattggtagcttgatggggatggcattgaatctataaattaccttgggcactatggccattttcacgatattgattcttcctacccatgagcatggaatgttcttccatttgtttgtatcctcttttatttccttgagcagtggtttgtagttctccttgaagaggtccttcacatcctttgtaagttggattcctaggtattttattttctttgaagccattgtgaatgggagttcactcatgatttgactctctgtttgtctgtttttggtgtataagaatgcttgtgatttttgcacattgattttgtatcctgagactttgctgaagttgcttatcagcttaaggagattttgtgctgagacgatggggttttctagatatacaatcatgtcatctgcaaacagggacaatttgacttcctcttttcctaattgaatgccctttatttccttctcctgcctaattgccctggccagaacttccaacactattttgaatattagtggtgagagagggcatccctgtcttgtgccagttttcaaagggaatgcttccagtttttgtccattcagtatgatattggctgtgggtttgtcatagatagctcttattattttgagatacgtcccatcaatacctaatttattgagagtttttagcatgaagtgttgttgaattttgtcaaaggccatttctgcatctattgagataatcatgtggtttttgtctttggttctgtttatatgctgtattaggtgtattgattttcgtatgttgaaccagacttccatcccagggatgatgcccacttgatcatggtggataagctttttatgtgttgctggattcggtttgccagtattttattgaggatttgtgcatcaatgttcatcaaggatattggtctaaaattctctttttttgttgtgtctctgccaggcattgttatcaggatgatgctggcctcataaaatgagttagggaggattccctctttttgtgttgattggagtagtttcataaggagtggtaccagctcctccttgtacctcaggtagaatttggctgtgaatccatttggtcctggaccttttttggttggtaagctatttattattgcctcagtttcagagcctgttattggtctattcagagaatcaacttcttcctggtttagtcttgggagggtgtatgtgtcgaggaatttatccatttcttctaaattttctagtttatttgcgtagaggtgtttatagtattctctgatggtagtttgtatttctgtgggatcggtggtgatatcccctttatcattttttattgtgtctatttgattcttctctcttttcttctttattagtcttgctagcagtctatcaattttgttgatcttttcaaaaaaccagctcctggcttcattgattttttgaagggttttttgtgtctctatttccttcagttctactctgatcttagttatttcttgccttctgctagcttttcaatgtgtttgctttgcttctctagttcttttaattgtgatgttagggtgtcaattttagatctttcctgctttctcatgtgggcatttagtgctataaatttccctctacacactgctttgaatgtgtcccagagattctggtatgttgtgtctttgttctcattggtttcaaagaacatctttatttctgccttcatttcgttatgtacccagtggtcactcaggagcagtttccatgtagttgagcggttttgagtgagtttcttaatcctgagttctagtttgattgcactgtggtctgagagacagtttgttataatttctgttcttctacatttgctgaggagtgctttacttccaactatgtggtcagttttggaataggtgtggtgtggtgctgaaaagaatgtatattctgttgatttggggtagagagttctgtagatgtctattaggtccgcttggtgcagagctgagttcaattcctgggtatccttttgactttctgtctcgctgatctgtctaatgttgacagtggggtgttaaagtctcccattattattgtgtgggagtctaagtctcttcgtaggtcactaaggacttgttttatgaatctgggtgctcctgtattgggagcatatatatttaggatagttagctcttcttgttgaattgatccctttaccattatgtagtggccttctttgtctcttttgatctttgttggtttaaagtctgttttatccgagacttgattgcaacccctgcctttttgttttccattttcttggtagatcttcctccatccctttattttgagcctatgtgtgtctctgcacatgagatgagtttcctgaatacagcccactgatgggtcttgactctttatccaatttgccagtccgtgccttttaattggagcatttaacccatttacatttaaagttaatattgttatgtgtgaatttgatcctgtcattatgatgttagctggctattttgcttgttagttgatgcagtttcttcctagccttgatggtctttacaatttggcatgtttttgcagtggctggtaccagttgttcctttccatgtttagtgcttccttcaggagctcttttagggcaggcctggtggtgacaaaatctctcagcatttgcttgtctggaaagtattttatttctccttcacttatgaagcttagtttggctggatatgaaattctgggttgaaaattcttttctttaagaatgttgaatattggcccccactctcttctggcttgtagatttttaaagatatatcccaaaattttaaagtagtattgatagaaatatttctcttcattttatatgacatatgaacgaacattatagaaaaattatactctatctgtgcatagttaaatatacacatatttatttttggtaagaaaagctaaaatgattataatttcatagcacatttaatacttcatataaaacaatagccatagagttttagggtttaatcataagaattttaagaataatctagtcccgtcttcctctccctgttctcttccagacttcagaaagtaaaataaacaaggctgttgccatgtagaatgtttaggaaacatttccaccatcatcatggtgactgggctggaattgggtatactgagacccaatctcagtccaccccattactaccccaactcactgagatagtcagcttttaccttgattcacatattggagagaagaggggaatctcagaacaggaaaaagaataggtcatgactgctttatcaaactctgagttaggaaaaaaaatcatcaaggtatagtagttgtcttattccattgttacttataaaagaatttatgaaactgggtaatttagaaagaaaagaaatttatttcttacagttatgtaatctgagaagtccaaagtcaagcagccacatctgataatagccacatctgataataccagagtcctcctggtggggactctgcagaatcccaaggcagcacagagaatcaaattactagggggctgagcctgctaatgtggtagctcaggcctctcttccttttcttatggcactttgattatcatcttcttcccaaatataaaatcctatgattctcctcccatgataacccatgttctttgccatgatcacccatgaattcattaacatatcaactaattaactcatgaatgagttaatctattcatgtggggagaaccctcctgacccagtcacctcttgaaggccacacttctcaatagtgcctcattaggcattaaatttcaacatgagttttggaggggacaaatattcaaatcataatagtagtgaaagaattggtatactcagcaaaacagaaaagcatcactagataagtatccatgagataatattgaagcctggcaattatttgggaatttaaataacaaaaatatttatatcaatcagaacaataaatagaatggtttatctcagaccttggcaagagaaaaataatcatcctgaatgtcctttctgatggccaagtattcacaaagcttaagtttatattaaatacaatgtgatgactatagttaataacaatatatacttggaaattgataagagagtagattttaagtgctctgaacacacagaaaaaatgttaaatatgtaagtaaatgcatgtgctaattagctagatttagctattccacagtgtattcgtatttcttttgtgtgtgtgtgagacagagtctcactgtatcgcccaggctggagtgcagtggcatgatctcagctcactgcaacctccgtctcctgggttcaagcaattctcctgcctcagcctcccaaatagctgggattgcaggttcctgccaccatgcctggctaactttttgtatttttagtagagatggggttttgccatgttggccaggctggtctcgaactcctgacctcaggtgatccacccacctcggtgtcccaaagggctgggattacaggtttgagccaccatgcttggcctgtattcatatttcaaaacatcacgttgtagatcataaatttataaagtttttgtcaattaaaaattaataattgtttttacaaaaacttatattaaagctaatttagttaactttctgtgtccttggtaccatgtcacactttccagcgttactatgtctgacagtgactggcagcatcttaaagaagtatagcttttcttttctgatcatgttcagattctttaatagtatatatttcttatttttaaagttccactaaggcactagtactttgtagacttctcttcaataacataggtacattaattctgtatatgtgcagaactttaaaatcaacctgtatgctatttaacatctgaagcagaataagtaaatccatgtacatattcataattctttcatttatgccatttaaaaattaatattttgaagaaattgtttatcccttccacatagtaatgtagatgatactatcttttttcttgttttccatttgtattagcacttgtttcacattgtcataatttggtttatgagcattttaaaaataaagaattgtaaatatgttcatgcatgccatatatttttatactattcaattattttaaaattcttaattttattttctaaaagtatctagcctggtttatataataatcgttgtttcctatgatatcaaaaatgtagcattgtgtatgtttgtaaatgatagagtcttgctgtgttgtccaggctggagtgcagtgcccatctacaggcacagtcatagtactctgcagcctccaactcctggggtcaagtagtcctcctgctttggcctctcaagtagctggaactaacatgtaccaccatgccccattctgtacttttgtgagaataatttctcttatgttaatgatgtgttctgaaaaatataaagttatattcttcactgttttcaaaagtaaaaagtaaatggatttttaaaaatttcagcctgtatttctagctttatattaataatgaatcacaaaagaaaatgtcattttatatgtaattacattatctgtcatatatcccttatctctagccaagtataatgagaaagccattatttctgtctatattcagagtccattttagcaagaagtgcagtttcagagattctgcatagaaatctttcagccctgggtctcacatattaaaagccttgaattctatttaaaaccttctaccattaattagtcatgtgatttgtggtatttatagctcatctatgctacagtcatccatgagtagattttccagatggtggaaggaggcattttgacttattccctgtgttagctgtcatgccatgttctactctgtaatcagaaatcactgatttatttttgtttttgaactcagagttccagattgtagatagaaatatttagccattccatttacaattttttttcaccatctatggagcaacatttgtcaaattctaaattgttagtttcatttttcatgaccaagtgttttagtatttccactgacaactttgcagtgggtttttgaagtgagaaccctgaagaaaaagtacttctgtccttccaggagttaatgcctttttttactcttttgcctatgtcctaggcagagcataccactgtattaaatacacagaataccacagtgatagggctagatagggataatggactcctttatgtttgtttactgctttaagggtttttttccaaattctttcttccacatttaatccttacagtgatcacatatggtagctaagttatgttccttttaatcattttacagataaaagacaaagtgaaagagatttagtttcttttctgaaaagtatatatcattcagtaattggtgtggaacagctaaccagatatccatctgtaaaaagtgcagtacaactcacaattgtatatcaaaataaatttcaggttaatctaagacttaaaagtaaaactaatgctccaaagtactagaacaaaacagggtgtgggtgggggaaacagagttatatgtgtgtactggaaatgcctttataaaatataagcaaaacatggaagccataaagcaaaatattagtaaatcacagataaaagaataattttcttaattttgaaagggctgctacaaactggcaggtaaaagaccaacaacattattcattagaaaacaaaaattaaaaccacagtgagatatcattttcacttatcagactggcaaaaagttaaaacatttgataattgaggtattggtgtaacctctcttgtagtgactctgaatgtgtgatccaaaatatgggcctctgctgggcgtggtggcacacgcccataatcctgggtacttgggaagccaaggcaggagaatggcttgaacacaggaggcgaaagttgcagtgagcggagatggcgccactgcactccagcctgggtgacagagtgagactctgtctcaaaaaagatatgtatatatatttgggcctctggaggggtggctccctgaatctctttcaaggattacacaaggtgaaaattgtttttacactaatactaagatattttttgactttttcacatgttgacatttacaaggacaaagcaaagcaatggtggataaagctgcttccagtgtagcacaaatcaaagtagtagcaccaaacttcactagtattcattgtggtcttcatcaccatatattcacaattttaaaatgaaggagggggaggaagggaacaagaaacgtggtcagtttcacttagtaattctttctgcaaaaaaaacaataattttagtaagtctcaacccttgagtatacagctttataatagtctgtgttggaaaatatgcgtaaaacacatctgcgtaccaagtatgttggttgtgttgacgaaaagcagtggtgagattaagttgcaagctaaactagctacttcttaaaataccatttcttacttgaaagaacaacttgacagacaagctactgttattccagcttcggtagttgatggacattttctctaaaatgaacgaagtgagcttgtcacatcaagaaaacaactgacaggattcagtagcagtgataaaatttgagctttcaagcaaaaatttgaattttggaaaacttttatctgcaatgagctgacagcttcccaacatctaaagacttttgtgatgagattgtagtgatagcaacaaatgtgaatttttgatatgatataatgaagtgtatcaacatttagaaggtccacataaccaatatttttcaaatgatcaatgtgtgatttcacaaagtcatgcattttacatgaatgcatagatggatatgaagcattcattcaaagtgcaagatagaccaatggttttaattaacagagtagggaaaattcattgatatggctttagattcctcattgcaaataaccgttaaaaaaaattacttgttgagtttgacgatagatgggataatacccaaggttgtctgaaaaggctattttaatacttctaccaactgcattttttgtatttgtcaaccaaaacaacatattacaacagattgcatataaaatcagtgttaaaatataattttattttaaagccaggcaattctactcttttttcaaaaactttttgttttgtaaaagttatttttcatgaaattgttatttgtgtttacatgtaatatatttatggttattttaacttaataaaaatattgaactatttctgtcttaatttttaatacagtaaataagcatagatataagtcacataaacaaagctctttggggtcttcagtttttcagagtatttaaaagtttgagaactattcttctatggagcgtaaaatataaattttaatttaatgtaacaattgaaaccataattttcattttaggaatttatactacagatataatctcacaaaggtgagattatacaaaattattcattgttggattgtttggattatcaaaagattggaaacaacccagcatttgcatatcaatagagaatcagttactgagataccttcatacaatgtaatactatattctctatatgacacaaatacagatttaccattatgaaaccatctcaaagattattaagtcagaaatttaggatgccagaaaatgtgtggagtacactactatttgtgcaaaattatatgtagtatatgtatttgcatagattgtcttggaaggttagacaagaaactgctatggtggttgccactggaggggagcagggaatggagtaaaatgacttttttttttggtttcttaagattgcgtgcctgattactcattattagcagctaagctaggttaaaaatgcaaatctaactgttcctaattttatcttctttccattacgttaaaatctccacatactgttaccaagtgtaaagacattcacagaaaaaagtttcttaatgtagtggtatgtgttttattaccgtagtgagctgacgtgtctaaaagacatgagattatgtagaagatgtcctggagtcccaagaggctggagcagtgttcaaaaggaagggatacagagagttctaaaggggtaatataatttgattagcaagaaaagaagtttattctaaatgaagaaacatgatcaagacattagaagtaggatgcccattgcaccccctggcatcaatgggggaccagtgtagattcctgagagcaagtgtcagcatccagtcagccggagaacttacgaacatacaaggtgctgggccccacctcctgaggttgtgatttgttagatctgggcaggagcctaagaattctcatgtccaacaacttcccagccgattcagaggctgcagaaccactgctttagagaaattgtggttaacaaagttggaaaggtaatctggggccagaacaatgagttctaatttgcttaaacaattccacaggtcagttaacttaattagaatgaaaatattaagaatgtttaagagaataagtgatatatgtgaacttttttatgtgtatcttttattgttctctgcttaattaaaaacaaaaattatatataaaaattcattgtaatccatttttatgacaagaacaataacactttagttttgcttttaaaattaaaaattttctctaaatcagttttagtttctctaaatcagttttaaacccttaattctatttcaataaagtatttatatgttttagagaagaatttcatttgtaatttggctagagttaccatcaaagggaagttagcatgtgtttgttagttcaggatgatcagtcctgaaaaaggctgatttttacactggtttttgtaaatattagtaaatcaaaatgctattccatctgttgcagtttctcttgagtttttgagaaagaattttggccttcaagaaaacctgagatacgtatttactgaagtcccaaagaaaagacaatccaaagttataaattcctggttcttctttaagtactgtgccaagttcacaggctagcatctccatcagcatgcccttctttgtaatctactcacaaagagacattatttctctgagaatttgcttaaagtaattctagctcctagccttgtgcctctgatttttcccatgttaaaagtactttcttccccaggcataataatatattaaaacataaaatattcctgtagtgtgagatttaaaagatatgcaaattaaaggcaaagaaaggctgtggaaacattccaaatgaaaggaggctattaagtaacagctttatgcaatttctagtcctacactgtatcctgtgctgcagggacaaaaatgctgtacggaacaagaggtcagtggacaaaactgaaatatagatagcacattggataaatgcattgtttgtgtgtaaactgtgaattgttaactgtattgtagttatgtaagagaatatccctactcctagggaatgcacagtgatacatttagggacaaaggaccttaatgtatgtacttatatacatggttccgaaaaaaatttgtttcaaagagggaaagaacacaaataattttgtaaaaggggtaaaatgttaacaataggcaaatgtggttaaaggcttaacagatgtttcttgtactatttctcttattgcaactttaagtataaattactaccaaataaaaaagcttttaaaaaagtacaaaaaactgaaatatgtcaatttaaaagcttctctccttttaaagagcaaatttcctttgaaattatactcttgaaattgtactctcaaaaagcatttctgtcatttcacctaaatattttttaaaaataaggccagaggcagtggctcatgcctgtaatcccagcactttaggaggccagggcaggcggatctcttgaggccaggattttgagaccagcctggacaacatggcgaaactcggactctactgaatatacaaaagttagcctggcatggtggcagatgcccgtaatcccagctactcagtaggctgaggcatgagaattgcttgaacccaggagtgggaggttgcaatgagctgagatcgtgccactgcactccagcctgagcggcagagcaagactctgcctcaaaaaaaaataataaattatatatatgtgtatatatatatggcatttagaatagcacaagaaacacattttgtgattgagtttatttttctgtgaccatatctataaaatattactgataatttatactaaagtgcatgattatgctgtttccacgagttagatatatgtttactaggtagttgttagagcacttgaaaaaataccagccaattcattgtcaaaagaggcatgagatatatgaaactacttggaagaaagagaaactaggggagaagtaaagtatgaataagattctaatatgagcattttgtcattggggtaaaaatgaagggaaaagccgtggtaatgctcttcaaattgttctcccattaatttacagtagaatggtttggttttaatgaagtctatgttatcacttgagccagtttgtaaatcacatttttgtattagttctttcttacttggctagctctcaaactttttttttttttaagctgtgatatatgtttatctccttggaaaaccttctccttttcaagtattcctgcctagaattgcatctttgtctctcaatctatttaattctcagtagtccaaatctatatgttgcaaattacagatgttctctacatattttattattaattcaactattgtatttaatgttgcactcctctaaggcagggtttatcataatgttattaatcatgaggatcctaagtaagcaaatcatgaaattaaatgaaagaaattcattttttactttgttgtgcatttttaattttccatgctgaagtcagtttccattggctagattttaattccactcagcctaaaattctttttttttccttttgaatacattattggagacttgataggcttttgataactacatagctctcagtacgtaagtatgcttcactaaatatacaatgaagcatatttctgtattaataatccttttattttcttccaagtgtatatactacctcaggcacgagttaaataatacaataaacaacagcagtaaatcagtgattaaagcaatacaaaatcaatccccaaattaaaaaactaagtgactgtgcattgtgaatgtccacataaagagacttaactctgcgacatcaaaatctgtaaaccccatcaggtagcagggacattagatgggagagagcactagagagctgacacctcagtaatgtcagtaacttactaacttcctccataacctcacctctgtaggccttagcagaatactgtgctttgtaaaaaacagtcacttggaaaggatatctatattcctttcatttgctttttcattgataaaaatttattggtacttttaagaagccagagtgttgagggctttataactcttggatcgaagttcatccagaataaagtctcttacatatgtataaagttaagagtctcacgtttaaaatactctgtataataatggactactgttgatatgcttatttttctcttctatggcagcagtgataattatgtaaataagtcaaagctacatttttaaaaattgatggttttaacattacaggctgaaatggggtctcttaccaacactatacatttttctttttataatttcaacttttattttaaattcaaggagtccatgtgtaggtttgttacatgggttggggtatgactgatcccatcacccagatagcataggacccagtagtttttcagcccttgcccccctccctcctatagaaatgcttaaccacacagaagtgtgcaatttagaacaagacacagtccagataatcagttgcaagggccagagtaattttttaaataaaatcatattcattttgaagccatgtgtcaaattcttctgttttatccagattgatgtagactttgaacaaatagtaaatttaatataccatacaagaacactttattttgtgactattaatggactcttgaagtttcttttggcagatggagatggacacatggatcatttactgccaggctgtgaagataaaaattgccaaaagagtaccatctacttagtgagatctgggatgaagcaggtatatcaagttgtttttaatgtaaacatttttttttatgtgcttggaaaaaaatcttctaaggttagaaaagatacctgtagaatcagaacagagggaaccccaaaattaagttaccgacttcctcattttaacttaatgaaatgcatttaaatatattattttttaatttgttgcgggaaaatcattgttataattatttctagtgaagaaaacccattctggatactataattaaatgatcttttagctttttatatgccaggaatatggcaaaacacactataataaaaggttacttagaagaacgttgtatctattttcgaaactgatcttgtttttatttgtgttatttaaacctattttattatctcatgctgacttttacctgtagcttgtaggtaagcaatttagaatctgacagtcacagtggaggattaatatgggaatgataggttataacaatcatattagaattaatgtttcttttggagggtaataaatgatagaataacgtattgacttttatagcccttatggaaaaggagcatcatattttatgtgaaaacaaatcttcacacagtcagcattctaaaagcatttaactggccagtgtgagtacagtggtgttaagtgaacacagccagttacagatttccttgttgcttctctacccccaaagcttcactttattagccttaaaaataaaataaatgaaaacatttaactgttatacctgtaagttttatcttgaactttttttaaggttttgaatcacttaaaactttaggtcaagtaactatcattggttcataattattagtaatcctagtaattattgcctatcgacagactactgtaagaatattttcaaattatacagtcatctctctctgggaagataaatgtcacagttctttggtgactattatcagtgtcatattgatactgaaaaatctttttactttttaggccttaatacatttaccttaacaggaatactttattcaatgtggtttatcctgattaataacctgtcagcctcttcagaaatttgtgataacgtggcattttgtgaaattctcatctgctgaaataaaacacaacaattttttaaaaaccaagtgaaaccattgaaacattttaatgatatataaaataatactgttttgcttaaagattgaaaaattattaaagatgcatacctttttttttaaaaaaactcattttctgtaaacatgtctttaccaagtttcctttttccctggtaaattatactttctttggaaaatacataaattgttggagataccctgtttattaaccccttttcaagaaaccatctttaatataatttgacttgcagccatataaatgagtcacctgcttagaaggaaaggaagggaatctctaggtatgtttggcctcctgccatctcaagtcagctgtgcctgcttctgctcagacatcttcaggttatgtggcagcattcatatgcagcaaattgtgggcacaactataactttaatggcatgatttccgctcttcaaatttctagttattaaaaagtgaagatttatgttaatctgaagagaaagggattcccaaagctcattttcaaatgagctttctgttctctttctgttctcttcatggccattaatatagaaataaaggaatttactaaaaatgtagcttccggccgttttagtgacagagctcagtcttcttggctgagaagtgcctgtcagttactgatgaagcctgtcaggcctggtgttgtttggaaagactcaggagctgctcggctggaaggcaatgactgaagtcatctgcatgtgtaagagacacagcagtagaatgaacaacggggtctctgtcatgttctaactttcttcctaagttggtcctcccgaaagcacatcagtattagatgatattacagcttgctctagttttttttaaacgttcgagtgtttctatgtgacacagttttaaattatgtaatctgactagatgtgtattaatatcagttcaatcctaagattcatgtggtattgtgaaaaactttctaaggctttctgtgccagttcagacaaaaatgactaggataaattctaagggaaagtacttttttttttcccagagtgtcacctattcatcagagtaaattatgatcccctaccatattgtagagataaaaaagttaagtaaaataatgcttatcttgaaaacttaatggatcgtttgttttgcaaattataaatttttttataaaataactataaagtctgatctttttctcttaatccatagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaaggtaaggaaattaaatcaagtgagaaatatttgtaaactatgtgagaaatatttgcaaaccatggtactttgcaactgaatagtacctaaatatgttataatctcttaaataaggaacatggtgagctcagttcctgtttttaaatttggtccctgcacttctcacaactgcttagttgtttttttttttttcacagattcattatctgtaaaacaaaaatgaacatttagtctaaagcaaacagttatatttcactcaataaaacttaatctttaaaagttcaaaagttgttataggcaaatgacccaattatattttgagaccgaagacactggtggttaagaactgactctaggctttgatctcagtccaaccacttaccatctgtgtgactttggtcatattactcagactcttcatgtgtgaaataagtgtaataattgtacctctgtcatggagttatagtaaagattaaataaggtaaaagtaaatgaaccacttagaaagatactcttggcatactgattttacatttagtaaatgttgttacattattgttgcttgttttgtaatgacactggaaattccaccatgactgttgatactttttgtatatgtcaactgtgagtacatttattgcattagcagtgacttttaatgctgcaattactttaatttttgaaatagaagtatcagtagataaaccaatgtagttaaactcataattagcttgaatcctgacagatgccataaatatgagtattcctaaattttaataccttatcgttttattcatctcacaattaattatattccttagcccttattctttctttccttttacattatttttctgagcattaatttatttgttgacgctagaattactaatgattcagctccatattcagaaccaggctcatgatacaaaacaacttctccagaagaagtcagacgtattactgcttttaactccaaacagtgttgtcctgaaatctgatatttagagaaatatttatcattagtgagtgtccctaaactatttatagaaaagtatgggagagtctgtacgttaactttcctaagcacgttggtttgaaattataatgtctctgcatcctgtttggagagttttccaaggacatgatcagggtgctctgttatgcagagtttacttgtaacctatgtgtgtgaaacagatctgatatagccaaaacaaacttctgaatggaacgtgagtgttgttctttttaaaagcatagtggcacataaaaacaaagaactgtaaaattactttattttagacattggctctattcagaagaataagaaattacattttaaattcatttaatcctgtgattactcatccttagaatatgtaaataatttatattttactataaaagttctttatcaacagtgtttttgttaacaattcctttgccattcagcaatacagatggtatcaactgctaactcagcagtgaacattttagctctgcaggaaaaataagtactaaaggcagttgtacttttttatgaaagtcttaataccattataaaagcagttgtgtaaaactcagttatttcttttctgttcttttaagatggatgagaattgaaggatagatttcagttcatcttagtgttcattccatcacagatgagaagtagccctaactttaaattaaatataaatattatttagagttgctgttacatttctgtaggaaaatttgacaaatcatatgaaaattaatgttctagaccttgttagatcattttctaaaattcaaagacagattgtgatttcctagtaataagtaaatgtttgattaacactggtactatagaagttatgttaataggccaggcgtggtggctcacgcctgtaatcccagcactttgggaggccgaggcacgcggatcatgaggtcaagagatcgaggagaccatcctggccaacatggtgaaaccccatctctattaaaaatataaaaattagctgggcgtggtggtgggcgcctgtagtcccagctacttgggaggctgaagcaggagaatcacttgaacccaggaggcagaggttgcagtgagccaagatcacagcattgcactccagcctgggcgacagagcaagacgccatctcaaaaaaaaaaaaaaaaaagaagttatgttaataatgtatcattatgttgagcacatagagtgaatatttcttccttcttttgagaatttaatctagtgactgtgtttaagaatgtgactcctagtcttcattctgactattcctatcacctttgtatgatacagtcaaaatgttgacatatttaagaagagttttattgttattaatacattgcaagtcacgaatgaaactggatagcaaaacctgagcttccactgggctcttatcggagttccaagcctagaagtagctaaaaataaaaaaagtttttggcagcaaagaagcacactcagaagtctgagtatcagccatgagaacatcccaagcctattaaatggcaagtaaatctgtaaatggccaaatgtaatatattgcctgttagttaatgctgggaagaaaatggcttttgtttataaagtaattttagtttgtattactttaccatcgtttttcatgggttggttattatctttattttacaaatatgaaaatagtctgagataaatcagacagcttatccaatatcatgcatcctaattcagttataatctgcattttcatcagcatcctcagctttatacaataatttagcttcacattattgaccctgactcatcaatgaaaggttacattatgttgcagatgttctactttttcaaaaggcatggaggttgatagtacaaaggcctacatctgtgggaacatttctagccactattctttttcacgttctctatgaagtagagatgccggtgaggctgcagataaaagggaacacttatacactgttagtgggaatctagattagtcgagccactgtggaaagcagtttggagatttttccaagaacttagaactgccattcgacccagcaatcccattactgggtatatacccaaaggaaaataaactgttttaccgaaaagacacatgcacgtgtatgttcattgcggcactattcacaatagcagagatatggaatcaatgtaggtgcccatcaatagtggattggattttttaaaatatggtataaatacattatggaataccatgcagccatgagaaataacaaaatcatgtactttacagcaacatggatgcagctagaggccattttcctaggcgaattaacacaggcacagaaaatcaaacactgcatgttctcactaataagtgggagctaaacagtgcatactcatggacataaaaattccaacagtagacactgggaactactagagagggaagagaggaaggagatcaagagttgaaaaactaacaatggggtactgtgctcagtacctgggtgatgggatcagtcacaccccaaaactcagtaccatgcagtatacccatgtaataaatttgcacatataccctgtgaatctaaaataaaagttgaaattataaatgttaaaagaagaaagaaatattgtcctggatgtaaactcattctgtgtcattattgaagaagacctcatattgctacgttcgcttgccttcactcaaccaactccaacttcattagttggaatttgtaaagatcaaaaaattttctttcaataatattgcctattcatctgctataatgaatcccatactaaaattcttagtcccataataaaatggaaaaagaactccactaattagttctgagggaagaaacctctgtagacagtgagagttaattctaccattaattccaatggagatatattaaaagatatattacacattatcagcaatcaatttttaattaaagttttaataaatacccttacacactaaatttataggtataaagttgcattcctttatgatttttaaattttctctaagtctttagatacgactccttcatgtttttagtattatttgcctttttaatttctttcatcagacttgataaaggcttctttctccgttttttttttttttttttttttttttttttgagacggagttttgctctgtcacccaggctggagtgcagtggcgcaatctccacatactgcaagctctgcctcccgggttcacgccgttctcctgcctcagcctcctgagtagctgggactagaggcgcccgccaccatgcccggctaattttttgtatttttagtagagatgggatttcaccatgttagccaggatggtctcgatctcctgaccttgtgatccacccgcctaggcctcccaaagtgctgggattacaggcgtgagccaccgcgcccggcctctttctccgttttattatttcagtcatgtctgtgtttttgttagtattgtagaggttcaaagaatcacctttattttcagtaagatgaatttcttctatgaatattttatgtttatttttacattttttcctgttttgctttcttcaagttttttttttaattttttacattatttcattgaatactaaactaatagaagtttactcttgttttctattaagtgcttttaagactaaatattgtgagcttgacttcaggtcatatattttgataataagtggtttcattgttcttttttatttaaaatcttgcatatacacagaattatttagaaaggtatcttaaagggttcacataaatatgtttgggcccaaagttgtttttatggtggttttttggattttagtctatctcttcattttttatgcttttaatatggcattgcaaatataaatgtggcttgtgcaatacttttagaaacttgttgaaatgtttctggtggtttaatagctcagtcaatggttatctgaaatatcattccagttaattatgttatttaaatctttatttttattttcttttctgcctttttttggattattcaacattttcttccttttatagttcctaaggtggttaacatattaaaatttttatttttgtcattgtggttattaaatattaatacctatacttaaattttacctttaatgaactactggagtcaatatgtaaggcaagtattttaggacacttctagttctctctctcccgaccccgattacttctcgttcagtggtattatcaattgatggaatgattttcacgttttgttgctacagttatttacacttagctacagggtttactgatttctctgatcaccactgaatattatatcttttgttctttcttcagtttccatttttctggacacattatcaagtaattctatctgggagagtctgcagcctctttctgaaactttacatgtctgaaattttctttattttcccccagcctgaattgctaacttggctgagtatagaattctagattcaaaattattttacttcatatccttaaaaacacttctctgttaaattctgatattcacttttgctagtcaagtctggtgataatctgattgttcattgcaggtaacctcttatgttctttctaagatactggatttgtactttatccatagtagtttgaaatgttaccatgtggagttgaattgtgactcctgtaaatttctatttgttatttttgtcttctgtttcattctcttaggttttttttcttagttaatttgtttctaaagctcatattagaacacatgagggaagttgtaggtctgccctccttgtctctctgcccataccctcacattttttaacttgtatcttttgtgctgtgttcttgaaaaatgtctttgttcagctcaataactaccctgattacagaagtgaacaagacagaaatgaaatttactcactacaaagtactagtcaccactgtgaaagcaacccagaaaatattcttactgacagtgggtcataagtatcattttccaagcagtttatatgtataagacagcacatcattaattacagagagagagtagtaaatgatatatgagtgtatatacttgtctttccagacaaattatgttggtaaatttcattacttatacactagtggtaccaagataaatttcatcattttccatatgtccatgaagtgcactgagtacacttctaaatttgtttttacataaaattatactgtgataaagtaaagtaagctttttagctgttgaatcatcaacatatacagttaacttttgtatttcttaaggcagtgctgggaaaggagagtgccattctgagataatatacttaaatccattttatttaatatcaatcagcttttttacaagaatagtggccacaaagttttatgactcctaaggaatagtagcagtcctcttcaaaagaagagtgacatggaagattttgcacttttttttggtaaatcttaaccatctgtatgaatcagactagtggttatcgtgtgtggaatcaccagatgacaagatggaaaatccttctcctaatagtctgtgaataggacaagacttagattcaggcctgtcttgttatatatatactttcagtcacatatattaataaaaggagaaataaaacacaaatggagaaacaaatgtacagacaacatttatgctcaaaggaattcaggtcagcgtgcattgtgaaacacatgcactacgtcatctctcacatacagttaactgaaaagtttattgttaaatgcacctttggataagagaattaaataaagatcatgtactttggatctcagttgaaatgccagtgctgccacttatacttctgtttccttttgtcacttacttgacctgtctatgtacctgtaaatttataaaatgaaggtggttatacctaccctgaaaattccttctgaagattgaaataccattcctttccctttccctcttaagcttaactaagaaacctgtaattaagctagactggcacaacatgagcgatgactttaattccaagagatctgtgacagctaggtaacctcctaccgactgtagactacacagattattgatacggaaagaactgatggctatttcatttctattctttttctacaactataaatcccaaagggttgtttatttatgtttcagaacatttaaaacatgtaagttaaaatgtatcaatctaagaattttttttttccaaatcccagtgacttagtccgatcagactaatttaagtaagggtagaatcagttgaaaacttgcaacggaaaattattaacaggccaggtgtggtggctcaagtctgtaatcctagcactttcagaggccaaggtgagaggatcacttgagcccagaagttcaacaccagcctgggcaacatagtgggaccccatctctacaaaaaataaaatgaaataaattagccaggcatggtggcaggcacctgtgttcctagggactcaggaggcctgagtaggaggatcacctgagcctaggaattgaaggctgcagtgagctataattacaccactgcattccagcctgggtgacagagtcagaccttgtctctaaggaaataaaaggaaaaagaaaatggctaacactaaaagggaggattaaaaggtttcagcaggaagtgtatttctgtagatttccggaagtaacttaaaatgtccaaatctttccggatcctcactttgcaaccttttcccccctaaggctgatagattaagtgctatattgggtaactgttttcaatgttgtgtatgtgagtttttaaagctcataataagtctttggtagcaagatacatctctctacataagcccatcaccttttctcactttcttcataagcaaagacagaaataaagaatatatactatacggaaagaatataaaaggaaaatataaatcagcattattgtctcttttttttttgagatggagtctcgctctgtcatccaggctggagtgcagtggtgcgatctcggctcactgcaagctccgccccctgggttcacgccattctcctgcctcagcctccagagtacctgggactacaggcgcccgccaccattcctggctaattttttgtatttttagtagagacggggtttcaccttgttagccagcatggtcttcatctcctgacctcgtgatccacccgcctcagcctcccaaagtgctgggattacaggcgtgagctaccgcccccagcctatcgtctatttttcttcacatatttgtcactaaatctaaatatcaagaccccgtctctgtttttgcagagaagaagcttagttcagattgatctaagtgttttcttcataccaatgtgcaaacatagcaaatgtaagtcaggtaacaaggcgatgtggcacagtggcatgagaattagacttgatataaaaagatttgctttaaaggcctggcttagtgtcataatttctgcatctgtgaaatgaagcatatacttctggtgcattacggagaagttgtcaaaataagagtgtaaatgagagaggaaagtatggggtgttccattaaattaggctttatttatctttaatttcttggtaacagctttttaatcccacaaagtaagtttttacaacgtttaaattgtctgtgtctagtgattgcagcattaagatcttggacatagggctgaagggctcctcaagtacggccaaagtgggagcccaggcagaggaggtgctgagagcaagcgagggctgtgaggactgccagcacgctgtcacctctcaatagtataatcatttaaatatactatgtattagtcattaacattgctaaaaaaaaaaaaataccaaaaatgtcatacctaaagaagaggtcttttcctcagcaggacttcttttaactgaagtatttgggagcagtgcttatgacttattttaaaagacaaatttctctagtcttttaaatatgaatacaaattttgactattaaaagtgactggtaacccttccgttaatagaaaaaaagcaaatacaagttccttgagagcaggagtcttaaagaaccagaataattccctctctgttttagtagcaggtacttattttttcttgtgcttcttttcaaatttaccacaccatagcattgcttttataatcagaaacctcagaaacataaagatttttttttttgaagactcattggggaaactagacaaggtcacatctatatggttggctgcctcttcagtatctggcatccatgagaaaatacctaatgaagtgagttagtgggccaagtcttgagtttgtccagtgctgtagtctaacaaaaaacctggttgattttgatcaaccaataaaatgagtcctgttaaacaaaattttaagtaggacttttgaataggttgttggaaataagcaccagatatagatgaaatcgttttataattgattctctgtcaaatcaggcattccctatattattgtcatttgtcagtcatgaaatatttagctagaaaaaattggaaatagctgggcacgatggctcacgcctgtaatcccagtactttgggaggctgaggtggacggatcacttgaggtcaggagttcaagaccagcctggccaacatagtgaacccttgtctctactaaaaatgcaaaaattagctggcatggtggcaggcgcctgtagtcccacctactcgggaggctgaggcaggagaattgctggaacctggaagacggaggttacagtgagctgaatcgtgccattgcactccagcctgggcgacagtgccatctcaaaaaaaaaaaaagaagaagaagaagaaaagaaaaagaaaaattggaaatactgccagttttgaaatagaattcatgtttactgtaaatcaacacagactcagtaaggcacttgcaggtttgacctttttatattataatacattaatttacattttctctagtttttagtccattgtctctcagtgaaaatctgcaccaagaatcatcttgaactctttgttcctatgggaaggaggattgcctaatggtgcttgttttgttcactgatctgtgtgttttattctcatttgtcttttagtaaatctctctagtcatgaatgttatttacttttattaaggcacatagatttctgtgtttcaatactttttaaaaattatactcctgggcttttagggctgaaaggaaatataaaatcatatagtctacttatttatgaattaattagggcacagagaacttaagtgatttatctaagatcactcacttagtagtagaattgagtggatcactcaattagaagtagatccagttcattgcataatcttttttactgtgctgtgtatttatccaataatttgtctatacttacaaaggagcattatgctagaatctgaaaataagtaactgaaattcggtactcgctaccagcactaacattctgtattcagaattccatcaagtgtttcaagatgtcttttttatattaaactctttaagccatctgccttctattttaaggtatattataagaatcattaaagccaaatttattgttaaaatcttggagatgcatagacagcagcccttcagctgtgagtttttgcctccatggctatccaaacacatcattttaccaccaagtaacagtcactggaattcagaactgtcactctaggaaaggtgggatagtctccagttcctccaggtctttctttgcccaggaaccttatccttctttccttacctgctgccctcaggggtgtgaagaactggaccttctctcagccattcatgtcagaggtctccaacacaccgttgtgaccaagtggtagggatggctgactagaagcatttcaagcacacctcatacttcaaagagcaaaatagcatgtagacaattacagttagaatagattttccaagaaggaacatgaggaagtcaacagaaaagcaacaagaaaaaaataggaagcagaaggaaaacaggaagcctatttgaccagagtgggccaggaactgggagtgattccccattacaggaaaaggtgaatgaaactctttctgcagtccactttcccactggggaatcatacaatccagaccataggagagtactatgtccctctcaagtcctgaatctaacttagggagtagccaggagactatgagaaggaactactccagggaaagaacatcccatgccctttctgaaacacaagtggcaaccataagacaccactctttatcctaccttttagcagactatgcacagtcccaggaacgaggccagaactgataagcaagtgtggcattggctccagccaaggttatgggattcgggaacctccccatcctggaattgggctgggaggggtttcacctgggagccacagttttatggcctggggttatattgcagtccaaagacaaactgcttgtgatttggctggctgcctcagctcgatgccagtggcaggccgtaggatggtatcccgctaggttgagagcatgagagcaaggcaggtctcactaccacctgctaggctatggaacccgagccaccccactttccccatgctggttagttggaacagaaagagttgctccacttctccctgaactattgctccagtggcctgagaactgtcctccaacccccatcagggctggcacttgtactggccattaggaggaccaggtatagacctgcccatctcagccccaccctgctttctcctctacccaacaccaccagctttcccccctatttcccaccttggaagcaaagtacaggactgagaccgctgagaattccgtggcccaacccattgcctgggaaacccaagtacatcaccaagttaacaaaggtcaagccttaactgtaacaccaccactgcagctggctctcacctgcacgcactgcctactggccaggatatcaacatgcacagccactacaaagtctgatacagtttcatcctataagtaaacagcattgcagcctaaaaggaaacagcattgtctaacctaaccgaatattctgaatgtcagacaaaggcgagtaaaggtagcagatctcattcctgcctgtcaaagccatggtgctggtaccgcccttcactccccaagcggagacctcagcagatttcaccaggggcctgaggactcccccaccacccctctcagggctggtgtgtacatctgccatggggggcctgagtgcagggttccccaatctggctttactcagctttaccaccccatcctagagagaaggtgactcaagcccttgagcactccagggcccaacccaccacctgggacactgaaagcgcttctacagatgttaacaaagatcacatataaaccctactgctatcatggcagcctgctctaactggcatgtaccacctactgaccaggtcagcctccaaaacacaaggcaaatctgctgaaaaagatgcacagcactcaggaaggagacaggcttcatgtgacctctgcatccaccatcacccatgccaccctggcttctcagtattctgaagtggcttcttcatccacccagtacacagctactacaactgccattttataaagccaccacattaaagctatttttaactaatattgtacagagtctttgctactgaacatacccagaagcaaagagaaacagccctacataacatcatagtcacatcctgaagagaaaaaaaaaaatttccccccaaagaaagtaaattcaaaagcaagaagaagcaactgttttctcatatgtaaagaaatcagtgtaataatgctgaagtatttaatagcaaagggttatggcatccccaaagaaacagtaattctccggtaatagatcctaaccaaaaagaaataatcaaaataccaatttaaattattgattgtaaagaatctcatggaaataaaaagacaaatctgaaaaccagtactgatgaatcaacaaattaattttgaatatgaatgacaagtgtaccaacgagatggatatcattatttctaaaaaagccagaactgctagaaaataaaaaattattgaaggaattaaacaagacagttgaaagcttcaacaagagactagagcaagcaaagcagagaatctcactgcttgaaacaaatcttttaaattaatagagtcagaaaaaaagaaaaaaatgaacaaagacttcaatatgtactacatagtaatgattacacttatgaatccttggtatttccaaaagagaagaaaaagtaacaagactggaaaacctatttaaggaaatactacgttaaaatttccctagtcttgcaaaagatttacacattcaaatataagaggcccagcaaataccagaaaagtgcattgcaagacatagttcaccaagaaatatagtcatcaaactgtataaagtcaacatgtaggaaaaaatctgatgtctagttgcctataagagaaaccttatcagagtagcagtggacttctcaatgtgagacttaacaagccagaatggattgagagccttttttctgagttcttaaagagaaaaaaaaaaaaaaaagcaaactgtcaatcaggaattttatatcctggtagagtaagcttgataaatgaagtagaaataaagtctttgccacaaaagcaaacatcaagggaagtggtcacaaatagactggacctacaaggaatactcaaaggaattctaaacatggaaacaaagggttagtacttaccaccataaaagtgcgggaaagtataaaatattaaccttgaatgtaaatgacataaatattccacttaaaagatataaattgatggaatgggtttttaaaaatcagccatctacatgctgcttataagaaatcctctcagctggtaaagacacttacagactgtgggtaaaggagttggaaaaagattttcctcacatgaatggaaaccaaaagcaagcaggagtaactatattcatatcagatagaacatactttaaatcaaaaacagtaaaaaagaaagaatgtcattttataatgagaaaggaatcaagtcaacaagagaatataacaatcctaatatatatacacccagcaccagagcacccagattcataaaacaaatattactacacctaaagacaaagatagacaataatacaataatagtggggaacttcaacatgccactcacagcaactgacagaacactgagacagaaaaaccacaaacactagacttaaattggactctagaccaaatggatttaatagacacatgtggaacattctaaccatataattcttctcatcggaacatggaacattctccaaaatagaccatatgttaccacaaagcaagtctcaaaaaatttttaaaaatcaaactcatgtcaagtatcttttcagatcacagcagaataaaactagaaatcaataccaacggaaattctcaaaactatataaatagccaggcgcggtggcccaagcctgtaatcccagcactttgggagaccgaggccagtggatcacctgaggtcaggagtttgagaccagcctgaccaacatggcgaaaccccatctctactaaaaatacaaaaattaactggacgtgatggcgtgtacctgtaatcccagctactcaggaggctgaggcaggagaatcgcttgaatccgggaggcggaagtttcagtgagccgagattgtgccactgcactccagcctgggcgacagagccagactccatctcaaagaaacaaaacaagaaactgtataaatagacagagttgacaacacactcctgaacagtctttggatcaacaatgaaattaaaaaggaaattaaaatttttttgaacagaatgaaaatggaaacaatatgttaaaacccctgggatatagcaaaagcagtgctaagagggaagtttatagtgttaaatgcctacattaaaaaaaaaagaaaaaaagggctgtacttggtggttcatctctgtagtctcagcgtctttgggcagctgaggcaggaggatcccttgagccaaggagttcaggaccagtctggccaacatagcgagacctacctctacgaacaatttaaaaataaaataaaataaaataaaataaaataaaataaaaacttagccgggacatggtgatgcatgcctgtagactcagctacctgggaggctaaggtgggaagatcgcttgagctcagaaggtccaggctgcaataagtcacgattgtgccacttgcacttcagcctgggcaacagagtgaggccctgcctcccaaaacaaaggtaattaacaaactaacatcaaacctgaaggaactagaaacatatgaacaaaccaaacccaaagctagcagaagaaaagaaataataaaaattaaagcagtactaaataaaattgagaccaaagaaatacaaagaatcaagacaacaaaaagttggttgttgaaaatgtaaacaaaattgataaaccactccctctaataaccaagaaacagaagattcagataaatacaatcagaaatgaaaaagaagacattacaactgatagaacataaatatgaaagatcatcagagaatactatgaacaactctatgctcacaaactagaaaacctaggggaaatggataaattcctggaaacgtaacctctcaagataggaagaaatataaatgttgaacagatcaataatgagtggtgagattaaatcagtataaaaacatctccccaaaacaacaacaaaagagctgcatgaccgtgtggactgacaatcaaattctcctaaatgtacaaagaagtactggtaccagttctactgaaactgttccaaaaaatcaaggagaagggaatcttccctaactcattatatgaaattgttatcaccctgataccaaagttagacaagtacacaacaaaaagagaaaatctggtgaacatacatgcaaaaatcctcaacataatactagcaaattgaatccaacagcacagcaagatttattccagcgatgcaaagatggttcaacatatgcaaattaataaatgtgattcaccacataaacagtgttaaaaactgtatgatcatctcagtaaatgcagaaaaagcatttgatgaaattcatctcttcatgataaaaatcatcaaaacctaggcatagtgagcatgccacaaaataataaaatccatatacaacaaacccacaatcaacatcatactgaatgtggaaacattgaaagctcttccccgaagaactggaacaacacatgtatacccactttcaccactcctattctaaataataccggacgtcctaaccagagaaatcagacaatagaaagatatgaaaaccatgcaaattggaaaagagaaagtcaaactatctgtattcactaaagatatggtctaacacctagaaaaatcctcaagacctctccagaaaactcttagttttgataaacaaatctagtatagttacaagatgcaaaatcaacatacaaaactctgtagcatttctatacaccaatacaaatcaagctgaaaaacaaatcaagaaggcagtttcatttacactgactacaaaagacaaaataaaatacttaggaatatatttcactaataagttgaaagatctctacaaggaaaactacaaaactttgatgaaagaaattgtagatggcacaaaaagatggaaaaacatcccatggtcctggagcaggagaatcaatgtcattaaaatgaccataatgcccaaagcaatatacagattcagtgcaattcctatgaaaatgccaatgtcagttttcacagaattagaaaaaacatcctaaaatttatatagaacaaaagaagagcccaaatgaccaaagcactcctgagcaaaagcaaacctggagtcatcatattatcttatctcaaattataatacaaggctatagtaaccaaaacatagtactggtattaagtaaaatagacacatagatcaatgaaacagaatgtggaaaccagaaataaagccaaaagtctacagttaactgatctttgttaagacaaaaacaacaatcactaaggacaatcttttcagtaaatgctgctgggaaaatgggacagccatatacagaataatgaaaactagacccctatatctcaccatatttaaaaattacctcaacatggatcaagaactgaaatataagatctgaaataataaaaatactggaagaaatcctggaaagaaaactcttctggccaccaggcagctaattcatgactaaggcctcaaaagcataatcaacaatgacaaaaatagacatatgggacttaattgaactaaaaagcttctgcacagcaaaagaaataatcaacagggtgaacagaccagctggcaaaatgggagaaaatatttttaaactacagatctgattaatgattaaggacttatattcagaatttataaataactcaatccaacaacaaccaaaaaaaacaaatacaagtaaccccatttaaaagtgggcaaaggactcaagtagacatttttcaaaagaagacatatagatggccaagaagcacataaaaaaatgtacattactaaccctcagagatacgcaaatctaaaccacaatgagacatcatcctacaccaatcagaatggctgttaccaaaaactctataataatagattttggcaaggatacagaattaagggaactcttatatgctgttggtatgaatgtttattagtacacctgtatagaaatcagtttggagacttcacaaagaactaaaaatagaactaccattcgatgcagcaatcccactactggatatctactcaatagaaaataaatcattataccaaaacgataccagcacttgtatatttattgcagcggtattcatactagcaaagatatgtaatcaacctaagttcataaacagatgactgcatacagaaaatatatatatcacatttatatatcatatttatatatgatatataatatatatcatttgtatatgatatatattatatatcatgcttgtatatgatatatattatatatcatgcttgtatatgatatatatcatatgtatatacatatatacacatacatatatatgtatatgtgtatttgtatatatgatatatatatcatatatatatagagagagagcatggaatactactcaaccataaaaaagaatgaagtcatgtctttttcaccaacaaggatggaattggaggccattatcttaatttaaacaattcagaaacaaagtcaagtttctaatgtgcagaatggacatagattgtaaaataatagtcactgaagacttggaagggagagagagcatggaatactactcaaccataaaaaagaatgaagtcatgtctttttcaccagcaaggatggaattggaggccattatcttaatttaaacaattcagaaacaaagtcaagtttctagtgtgcagaatggacatagattgtaaaataatagtcactgaagacttggaagggaaggagggtgaggggggttgagggataagaagttacttaatgggttcaatgtacactattcaagtgatcattacactaatgtcccagactttaccactgtgcaacataaaaaaaactgcacttgtagccttgagtattcatgagtaaataaaagggagaaaagtctgcacagagcctatattactacactcatccataagcaaaatcaccacactattcccaactggcacaataaaatgaaactctaaagtctttttctagaacaggcacactaggaaatttggaatcactgattatttcatcgaatacagagacatcaatatagggacacagaaaaacacattaaaaagcaaggaaaggctgggcacggtggctcacgcctctaatcccagcactttggaaagccaaggcaggtggatcacgaggtcaggagttctagaccagcctggtcaacatggtgaaacccgatctctactaaaaatacaaaacttagctgggtgtggtggcgggcgcctgtaatcccagcaacttgggaggctgaggcaggagaatctcttgaaaccagaaggtggaggttgcagtgagccgagattgtaccactgcactccagcctagacgaaagagcgaaactccatctcaaaaaaaaaaaagcaaggaaaaatggcatcatgaatgccatatcatatctctaataatgtatcccagtgtaaaagaaatcaacagttaccagaaaaggaattcaaaataatgatattacggaaactcagtgtgacaaaagaaaatacatgtagacaattcaacagtctcataaaaacaatacgagacttagataagaaattcacaaaggggtataaatcataataaaaaaataaaaaccacacagaaatcctgcagcttaattactcaatgaatgaaataaaaaataaaatagacagctgcagtagcagacttcatcagacttaagaaagaacctttaaatatgtagatctgtcatttcaaattacccagacagagataaaaagaaataagaatgcaaaagagtgagagaaatcctacaaaacttaagttacatcaataggcacacaaatagtaatcttatgggaattccagaaggtgaagagaaggaaaattacatagaaaatctggttaatgaaatagtagatgaacactttccatgtcggtggagagagatggacgtttcaattcaggaatctcaaaggtctccaaagagaatcaactgcaaatggtcctccccaaggcatattgcaattaaatggtcaaatggcagagacaggaaaaaaatttaaaaacagcaagagaatgaggagaaaaagcaaaaaagaacagcaaaacagtcaagtcacatacaaaggaatcccaattagaataacagatttcttgcagaaaccttacaggctatgaatgagtgggatgatgtattcaaagtgctgaaagaaaaaataattgttttacatgatacgaccgagaatactgtaactgtaaaaaccaaagaatactataaccaccaaagctgtagttcagcagagagagagagaaataatgtctttcctagaaaaaaatctgagagaatttataactgctagatcagccttacaagaaatagtcaaggtagtccgagatctagcaggccacaggacaatattcaccatcatgaaaacatgagaaagataatagaacagatattaaaagaaaacagagacaagaattaaaccttgtcgctgcaaaaaactgtgaaaccacattaataaacaagattggaataaagaaacaaagtatatagagaaaaaacagaaaacattcagccaagtgacaggagtaagtcttcacctatcagtaataaccttgaatgtacctgcattaaatttcccacttaaaagatacagactgactgaatggatttaaaaacaaatatggcccatctatacctactacaagatactcactttacctgtaaatacacatatagactgcaagtgaagagacggtaaaagatgttccacacaaacagaagccaattgagctggtatcgctacatttatttataaaaaacagactttttaaaaactctaaaaacagacaaagtaattattatataatgattgaggaactgatccagcaacaggatataataattctaaatgtaaatacactcaataccagagcactgcgatatataaagcaaatattcttagatctaaagggaaaggtagacttcaatacaataatagatggagacgtcagtaaccactctcagcattagatagatcatctggacataaaaccaacaaaaacattgctttcagattgtcctttagaccacatggacctaacagacatttacagaacattttatccaacagctagagaaggcacattctttccatcagcactctccagggtaagaccacatggcagaccacaaaacaagtctcaacaaatttttttaaattaaaattatattaaatatcttttctcaccacaatgcaacaaaactagaaatctgtaaccaaagaaacttttgaaattgtgcaaatatatggaaattaaacagtatgcttctgaatgaccaatgggtcaatgaagagatgaagaaggtatcttaaatgggttttgaagcaaatgaagataggaaaacagcataccgaaacctgtgggatacagcaaaagctgatataaacaccaacattaaaaaactagaaagattttaaataaaccacctaacaatgcatgtcaaaaatagaaaatcatgaagaaactataccccaagttagttggaggaatgaaacaataaagatcagagcagaaattttactaattgagactacaaaacaacaggatgaatgaagcaaaagttgatttttgaaaagattaacataaatttaccaatagctagactcatctagataaaaaaaagaggaaaggccccaataaataaaatcaaaaaggaaagggagacattaaaattgatatcacagaaatacaaggaccattagagactattacaaacaactatatgccaacaaattagaaaatctagtgtaaatggatgaattcatgtacacatacaatccaccaagattgaaccaagaagaaacagaatacctgaacagaccaattagaagtaatgagatttaatcctgaataaaatgtcccccattaaagaaaagcccaggacccagtagcttcagtactgaattctataaaacattaaataaagaactaatatcaattcttaaggtatttcagaaaatttaggaggtggaaattcttgcatactcattatacaaggtcaccattaccctgataccaaaacaagacaaggatgcaacagaaaaagaatagtacagtttaatatgtcaggttagttgagatgcagaagtcctgagctaaatactcacaaactgaattcagcagcacattagaaagagcatttaccatgttcaaagtgaatttatcccaggaatataaggatggctaaactatacaattcaataaatgtgatacaccacattaacaaaatgaaagacaaaaactctttggtcatctcaataaatatcgaaagaggatgtgataaaattcagcatccttcatcgtaaaaactctcaataatttaggtacagaaggaatatacctcaacatagtaaaggatatatatgacaaacctactgccaacattatactacacgaggaaaagttggaagcttttcctgtaagatttggaaggagacaaggatacccattttacttcaccttttttaagagtctcgcactgttacccaggctggagtgcagtggtgcaatctcgactcgctgcaacctccacttcttgggttcaagcgattctcgtgcctcagccccaagtagctgggactacaggtgtgcaccaccacgctggctagtttttgtgtttctggtggagacggggtttcaccatgttaaccaggctagtctcgaactcctgagctcaagtaatcttcctaccttggcctttggtctaagcgacagagcgagactttgtctcaaaaaaaaaagaaaaccaaaagtaaatgctgttgaggatgcagagaatgggaaactcttatacattgatggtgggaaagtaaattagtacagccattacggaaaacagggtggaggttgctcaaaaaatataaaaaatagaactatcatacctgccatacgttccagcagtcctgccactgagtatcccaaggaaaggaaatcaaaaggatacctgtacccccatgtttattgcagctctgttcacaataaccaagatattaaatgaacctaactattcatcaagagatgaattgatttttgcaatgtggtatataaacacagtggaaaatatttagccattaagagtggaaatgttgtcattcataacagcatgatgagcttggaggactttatattaagtgaaataatccaagtacagaaaggtgaataaccacattctcattcatgtggaagctaaaatagtttatctcagaagtagagagtagaatagttgttacttaagatagaggttattgtggaataggtgaacgccaagggttggttaatagactctttctcaaaaaaataaaaataaaaatgtacagcaggaccatttctcctagtctacaggatgcaactaggaagacttcctggagaaagtaatgtcagcagttgaagttcttatatgtggataacactgtataaggcagaagataattgagtaaattgagatatttattcttgccatgctttctaacagaagaggttaatgctcacttttcaccttaaactgtgaatagacatttttccaaagaagatatgcataggataaaaaggcacataaaaatttgcttaacatcattagtcattcgtgaaattcaaaacaaaaccacaattagataccacttcacactcactaggatggccagaatcaaaaacagacaaccctggtatggtggcacacacctgtagtcacagcactttgggaggctgaggtgagggaattgcttgagcccaggagttcaagaccagcctggataacatagtgaggccctgtctctacaaaaaaaaattttataatagccagacatagtggcaggtgcctgtggtcccagctactcaggaggttaaggcaggaggatcgcttgagcccaggaggtcaaggctgcagtgagctgtgtttgtgccactgcactcctgcctgggtgacagaacaagcccctgcctcagaaagaaagaaaaaaaaatagagcagttggtcttgcagcagctgggcttggtggctcacgcttgtaatccccctttgggaggccagggcatgagaatcacttaaagccaagagttcaagaccagtccgggcaatagagcaagatccccacctctaatttaagaaaaaattatatgtaaatatatatatatttaaatagagaacatttctgttaacacaacgttattctggacagcatttctctgtatggtgtacagagttagaatggtcttcgggtctagttgcagcatcatttcttaaccaagtgtccttgcattagctctgatacatctgatcttcagctttatcttacaaatgcagctagcaattgatgtaggtcttgcttgcctcaaaaagccaaacttttgaacaaatttattatcttaacattccttgaatgtgaactacctgagaggaagttgtgattaagtgaaagaatatagattttgtaagtttaccacatattaaatgtgagatgttcagtgagttttttaacctctctcagccttgcctatctcatgaatacaatagggatagtaatccatacctcataagactggaggaattaaactgtataatgtatcaaagctcagcacctagcacatagtatataagcaatgtggtgctacccagatctctctttaggacttaaggacctatttcctgggctgctgagaaggctgccatctgacagccatttgctattaacactctctggcaattatctttttttttttttgaggcagggtttcactcttgtcgcccaggctggagtgcaatggtatgatcttggctcaccacaacctctgcctcccgggttcaagtgattctcctgcctcagcctcccaagtaggtgtgattacaggcacccgccaccatgcccagctaatttttgtatttttagtagagatggggtttcaccatgttggccaggctggtctagaactgctgaactcaggtgatccacccacctcggcctcccagagtgttgggattacaggtgtgagccaccgcgcccagcctctggcaattatctttaacaaagaaggccactttttctagtgatatgcctcctttatcatatcatataattgacggggcagttaaagtcccagcctctgcacccataatggaggacaatttggaatggccatcccaacttcagagcttcctgtgggatagattgaggcctttgttaagactgcatcacagtctaaattctccctctacctatgtagagttcaatgtaatatatttactgctgtcctgtttccatctcagatctccttcccagggaacccaacttgccccaagcagtgatgttacttccatctccctatactgagctccttccctttgtagtctgccatgtggaggagtgtcaggaaaggcttttgggagaaagtggtacttacactgagtgtcaaaggaattacaaataatttagcagtgggtaagtgtgggggtgagtttcagggagagcaacacttgccaaggcacagatgatcagaggcagagggtacatgaaagaattataagcaatattattataacgcgtgtttacaaaattctttgaattgactactactgttttctacagctcttatgtaatataattgtgtaggaaaaactctctctgcctatgtttttcctctactctcacaccacaatagttactaacatagaagacttgggtgaccatatgtgtggagtttttgtccccacacacaaagcagcagacaccagctgggtgtcctctaattcagttccaacactcctggagatagtgtcagatccaacaggttaagggctcaatccccaagaccactgccacatacacactagttgcaagcccaggcctctgaaatttctgtccaaccagcgtcaggttggggttcccatgaccccctcctttggtatgagttaatttgctggagtggcttacagaactcagagaagcacttacttatattgacaggtttattataaaagatatagatgaagagaggcatagggtgaggtacggggcaggggctcagagcttctaagccctccctgggcacaaccccctccagcaatctccacttgttcagctcggatgtttactgaaccctttccttttgggtttttatggaagcttcattgcatcagcattcttcccccagggtatagggtgggactctctcatgggagtgtcttaagacccaggatcagaaaggaacattagcgtgaacggagtgcaggagaaggtcagaggcctgcctctgaggcctaacacacccaacattacaacaaaagactgtaacgagggctatgggagttttgagccaggaatggtggaagaaaactaatatgtataataccaccataataacaataatacttgacatgtgtagagtaattctgatgttgttctatgtaagtttctataacatgatagcttcagtttttcaaatgttttcattccttcagaataaatattacaccataaattctaattaaatatatgtgtgattcaagaaaattatacaagctttgggttttcatgtacaaacttaagaatacttatttgaggacattttgttttttgaagattcagaaacagttattcttccatgaattattccaagcacatgaatttttttaaagatacatttcaaaaatagcacattcattcttctcttgactctctaaggagcacagaaaacaattttaatgggggtggttgtggggaaggtgagcatagttgacttgacccattatgcattaatctgacaggtagctaaagaatgtaatgaaatagctgtttggattgtatttattgtgtttatagatgtattaaaacatctatcactgtttagatgatggctacactgtatattataactgcaaaacaggataaattaaactgagtttcatctatgaacattaaaacacttgtgagtgtgaggaacgcgttttgtaaggctactatataatgaacacaatatctatttaaataagttgcatatattcttgactatagaaatatgttatatcttattggtgctctttttttcctagaatttttgtgtacttttattctgcttcattaatgtttttataaatgtataattgtttaacaactttgtggaggtaaatacacatatcataaaattcacatgttgaaagtgtacaatctaatggcttttggtatatccacagaggtgtgcatccattgccacagtcagttttaaaacatttctgttaccccaaaaagaaaacctcacacttctaagccatcacctcccaagccatagacagccacaaatccattttctgtctctacagatttgcctattgtagtcatttgactaaaattgaatcattataattcatgatccttcataattggcttctttcacttagcatagtgttttcaagatttacccttaatatcagatatatcagttctgcatgtctttttattgccaagtaattttccacagcatggatataccacattttatttatccatttgtgagcttcaaatgttgactgacacaatattgtagaaaggtaccaagagtgaacctggtttgtgtattagtttcctattgccatagtaacaaattgccacaaatataatgtcttttaggaaaacacagatttattatattctgaagtcagaagtctgaaataagtttcactgggctaaagtcgaagtgttagcaccacttgttcttctggaggcttaggggagaacttgtttccctgccttttccagcttcttaagaataccagcattccttggctcatggccccatcctctgtcttcaaatttcacagtgtagcatattggttttagtcagggttctgcagagaaacaaaaccaatagaatggacagagacaggatttattataaggagctggcatggtattgctataaaaatagacacacagatcaatgggacagaatggagaacccagaagcaaacccacataccttcaaccaactaatattcaacaaagttgacaaaaatacacaatggggagaggacagtctcttcaaagaatgatgctgggaaaattggctagccatatgcagaaaaattaaactggacccctgtctctcaccatatacaaaaattaactcaaggtggattaaaatcttaaatgtaagacctgaaactataaaaatcctggaagaaaacctaggaaaaactcttctagacattggcctagggagactttatgaataagtcctcaaaagcaaacacaataaaaacaaaaatagatacatggaactcaattaaactaaaaggcttatctacatagcaaaataaataatgaacagagtaagcagacagcctacagaatgggagaaaatatttgcaaactgaacatctgacaaagggttaatatccagaatctacaaggaattcaactcagcaagaaaaaaaagcaaccccattaaaaactgggcaaaggacatgaacaaacatttttcagacaaagacatacaagtgactgacaagcatgaaaaaatattcaacattactagtcatcagagaaataagaattaaaaccacaatgaaatataccatctttcaccagtcagaacagctgttaagtcaaaaaacaacatgttggcgaggatgtggagaaaaggggccacttatttgctgtcattgggaatgaaaattaatacaacctctgtggaaaacagtatggagattcctcaaagaactaaaaatagaattaccatttgacgtagcaatcctactactgggtacttaaccaaaggcaaagaaatcattataccaaaaggatacctgtactcatatgttttttgcagcactattcatagtagcaaagctatggaatcaacctaagttccccatcaacagatgattggataaaaaaatatatatatcatatacatatacaccatggaatacgactcatctataaaaaagaatgaaatcgtgtcttttgcagcaacatggctggaactgtcttaagtgaaataactcagaaacaaagtcaaatactgcatgttctcacttgtgaatacaagctaaataatatgtacacatggacatagaggatggagtaatagtgaagactcgcaaggctgagggggtgtaagggatgagaaattacttaatgggtacaactcatgggtacagtagtatatattgtaccaatgtagtaatttctcatccctcatacccgctcagcctcatgggtacaatatatactactgtactgtacgtgggtacaataggatatattgtacccatgaggctgaggggatgtgagggatgagaaattattacattgtataactattaactatgtatacaaatagtatatattgtacccatgaagctgaggggatgtgagggatgagaaattatttaatgagtacagtatatactattgtatactaaaagcccagacttcatcactacataatatgtccatgtaacaaaactgcacttgtagcccttaaatctataaaaataaataaatagtaaaaacagaaaaataacaaaggcaaatcaaaagctggtttttggaaaatatcaacaaaatcgttaaacctctaacaagactgacaaaaaaaaagagaggattgttagtttttaaacaataacaaaaatgaaacagaagattttactacagatgttcagatgcttaaaggattagtgttgttgcaatgaacaaccctccatgcataaattgacaactttgacttaatttaacaattccttgaaaaccacacactatcaaaattcattcaaagtgaaatagatcataggaaccattgtataactattaaagagattaaaactttaaccacaaccttctgaaaaagaaatctccaggcccagatagtttcactaacaaattctacgaaacctttaaataattccagttctacataagctcttccagaaaatagaagactaagggacacttctcaattcaactaaatttaggaggctgatgttaaccttaatgccaaaccaggcaaaaacagtacaaaaaaagaaaactacagactaatacttcatgaacagagatgaaaaattacccaacaacaaattagcacattgaatctctgattctccagtaccacttgtgtgcccagtgatccaagccactgacaccaaattcccagagtaagtgtgcaactctacatttgttaaggattctgttccacaagactgccttgacttcatatcccgatctcaagctccagtccccaggatacccagatttctctccaacttggctacaaattcaggagtcctcattcctccccatgttcaataatgtgctagtaagactcaccaaactctggaaaatgctatacattctattgtagtttattctaaaagaagcaagtgaacagcaaaatgaagaggtacattagggtaaggtcacaagggtcacaagcatggccttttttgtccccatggagttagagtgtcccaccctcacaactggatgtattcaccaaatcctgtcgtttagaggtttttagggaggcttcattacgtaggcatgattgattcagtcattggccattggtcgttggactcaagctgctcctcctctcttttctgggacgattagggggtgagactgaaagttccaaccctctgatcaaagattgttgtttctggtgaaaggcctcatcctgaagctatctaagggccttagcataaactcaagatagatgagatagctcatctcattagcataaactcagataattggaagggcctgttatgagtaacaaaagatgctcctattgctcaggaaattccatttaggagctccatgccaggaactggggaccaagaccaaatatatatttcccattataccaaagaatcccagcaatatatcaaaaataatacaccacaaccaagtgggctttattccagggatgtacagttatttaatatttaaaaatcattttattcctccatttactattttaaataaaggaataagcatatcagttcatgtagaaaaatcatttaacaaaattcaatgcattcatgataaaacctctcagaaatatgggaatacaagggaacgtcatcaacttgataaagaattataaaaaaatctacagccaaccttataattaatggtgaaagtaaaagtaatgcttttctctaatactgagaataaggcaagtttgtgttctctctctactcccattgaacctagtactggaagtcttacccagtgcagtaaagcaagaataagaaataaaagacatacaaattgtaaagaaagaggtcagacttcccctattgaggtgacatgattgttggtgtagaaaatttgaaagaattagggaaaaaaaacctcatgtaactattaagtgaatttaagatagtggcaggatacaagatcaatacacaagaatcactcttatttctatatattagcaatgaacaactagaaatagaaatcaatacaatccaatttaaagcagcattaagaaacaaaatacttaagtataaatgaaacatattaagtatctatatgtcattaactccaaaatgctgatgaaagaaatcaaagaagaccattggtgagacataccatattcaggcactggaagactcaacatccaaaaatatcatttctctcaatatgtagagttattgtcattcctatcaaaatcgcagtagagtttttttgtagatacagacaaattgattctataatttatatgaaaagacaaaggaaccaaaatagctaaatcagttttgaaaaagaatataaaattggagaaatcacactccctaagttaaggattttactatatagctacaataatcaagacagtgtggtattggcaaggcagtagacacatagatcagtggaataacttagactgccaaacaagtacagcttactagtacagctaacggtgtttaagagaagtgtagtctctttttcaatggagaaaagatagtctttataacagatggtattggaaaaactgggcatccctagcagggaaaaaaaaaccttgactaaacatcatatcttacacaaaaactaactcaaaatagattacaagcttaaatgtaaaacataaaatgatgaaacctttagaagacatagaaagtctttgtgacctagattgagttagttgaagagctcttagccatgacaccagaaacacagtcaacgaaagagaaaggctgataagttgacctttatcaaaattcagacctttacttcacaaaagacattgcaaagaggatgaaaaaacaagccacagactaggagaaataataattgcaaatctcattcacaaaggatttgtattcacaatatataaaaaaactctaaactcaaaaataaaaaaaaataggaagattcagaatgtaacttggttcctaattttttatgaatgttaaactttgaatgcagaagaaatgtaagaatttcaagtctttcataagtattcaccattgcttaagttattcccttatcataaattgtacatagctgtgctgtcagtgagtaatatttaggttgacataattcctattagctgataataatcatttccactccagttgctgagttattttcccttcacatatggtaagtctctcccttcctccccattgccactactggcttttccctagagtaacagcattagaagttcaaaaatatcactttcacaacttttttttctatacagaaatattttttatctaagcctgtgtgtgacagatctgtcacagaatagcagtgaaattgctggtccaggcaggaatagaaagagcagaaacaagtcggcctgcctcgcatgctttctcatctctcttgcatactgcctggaccatggacacttgtgcataatgctctaccatctgaaatgtggagcgaggtagcagcagccgccccttctgttcctgccctagactgactcagccctagtcccagtgcctggaaagaaactccatttgtaaatggcgtcttccaatcacctttcaaatcaccaccattctgagaaatcttcacttttggtcatatttgttcagattattctgatacaactgagacccctgtgacttgtgttctcctcgactccaccactattctttatgtctgttctatttacatgaaaacatgttaaacactgacacttctatacacaaaatctccatttgtaatctccgttaagtaagactgctttaaataaagactggaagcagacctcaagaccaatgaacagatataaacttaatctcccctttagacaataggagtatgagggaacacaggtagatatgtgaataaataattggtttaatgctgaaacaaatttattctgccttatattttatatataattttgtgatatactttaaaggttatctgtttgcgcaagatatttgttctgattatgggcaattctgagcttgaactgggacataagcttgtctctcccaaatataatagctgaaataagtgtatgtgctggcatatcacacacagccatctccttacagaataagaaatttagtagcatattcttcaaaacacagttgtgttgttgtagtatgtattttttgtgcgtacatactacttcttcaaaatccactctgtagtttacactaaagcacatctgaattcagaatagccacatttcaattccttagtagccaaacgtgaatagttcttactatattgcatgttgaaatggtcatatctaattttcttttgaagtttcaaggtactgtgttcactgccatattgtaaatatattcttatacagttgaccactgaaaagtaccagtttgaactctgctgatgcacttatgtggaattttttcaataaatacagtcagctctccttacctgtggattctgcatccactaccaaacacagatggaaaatatagtattcgtgggatgcaaacccttgtacatatttcctatggcatcggaccccaaagggctgactatggacttcagtatgtgtggatttgggtatgggtactgggggctggtcctggaaccaatctcatgtgtatacctagggacaattgtatttaatttttacaatttgggaaattaaaatgcatggattatatttccaataaaacaagcaaactgattttaagataatataatgtttttgatgagctatatagctcagttaaaattataatctagtacatttttacatgtaattgtgtataagctgccacaatagtaatgataactcagtggtattcagtaggctcttctcatgtgacaaaacaaaatgggagagaatagggataattatagctagcttaatgttacagatgtgcacagaatgaatacaggttattttgtttgcaatctcagcttttctcgatcttatttaggtaataatgatctatcttgtggtcataaagatattttcctgtattttatcataaaagttttagaattttacttttcatatgtaggcttttaatgtacctaaactttatttttgtgtattgcatcaaaagaacctagtttaattcatttctcttggataaccagttgtccccatgcttaatgagtagtgtatttttccccactgacttgtaatgccacgtttgtgtgtatccagtttctctgtgtgtgtggtcctatttctgtgccttctattttggtgccttaccttaattatcagtctgtgcactgattccacatagtattaatcattctagctctaaaataatgtttgatatctgatagggaaataccttcccatgtaattttgtcttcagaattgtcttgactattcttgtccctttgtcccttcacatgaatttagaattaatttttcttatttgaccaaaaaaaattctgttgacttcttgattgatttgattacattttatttaaagattaatttttgaggaactatttgtgatgttgaatcttccattccataacatttattcacattgtctttacatttcccctggtaatgttttgccattatcttcataaaactccgacacagcttttgctagattattttttaaaacttagagatttcattgttattgaatgagatttttttttcctattacttttctaatgactattattgaaatttaaggaggctattgattttggtatgtggatcttatattcatcaatctgactattttcttattctaataattggcatattctcttggatttcctatatagataattatttcatttgaaaataaaaatgatctcttgctatgtaagtattgtatctcttctttcttttttagtcttattgcattggccaggaccttcattacagtgttgagtagtcatggtgttatttggtatcattgacttgttcatgaccatacattctttttattcagaagagtttattttgtaatatgtaacagaaccatgtatgacttaatagaatgtaaatatagtacagtactttttattttatttattcttctaatcacagattatagcaatttaggaagtacaaattttaaaagcttaaaaatcacccagagatgatcactgtttgcattttgatatgtggcagaatcacaaattaggttttaaagtcagtctaaaaatggcagaattactctttaaaatccattaaatcactcacaagttaaaatatacatatatggatttgtgtcatcttccctatacatatacagtaatatatattgtaagataaaatggagaagattacatatgaaaacacaattctctagcctttttactatacctctacagttggtgaaaaacagattatatattgatctcctacagcatgtcaagcatgcagttggattcagaacgttaaatctgtgtggattaactccagcatgtacgtgatttttatcttactagcttgagaagctatgcttgtgtgatgcaactctctcatataaaatgtactgtattttatatagctatattttataaatacctattattgtgtatttacttgatagcattattatttagccccataagtgacatttcacaaacagtgccctgtataatccaaaaacagcagttgaagaaatataataacaaaggagaggactgggattctcaaatccaaagaaaatatattattccaggtcctttcaggaagtagacattcaatgtcagctaaacagagtagaataacagattcatacatgtcaggtacatgtggaaatttagcaaaagatttatgaacatgaacccaagcagaggaaactattaaaaataacagacatgtgatatgtaaaattcaccagataaaatccctggttgtgttagccacactttcaaaattctattgttcataagtcttagaaattccttccctccccttcttcccatagtgaacagagtttgaattatatttcaattctttacatactacagagtttgaaatagaattctaaagagtgaaggaacaatcatggactttctgaaaggctttttcattatggctatggtatttaagcagacttactcagattttgttccacaaaacatctattggactaatggcctttcccactgtagttcatctctctacgtcttcaacagcttgttagcagacgtaacaagctgttacgtctatataaggatatatagaagtgagagtttattagtggtattttctacaaattttcattatcataggtattctattgtttggcagttttaaagctaccattataataagaagagagaatttcatctcatagcatgtgaagcttaaatcttcaattgggtcacttggggtcacctaaggccaacagtaacctgaaaaggaaaaaagttttcagttttttttactagaagggctaattgtgttacatctgttctttctttcagcccaagttttagttaattgtctaagtgttctgttctctgcttagcaaaggatttaatagctgattttatatacattcctggtttaatcttactttaatacactttcattgataggataaatgcaccttcttaaggtgggcaattctgttaactcagcatggtcaaacttttctcaagatgataagattgaatcttacatttggttagttctttttttttctttttatgagatggagtccctctgtcccccaggctggagtgcaatggcgtaatcttggctgaccacaacctccacctcccaggttcaagcgattctcctgcctcagcctcccgagtagttgggattacaggcacccaccaccacacccagctaatttttgtatttttagtagagatggggtttcaccatgttggtcaagctagtgttgaactcctgacctcaagcagtccacctacctcggtctcccaaagtgctgggaatacaggcgtgagccaccacgcccagccgattaattcttgtatctcatagttattaaagtacatggatttcttaccttttatgagctaatgaatattttgtagtaaccctggaggaggagtttgcagtgagccaagatcacaccactgcactccagcctgggcaacagagtgagactccatctctaaataaataaataaataaataaataaacaaacaaactaatagattcttttgaatataggtaaattaaaacatgacaaaatattttctactcacctatttgacagaaacttttcagcagtcacagtgttatattccattaggtttccctttcagttggcctccctctacaaaagatgctcgcttccttttttcattcaggtaacatgtgctgtctcccccactgagtcacatatcctagacactgactggggataaatggattgcatttgcccagagataaagtgaactttattgtgaatatcaattaattgcctttgactatttcttgttgtcagtagcatatgttgcaaaacacttcaataatatttagtatttctaagtgaaagttttatatcagcttagctaagcattctgcacttaccgatagtaggcagcatgggtttcagagcatcatttttttaatgtttaatttttagaggattcctaatggacttatttgtgtttcttcttaatttgtttttcttctccatgtagaactggctttcctaaggtttatacagtaagacagacgtatccccacattgaagctctttccatttgagtctaggctgataatgaaattggggaattaaggaagagagttaaagacagtctggaagaggagaactcactgaatatagaaatgactaaaatggacatgagctctaaggacagccaaggagaaaaatcagactttaagttaaatgatccataagctacctctcttaatgagaagtaagacagttgcttacagcacattaaccacctagaataacccagacctcatcaagtggtagtgtattgagtaacaccaccaattttatagcctttgaagataaattaaaaccagcctcaaaaaaattgcatactagatatacaaatattggcatattcagagaagcaacatttaatatgtacattttacacattatgtcacttaaacatttaccatgggttttttaaataggttgaaatgttctgcagttaacttttgtattaaccactttgttgagatataattcacacaccatacaattcacccatttattctatacaatttagtggcttttaaaagtgtattcaggctgggcgcaatggctcacgcccgtaatcccagcactttgggaggccgaggcaggcagatcacttgaagtcaggagttcgagaccagcctggccaacatggtgaaaccccatctctactaaaaatgcaaaaattagctgggcgtggtggcgcgtgcctgtaatcccagctactcaggaggctgaggcaggagaatcacttctacctgggaggcagagattgcggtgaaccgagatcacactactgtactccagcctgggcaacagagctggacttcaattaaaaaaaaatgtattcatattgttgtgcatccatcatcacaagcaattttaggacattttattaccctaaaaagaagccccattcaccttagctgttactctccaattcccctacgacttcgtccactgccaccagacctaggaaaccactaatcttctttctgtctctatagctttctgtctctgtagctttctgtctctataattggacctgttctgaacatcttgtatatgcagttatacaatatgtgttactttatgactggtttatttgacttggtataatgttttcaagatttttctatgtcgtagtgtgtagcagtattcctttctttctgttgtcaacagaccattatatggttatactacatttcattattcatccttcagttgatggacatatgggttttttgcactttttggctattatgaatactgctgtgaacattcatatgcaagtttttatgtagacatgttttcatttctcttgagatatacctaggagtagaatattctttagaggtggaactctggtttttgttgtttgtttgtttttgagatggaatctcgctctgtcgcccaggctggagtgcagtggtgtgatctcagttcactgcaagctctgcctcccgggttcacaccattctcctgcctcagcctcccaagtagctgggactacaggcgcccaccaccacgcccagctaattgttttgtatttttagtagagacggggtttcaccatgttagccagatggtctcaatctcctgacctcgtgatccacccgcctcggcctcccaaagtgctgggatcacaggcgtgagccagtgccccggccagaactctgtttttaactgaggaaccaccagactgtatttcaaagcaggtttgccattttatattcccgtctacattatacaagtattctcgtttttctatatcctcaccaacctctgttacctgtcttttttattttagccatcctggtgggtgtgaagtgttatttaattgtggttttgatttgcagttgtctaatggctaatgatgttgagctttcttcacgtacttgttggccatttgtatctcttccttggaaaactattcagattctttgcttttttaataattgggttatttgtctttttgctattgagttgtaaaatttctttaatacattctagatacaagtcccctattaaatatgagatttcaaaaattttctccctttctgtgggttgtcatcttactttcttgatagtatttgaagcacaaacttgatgatgtcaagtttatttttgttatttttatttgtgcttttatcatgagagtttcatgtatttttaatagcttaattggggtttaattggcagagtaaattacttatctttaaaggttgtaagtcgatatgttttggtatacaaatgcatctataaaatatcaccacaatcaagataatgaacatatccatcactcacaaaagtttcctcttaaccctgtgtaatcagcactttccccatcccacaggaaaccactgatctgctttctgtcgctgtagattagattgcattttctaatattttatattaatggaatcacacaatatctgttcctttatgtctgggttttcttacgctgcataataatattgagatttatccatggttttacatgtatctttagctctttgcttattattcctgaggaatattccattgtatggatgcatcacaatttgcttatatccatttacacgttgatgagcaattagatctatatcaggtctgactgctacaaatagtcagctgtgaacattcatgtacaagttattgtctgaacatgtgctttcctttgtaaataccaaggaatggggtagctatgtcttttgaaacatgcatgtttaactttttaagaaaatggcagacatgccagtttctccacattttctccaaaatcggtatggttggtctttttaattttatctgttctgtttgtagtagatgttcttgtagttttaattttagtttatttaataaattaggatatttgttttcttattattgaatattgaaagatttttatatattctgggtacaagtcctttgttattggatatgtcatttgcaaatattttcttgcagatctctagcttatcttttcattttctgaacaatgtctttcaaaggggagaagtatctagttttgggaaagtaccatatttcaattttttttatagatatggttttagtgtcgtaactaagaaatcattacctaacacaatgttttgccctagaaattgaagaggtctggattttacaatttaggtctgtgatccattatatccgagttccttttttgtaaattgttccaacaccatttattgaaaatattttctttttccactcaattgcctttgatccatgatgaaaatcagttgacaatatatgtttgggtatatttcttcattctcttttctgttcccatgatctattgtccatctttgtggcagtaccacacttgattactattgtttaaaatgagtagtcaattcagatagtatatgccctccttcttttccagagttattttggctgttctagtttctttgtatttcctataaattttagggtcagtttgtcagtttctgcaaaagaaatacaaataaaaagtctgctgagaattttattgggattacaatgaaactataggtcaatttggggataaatgacatcttaacaatattgcatcctctgactatgaatgtagtgcatatatagcttttttattttagatgtttaattttttaacagtgtttctagttttcaatgtacaggtcttatgcatcttttgtcagatttatacctaagtagtttatatttttgatgctattatgcctggtactttttttttttcaagtttttttttttttttttaatagagacagggtctttctatgttgcccaggctggtctcagactcctgggctcaagcaatcctcctgtcatggcctccccaaagtgctaggattacatgtaggtgtgacccactgcacccagccagtatttttaatttcagtttccattgttcttgactattgtatttatatctgccacctagccaaacttactggttctagtaattttttcctagatctcatatgatttttctaagtacatggccatataacttgcaaataaagacagttttacctctttctttccaatccggatgtcctttgtttttctttccttttacaatggctagaacctgtatattcattgctgagtggaagtggtgaaagcacgcattcttgccttgtaagaacagggaccttaggaggacagcattcagtcttccaccattagtatgatgttcactgtaggtcttctgtagatgccctttacagtgttgagaatttttcttctattcctagtttgctgagagtttagatcagaaatgggttttggattttgtcagatcctttttctgccttttattagatgattgtattattttcctttttttcgtttgttaaactaatgaattacactgatttatttttgaatattaaaggaactttgcattcctgcaataaattcaacttggtcatgattttagtaattataatattcctacagtgttcactttgcaagatgctgtgttcactgaaacatgctcttatcagaaatatgtcctctctgtgtgattggctggtaatcacagagcagagacatggttcaaaaaatgcacacgtttcaatgaacactgaactgtgcaaatcaagatctgactgtattattgaatttgattggctagaattttgttttaaaacaccgcatctatcctcatgaagaatattggtctgtagttttcttatgatgtctttcatttgggtgtttaacactggtttcacaggatgagttgggaagtatgtctttctcatctattttctaaagagtttgtgtagtacgtgtattatttcttctctcaatatttggtagaattcatcagtgaagccatttcggtctggagttttcttttttggagactgttacactgcaatttcaatttatctcttcttgagtaagctttggtgttttgtgacttccagggaattcgtccatttcatctaacttatcaattgtattggcacaaagttttttataacattcccttatcatccttttaaaatccctaaaatttgtagtgatgttaactctgtcatttctgatattggtactttttaccttttctcctttttatttttttaatggccattctgagtgaaggcttatcaattttattgttttttgcaagaaaccagcttttgttatcattgatttttctctatttttttcctgttttctatgtcactgattttctctactattatttacttttttctccttaatttacattttatttgctcttctatttttggcttttaagaaggtaactgaggtcatttgtttgagacttttcttcttttctactataggtgtttaatgatataaatagtcctttaaatactactatagtgacatacaacaaatcttgatggcttcatttttatgcagctcaaagtactttcgaatttttctttgtactcatggtttatttagtagtgttttattttcagttttaaaaaaatttggaaatttttgaaataactgttattgctttcccatttaattccattatgatcagagaaaatattttgtatgacttaaattattttatatttattgagacttgtttcagaatccagaatatgctctatcttgataaatatttcatgttacgtcaaaagattatatattctggtgttgctgggttgtggtcaataaacgtcagtcaggtgaaattggttattattgtttgagtcttctttatcttcgttgattttatgtcttttagtttatcaattattaaaagagacatattggaatccgtgactatagttgtgaacttgtctgtttcttccacagttctttcaatttttgtttcatgttatttgaagttatgtcatcaggcctataaacatttaggattcttatgttctctagaactgactcttttatatgaaatgactctctttgttctggtgatattctttgttctgaagtctaccttctctcttattaatattgtcactccagctttctttttatttgccttaacttgctatatctgtttttaacctatgtaaatagttttgttgagatataatcacttgccatacaattcacccacttaaagtatacagttcaatggtttttagaatatgcatagagttatataaccatcaccttcaagtttagaacattttcattaaccccgaatgaagctcttaccccttaagcagtcattccccctttcctccaattccctcagccccagctaattactagtctactttccatcgctatagattttcctattctgaacattccatataagtggaatatatgttgtcctttgtgactggcttctttcacttagcatgtttttaaggttcagccatgtctttgtataatagattccttttttggccaaatagaattttgttatatagatataccacattttgtttatccattcatcaattgatagatatttggatagtttctaccttttgatccctttaaatactacgactatgaacatttttccatataagtttctgtgtagccatgttttcattttccttggaatatatctaggaataaaatcctgtgtcaaattttaactctatgtttaatcttttgagtaactgctagactgtttttcaaagctgctgtaccattttacatgtctcccaacagtgtatgagcttccaattactccacattttcttgaacactagttattatctatctttttctaaaaattatagctgtctggctgggtgcagtggctcacgcctgtaattccagttctttgggaggcccaggtgggcagatcacttgaagtcaggagttcaagaccagccgggccaacatggtgaaactccatctctactaaaagtacaaaaattagccgggcatgattgcaggcgcctgtaattccagctactccagaggctgaggtaggagaatgacatgaacccgggaggcagaggttgcagtgagccgagattgtgccactgtactccaggctgggcaacagagcgagactccatcacaaaaaaacaaaaacaaacaaacaaaaaaattttacctgttgtactggatgtgaagtgttgtctcattgtggttttgatttggagttctctgatggctaattttgttgaacatcttttcatgtgcatattggctgttcgtatatattttcgtatatattttccttgaaaaaatgtctgttcagctacttagttcattttttaaattaggttgtcttttgttattaaattgtgagagtttcttgtatattccatatgcaagtctttttcagatataatttgcaaacatgttctcccattttgtgggttgtctttttgccttccttggggtgatctatcttttatcactgcttttacatcttacctatttgtatctttatattggaggcaatatatagttgagtcttcattttttaatccaatctcacaacgtatggcttgtagtttgtgtgtttagaccctttatatttcatgtcagtattgatattgtcaaaatctactttctggtttttgtcctctttctaaaggttttcatttaaattaagtgagtatttttatgattctattttgtctttttgttgatttattcattagaaatcttattttagtgaatactgtagtgtttatacatctttaacttatcctagtctatcttcaaacagtattatagcacttcacgtatagtttcagaacctttatgatagtatatttatatttctcctcttctggttttagtgctatttttatcacacattttacatctactaccttattaacaccatactatgttggtttttgtttgtttagacagttgattctccttaaataaatttaaataataagaaaaagacttttctgtttgcctacatgtttgccattttcagtgttccttgttttgtgtagatctagagtgtcatctggtgtcattttccatctgcctgatagacttcctttaacatttcttatactgctataaagaaaaatatagacataaatgactacataaatattaaaaaccttttagtgaagggtaccgtaaacaaaatttaaaaaaaaaaaataaaaggctgggaagtatttacaacatatcaggtaataataacagcagtacataataataataataataataatagcagttattaaatgtgtactgtgctataccaggcactatactgaacactttacaatgtattttctcattcaatccttagaacagctgtttgaaggtaatgtactattatgacttccatcttacaaacaaggatatgagactaacagataagtggctaaagtctctaacaataaaagatctaaaaatcaatgagaacataattttaattggcagttcttcagaaaaatgtgaatggcttataaacataaatgtaatactcagctgctgtcatcatcagaagaatgaagttgtttttaagctcttcaactgtcaagagtaagaagcaatgttactaataccggcaagatatgaaaagacgctcatacattgttggaaataaaagttggtatagcttttcagagaccatttaggtttaactgttgtcatttaaaatatccatatcctttgaccagatgactgtcatctggaatttctcgtacaagttcccaaagaaaaattttctctctatctctgtgtgtgtgtgtgtgtgtgtgtgtgtgtgtgtgtgtgtgtgtgtgtaatagagaacagttggcaataacctgaccatcaatagcatagtgttaaaatgaatgatggcttggccatataatggaataaccattggaaaaacatgagactgtgtagaaacaggcaatttgataggctactaatgggagacttaaattggtacaccttctcatgggggatgttttcaatatagggatcaaaagtcttcagtcagactatatcccattcccttttgtgtgtgctatataatgtagtggaaagaaaaatattatagaaaaatatatgtatcagaacccaattaggttttttttaaggttatatgtatttacatatttatatgtgcctagaagaaagcttagaaagatgcataccaaattattaacattgattattcctggaaaggaaggattttgactttttaaatctctctattgaatgttatgattgcttttgtaatcatttttaataaaaaaatgtttaagatatattagttataattgccaagaacacatagagaaactgactaaaaagaagcaagactgtttgtcgccaatagtttctaaaccaaatgggtaaaggttcttcctcctttggcttaaatcaaattttatttttaaaggcaagatgctgggttctacttgtagagctctgtagaattttaaagaactgaactgttacgaacctcatgtttcacaatacaggaccaaagtagctagggagctctaagacatttgtaatctttaccaactgatatcaaaaattaagaatgacattttattcatttatttatgtatgtatgtatttatttattcattcattcattcattcaggtaaagtagtgagtagagtaccttaacatccaagaaagtaaaatagccacctctgcagcagctcattaaggactggtaacacatagaggtcagtgttccacagctttaaaaaaaagtattgatacagttgaagacccctccactagagataagatgaagcactgtatccatattaccaatgacagtcacccaagaaatgcaaacagctacatcaccctccctcctggggtagatccatcatacttgtcatgaagatcaactgcattgtcactggagacttggatccagccatcctcctgcacatggtagaggttagcagcacctcctgagtaggcatctatgcaggtggcttggtagatggcttggtagcttacctcatgggccagatcataggcctgctccatttccaggttataggaatagccctgattcataaccccataagcatacacagagcaagaacctacagagaaggtggcccctgagatctgattcccttcagtgtccatgtagcagaggccagggcctctcctatcccagccacagatcatgttgcctatggacagccccatgcctttgtactgatacaatatgttgtcaggcagcttggaggcagctgttacagggatgcattccttatttcaaagctcatacatttgactttgccgagccaacagccattctcagaagctacagttccctgtgcccctagccatgatggcttcgggtaggggttgatctctgtcaccttctttaccatctggaggcaatgtaagcacccactgcagccctatagtctgctgcaactatgactccatgccagaacttgaagaccagggtggtgattccaggaagcattttgattccctgctcctctgagactccccagctgggcatggccagcctcagcccatcagtgggactccctggacccagatccagcagatctgcataaactgtgagtccagaaaacctgcactggttcatagcagcctctccaaatagctgaccagttccatgtctagtgtgggcaaaagaaggaataacattttaaattgcatgactgcaaaagggtttttgttgtaggttgttgtatatttgaaattgtgaccagacttataataatgaaatatgtgcagtagttttgcaaaggaaaataaggatgcatgctcactcaaatgttgaccatatgatgcatagattatagaatactgtagaaagtccgcttttatcacatgttctcatgttttaatacaatcttctaataacagagtgtgctacatctctgtgaaatatctagaaaaactctttagctaaaagggtaggatgggtaagttaccaggaaaaatttttataaattagaattttaaaattcattgttagacaggagacaaagaagaaatcatttattctttctagtggacaaatactgttctataataggtcatgaacaaagtcacctgagagttttccaagtaaatgttatggtctgaaagatttttttcatttgttaaagaattgttctggtaaactatttgttttggaatttttcatctggaaaaatagtttgaatccaatcatatatttaccagacatcatgcaaattgaatatttggtacattggtttctattctgtgttaaacgcttagaaattttgctttcttataatcaaactcacccagagccacagtaatatttttatatgaacaaaagaaatctctatgtactgatttatttaaagtaattattagagggcagacatggtgtctcacacctattatcccagcactttgggaagccaaggcaggaagatcacttgagctcaggagtttgagactagcctaggccacatggcaaaaccctgtctctacaagaaatacaaaaattaactgggcatgatggcacacacctgtagtccagctactccggaggctaagatggcagggtcacttgagcccaggaggcagagaggttgcagtgaggcgagattgcaccactgcactccagctgggtgacagagtgagactgtctcaagaaaaaatgaaaagtaattattattagagaaaaattaaacaataataaaatttaggccgtatcatctattattttctatatgcatagagaaaagtgaaagaatatacatattttgggaaaatgcctaggagctattacataaaataacactttacaaagttacttctgtatctaaagaaaatatttttacatggcattgtattgcattctatagtaaaaatgaagataatataaacactttcattgagtactaactggatgccaggagttgttctaagtaactttccttgcagtgtttgatttcatgttaacaacctatgctctaagtactcttattatacagcttacaaatgaggatctgagtcttagaggttaaataactcactcaaggccacagagctgctaaataacagagccaggatttgaatctaggtaatctagctccagaatctaagctcataaatactttgcctctagagtaggattcaagagggaagacttcatggctatgcaacgtatgatgcttctgttatctgagagatgcttggcaatatctgccctaccacctatgagagcagctgaaattctgttgtaatagattcattgctttgagtttatgagacattctagttaaaatgtagatattcagtgaaaagtaatacacatctaaacagataatgacagtgtgcaggaactgagggtcaataactatagagtagtaaatgaggaagaagggatggacttggaaactccatagaaaaggaaagaagccagcaaccaactagcctacaaaatcagaggatttttgccaaaggttgaaaagggatagccaacaattttttaatgacagtactataaacaaaaaatgtggagattttttcgtgtaatttcactgtgtaccgtttaccgtctccttttaatctaggaaatactacagagccgatgccacagtgttgatgtttatattaacgaaatgcctttcctttggcgcacagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatgtgagttcagagctgggctgtgtgtttgaagtttaattgcctttcaccttgtcacactttagcttcattccatttgaccagaaaatgtggacaacacaacaaaaagcaaatgagttaattaaggaaagccccttttaatgttaaatgacagatgaaacaaatctattgacaacattggctgatcagtacagtcaaatattaaaactctcttacttcattttgggcatatttggattaaaccactaaagcatcatgctctaagactggcagacctgaatgttcaacagtagacaaaattacagccaacaggccgggcgcggtggctcacacctgtaatcccagcactttgggaggccgaggcaggcggatcatgaggtcaggagatcaataccatcctggctaacacagagaaaccccgtctctactaaaaatacaaaaattagccgggcgtggtggcgtgtgcctgtagtcccagctgctggggaggctgaggcaggagaatggcgtgaacccgggaggcagagtttgcagtgagccgagattgcgccactgcactccagcctgggcgacagagcaagactccgtctcaaaaaaaaaaaaaaaaaaatttacagccaacaaataacagacccttgaatctgcacaagatcacaaaagaatgagtttagtgctcagttttatctttgtgacgcagagtagcgtctatttccacagattcttgtgactctgactgattgccaggtgaccttatgaaaggctttaaggttccagttttcccctttctaaggtgaaatgccagtttaccgctctgaaaaataataaattctgaaaaaagcaatgttaaattccagaattaatgtatcacagtatatccttgtaagataatttatttttaaaagttaagtgcccaataggacatttatgtccccatttaccccatttttgattttattttgttttttataagagacttattctcaattatatgaattattcaggtccttgttttcccgtttctcctgcaatcaaatcttgtgttatttcacttttcattagcagattccaaccataaaagtaattgacagaaatatcacaaggggacaaagcaagagaattgactacaaatccatttttaatttctgtacatcaaaaatatgaatgaaatttaaaattgttttaaaactgggaaataaattttctatgaaagtcaaatagttaatattcataatataaaagggcttatacaaactgatatcatcaaaaatactctgcaaaactagaacatagtttactacaaaaagccaagttgctgacatatttaaaaatatgataaatgaccaacttcatgaaaagaatcaaaggaatatcaatttaaataagcatacatttatttccttcgacaaaattagcaaagctccctcctttttgaaagcaaatgataaaatgctgtggtggcaagggcagatgaaaaggtactccccctgatggttggaaagggtctggcaggtccacatcatgggcctttgaaacttcatgcaaatttgactggaaagaaacatagcaaaatgctaatcattatctccagagactaaaattacagatgttttttattttatttatattttactattgaaacttgggtgtatatactacctatttttaatagcgattttattttaaacatgaggatgaataaataaggctacatttactttataaacaatatgccatgcattttaatggtcattttttttttagttggtctaatagtttgttcttaccatttttgtttgtttttttccagggaatcttggacattgtagtgctaagtaaaggatatacaaagaatgattttgccattcatacactaaaaaataactttgaagcagatgcttattttgttaaagttattggtgagtaaagtactaacatttaattttgttctctttctcttcccctctctccacatattccaaagagcaaggacatgctccgatgtacaaccctctagatcagatcaaccagtacagcaccatcctgtctatatacatagaccccattcagatttcaccagctgtcccaacaatattgttttttctttctggcccaggattctgtccagaaatatctattgcatttaattgtcccatcttttcagacttcttcaatctggaccagttcctcagtcttttcttatttttcatgtccttttcagttttaaagaatccaggctttgcattctgtgagatagcactgtttcctcattacccaacttaggtcatgaattatttgcagaaattccactgcaaggagttgcagaattgatgctgtgcatttctcagtgcatcatatcaggaagcacatgatgttcacctgtcctaccaccatgatgttaaccttgttcacctggtcaccttgatgatcaccaagtttctctaccctaaactcactgttttcccctttgtaattcattagtgttttggggggcaatattctgatattacattaataggcttttctttatgaaacttttgcctagcacccttagagtacattgacaactccctgaatcaaccttctacatttgtcaaataatgattctctatttccatcaattgacattctactgttcatcttgtaccccccttgtcccaagcctggaatcagacatttctccaaggaatcagacatttctctcttttagtagagaacagtatttcaaaaccacatcctgaaatggttgcccagtgtgctcgttgctactgggttgtcatttcttccaggttctctcaatggacacagctaggagaaaacaggtatggattcacatatgtacatacaagtctacacatttgtaactatttttacatctatttacatttgtatgagctaactataaaaccatgaattcgttgcaataatttcatttttcatccaaatggagcacttcagggttccttctaatttcgtctgtttttgtagatatctcttccagcagtgagaaacgtgacttctgttttcctcattgtgttacttattttttcattgtaaccagttcccacccatgctagtagtatcctccacctgacccccatgtttgtcataaagaccctgtacatgttttgttaagtgcatgcctaagtattttattttctttaagatggctgtagaggatattgtgtttttaagttttgcttccacatattttagtgtatggaaatgaaatttatttttgtgtattgatcttgtatacagtgaccttgcttgactcactaactggttctaggagggttttttgaagattccttgggattttctacatagacaacttcgtcttctgcaaagagagataattttctttctaatccctatgtcttttatttttcttgtgctggctagaattttcatttactatattgaataagtggtgagagtggacacacttgtcttgtttccagtgttaaggggaaaacattttggctttcgccattaagtgttatattagctatagagttttttggtagatgctttgtatcatattaaagaggttctccctattcctactttgctgagagttctatcctgaactggtgttagaggtgactgtttttgcattactattgtgatagccaacaccaagagacccatgttgatttgtgtgaccaaaaaaggcacatgtactttgtagaaatatttattacagttttgaaacaagcataaatagctgaacccagaaaagcaacagaacgtattagtgttgagatttattttgagagatgaaactgatataacatgcatccttcctttctaaacagcaaattcagtcttatttgagctaagagtttcacctatcttcattattactgcagccacaaaatactgatacatgagtctaatcatttctatacttttaattatccatgtcctctcttttgccattttcaagaaagtattatttggctattttaaagctaaaaaaatttaaatatactgtttatttggtatgatgttaattttggagttgaagtacattccttatctctgtccttcttcaactggacacctctagataagaaggcaagaaattcttaaaacttttgctaacctaattgtgtatgtaattagaataaccaagttcagttaattgaaacaatgagtattggagtaagagtttgggatttgattccttagggataaactactaaatccaggacagtcatttaactgctgcagatttgagttcccaggggaaccaaacagaagtcacacaatttctaggatgaaaacatctcaaaaaaaaatcagtcctcccagcacttcgggaggctgaggcagggagagcacttgaagtcaggagttgaagaccagaccagccaacatggtgaaatccctgtctctataaaaaatacgaaatttagttgggcgtggtgacgcgtgactgtagtcctagctactcaggaggctgaggctggagcctgggaggcagaggttgcagtaagtcaaggtgacatcactgcactccagcctgggctatagagcaaggctctgtctcaaaaaaaaaaataaaaaaataaaataaaatcagttattttacctttgctcacgagcatcatccttcttggtgaaaagcagcgtatttttagtcttcatttattttaatatcacatttaatctctccttcatccatccatttcagaatgcttggcaagcactctgaaatctaggcttatttatttgtgtcattcacattaacatctctcttactcctagtatgctttaatgatctaagcaacttaagagcagcctctgtcttatttgtctttgattgctgggtgcctaacacagggcctggtacataggagacattcaataaatttatgtcaaataaatgtccagctatcttttgaggcatggattggctatcttgattaacagtgttcccttcttctctagtacttaagcaacacttgatgcctctgactcatctgtgtctctaagaagcattctaccaaaataggtgaaactccaattcaaagtcagatttccaccttgacctgtttgctgatattagggacacaactaagtcagtcattcatttcttgaaaagattgaaatgcctttcctggtttaacttctcaagtctacccatcttttgcagattctgtgtgactagaaactctaatttacgtaatttctcaggcttacaccaaaaatgcacagaaagagtaacacatgatgagtgacagtgagtttttcctctcattattttaatgggctcctgtaaaactaactgttttgctccaacctagcataagtgtgatttgcttcaaaaatatacattaaatttaaattaataattctctttcaaaatattgttttctttctgtttaatgagataactgtgggatttttccttctttcatttgaattttgccagtgtacttcaataaacttttttgagacagagtctcggtctattgcccagactggagtgcagtggcgcgatcttggctgactgcaccctccgcctcccaggttgaagcaattctcatgcctcagcttccaaagtagctgggattacagacatgtgctgccatgcctcgctaatcttttgtatttttagtagagacgagtttttgccatgttggccaggctggagccagtgtactttaaaggaactattttctcaagtctgaagcttaaaaaaaagacagatttattacttagttcatctgaatgtggtatgtgcctgtgcatacctgaacagattaaagatcaattctttctaggacagatgttacgcattaagtactaaggaaaatttcaagtgcaagagatattaatctgtatattgttaaaacaaatcaagttctccctgtgctcagcaagttcttttattcaagccttgaaactacttttatactaaaagttctgttttatactcttaaaatagaatgtgattgaactgtctatacttgtgagttttgctgactagcatgagggcctgcgactccactgctttccatgctcaagtctgcaagttcttccctcgcacagaggtccccagccaggtagaacggatgggaatcagagcatagggtttttgtaacattgataagatattccaattcccagttgtaataataataataataataataatatgctaaagagagtaggcagttctcagggtgaggcaaaagaaggtctgactttttttatattgatcatttagaaattatccacgtgggaaaatgtatgcatataatttagggtcccaagttcttccttggcatttattcatttacattttttttaattacaaaaacaagatattagagatggggaaaatctcaaaaggcatcttgcccaagtctaacctaatgcaacatcttagcttctgcttgaatgctttgtactaaaggagacctcacctcctcataatgcaacacagacttcttttatgatcagtttagttgttagaaaactcaagtcaaaatgtgcatatttagttagttctgtccattgatactcatgtctggtgtatagtaggccctttataggtatctgttgaattttttaaaaattgttccaataaaattactctagtttttattgttaaagcacaccctaacgcaggggtcccaaaccccaggctgcagaccagtactagtctgagacctattaggaaccaggccgcacgacaggaggtgaacggccggagggcgagcaaagcttcccctgtatttatagccacaccccatcactggcattaccgcctgagctctgtctcctgtcagagcagcagtagcattagattctcataggagcacgacgcctattgtgaactgcacatgtgagggatctaggttgtgtgctccttatgagaatctaactaatgcctgatgatctgaggtggaacaatcctgaaaccatcacccatctaacccccatctgtgaaaaaattgcccttcttctgcaaaacccatctgtggtgccagaaaggttggggaccactgccctaacttataatcataataacagaatactcagaacacatcatggtcctgctcaggaaaatgtagcctttacatcattaaatagtgagacagcaaactacctgacagtgaaatgacatgtctgagcccttctttaaagtaatccagggatgtggaagctaggtatacatgaaacaaggttggccatgtgttgttgacagtttttcaaattgtgagaaatgtgtgtgaggttcattctgctattttcagttttatatatgtttatacttttgtttgaaatgttctgtagtaaaaagttaaaacagaaaactgaagagagtcttgagaatctctaatctggagtttaagaatccctggccttcaacttaccaccctaaatcaggacaagtcaccctgcagtctcagtaacattatcctgaggagaggattctccacacatctccaagctgagacccatagatagccaatttggtgcaggaggttttagttttagaaaacaggataactttgcattaaagatattaacataaatattaataatgtaatttacagaaaggtcacaggaaatgagatcccaatttaaagcaatcatttggaagaaaaataaccttctagttgttttgagatgcccttccactctttcctttgattatcggttgtttgccttaagtcagttactagcacgtaattacccttcacagccatcggcaatgtccacagctgattttgctcttaaattattctgttactctaatctcaaaccagcctatactaaatgccactgtttttcagttaaggaaattggggatacttaagcttttatatgtggccatggcaatgtaaactgcccttctgcttctcttacgcacagcacagcagatccacagcacttacatgaagacggggaccttgcgtattacagaattgtggggtcccctctcccctgaatcaagactagttactagctctcatcttttattgttattcctgtcagatacacttggaggttctgaatcttaattctagtctagaacttaactcatttctaacaaacctggatgaaccctgtttcccctaggacttttaaaattgtaacagtatcttcacctttgtttaccaaacaagatgagacctttcctttgggaaagctttcttttttcttttttctccaaaagcagatacttaatgggaaagcttttattccccttgcctgcctctgggttttgttgaaataatatggaagtttaatttctggatgattaattttgttttactttttgtgccttccattttataaatcctttcttaataattcacaaccatattatcagtaataaacaaattttaccagccttattgccaccttttttcttatacaccacattttcccctatttcttttggtgaagtattttctcaagttattttcagaaaaattgtacttaggttaatatattttctgagtactagtatgtcttaaaatatctttctcttgctcttactgttaacactaagttcgctattacagaattttataaacattgctctattttcttcttgcatatagcgtagtccccacttatccacagtttcactttctgtggttttagttacccatagtcaactgtattctgaaaagatgtgagtacagtacaagaaaatattttcagagtgaaaaactacattcacataacttttattacagtttattgttacaattgttctattttattattagtttattgttgttagtctcttactatgcctaatttgtaaattaaactttatcataggtatgtacatataggaaaaaacagcatatttaggattcagtgctctgcacagtttcaggcacccactggtgctcttggaacatgtccctttggataagtgggggctactgtaatatgctcatctttgaaattccctcctgttcctgtgcatgttctgtttagggtgggggccatttatatgattattcctgttagtcttccttctcttaagctgttgcttttcttcttgtgcatgaggagttttctctgcttacatttcttaaaagaatcagtgttggtgggtagtgcgggcggggtgggtcactatatacttctgcccatcagacaattgccactgcttcctttttcctttcccctttggggctcacaagctgggagcccaccaggggtagaagctatatttgagcaaagtggtggcttgagggctctcagacaggagagctgaagtgatgccttaaagttgaactccagctgccttctctgtgaaagtcactagcaagagacacaagagccctgacttactcctgtggcctcaaccgagggtgtcgacaggctctctgagtctgaacacatttgtgcattccagtgggaagtaatgagaggatgttacagggaggaactcactgctttgctgagcttttttgtgttgtttcatcctctatgctaaaaagtttgtgttttgggcaacactgtgcagttatatagggcactgactagaagcaccagcaaatcccccactttacttagctaccaagaactaccaagtaacaaatgcagcttttcctgtcacaagcctcgaacctgttttccagagaccctccattccccttctttcctcagccctggcatgtttcccctctcagctgccgcagctctgagctgaaaggtttcccaatgagctgctggggggtccacccccattgccccagtagctctctgacctgctcaacactaattagctctttctcaatcctactcacctattcagtatcctttaagaatttctcaagatatctgtcatttattatttttgaacattgcagtgacatttagggaattaaggaaggtaaataatatgttttgtttttgaaattgtctcctagaagttatttcaaacatactgacctggaaccaatatgttttctgttttttaattccttgtttaatattttttaatttaaggggtacaatatgatattttagtatatgtataccttgtgaaattattaaatcagacaaattaacatatccatcatgtcacatacttaccatttttttattcgatatgttcttaaagatcaaactgctcctgactttagcaaaaattttaacaaatttatatgtgtatgaaatatatgtatatatatttatataggtatatattatataactaccatatttgatacttaatatgtacacataaagaacaagattaaaattgcttcaaaaatatgtttctgtatttttttacaaagagcatatgattttacaatttaataaaataattaatgaaagataggtaatcaataacagaccaaaaaatcttccatagaatatctaaaataatgtcgtctaaatgacaagaatgtctggaagcaggtacttgattttacacatgtgctcaaagcttgagtaatttttaaagaggtgataatgtttttgtgttcatatgtcttaaagaaacaaagcttaaagacattttcagagaaggaatatgaatagtcactcagaatccaggcaggaattttttactttaaacacaactaaaaccattatacagtattgacctttacagctttggctatttaactcatccttctcccaacctgcacgttggcttagtgttacagtatttatgcacgattattgccatatttgggttttggttttgacatttgtgtgaaatagctaatataaactgaatcacaatgctagaagccaaatttttatactttaaatatctttaagaatacatggactgtaacatacagtatggtttaacatgaaatgataaaatcctaagcattatcatgttaaaagaaacttacaaattgcacatcccattgtccatgttttaaactacaaattaaatctcctaataaccagtatttcacatagctcatcaagtgttttaattactgctttttatttgtgaataggctgttttcatatttttttaatctttaaaaacaaatttggttttaaaagtccctaggagtattagaaattactttttggaacagctcatttaaaagggtattacacaatgttataataatcctgtgtagaatttttgtaatttctttttcttttttgagacacagtctcgctttgtcacccaggctagagtgcagtggcatgatcttggctcactacaacctctgcctcctgtgttcaagcaattctcctgcctcagcctcccaagtagctgggattacaggaatacacccccacactcagctaatttttgtatttttagtagagatgggggtttcactatgttggctaggctggtctcaaactcctgacttcaagtgatccgcccactttggcctcccaaagtggtgggattacaggcataagccactgtgcccagcccatagtatgattacaaataatatgtaattacaaaagcttatgaaattattaaaaattcttaaacttctagagttagccaaaattagctagtgaaaaaacattcagttacacttgaactaagcaacacagagagagttacacttgaactaagcaatacagagagacacttaaaaatcaaacaaaaacagttattgccttcaagaagctcacaggggcaaagaacacaaatagtagaaggctagaattgcatacaggtgtctgtcctgttaaatttcccttttccataatgggccctttatgtattttagcataccttcccatttattatacttacttaaaaaaataagtttcacttcacccataaacctatatttttatatcagtaatataactgtctcacttttaaaaaatgggcttttgctgtaatcatagtaaattcagccttggcacatttaatagtgtttgtttttaacctaactgaagcacaggtgatgaaatttttattctgatatcactggggaaattacatatttgcactcatttaatagactactttaaataatttttacttgttcataagcttgacattgtggagtttttaaattataatttcagggtgacattagtagaatcaccatcagtctatccttttacttttttgattatgccagagaactttaacacattatttcttttttttattggtaaggttttggtttagtatttatttagttttgttttctgattacaaaaataagagagcctattgtaaaacatttggaaagtcaggaaaagtattttagaaaagctgtgctctttgccacttagtagatataaccaccatgagcactgagcattctctgcctgcttctgctggtctctgaagtttcaggcacactgaaagaagctgcagcaatgaaagctgatacctctaaatcctgaaatccagaatgatagaatctatagtttgttttataaacaaaacagtaatagctaacatttattgtttatcatgtgccttctgctttacacaattgcttcctataatagtatcctatattaagttttagatgaaaatacgtgagtatgtatgtaatgttacatatgctgtaaggaaaaagagaatgcagaaaattagcttacatagtagcaagttccatttctggttctgctctgcatttctgacattgagaggatgcatcatccatgatccagcctcgttcattcagacccagactattcaaggctttgttctctagataattttgtcacatgtgagcaaacttacacaaagagccctttaaacccaggctacttccctctgagctagggtgagtattaagcacctgaaactactagataacaatatagatcccggtttggaatcaaagaattatgaaataatttataaggtttataaaaactccagtttagaggtttttataaaccttataaattatttcatccaactctcttactttaaatgtttttgtaaaaccataaaagagagagaggtgaagtgatttgcccatgatcacatctttcattagctaacacagcaagacgtggccctgcttgagattttctgtgccaaatgaataggaagcttgaaaggagtggcacttacagctttgagccagcattggtgtcagatatttgccttgaggtttacccttatcaacactcatgacctaaagacttagtttctgtagtagcagattattaataacagaagatgaactactaacatacatataaaacttacactctgttgtgttttccagccatatttaaatcagttctgcctttcatgaagaatttacatctaattgtaataaactgtgattgaaaccatattcctgatgagtctgtccctttaatatattgagcaataagaggggaaaaaatgagaataaaaattttctttatatggtctgtaaatttcaagaaacctaatgtttttcagacattttcaaatttcattaactcaagaggggaagaagatagtaagtatgagggtgggtgtcctctttttttcttataagaaaactaggccatgcgtggtggctcacacctggaatcccagcagtttgggaggtcaaggcaggcgaatcacttgaggccccaagttcgagaccagcctggtcaacatggtgaaaccccatcactactaaaaatacaggtgtggtggcaggcgcctgtaatcccagctacttgggaggctgaggcacgaaaatcacaggaggtagaggttgcagtgtgccaagatggtgccactgcatttcagcgtgggcaacagagtgagactgtctcaaaaaagaaaactaaagggtgggtcacagaggatttgagtggtaaaaccaaagctaaaagtaaaatttcatccttctgtagcactccttaacaaaagcagtatcattactgaatgtagctaaagacatattttcctaccttacatcaaacatacatagctagcagagcccagaacccacgcagtctgagtcagcctcacctgctgcatagccgtatagatgtcactgggaaaaggtcaagttctgtaggtaaaataatttctgagtggacacagataaacctttataatattatgtagagagttcagaattcctaattaaacaatattatgaaccagcatgataattaatcaagggttagtattgtttctccttgaatctgtggttgcaaaaaccaaggaaatgcatactctatttgtattatgtagacacccctttttataacacatatctatggcaaatatgtatcatattttttcatgtttaatacctagtttgactttattgtataaaatttcttagtggagaaaagatgtggcaaagttaaggttacatttaagtcttatcatgtgatcctaatgttataatgtgaaacttcaaatttgacaggaggtcttgtgaaaaaacaaaaacagatgcaagaaccaagtttttagcttattgtacacaaaatggaagaaactattacatgatttttgaattgtattatgtgattaatactaatgtgattatgtgatatattagtaaatactctagactatgctaaccaagacacagacattttatcttatacagaaaataacccaatagttcatcgatttctcatctcctatcatcgtaggataatgtgttccttaaatgagttagtttcttgttgcttgttgaaagcagtggccacatagtcttgcaaaagagttccattcaccttgtgaccgtgagtatggtccgaatcttcagttcttcagtttcctcttcatttaaaaaaaaaaaaaggaggaggcaggggacaattagaattacttcacagtcttgatatgaagattaaggaagactatttgtaaaagaaaattcatgtgttcacagcttggcacttaccagaagataaataaatggtctttttagatgtttgatagtcttttctggagaatagtttcattgtgtatatcaaaagctttcagattgaacccagaaattctgttctatacatttattccaaggaaattgtcagagatgtgccaaagatctgtgtataaatgtaccaggtccataaagctgatcttgccaatggtgtttttaggaggaaaaaaaattggggtatgaggaggggaagaacctaaacatcctaataaaaagaaggggtaaatacacacacacgtaaatggaataccatgcaattatgggttgaagtaataagtgtgggggaattacacaatagtatgtagtatgatttcatctacataatttttttttttttgagacagagttttgctcttgttgcccatgctggaatgcaatggcatgatctcagctcactgcaacctccacctcctgggttcaagagattcccctgtgtcagcctccctagtagctggtattacaggcacacaccaccatgcctggctaatttttttgtatttttagtagagacggggtttcaccatgttggcaaggctggtcttgaactcctgaccttaggtggtccacccgcctcagcctcccaaagtgctgggattacaggcatgagccaccgcacccggcctaaaaatgttttttaaaaggaagtatgtatgtgtattagtctgctcaggcttccataacaaaataccgcaggctgagtgtcttaacagaaatttatttctcacagttttagaagctaggaagttaaagatcaaagtgctgggaaggtagatgcactctgagcagcctcatctcctggtttctaggtggctgccatctcagtgtgctctcacatgttcttttcatgtgcatgtagagagaagcagcaagctcacttattaggagacactgatcctctccctgtgacctcatttaaccttaattgcttccttagaggccctgtctccaagaacagccacattgggggttagggcttcaacatatgactttgagggagggggtactcattcagtccataacatacagaggggtaaatacacacacacacacacacacacacacacacacacacacacacacacacacacacacacaaaagatggaataccatgcaattatgcataacataagagacaggacaaaaccaaactttgtttcgtctactctcacacagtcactacaacacagaatattttatctctggtcaccaaaatatgtagggattctgccttccccctccgtacaccaaccaatcaatcaattctgacactatctacctagagataatctgtcagatcccataggttgagggctcagcccctcaagattgccccacattgcagatgccaatcacaagtcccaggtcaggacctgtacttctgactaactggccatgaatcagggttcccatgaccccctcctcgggtttgatttgctagagcagctcacagaactcaaggaaacactttacttacgtttacctgcttattataaaaggtattacaaaggatacaggcaaacatccagatggaagagatgcataaggccctgtttttgaacatgatgtaaatgaaatcatacaggatgtgctcttggcacctggcttcttttgctcaacactatgtctgagattcatccaacacatttatttatttagagacagagtctccctttatcgcccaggctggagtccagtggtgcaatctcagctcactgcaacttccgcctcccaggttcaagcgatcctcctgccccagcctcccgagtagctaggattacaggcacctgccaccactcccggctgatttttgtatttttagtacaaacggagtttcaccatgttggccaggctggtctcgaattcctaatccacccaccttggcctcccatagtgctggattacaggagtgagccactatgcccagcccaacacatacttttaaatggaactttatgaaacatatttgcatgcatcttggtttttttaccttaacaaagtataagccccctttcaagtcagcacttacaggcctccctcattcttctgatacctccatatcattccataatgttatatatgttccacaatttatttcactttttatctctcagtggatatttatctggtttccagtatttcatagacatgagttgaagagactgtgtttttaatgttaatcaataataacaaattatcttccctgaaagttgtagggatttatattttcaccagcatatgacactatctagtttaccacatactcatctgagagttcttaatttttatttcactagtgaatttgtttttaaaataagtaatgcagatggtctattaaaaactacaagagtatatgataaaagtaggtctcccttttactcatctcccagtgatacaattctcttcccagagacaaccactttgtatctaagatattttatgcatatatgtatatatatgtataatctagaatatattcagtagttaaagaagcaatttaaacttctttaactactgaatagtatcatatagtatggttacaacataatttaatgagttccttattcacatatatcatgtggttttcaatctcttattatgaatagtgctgtaatgaatatcctgtaggataaattattaaaaatggaattgttaaagaatacatatatatttttaaataaacattttattgaaatataacatatagaaaagtatacataagtgcacagctctataaattttaacacagtaaacgtacccatgcaattacacgcagatccagaaacatgctaccaacatccaaaatgtgccctccagcccccttattagttactaacccagttcacctgaagtaattgctattgtaatttccaataccacagattaattctcccttgttttgaactttatattgtattttttaacagatgtcccttcacagaaattgtataattttctacttcgacctacagtatatatatgaaaatgctcttttcctaacaccttcaccaacccaaggggttattaaactttttgatctttgccagttaggtgaaaaatatgtcctgtttttatttcatattgttcttataatgaatgaagttcagcattttttcatatatttaagaggcatttgtatctttatttctatctatagtccttgtcctttcttattttctaattgatttataaaatgtactgtagtatgtattaaagagccctttgtgataatatatttattattttccttacagacaattttatcatgcttttctttttcacctatctcttgggaataaaattggttttttcctaactggtgcagttgagtgtctttctcagtgtttttttttttgattatttgcattttctcttccagatattgcttcttgaaatcctttgttttctgttggattattttctaactgatatctagaagttctttttatattagcaatagtatctctttatactgttatattacaaaaagttcaccccctttgtcactagtcttttaaaattttatggtatctttcttattttgtaacagctttattgagatgtaattcacataccgcatcatgacccatttgaagtatacaatttaatggctttagcatattctcagcgttgtgcaaccatcactgcaatcatttgagaatatagtcatcaccaccgaaagaaaccctgtacctattgtctgtcactcttttctttttctttttttttttttttgagacggagtcttgctctgtcacccaggctggagagcagtggcgcgatctcagctcactgcaagctccgcctcccaggttcacgccattctcctgcctcagcctctcaagtagctgggactacaggcacctgcctccacgcccagctaatttttgtatttttagtagagacggggtttcactgtgttagccaggatggtctcgatttcctgacctcgtgatccgcctgccttggcctcccaaagtgctgggattacaggcatgagccaccgcgcccggccttgtctgtcactcttagtcccccatcatcccccagctccaggcaaccactcatctactttatgtatccatcgatttgcctattctggacatttcatataaatggggtcatataatatatggttatgtgtgactggcttcttacacttagcataatgttttcaagattcatccatgttataatatgcgtcagtactttattccttttaattgccaaataatattctgttgcatgtatattccagattttgtttatccagtcatcatttgatggacatttggatggtttccaccttttggctattatgaataatactgctatgaacactgatgtacacatttctgtttggatatatgtttctttgtttttcttggaatatagctggaaatgaattactgggtcaaaggagaactttatgttcagccttttaaggaattgccagattgttttccaaagcagctgcaccattccacatttccatcagaaatgtatgagagttccaatttcttcacatcttcaacaatatttgttattcttggactgttttattataaccatcttagtgtgtataaaatgttaactcattgtgagtttttttttttttttaccatcttaaccatgatttaaattgtggtaaaaacgtgtcacataaaatttgccatcttaaccatttttaaggtatagttcagtggagttatgtatatttgcattgttgtgaaacacatctccagaactttttcttcttgcaaagctgaaactctatacccattaaacagctcccttttttccctttcccctactccccactaagcaccattctactttgtctctgtgaatttgactactttagataactcattaaatgaaattatacaataaatgactgcttatttatcctaacataatgccttcagggttcatccatattgtaatatgtgacaagatttccttcctttttaaggctgaataatactccattttatgtatttaccatattttattcattcatctgtcagtggacatttggcttgcttccgcctcttggctgttgtgactaacgctgccatgaacatgggcatgcatctcataatgattctgctgtatatttttctgatggttaatgatgttgcgcatcttttcatgagctcagtggccatctgtatatcttctttggagaaatacctattcagatccttttcctatttgtcatctgggttgtctttttattgttcaagtttaagagttcttttattattatgtctttgtcaaatatacattttacgtagggaggtaaactctaactttatttttttccaagtaaccaattatccagcaccacttattgaataatccatctttttttttttttttttttttttgagacaggatctccatctgtcaccaaggctggagtgcagtagcgtgatctcagatcactgcagcctctgcttcccggctcaagtgatccttctccctcagcctcctgagtagctgagaccacagacgtgtgtcaccacatctggctaattttttttttttttttttctggtagacagggtttctccatgttgtccaggctggtctcaaactcctgagctcaagtgatccacccacctcagcttcccaaagtgctgggattacaggcatgagccactgtgcctagcctgaataagccatcttttttcctcctttaacaagtatttattgagcaaatatgttgggtgagaccctgagaaaataaggacagaatgatgcagaggtaacatctgcgtgcaaagacatatgtgtgcatcagtaactgtgggtcagcaagataatggtttaaatgaaggcttatgcaaatcattttggaacagttggaaaagaagtaccaatatctacctaaactttagggaagaagataaaaggagagtgagaagttagggttttcataataaaagagtgagaaccaggcattctgctggggtaggaaatttaaacattgaaaactgcttgcaagtgtaaaatatttatttcactgtttcctcaagttgtatttaatgtaaatattctatagtaaatgaacaggtattctcttttgtgatgaaatatatcatgtttatttcttggtgccttttaccttacatactctgtatcttagtccatttaggctgctattaatataaaaaaaatatctggccagacccagtggctcacacctgtaatcccagcactttgggaggccgaggcaggcggatcacaaggtcaagagattgagaccatcctggccagcatggtgaaaccccgtctctactaaaaatacaaaaattagctgggtgtggtggcgtgcacctgtagtcccagctactagggaggctgaggcaggagaatcgcttgaacccaggaggtggaggttgcagtgagccaagatcgtgccactgcactccagcctggcgacagagcaagagactgtctcaaaaagaaaaaaaaaaaaaccttagggtaatttataaacaacagaaatttattgctcgcagttcttgaggctgggaagtccaagatcaaggcactggcaaattcagtgtctggtaaggtctcacctctacttcaaaaatggcaccttgttgccacgtcctcacatggcagaaggggtcaaaagaaattactggagcctcttttgtcaaggcattaatcccattcatgaggatggagccatcgtgacttactgtcttcacaaaggccccacctcttaacactgtcacgttggttattaggttccaagacatgaatttggggggatagcaacattcaaatcattacaccctgcctaagtcaaacatttatattagaatgattgtcattccatagtcatgtaatataaacaaacaaaagaaaccattttcttctggatatattttaatctacagacaaatattcataactaagaaaataatttgtgcccactgagaactatcagctctctttctttatcttataacatatagcattttaaaatgatagcatataatgtctgctttcttatcaaaggtatcacttcaccaaaagtggtagaaatatggttttatttcagaactcatattatttagataaagattgttcagatattttaacctctttttgctggttatacaataaatttatcattattttgtatatttgttgtagactcatcaattattttatagttatgctctctatattagctatcaagggtacccaaaatctttgacccagaattacatgaatgaaaaaagtctagtttgagatataaagtactgaatgtagatgtttttcttagtatacattttagttggttctcatttggcacccctctgtcagaatctaagtcatccttggaatttagctaactaattggaaaatagaaccaacaggttctattttaggtatggtatgatataatcataatttatctcacctatatagttcacaaaatagtagcatcttgacagtttaataaaggcttttgaaatattggtataaagtgaacaacagaactttaatttgctcagatctaaagaaattgaattggtttctgcttgtgattatgaatcaatagagtatattaatggatcttagggagaaaattagagctcactttaaatataaacttataatagtaataattgcctgtttatttttccacagttcttagtggtctgtgttctaatgactgtcctcgtaagataacagtaagtaaatttatatctgttataaatatgtctatgaaaattctatgtataagtagacacacacaaaatagttgttatagattatcaaatatcattattatctggcagtgattaaagaatccttcattactcaagaaaactgtgctgaaagtaaagtacctttcctaaaaaaatgtcttacctgaacggtcgtctttatgaagccttttctgatatccttagcagaatgaccacccctccaattattttaagacattttggcatttataatatttcattacacttgtttagattagatgcctctccacacgagactgtaaccccctgaagtcaagaaccatgtcatcttgtgtacctggtataggtcgcagagacaagcatatagtaggcaattagtgacttttttgtgtgtagtcttaatattgacttgctgtctaatagaatgtttcagtgaaataacaaatgtgaaaataattagtttttgacagaccaattcatgtaaactgtaataagaatattgtatttaaaagcatgcatgtgtttgtgtgtgtgtacagggaactgtttggggtctttgtagtaatccttgtttcataagaaattagcccctatttaaagacaaggaaactgagactcagagaagttaaattatccaaagtcatggagctgttaaatagtggaactgcaatacaaactaggtgttctcattattgtctcattttcttaacagtgtcattaaacattacattgacaatattttatgtatagttgggaaacttcccatatttaagaagtgtagaaacagaccctgacacagggatataatctagactcaaactgggggcaacacctctgaagtagtgaagaaagcagcagtggcagaaggagaagatgcatggggagctctggagctaggatgatccttcaaatgtggcccgaactgagccagaggggcgcggcttttgaactcttgcatcaatcacacatcacatccagacaggccgccaggaaagtgttaacgtttatatgaggcagctctctttggctaagaacaatctccaggtaggaaccctgctgtgagctgttagcagccaacacaggccagctcagggaataagtgtgtaggtcctgaagagaagatctggatgaggcgtcaccacagtcactgcagcatgcatgtgaatgtttggtccaacccatatacttttatatcactgtaaaactgtggatgggattcatcagcctaaagattaacttggttattcaggtattatctacccactttgtgaaacattcagacctacatttctccctctaactaaccatatctccattctgtggctctttgattattacatggtggccatgtaataactttaaaaagttatatttgaaaccactgattttacttacaagttctaggtgaaagtttgataggaagggctgtatagccaaggcaggtgacactttttttttttttttttttttttgagatggagtctcactctgtcccccaggctgcagtgcagtggcgcgatctcggctcactgcaagctccgcctccggggctcacgccattctcctgcctcagcctcccgagtagctgggactacaggtgcctgccaccatgcccggctaattttttgtatttttagtagagacggggttttaccgtgttagccaggatggtctcgatctcctgacctcgtgatccgcctgcctcagcctcccaaagtgctgggattacaggcatgagccaccacacctggccaggtaggtgacacttctaagatccataaggcttcctgtctccttatcttaaaatattaagccacttctatcttacagtgaacagaatcatttggaaagtcacataagtaaagtccaacatgcagagctgcctttataatgattaccattaccgcccagcacctttgggcttttctgcagataatgtatctgcctcccattcattcatgactttctttgaaattaagatcctgttaagctgcccttcaccatatcattttccttctctctgatattttactgatatcatagatcacaattttatcagcatgtaaacaaatgcacagtgtacttacccagtatcacaaatgtcaaatgtatgcccacttgcgaaattatttacttcttgaaaaagtagttcttcttcatattcctttgacatcagatcatagtaaaaagtgttatattggatgtgacccagtgtgaaactgagagagaaaatatacatcccatatagtattctttaccacttgagttaattcatgagttgaatagctcttctgctggttatgtgttctgtcacacctgataggcagactatcaggtgtatagaaagaggaaaaaattactgagctcatgaaccgatcccacccatattccttcatctccattttgaaaacttcagagtgttttattcatattcagttttagctattcactcccatggccataacctggaccttatctaccagaatggtttcacttttgaaaccctaatttcatttatccaactctgaccacagcctattttccagccctcccactctgttactctaattatacctgttccactttaaaaccattagtctcttgacctgtatcagcccagtattgtctttgcccacctccttatttagttaccacacaccaacattacttctgccagtacctttaactcctataaagcactgactttccagtgtacctgcctgggaaaatttcaaccctgggttagtccagctatctcttattccctcctatgcctagtatactgggcatttctgaagaaaaacctgtagctctgcgtattggcactacccctctgtattagtccgttctcatgctgctatgaagaaatacccatgactgggtaatttataaagaaaagaggtttaattggctcacagttctgcatggctggggaggattcaggaaacttacaatcatggtggaaggcacctcttcacagggcagcaggagaatgagtgccagcaggggaaatgccagatgcttataaaaccatcagatctcctgagaattcactgtcactagaacaccatgggggaaaccgctcctgtgattcagttaccttccaccaggtccctcccatgacatgtggggattatggggattacaattcaatgtgagatttgggtgtggacacagccaaaccatatcaccctaattcatggtcttcaacctcaaatgagcttttttaaattatatcacagttttatatggaatccaagtcatattttcttccatttcttttttctggcttgtttcaagattttctcttcgtttttgattttttgcggttcgaatatgatatgcttgggtatagattttttcaatatttatcctgcttggtgttctctgagcttcctggttctgtggcttgaggtctgtcatgaattttggaaattgctcaatcattattacttcaaatatttattcttttgcctttctctctttcttcttcttgtattcctactacgtgtatttacacctttggcatcttcaagcttaactgattctttcttaggtcatgtccaatctaccaatgagtccatcaaggcattcttcatttattacagtttttttatttctatttcgttttgattcttagtttctatctctctgcttacattaaccatctcttcttgtatgttgtctgcttttttccattagcacccttagcatgttaatcatagttattttaaattcctggtctgatcattccaaaatgcctgctatatataagtcttgttttgatacttcctttgtctcttcggacattttgttttgttttgtcttttgcctttctgcatgccctgtaattttttattgaaagctggatatgatgtattaagcaaagggaactaaggtagacctttactgtggaagttttaaggttgatctgactgggaattaggctgtatatactgttcacagtagctgttgtgttggaggcaattatttcctctagtgtccttgtttttgtctcctctggtgtgtcggtttcgctacagactccttcttaaatgaaagataatgattacagtgctttgggctgtaattccctgttatacaggagcccagttgatgaagtactggaataggaaaagtgttctgtcatcttgtcattaggtctcactcttttagtgaacctgtgtccctgggctgtgaccttcacaagtgcttctcagcttccctgtcttcttaggtgagataggaggatgagagggagctgaagttgagtatttccctttccccaggtcagttaggcttttgttaaacccaagtcagttaagctgtagtagaagttttctttgaaggcaggctgttagggagaacagagagctctgggcatatttcagaatggttaccttctcatgcttctgctggaaacataaaggtatttttctccagtcttcacagtgagaatctggtggaattcctggaggtaaaactcaacaaaagtgtaagtgtgagggttcccccctgccctgaacccttggagttttgaacactgaagctagtctacactgagcctccagcagtttttcagttaagtcttcctacctgtattggctccatctttgatcttctgctcttgggcttctgcttcttgtaagctgtgactctgtttccacctgtctgtctctccagtttgcaaagtagcagtttgtcctgtgaccttagttctctgaaagatctaagaaaagttgttgattttctgtttctttgcttttttcttattatgagaactagagtgacaacattaaggaactttacattcagaccagaaactggaagctctccttgcatttttattggttttgctttatttgaagtttgtttttgtccattttacttcatggcttttatcagtgtatctggtgtgtcatttattgctctttatcttgatttttttaactttttaaaaatttgcaaaatctatgaaagtataaatcagtataataaaactccttggatgggcacagtggtttatgcttgtaaccccagcactttgggaggtcgaggcaggaggatctcttgagcccaggagtttgagaccagcctgggcaacgtgctgaaaccccatctctacaaaaaatacaaaaattacctgggtgtggtggtgtgcacctgtacccgagctacccgggaggctgaggtggagaatcacctgagcctggggaggtagaggctgcagtgagccatgatcacaccactgcactgcagcctaggcaacagaatgagactgtcaaaaaagaaaaaagaaaaaaaaaaaacaagaacaaataacataaaattcttgtgcccatacccaacttcaaaaatatcattatatgcccaattttatttcacccataccaccacctactacccatcctccccctagagtattttaaggctaatccatcatctctaaatacttcagtgtgttgtaaatacacattttacttactataccagaagttctctttcttcataagaactatttaataccctttctactttcccagtttccagttctcagtagttaaccttccctcctacttcaaaaaagaaaataatccataaaatgcaaatctcttcaactatctacagtaattttggaaaagttatttcacttctgttaagcctcattctccatgtctgtaaaactaacctatgtaagtttcctatcactgctgtgacaaattaacataaacttagtggcttaacacaacacagatttattctcttacagttctagaggttggaagcctgaactgtgtttcactgaactaaaatcaagttgtcagcaagcctaccttcctttttggaggctttggggagaatccatccccttaccttttccagcttcttgaggctgcatatcttccttggctcatggccctttcctccatacccaaagccagtagtgttgcatcttcaaatcactggcactaatgcatactgccttcctctttctcctatggggagctttgtgattacgttagccccacctggatattgcaagatactctacccatcttgagatctttaatgacatctgccaagtcctttttggcagtatattcagcaggctctggaaagtaggacatggacatctttggagtaccattattctgcctatcacattaccttaaggttattgttaaaattagaggaattaatgtagatagaccatagtaggccctaatacacaataaacactcaaaaagtttagctgctattatttgtcaatgttattgttgatacccctgcctctataacatccctatattggtagggatagtaagttccaaatattttgagaaatgttggtgttccatttgtgtttcaggtacgactagaggtatactagacttcttgactttttcttactgtgtaaatctttttaaacatcacaaatttatgaaatatggatatggtaaatatcagtattattagtggtgctatcataaatatctgtgaatcaaaagagtatttatattcctgttttctgatttttttttccttcaaatatccaactaatttttgaaatcttttattctcagtataaggcatattctgacctttcactatgtcagtggaaataatggcgtttttctctgtgacttggtaattcttttcaccaaagtctagtgactttttccacttcgtggattatgaatctagaagcaggcagataagtacttttccccttggagaacagacggtttaaaagtagtctttgacttccccatatacaaaaagactctgtgcacattcctttcaaagagctccatggaggcagaaaacagtatctttttttcttgacagtatgtcctggaacctaacagaggggctggtgcttaataatttgtcatttgggctgggcgcggtggctcacgcctgtaatcccaacactttgggaggctgaggcgggcagatcacgaggtcaggagattaagaccatcctggctaacacggtgaaaccccatctctactaaaaatacaaaaaattagccggacatggtgtcgggcgcctgtagtcccagctactcgggaggctgaggcaggagaatggcgtgaacccgggaggcggagcttacagtgagccgagatcgcgccactgcactccagcctgggcgacagagcgagactccgtctcaaaaataataataataacaatttgtcagttgacctctgcagcactaaacataatcccttcctccacagccattctcattgcttttcctcttgactgaaaatcagcgtgccagctgtgctgtgggtcacacctgcctcctctccaggaaccttatgggccttgttccactgtttatttggcctatgcatctggcctccacttgtctgctggtgtctttccttcagcagttaaggatgcctaagtctcttatctgtacatgtatacatatgtaccttctgaaacccacatcccctccagctactacccatctctcttttcttttctcagccaaactcgagttgcctgcatttggatctctcaaattcctcacctcagtatccttaacccactgttatcgtctagcctttgagcttatgccgctgcagctgcatgtgatactgccaacacttaccgaaacactcccttttctcggctgccttcctgctctttcttcccagctctcctcctacctctctgtccattcttccgggtttctttatgaacttctcttctgcctatctttcaaatgttggtgattttcaggttccatcctaggttctcttctcactatatatacaatagtccccccttatccacaaagacgcattccaagatccccagtggatgcctgcaacctcggatagtactgaaccctatgcaccttctttttcctacacgtacgtacctatgataaagcttagttcagaaattaggcacagtaagagattaataacaacaataactgataataaaatagaacagttataacaatatactgtaataaaagttatgtgaatatttatctctcaaaatacattatggtattgtacaatgagtaactgaaaccacaggacatgaaaccgcacatgagcggcgactactctaaactctttaagtgatctcaaccactttcctgaacatcagacctttgtatctaagtcccttacaaggaaggaccctgaaatgtaatgttccccaccccccaaaacccagtcctcttcccacgttccctggctcactttttcctttcccttgtctcccaaatctactagattatcattctttccccacaactgtcccttctctctgtcctgttactttatttcaggacttttttttttttttgcctgactgcagcagttatctaagctatccttcaaaaacatacaacagtgatctttctaaaacacaaaccttcagtggctaccctttacccttgagagatgatctaaatctagcttcctgagatagagccctggtttaccccttcagccttatctcttgcagtttttcctcaggccctcccacaactctataatcagatctctgaaccactatgttctgtcacctctgtcacctcctgttcctgcacctgcctctgtaacaaagccttctcttcttcaccttctcctagtttgctctgtgtgaccttcaggttggcactcagacaatatttcctccgagaaagcattccctggcttccgtttgacatagagttggatgcaccttctgttgtttcttagcaccctatgcctagtcctactactgtcacttattatagtttaaagtgggtgagtatctgtgttaagtcccttcaggattgtgtcttattgattattcagtctttactccccagcacagtgcctgacacatagttacatgacaaatatttgaggtatgaataaatgagctttctctagaatttggtttgctttttaatgggccgtcattgataagtttaccatcacatctctcaccccaatagcatattcactgttaagtatgaaaacttgaaaaataaattacaagctatttacaagagaaatgcattctggaaaagctctgatgcaaaggaaaaacattccctattaatgctcacagaaatacctcctaatgaaacacaattgtttccattgttacaacaattaatttttaatatatgcaacagaacaaggtgacttaactttttaatcttttcaatcagaaggggtctcaggcttttacctattctatttaggaacattctgacaaagtacaggacaagtacatttatcttcgggtcagatgccatggcttacacctgtaatcccagcactttgggaggctgaggcagaagactgcctgagcccaggagttcgagacttgtctgactagcctgggcaacatagtgagatcctgtctctacagaataaaaatgttttacattagctgcatgtggtggcacacgcctgtaatcccgggtactcaggaggctgaggtgggaggatcgcctgagcacaagtcaaggccgtagtgagctgtgatcgcgccactgggctccagcctgggcaacagggtgagaccttgtctaaaaaacaaacaaacaaaaaaaaaaccttcttatctttattttggtgaagtgaatgatcttacttggtactgttttaccatgctttaaaatatagcaggcattacttcaaccactatttattgattataactgatttatttgacattccttaaaatattactcactccttaattctgtttgcctttcttttatcacacctgacagtggtgatatcatgcttcgtgtaccaaagatagaaaaacgatgatatggatattttctgcatttaatatacctttttacagtcctttacttaccttagtcagagggaaaatatcttgcagttttcattggaaaataaccaaaattaaaggaaataatgttttatttaatgtcttaaagagcaagaaacaataaaaaatgtcaatattaaactaaattgggcattacagctaacgttaatgaagataaagacaaatgccagtgagtgttcacttaaaaaataaacaggatttttaaaaattacccttgagaaaagttaagtccactctataagtcagctatttttctaatattttagaatcatgaatttctatcatataatagctattgattatacctaatacagtatcttttatatgtttttccatttttatttcatcatccagagccaatgatttgaagtattatttgcgctccactataggagcccaagaccttgaaacaaaccctaggtaatcaaataattgacactaatatagaaaccaccatttggcttactaaaaaagtctctaaagaaaacagaggtattccaaccccaattttataagacaataggcacacaagagatcaggttagttagaaagaatctatatgatacaacacctaaactgcattacatcagtgtgacacatcctagaatgagaaaaagggtgccaatgatagtctttttttactgatagtatgaaaaattgaaccatcactaatatgtctaaatttaacttccctgaattctttcaaacaagcatcagatgtgacatttaaaaggacaccctaatataacccaagtatgtaaaaggtgtgaaagatacagcaatactccttgtacctttattgtatagaagaaacacaaagtaaaaattattccagatctcttggcattttctatgagcataactatttttagtatattttgtagtaaacattcatatggaggtaagtgaagaaaaaaatgaagtttaatgctatgacgtatgggataagaaaccaaaagacctataggcccaggtatcagttgtatcatttcagttgagaaaggaaattgggaattgaattgttcattatacagatggtgtagaagagcaattctcaaacttcttggtctatggaccccaaacttttctttacattagatatatctactgacattactttgtttgaaattaaaactgaaataattttaaatgatattgtttttaaaagataacccattatattaacataaccaattttatttttttaaaaactatatttttcatattaaaatattagggaaagagaggcattgctttatgttattacaaatctctttaatgcttagtgtaatagaagatagcatattcccttatctccttttacattcagatttttgtggtatgttgccttggttgaaatagatgaaaaaaattcagcctcacataactatgtaatagaaaagggagtgttttaatagaaaccatcattctcagcgaactgtcgcaaggagaaaaaaccaaacaccgcatgttgtcactcgtaggtgggaattgaacaatgagagcatttggacacaggaacgggaacatcacacaccagggactgttgtggggtggggggaggggggagggatagcattaggtgatataactaatgctaaatgacgagttaatgggtgcagcacaccaacgtggcacatgtatacatatgtaacaaacctgcacgttgtgcacatgtaccctaaaacttaatataaaaatacaaaaattaaccgggtgtggtggcgcatgcctgtagtcccagctacttgggaggctgaggcagaagacttgcttgaaccccggaggcggaggttgcagtgagcccagattgcaccgctgcactccagcctgggtgacaaaacgagactcgggtctcacacacacacaaaaaagttattttgttagtagttgctctcaggattacaactaacatcgtaacttagaaacaatctagttcatattaatccagcttaattttagtagcttgtaaaaactttgctctaacatatctcagtttatttactcctcctcaatttgtactattattgtcaatacaaattacatcttcaagcattatgagaccaacaagatggttttataattattgtttcaaacaatagtcttttatatcaggtaagagaaaagagctacaaacaaaaatatatttataccatatttacctacagttccttttttttttccaacttcgtcttcgcagaatacttagagttacctttaacagtactctttatttatttgtgtggattcaaattactgtctagtgtcctttcagatcagccagaattccctttaatatttcctacaagtcaggtgtgctaataacaagttctttctggttttatctggcaatatgttaatttccccccatttttgaaggatatttttgctggattttagacttcttggctgacagtctttttcttttaacactttgaatttatcatcctattgccttctagcctcctgggtttctgatgagaattgagctgttaatctttctgaggataccttgtccgtgatgaattgcttgtctcttgctgctttcaacattcaatctttggctttcaaaatgttaactatgatatgataggcagggtttgactgtgatgtatcttggtgtggatctctttgagtttaccctacttggcgttcattgagctttttgggtgtacaggttaatgttgcattaaatttagatagttttagccattattgcttcacatatttctacctctttcctctcttctgggactcccattattgttggtattcttaatggtgctccatatgtctcagaggctctgttcattttttttttattccctttttttctatccttcagactagataatatgaattgacatatcttcaattttgctgattatttccttgccaggttaaatctcctattgagctttgctagttaatttttcatttcagttattgtattgtagaatttcagttttgttctattttgtgatttctctttattgttactgtggtgagacactgttctcataattttcttcagttatttagacatgatttcctttcctttaattctttgaagaatcttttcttttttgacaaggtctcactctgttgcccaggctagagtgcagtggtgcaatcatggctcactacagcctcaacctcccaggctgaggcaatcctcccacctcagcctcctgagtagctgggaccacaggcacttgccaccatgcacagctaatttttttaacttttcatggagacagggcctccccatattgccaagactggtgaacatgtttattatagcagatttaaagtctttgcctagtaaatctaacatctgtgcttccttgaaggcagtttattttgactggtttttttttccccgacgtatgagccatactgtttctttgcatgtcataattttttttattgaaaactggacatttttaactatacgtcaactccagaaatcttcccagatttctcccattgcctgggtttgtggtttttgctcttattgctgtttgttcagtaactttcccagactaatactgtaaagtcttcattttttgttgtgtgttgccactcagcttaatggccagctgtgatggccagagatttccttaaaagagaggttaggcccttctccagtctttctggggcacgaacatagtgctgcatatgttcatggacttctagattcccagaaataagtgagagattttcagagtcccctgtgaatatctcatttccatttttccttttaagatttggtcaacctctcattaaccccagctgataatcactgcctcaggcagctgcaatgttaaacaattgctgatgattattttcttttatttatttatttattattatactttaagttttagtgtacatgtgcacaatgtgcaggtttgttacatatgtatacatgtgccatgctggtgtgctgcacccactaactcgtcatccagcattaggtgtatctcccaatgctatccctcccctccccccaccccacaacagtccccagagtgtgatgttccccttcctgtgtccatgtgttctcattgttcaattcccacctatgagtgagactatgcggtgtttggttttttgttcttgtgatagtttactgagaatgatgatttccaatttcatccatgtccctacaaaggacatgaactcatcattttttatgactgcatagtattccatggtgtatatgtgccacattttcttaatccagtctatcatcgttggacatttgggttggttccaagtctttgctattacaaatagtgccgcaataaacatacatgtgcacgtgtctttatagcagcatgatttatagtcctttgggtatatacccagtaatgggacggctgggtcaaatggtatttctagttctagatccctgaggaatcgccacactgacttccacaatggttgaactagtttacagtcccaccaacagtgtaaaagtgttcctatttctccacatcctctccagcacctattgtttcctgactttttaatgattgccattctaactggtgtgagatggtatctcattgtggttttgatttgcatttctctgatagccagtgatggtgagcatttttccatgtgttttttggctgcataaatgtcttcttttgagaagtgtctgttcatggggttgtttgtttttttcttgtaaatttgtttgagttcattgtagattctggatattagccctttgtcagatgagtaggttgcgaagatttactcccattttgtaggttgcctgttcactctgatggtagtttcttttgctgtgcagaagctctttggtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatacggcgttatttcctaaatagacatctacagaactctccaccccaaatcaacagaatatacatttttctcagcaccacaccacacctattccaaaattgaccacatagttggaagtaaagctctcttcagcaaatgtaaaggaacagaaattataacaaacttatctctcagaccacagtgcaatcaaactagaactcaggattaagaaactcactcaaggctgggcagagtggctcacgcctgtaatcccagcactttgggaggccgaggcaggcggatcacgaggtcaggagatcgagaccatcctggctaacatggtgaaaccccgtctctactaaaaatataaaaaattagccgggcctggtggcgggtgcctgtagtcccagctactcgggaggctgaggcaggagaatggcgtgaacctgggaggcggagcttgcagtgagccgagatcgcgccactgcactccggcctgggcgacctagcgagacttcgtctcaaaaaaaaaaaaaaaaaagaaagaaactcactcaaaaccactcaactgcatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggtaagaaataactaaaatcagagcagaactgaaggaaatagagacacaaaaaacccttcaaaaaaattaatgaatccaggagctggtttttttgaaaggatcaacaaaattgatagaccgctagcaagactaataaagaaaaaaagagagaagaatcaaatagatgcaataaaaaatgataaaggggatataaccaccgatcccacagaaatacaaactaccatcagagattactacaaacacctctacgcaaataaactagaaaatctagaagaaatggataaatttctcgacacatacactctcccaagactaaaccaggaagaacttgaatctctgaatagaccaataacaggagctgaagttgtggcaatagtcaatagcttaccaaccaaaaagagtccaggacctgatgggattcacagccgaattctaccagaggtacaaggaggaactggtaccattccttctgaaagtattctagtcaatagaaaaagagggaatcctccctaactcattttatgaggccagcatcatcctgataccaaagccgggcagagacacaagcaaaaaagagaattttagaccaatatccttgatgaacattgatgcaaaaatcctcaaaaaatactggcaaaccgaatccagcagcacatcaaaaagcttatccaccatgatcaagtgggcttcatccctgggatgcaaggctggttcaatatatgcaaatcagtaaatgtaatccagcatataaacagaaccaaagacaaaaaccacatgattatctcaatagatgcagaaaaggcctttgacaaaattcaacaacccttcatgctaaaaactctcaataaattaggtattgatgggacgtattttcaagaaactttacagtgatggagcttgttcacacagagcaagctctcagtccattaaaaaaagacaaaccctgagaagagagcttttcagggagcttccgaaaaggtcatatagtgacatttctctgggaatggatctttggggagctctaaacctgttctgccccctccagtacctggtaggctcttcattttcatagctaccctacttgcaaagctgttggttttcaaggctacttcagagctggggagagtgacatggaaatagagcaatttaaaacacaacagaggtaattattcttaccaaaattcagctatttttcttaaatgagtgctccttggattcttgcaaagttctgaaaaagttgatttcaacaactttctgccagtattctcattgcttttattgaggagcagatttttttgaggtccttaccattccagaagtgattctacactactctgttacactaaaatatattggtctaccttgcactttagatggatcttttacccgtgaatggttttgtactatcatgcattggtcattttggaaattttggtttactgagttatgcagatcttcctcatgttaacacattttattgtatgatatttttaaataacatttgttaatattaccactgattgcctcagaacagtttcttaagtattgggaagatatcaggctcacagtggcagatgcaagtttttcaaaattaaaatattcacttagaagctcaaattttatcattagcgacaaatactgtcatttgtttttctgaaagtggctgactcactctgtccattttcaagaaaacgttagttagctaaatacccaagtcggaatatccgttgtttggtgccactgctaattacccacgtctttgtttttgctctattaatacaaatgttaactcagtgtaaaacgcgagatgtcttagtattattatgaaaatagtttttacctaatgtgaccttctgaaggtattttgggacccccaggggtttcttgtaacactctttgagaaccactgtgtagaggaactggatcaggatttctagaccttgtcttcaaatatcaaaatgactggcctgtgatgataggtgagcttcagctttacaactcatatcagacacatgctgacctgattttttttaactgaatacagataggaaagaaaacaatgcttttccttgcccatctgcaagataagaatgtagagacaacattttgctaattctctcatgaaagtagtgtgtagtacaaagcgtaatattcatctttccacataaaaatgtttcttaagtttattttgcatatttgtgtgatttcttcatgaatcatttaatcaattagtaatgtcttatgagtaattccatccttatagcaacctattttctcatagccattggaagcatatggacttctaaaaatcttaaaatatcagtcaggcaattgtgatgttgatgaaatcatattacttcttatcatcctggagaaaaatcatttttaaagcatcagtagcctatctaaatgtcattattaacttttctatacttttctgggaagatcagtagaattttgaggctgagaaaaatattcaaaagaatgtaaagcatttcttaaacattttgtcatcttaggatgtccattgcaatctttggtttctttatgttctatttaattagccttggtttctaaagagaaggagtatatcattttattcaaggtttgaggaatgttccagaaataggaaacaagttagagatagacctcaccattgtaactgaggcactgtcaatccatcagaattttcttaaatgaaaaataatgtattctctaaatgtgcaggagtttaaatgtggtggaactaatcatcagtattttttattctatcgtaattattgtggatggattttatttatgttgatattttagtgggaaaatgtaaaccatgtccaatccctccctgaagggaaaaagcaatgctatattcaacagaatatttggtcttagaaatacccagttaaaataacgaactgaataattgcaactattaaatcatttaaagtcttaagaattttctactaatcaggttttctttttgtttgtttattattttttaacactaagatcctaggaaacaacaggttttcttttgatgtgctgttaatggaaggggtctctaagtaactgtcatctgtgtaagaattttttgctttgaaagagatttgcctgaaacttccaataattcacttattttccaagccttaactattttttttttctattgcagccctttggagtgaatcaacctggaccttatatcatgtatacaactgtagatgcaaatgggtatctgaaaaatggatcaggtaagaccagatacattgtccataatgtataaaagcttcttcagtcaatatattagcaaggtaaactggtggaaaaaattatgttttcacactccttaataacatcttcacttttattatacttagtctttccatagacttacattggtagattataaaaggttcttatgacaaaaaatgttcactttcaattcttcatatatccctattatgatggagccaactcattatccttattttttagttgaagtagcagagagattgggtgaaattacttgtgttatcttggtcagaaagtgaagtgcaaattagttaattaagttcatcttagaagacgtataaattaagaatccaattaatagtataatataaactactcctagttttttttattatatagaatagaagctgtaatacatagagagggttttttgatatattattataaagaaaaaatctggttatacatttaaataaataataaaggaaaatgtaattaagacaataaaagaaataagattgagcaaaggatgtctgcttttaacagatggctgactgactgaggttagatccaaattacagtaaatataactgtgataattccagttatctaaagaagaaaaggaatctgaatatgcttcttttaagatgcctagagttttaaccatgaagaagtataagcagagttgctgtcactcctctatttttttggccaaaaaagaaaaaggaagaactcattatatggacattgccatgttatgtaatggccttactaaatcaaatataccccagagtgagtttacttttttagctaattgcacacatttaagagtctcagttgtactgcttgcttcagcacagaaacattccatataacaaaatttttttaaaaattcaaggagaaattgacaaacacaattatactttatttatttatttatttgagacggagtctcactgtgttgcccaggctggactgcagtggcgcgatctcagctcactgcaagctccgcctcccgggttcccgccattctcctgcctcagcctcccgagcagctgggaccacaggtgcccgccactacacccggctaattttttatatttttagtagagatggggtttcacctgtgttagccaggataatctccgtctcctgacctcatgatcagtctgcctcagcctcccaaagtgctgggattacaggcgtgagccactgcacctggccacaattatactttaatataccactgtcagtcacagcagttcaagataaataaggatatagataatttgaacaaattacttctttatgtttttaattcatgtacatattaaacctttacaaaaaaggctctgggaccagctggttttatcagttaattcttttagactttgaagatgcagatgatttcagtgctaggtaagatgttccagaatacaggatgacaagatgaagttatttattgcatttcatgaacctagtataactcgggcagagccagcatactcaaaaccaaaaactaagttcactggtgggatatcaatgaaaatcctatctaaaacctaacaacttaaatttgtctgtatttttaaagaattgcttacttaacgtaatcaagtagatgattatctaaggaatgcactgatggcttaaaatgggaaaatctcttaattgttatagcagtgcatcagtttttaaaatactttctttttctttttttttcatataatgatacattgtgtacatctctccatatctgttcatacagataatcctgatttctttgggggctattttgtataaagatacaatagctactctagccaatcctctattttttgttttactataatacaacaatacaacagtaaacatctatttgcatatatttttatgcagttaaatgaataattcaggccaggtgctcatgcctgtaatcccaccactttgggagaccaaggcgggtggttcacttgaggtcaggagttcaagaccagcctggccaacatgacaaagccccatttccactaaaaatacaaaagctgcacgtggtggcggtcgcctgtaattccagctactcaggaggctgaggcatgagaatcacttggacctgggaggtagatgttgcagtgagccgagatcacaccactgcactccaaccttggtgaaggagtaagactgtctcaaaaaaaaataaataaataaataataaaataataaaataattctcacttcatagaagaaaagttaataaaaaattaacatttatcttgaggaatacaatttcaagagattcactttccactttgtacatttctataactgttgactagttttcagttctttttcattgtttaaaaaagatgcgctgggtgcagtggcccatgcctgtaatcccagcactttcggaggccaaggtgggcggatcacctgaggtcaggagtttgagaccagcctggccaaaatggtgaaacgctgtctctactgaaaatgcaaaaaaaagaaattagccaggtgtggtggcacatgcctgtagtcccagctacttcgggaggctggggcaggagactcattgaacctggaggcagcagttgcagtgagctgagggcattgcactccagctaggtgacaagaacaaaactccgtctcagaaaaaaaaaaaatgggattcttgattcagtcaacaaaattttcaccaaacttatactgcaaactagacattggcaactagtattgaactccattcagtaatattcactacccattactatttttttaagcgaatggaacaatatttacttagcatgatttttaaagatctaccccaaaacagtaatggaacattagatttattcttatcatatctaatatttacctgtttctagattggagtagaaattgggagggaatttgtaggcataaaaggaaatgaaaaaatatctaaggtaaaaataaatgcagttgagtgcataaatcaaatgaatgcataaattttcatggcagaacactgaaaacaaaaataaaaagccctcacaaacttgaaaaaaatctaaatgtctataaatagagatataataaattatcccattttataatattctccagactgcaaaatattttaagataatttttgatgtttataatagttggaggaagacatatctgcatgtaaaatccaaattgtatgtgcgttattttaagtgtgtctgtgtgtaggaaaaatatataaacaaaatgacgcataaaatgttaccacaattatctcttggtcatgggaatgcaaattgtatgtgtgtgatttttaagtgtgtctgtgtgtaggacaaatatataaacaaactaacgtatgttactatgattatctcttggtttttggattttatatatttctttgcatttttgtttactaaatatatattgctttttaatttaagaaaaagcttttaaaatatttcaaacatatgctgtatttcatgcataaaatgtattctaagcaaggaagtagcacttaatttaattgactgagggagtgccatcatgaaaccctgccccaaattttaaaggatgaaaattcccagtttaaatgttaagcatgttgaactccaaagaaacattactgggctaaaccgtaccttccatcccatcctaccccatcagcagagaatgttccactgtaggaagaggatgactacatttacgtatttcggaaactacagccttggttttctcctagagcagctgagagtcactcactacccattgtcgggtcataaaattaatgtagtagcttttagagtattttacttaatagaataaaagagaacagtagaaaacaatctattgatcagagtacatcccagatggtaaagtattgtttcatgaaatttttatttagttgtgcgtgcgtgtgtgtgtgtgtgtgtgtgtgtgtgtgtgtgtgtgtgttttcacactgggtaataacataggatgtagtttttattgtgggctgtgatcagaaaagtttgaaaaccactgccagagagaaataacaacaacaacataaattaatattattcagtaaaggcctggcccaattatcctattgcttacagatagattatcattcttacccattactctgcagtcttagtccatttcctagcaaagcctgaatagccaaacattattagagagttacattacagaggagtcattaattttctaaataatagttcctgtaacagatttaaaaaataaaaataaagtacatttattatgaactttttaggagcttaaactcctctggttttgaatctaggattttgtttactactcttgtaaattagccagggatctgcaatgggcatccaaattgcctaaacaatatttgataagaacttaatagaatggagtacattggcaaaattttgtagactagtgagttgttggtcatttatgaataacaacattattagaccaagaattgcttttctaccccataaacgacttatttggccatactgtttaaatccagagcaaaatcattttcctttttcctctgtggttactatttgttaatatatctgagaaaaacataagtaacctttgccttctgtgtacccttagtgtatgcaagaagtgatgttaagcaatcacatgctgtgatgtaggggaaaaaatatgtcttctacgacacacactcattcaacacagaacacatctgtgaccagatatgtagggttttaccccacatcaacctgttctccaacacaagctaggtatctcataatttaattcaattctgacactttctggaggcagactcatatcccacagttaagggctcagtctcacaagattttccccactttggatgccaatcacaagtccaggcatccagtatttctgatggagagtctataaattggcatttcccatgactcactccttcatcaagttcagtcatttgctggaatggctcacagaactcagggaaacacttacttacatgtactggcttattataaagatattatgaaggatacagatcaacagccacatgaagaaatacataaggtaaggttcagaagggtcctgagcacaagtcttgtggaacctggggtgcaccacactcccagcccatggatgtattcagtaacccagaagctctccaaatcctatccttttgggatttatagaagcgtcattgtggaggcattattgattaaattactggccattagtaatcagctcaaccttcagccccctcccctcccgtgacatagcaattctaattgcatcaaaaaacagagctgcaaaatgtatgaagccaaaattgaactgaaaggcgaatagacaaatctacatttatagttggagacctcaatatctctctctcaagatttggcaaacagttggaaaatcagcaaggatacagaactcagcaatatcatcaaccaacaggatctagtagacatttatagaataatctgcccaacaacagcaatacattcttttcaaatgcccatggagcatatactaaaatagactgagttctgggcaattaaaaaattttaatttaaaaacctcaaaaaatttaaacaagtgaaaccatagagagtattctccaaccacaatgaacttaaaatagaaatcaacaacagaaattcctgttgtaaaatctctaaacacttgaaacttaaacatcttatttctaaataatccagaggtcaaagagaaattttcaagggaaattcttaaaatatattgagctgaatgaaaagaaaaatacaacatatcaaaaacttggggacacagccaaagcagtgctgagaggaaaattataacaatgcatgtgtataatagaaaagagtaagtctcagattaataacgtaagcacccacctcaacaacctatgaatagaaaagcaaacctaaagtaaacaagaggaaggaaataaataagagcagaagttattgaaattcaaaacagcaaaacaaaagataaaatcagttaaacaggaaataaacaaaattgacaaatctgtaccaggactgaccaaaaaaaaagagagaggagacataaattgccagtgtcaggaatgaatcagatgactcactgtggaccctgaagatatcaaaaggataataagggaataatatgcacatgcattggacatcttagaagaaatggacaaacttcttgaaaaacacaaactatcacaaattatccaatataaaatatatcatttgaataatcttaaaattactaaggaaattgggttcataattttaaaacttgcaaaaaagaaataggtagacccaagtggtaagaattataccacacatttaaaatacagttaactggtagagtgcgatggatggctcatgcctgtaatcccagcactttgggaggccaaggcgagaggatcacttgagttcaggagtttgagaccaacccaggcaatatagtgagatcctgtgtctacaaaaaaatttttttaaataagccagatgtagtggcatgtgcccatagtcccagcaattcaggaggctgaagtgggaggatcacttgagccctggaggtcaaggttacagtgagccacaattgcaccactgcactctaacctgggtgacacagcaagaccccgtctcaaaaaaataaaatagagttaacttcaaattctgtacaatctcctttagaaaaaaaaaggaaaattttctggtttgtaggtttaccctgataccaaaaccagacaaagacagtacaaaatccctgtagacagatagtcctcatgaatataaatacaaaaatcatgattagtgggacaaacatggtagcccatgcctgcaatcccagcactttgggaggccgatgtgggagaatcacttgagcctaggaatttgagaccagcctgggatacacagtaagaccccttctctaccaaaaaaaaaaagaaagaaaaaaaattagtgagtagaacacatacagcattatatagaaataattatacaccatgatcaagtgggggttatgccagggacacaatgccagttcaagattaaaaaatctattagtgtagtacaccacattgacagagtaaagaagaaaacaaaccacatggtcatattaactgatgccgaaaaagcactgaagtttaaactattcatgataaaaactgtcataaaaatagggatagagaataacttcctgaatttgataaagaatgtttacaagaaaccttcagctgaatttatgcttaatgataaaagactgaatggtctgcgtcgaagattaggaactaagcaaggatatcgcctctaaacactctaattgtaaattcactggaataaggcaagaaaaggaaacaaaaggcaaccaagttgaaagcaaagaagtaaaaccatcactatttccagatgacataattgtatacatagatgacctccaggaataaaaaacacacactcagcaaaaactgctgcaaccaagaagtacattcagcaaggttgcaggatacaagaacgcaaaaatcagttgtatgtctgtacattatcaatggatacatagacaccaaaattaaaaatacatttctattctcaatcactcaaaaaatgtgaaatacttaagtataaatttaacaaaacatatagaggacttatatgttgaaaactacgcaatgccagtgagagaaatcagtcgtctaaataaatgaagagatacgcaaggttcatagattgggagatttaacagagagagatatcagttttccataaattgccttgcaggtttaacacaattcctttccacgtccccggaaggatattttgtagatatagacaatttcattagaaaatatatatggaaaggccaaggagctattaagttactgcaaaagtaattgtgctttttgtcattttttaatggcaaaaccacaattacttttgcaccaacctaatagaactgaaacaattggaaaaagaagaataaaataggtggaattcgtctatgtaatttcaagacttattttatagctgcagtaatcaagactgtatggtattggcagaagtacagatacattgattatgaaatggaagacagaacccagaaataagcccatacaaacatgcctacctcatttttgacaaaggtgcaaaaagcaataaaggaaagataggtttttcacaaagttacaaaaaggaattcaaagtggatcatggacataaatgtaaaatatgaaaccatagatcttctaacaagaatcatgaggatattttctggatttaaggcttggcaaagagtccttagactttacaccaaaagcaagatccattaaaggaaatatttacaagacttcatcaaaacttaaatagttttgctctgtgaaagaccctgataagaggatgaaaagacaatctacagcctgaaagaaagatatttgcaaatcacatatctgacaaaggttcaatatctataatatataaagaactcttcacactgtcaaattaaaacatggacaagagacatgaagagacatttcactgaagaagatacataggtagcaattagcacatgaaaagacgttaacagtatttaattagggaaatgcacatgaaaaccacaatgggatatactacacacctatcggaatggctaaaaaaataaagtgacaacatcaaatgctaatgaggatgcagagacagtagatcacttatatattgcttgtgtgaatgtaaaatgttttagtcactctggaaaatgttggtagttcttaaaaaactagacatgcaactactgtatgacccagcaattgcagtcccaggcatttatcccagagagatgaaaagttaaatgttcactcaaaaatctacacgtgagtgtttataccagctgtattcataatagccctaaactagaagcaacccaggcatcctcctgtggcttattaaaatctttggtacatccatgccatgaaacactactcagcaatgaaaaggaacaaactatttttcacagaacaacccagatgaatctccagaggattacattgagaaaaagcctatcccagaagtttatatactatatgattctatttgtataacatttctaaagtgaaaaaaagttatagaaatgaagaacaaattagagttagacagggatttaggagtaggtgtgggtgacggggaaatggttgtggctatgaaaagacagtatgagggatccttgtggtgatggaaacgttcaggacttcactgtctcagaatcagtattttactggctttgataatatgttctcattttgtaagatgttaccatgggagaaaactgaataaagggtacatgggatctttgcattatttctatatctgcatggaaatctaaaattatctcaaaataaaaagtttagtttaaaaatcactgtaagatctgtggtggtaaaaatagtatctgtaactatttgcagcctaaaataccattgtatatttgtataaggttccatagagtaacagtatgttatgcttctttgcttttattggaattatatcaatactatggtaatattggttatataatgatcagtagttctgatcagatagataatattaaatgaatacttgggatatgatttattttacagttacaatgatggattaaaataggaaacattttagtaaatatagtttggtagacaaaatatattccaatttcaaatctataaaagaaatatataaaagagttttagtaataaagtaggtgggaaccacttcgttagatttcactgaactttggctatcttgatttttaatacttttctcatggctcaatttttaattctcaattttttcaatcttccttatgttttcccccttcttattctaagttggatgacaatgataaacatttaaagtatttgaataattgtgaggaaggatattttttaaatctctcttgtctctcaattcccagataccctcacttccctcctctcccctccctgcattgtactcatggaaggaagatgggttgaccatctgacttcctcaatcaaaaggttttactcttacaaatgtgataacactgattaaacctaataacaaacagagaagttggttatctctaacggtatcccacttatgtaggatgagaagtgattccagataagatgatcagctttttctgaaattacgttctccagtatttttcaaacaggagaaacatggagtcacactagaagttttattgattaccaccaaaacttcttatggttgccaacagaaaatattaatatttgacttctaagataaaagcgatacaattaaagtaaaggactggtgcccatcaatgttaaccacctgatgtcaggtcctttcgtttgttctagaagtacagctccaggttgtagaagatacagtgcctcatactagtctcatagctggaaagatatatgaggcttaaagactctgggaataaataatagcttacacttaatgagtacttttagcgtaccaaacaccttaaagttcttatacatggattagtttttttaagtctcacaaaggccagtaatgtagttcattattgtcatcctcactttagagctgaagaatctgattcatacagaagttaaggacttccccagagtcacacagctagtatgaggcagagcctggatttgaacccaggcagcctggctccaggttctctagtcttagccatcttttataataaatgataatatgacctcatatttataaattattttaaaggtagtggaataaagtttctggagtcagcactcctgatttcaagtcttggcttttccagtctcctgctgtgttaccttgggcaaattatttaacctccccaaactacagttttcttactgtaaaatggtgacaataattatgagataatgcatactaagggcttatacaatgcctggtacatagtaattattcagtaaattcatctcgtaagcatttattgaatgatttcactctgtctggtacagttcttggctgagtaagtatatattgttgaacaaaccagataatgttgttgctctcaaggcagttacattctgtggaaggggcgggagggtggggagagagaaaatgggaaaataccaggtagtgagttaacgtcctgtggcccccagggccctgcaagttctggatctctgttctctctctgacggcatctacttctactctcccgccttcttaactctgcatctgttatacgggcccctttgctgccctgcattcaccaagctcatcccctctccctgggacacctgtctttggatatcctcatggcttacctgcttcatgtctttgttcagctgtcagctcactgagcacttccctaatcacttttttgaaaaccacaacactccccactcctcactattccccttctgtacttcatcttgtgccaaagcacttgccaccttctaattattttattgtgtggtacctccattagaatataagagagcaggccgggcgcggtggctcacgcctgtaatcccagcactttgggaggccgagatgggcggatcacgaggtcaggagatcgagaccatcctggctaacacggtgaaaccccatctctactaaaaaatacaaaaaaattaaatgggcatggtggcaggcgcctgtagccccagctactcgggaggctgaggcgggagaatggcatgaacctgggaggcagagcttgcagtgagccgagatggcgccactgcactccagcctgggcgacagagcgagactccgtctcaaaaaaaaaataaaataagagagcaaggatctttgtcttgttcacttctgtattcccagcacctagagaaatactatcataatactgaataaatatttgttgaataattgagtgaacgaataaaagcaaaaagaggtccatgtaatggagagtggtttgagtgctactttaagttggttgatcagggagggcctctcttgggtagaaaacttaggagttgagttgtggctgttgggatgtcagtcaggtgaagtataggaagcattcaggcacaagatgccagcagctcacactaacatggtagcagtgatggagagaaatgggcaggctagggatgtgttaaggagatggcattaactgcacttcttcatggactactatggaatgggtgaaaaaagggaaatcaagagtgaaatctgaggaagaaccttgaatacctgctaaatgaaagaagccacaaacaaaaggccatttttgtggtattattccatttataggaagtgcctagaataagcagatccatagagacagaaagtagattctggttcccagaggctggtaggtgagagtaatgggatgactgctgataggtatggagtttcatattgaggtcgatgagaatgttctggaattcgatagtggtcaggtttgcccaactctgagaacatactaacaaactgctgaattgtatacattaaaggtacattttatggcatgtgaattatatctcaataagaataaatcacaggatatgagggcttgagccataggtagcagggtagctgtctcttactgagaaagatgactggtgaggagcagtttagatggggatgggggaggtaatcatgtgttctttggatccaactggagagatcaagttggtattatagcttagatagtaaatattaactattattatcaaatatttaatgcctggccaggcgtggtggatcacgcctgtgttcccagcactttgggaagccgaggtgggtggatcacttgaggtcaggagtttgagactagccagaccaacgtggtgaaaccccatctccactaaaaatataaaaattagccaggcgtggtggcgggcgcctgtagtcgcagctactcagggggctgaggcaggagagtagcatgaacccaggaggcagaggttgcagtgagccaagatcatgccactgcactccagcctgggcaacaaagttagactcagatagatagatagatagatagatagatagatagatagatagatagatagatagatagataatttaattccagctggggaaattgacaaacaactatgactctgattaattaaactgaattgcacactggttgatgatacgatcggagtggatgttcaatctctgtgtgtgttcctaggatgaagtctgttgaagtatggagttctcactggttgctccaatcctgaaagcctggttacttcctgtagttagataacttctttcacagaaaatttattcagaaggctagaagctcataactttattagaataatcacagagcgtagaaaaccttgatcaataaaaatgatccttttctcctctcccaggctgattatgcaggaaatgaggagtttttaccccctaatttactttttctcatcccgattcagaaatacactgacttgcattgagtgcactaagaatctgagtctgaaaatttgtacgaattgtctttggaccagtggttctcaatcgggtgattttgactcatgggagacatttgacaatgtctgcaggcatttttgattgtcacaactgggagggtgctactggcatctagtggatagaggccaggaggctgctaagcaaactataacagatagaacagctccctcaacaaaaaattatccatcccaaaatgtcaacagtgctgacttgagaaatcctgatgtagactataaaactcacaaatatcacaaaactttataaacttatgaatattcagctatgattccaaacttctacggatatttggaaatccttcccaccttcctatgtaaatagtagtattatttgccaggcatcatgtggcattgtaaacagacagatgaattaggaaaagatttggagaggcaggagaggtacatctgatggtcctgggacctgtcttttgatagtttagcaaagtgctggctcagcatatgagtttagagaatacaacagcctaataattgaagcttagttcctgacactcctcctttctaacaaagacagttttctcagccaggaagctctcatgtcttctagatattcccagtcttcttccaatgtccatataaaatttaaaatgccacaaagactggggcacttgagtattttccatggtgcatcctgctgcagttgatgcatgcaccttaataatacaggatggtagggggaaagggacccaggcattcagctactgctctgcctgtcagtggttcattaaaccttattttacttttaataccacctggtacaaatgatgtgtgtatgcatacctccttagcataacagtcagacaagaaatagttaaaagagctataatagaaataaaaacaaatgttttaaaaaccaaaagctaacaaaatacgaaagcatttctattagctaaaatgctgaatttattatctttagaagcagtttaggaagaaaagggaatatgatgtgtatcttagaaatactctaagcttataaagtcagctagttttaaggtacctgttggagtcactgagggaaggaatgactcacagaaattcaaactttgaaatcataaagtagttgttttgaaatttttgttatggaagcttgttaccaagggtgaatcttcggcagggttggtataggtgtggttgacaaaatttagctataacaagtgggctgtcagatgccatggaaagattttactggggataaaaatgctaataatatatgtattggacaaaattacatttttatatgggaccatggacagtttttcttagcatcaccaccatatttggcaggggtggggacttttcatttttgttttaaattgtggtgaaatacatataaacataaaatatatcatcttaaccatttttaagtatacagttcagtagtactaagtgtattcacactgtgtgcaaccatcaccatcattactctccagagcacttcaccttgcagacttgaaactctgtacccattaaacgctaactccccatttccctcctgctccagcccatggcatgtaccattctaccttcagtctctatgaatctgagtactctaggtcaggggtgcccatcccccaggccacagaccagtaccaatccatggcctgttaggaaccgggccacatagcaggaggtgagcagcaggtgagcaagcaaagcttcatctgtatttacagctgctccccatcaatcacattatagcctgagctctgcctcctgtcagatcagccgctgcattagattctcacaggaccatgaaccctattgtgaactgttcgtgtaagggatctgggctgcacgctccttatgagaatctatgcctgatgatctgtcactgtctcccatcacccccagatgggactgtctagttgcaggaagacaagctcagggctcccactgattctacattatggtgagttgtataattcattacatgttacaatgtaataataatagaaataaagtgcataataaatgtaatgtgcttgaatcatcccaaaaccatcccagccatcccctggtccgtggaaaaattgtcttccacaaaaccagttcctggtgccaaaaagtttgaggactgctgctctaggtaccaaatgtaattggaatcacacggtatttgtctttttgtgactggtttatttcacttagcataaagtccttgaggtgcatcagcgtagcatgtttcagaattttcttgctttaaggctgaataatatttcattttaggtatattccacattttttctattcactcccccagttcatggacacttgggttgcttcctccttttggctatcgtaatcctgctataaacatgggtgtacaaatatcacttggacaccctgctttcagttcttttgggtatatacccaaaagcagacttgctgcatcatatgatacttctgtgtaatttttgaaggaaccactataccattttccatggtgggtctacacaccattttatattccaccacagtacacagggtgcagttttctacattcttgccaacatttagttatttttactttttggcagccattctgttgggtgtgaggtgggatcccattgtagttttgatttgcattttcccaatattgcacgtattgtatttgcttattggccatttatttgtatatctgtttggaaaaatatctattcaagacctaggcccatttttttctgttttgttgttgttgagcacccctagatgttttcagatttctgcttgaagcaatacctgttatctaagtgttttctcattatgtttctttttttttttaagttacacctgcacagcagcctttcaaataattacacattcacaaggtagaatatggaaagaattaacgctaggacaacattaaagaatactgattagtgtgtatcagtgaaggaacagcagacatttttaaaattatgagaaggggttttaatgttttgtctatgccatctttgtttctaatatttagttttctaatctgaaaaccaatcctgagtttatcaaggttgtggcataattttctttcgacgttaaattcttcagaccactagtttctcctttcctaaactacttgagtgtattaaatggtaccttgctaggtgaaagagataatttaccccttaataataagtagccatctcatctcaacttttattcggatatcactaaaagaaattataaagtatttattaaagaatgaatgtctactattatctagttcaacataaaagaataacaatagcctcatataaacatgtgacagggagtactatttacttcttagcgttcagcctatgagttagccctgcatgttctgatctgggactataagtaacactgttatgtctcctttgtatggtaaaactgttagtactgtgtattactgaaaaccttttaaaagtagttctgcttacatggaaaaggtttaaacatactaaatgtcagatacacagtcaagatgataaatttaataggaaaatctatttatatatggtattgtgccagaccccttgatgaggatacaaagataaacaatacaaggtcagcccttttgctaaagggctagtgagattactgctaagatttgtataaaactttagaccactgtcagaaaagattataacatgattaattgtaagataacatatatagagtgcccatgtgaaataaatttctttttttgctgagaacttgattgaagtaggaattcatgggtcctcaattcatcccgtcacactggctagctccttaataatgttgtcttaaaatcaagaaactgtgagaataaggatttgatacaaatataaattcagtaagatatttttagttctaaataagggcaaaataaaaattttctcctagccgggcacggtggctcacacctgtaatcccagcactctgggaggctgaggcaggaggatcacgaggtcaggagatctagaccatcctggctaacacggtgaaacctgtctgtaataaaaatacaaaaaattagccgggcatgttggcgggcacctgtagtcccagctacttgggaggctgaggcaggagaaatgcgtgagcccgggaggtggagcttgcagtgagccaagatctcaccactgcactccagcctgggcaacagagcgagactccgtctcaaaaaaaaaaaaaaaaaaattctcctaaatataaattcagattctttcttctcatgaagtttcattaattttagaaaagatggtataattattctgaaaataagtgtttgagtcccattatcaggtatatagtacagctgtgattaaatctgtagagaacaaatattctccttattggcagtggttatcaaactctgttgtttttaaaaatcctgatgtccattgttattatccagtaggacttttaaaacatattattgggaaaatgagccaggaatttagtaaattggtgatgtattacagctttccctttgatgcatatatcgtttgtttagtacatttttagcttcgattagaataatgattctcagacatcagcatacatcaaatcacctagagagttaattaaaacacacctttccaggccccaccaccaaagtttcagctgagtaggtctgctatggggccacagaattttcatttctaataacgtcccaggggctccttcaggagtccaaagagcctgagaaatcttagataaggatgttttacaactataattatacacaaagtttgaagtatacatattatattttctcttttttctctggtttaaagcttaataggtatttaggagccactgacctaaatgacctataagtaattcagcttctccatatccccataattgaaagttttcgtcaagtgtaatgatatctaaaaatataatgtaggaaataaacttctgttgttgttactaatcattgtcatcatcacttttgttaatatctgttcaaggtatatcattttcctggggtaaagagagctatcaaattatttctaatttttaatccctactatgtagaaatgtacaaatgaataattagcagtggcccctctgaatttgaaatgccattttaactttttgtgtggtaaattttgtgaaactatcaagtatagtcatgcatagcttaatagggagagtaagttttgcaaaatgcattgttaagctatttcatttgcaaacatcatagattgtacttacacaaacccagatggtatagcctacttcacacctagactagatggtatagcccaggggtccccaaccccctggaccgtatgggtccctggcctggtaggaaaggggccacacagcaggaggtgaacagcaggcaaacaagcaaagcttcatctgtatttacagccgcaccccatcactcacattatggcctgagctccacctcctgtcagatcagtggcggcataagattctgataggagtgcaaaccctattgtgaactgtgcagcactgccagggatctaggttgtgcactccttatgagaatctaatgcctgatgatctgtcactgtctcccccagatgggaccacctagttgtaggaaaacaagctcagggctcccacgattctacattatggtgagttgtataattatttcattatatattacagtgtaataacaatagaaataaaatgcaaaataaatataatgtgcttgaatcatcccaaaaccatcccccacccccggtccatggggtccatggaaaaattgtcttccacaaaaccagttcctggtgccaaacaggttggggactgctgctatagcctattattacgcctaggctacaaacctgtacagcatgttactgtactaaatcctgtaggcagttataacacagtggtaagtatttgtgtatgtaaagatacctaaacatagaaaaggtacagtgaaaacagagtataaaagatttttaaatgttaccacacttaccatgaatgtagcttgtacaactagaagttaactctggggtgagtcttgagtgaatatgaagtcctaggacattactatgcactattgtatattttatacacactgcatgcttaacctacactaaatttggtttttttgttttggtttggtttggtttggtttgggtttttttggagtctcgctttgttgcccaggctggagtgcagtggcgtgatctcggctcactgcaacctctgcctcccaggttcaagcaattctcctgcctcagcttccaagtaactgggattatgggccatgatgcccgggtaatttttgtatttttaatagagatagggtttcaccatgttgcctaggctggtcttgaactcctggcctcaagtgatccacctgtctcagcctcccaaagtgctgagattacaggtgtgagccattgtgtccagcctacactaaatttgttttaaaaaatatttttcttcaataataaattagccttagcttactgtaacttctttaccttgttaacttttaatttttttagttttttgacccttttgtaataacttagcttaaaacacaaagacattgttcaggtgtacaaaaattttttttaatgttttatttttactttttaaacctttagttaaaaactaagacacaaacacccacattagcttaggcctgcactgagtcaggatcaccaacatcagtgtcttccacctccacatcttgttccactagaaagtcttcaggggcaataaacacccttggagctgtccatctcctatgatgacaataccttcttctggaatacctactgaacggcctacctgaggctgttttacagtgaactttttgtttttaaaagtagatggagtacaccctaaaagaatgattaaaagtacagtatactaaatacataaatcagtaatatcatttatcactatcaactattatgtactgtacataattgtatgtgctatacttgtatacacctggcaacacagtagttttgtttacccctgcatcaccacaaacatatgagtaatgccttacactatgacatcatgacagctaagatggcactaggccataggaatttttcagttccattataattttatgggaccaccatcttttatgtggtccattgttgactgaaatgtcgttatacagtgcatgatggtaatttgatgtggcattctaatacgctggcaaagctgggaactaatatttgagctcaagttactcatcctataattgtttcaagtaaacgtatagaaaagattagacagttttgtggttgatggccgaataattttgctgttttctttataagatttgattgcaacagaaccaatattttgttttcttaaacttcaatccgtaataacagtctgattccactacctaccacaatgtaatctctgagccctataaaaagaaattatactacagagcttatcatatctcagcattccctaatttgaaatacaaaatcaatggggcaaacatactgaagtaaagtcagagaaaattattttgtcatgtagttctcatgatgaagaaacaaaaaagatcccctcacgtttctggcaggggtgagaaacagtaaccattttgaaatgtggccaaggctctctccatctctagggaacagactttactcaggccaaggcacttgcctggctccaagccctcagccttcctgtctcacccaagtgggtgttgtgcaactcagaccagggatgtagagctaccaaaagactgttgatgaaaaagccaaactctgtcaactatttaaagaggtttattgtgagccaatttgagtgaccatggcccggggaacattctcaggatgtcctgagcaagtgtggcaaggcggtcaggttacagttagattttatacattttagggagacagaagttataggtaaatacataaagcaatacatgtaagatatacattgatttggcctggaaaggcaagacatctcgaagggtaggggcttacaggtcacaggtggattcaaagactttgtgattggcagttggttgaaagagttaagctaaaaacttagtagaaagaaaggcttgagttaagagaagggggattgtggaggccaaggttcttgttatgtggataaacctctaggtagcaggtttccgaaactagaaggtaactaactgttttcagaccttaaaatatgtcagactcttaatctctcctagatctgagaaaagcctagctgcataattggagattgtctgcaaatgtaacatttcctccacaaaagacagctttgcatggccatttcaaaatatgttaaagaaatatatcaatattttggagttaagtacttttatttccttcagggcctgctatctgtcatgtgatgctataccagagtcaggctggaatctggtaactttttgccagagagtgttttgtcagccttaggatctctaaattttgttgttgttgttttgttttgttttgtttttttgagacagggtctcgctctgtcacctaggctggagtacagtggcacaatctcggctcactgcaacctctgcctcctgggttaaagcgattctcctacctcagcttcccgagtagctgggattaatttttgttttttcagtagagatggggtttcaccagttggccaggctgctcttgaactcctgacctcaagtgatccacctgcctcagcctcccaaagtgctggtattacaggcgtgagccatggcacctggccaggatccctattttaatgttaatgctgatcagttgtgcctaaactccaaaagggagggagtacagcaaagcgtgggcaacctcccttccaatcttgaatgggaattcagttttcaggtttcctgtggcccaggagggctcagttcagttggttgcggggcttgggattttatttttggttttcaagactgattattctaaaatcataaaattttagaatgcttccccccacctcagcactttaccaccacaccccagggctcaatataatagtggagcattgtaagcaaacaaactgcaagagcagacgataaggaaaattagagtatcagaaggagaagagagaacagagcaaaagaaataggtgaagtaattaatagccaagaatcttctaaaagtaatgacacaccaaaccacaggttcgggttgctcagaccacaccatgcaggataaataccaaaaaaaaaaaaaaactacacttatgcatatcattgtcagactgcagaagagcaaagacaaagaaaaatcttgaaataagctagaggaaaaaatacctatagcagaacaagattagaattacagctaccttcttctcagaaagcatgcaagtaaaaagaaaatgcagtgaaatatttaaagtgttgtaatgccaaaagaaaaaaacaccaacctacaattctgtatccagcaaaattatctttttaaagtgagggagaaatacactcataagtgggagttgaacattgagaacacatggacacagagaggggaacagcacacactagggcctgttggggggtgcagggtgaggggagggaacttagaagacaggtcaataggtccagcagaccaccatggcacacgtatacctatgtaacaaacctgcacattctgcacatgtatcccattttgttttgttttttagaagaaattaaaacaacaacaacaacaaaaagaaagtgagggagaaataaaggctatcagacaaacaaaaactgaggaaattgattaagaaatgaggacattgatcaagaaatgttaaaataagttattcaaggagaaggaatatgataagtcagaaacttgtatctacataaggaaggaagaacattagagaaggaatacctggatgtaaaataaggtcttttatttttcttattcttaattgagctaaaaaaaactttgtttaaagtaataatagtagcagtgtactaggtgattgtggcatatggataaatgacatgagagacaggaatgccatagagatgagaagagaaaattgggagtactgttatttacttcaactggttctttcctggaaatgacaatcaagggtctcctttctaccagttttgtgtgatgattcttccagtgaaacaataatgggctataaaactttaataacctatgtcttcaaaattgagtgattttgtagcaccaccaccctgccctcaacatacaaacacaaccacacatttacaaagaactaaagaagagatgaggttaaataagggtaaggggtaggaaaaataaaataaaaagaaacttataaggacaaatctataaaataagtaggagcaagtgaaaaaaagatgaaagcaagagaataaatagaaattgttaagagagtcttagagaatggacaattgaaaagttcaagagcatcagaatcatttgtaaagtgtgtgttagctgtggaggtgtgggggatggtgcacatatacagcaaactccacagtgggttgctctgaagatttttttattattattcaaaaatttattgaggggagtcgggggcaaggggagggagagcattagaacaaatacctaatatatgtggggcttgaaacctagatgatgggttgataggtgcagcaaaccaccatggcacatgtgtacctatgtaacaaacctgcacattctgcacatatatcccggaacttaaaataaagttttaaatatatatatatattaagtagaaaaagtatttttgaacatctaccaaatacaagctgtaatcccaggcacattgaggagaagtgtgaaatatattcattgtcctaaagagtctataatttatttgcagcgctagagaacaagatgagctgctaatgaaagatttctcagaagggtgtttataagtgactgacttcactattcattagccctttcttctataaacttaggtgtccagaatggagtcttatgaaagaactaggattccatattctacaagacgtcctagaaatctgatacccttgaccttgtttgctggataactgtgcatgatactttgccaggtgctgtgaatatgaaaatatacttagatgaggttaccattatcaagaactttatatattaggagccagacatatacatttgaaaataccctcataaatagtcattacaaagcaataagtgcaatagagttcaaagaaagaccattattgactgaattgatcaggtaacactttgtcaaggaagtcgtcatttgaaggattggtatgcatggaccagaagaagtgagtaagaagaaatgcagatgtagcattagcaaagtcaacataatgggaaatgtaactttattaggagaatacacacaaaaataatttaacaatcaaaaaagaaaaatcttgttctggttttttaacgctatagtagacacaaaaactataatatctttaaatgttttctctttatttcttaacttcattgaggaaaaactcatattctagacagatattcccattggtttcacttagttgctctagaatttctgaataacttggtaaatagcctggaattttattttttaattgttctttacacaaaacatttatttttcattacagtttagtgaacagtttactaaccataataataatacatttaacttaattatgtatattcaccaaaagtagtaattgagaagattaatcctcctttatttcaagattttactttatttgtatttatttatttgagacaaggtctcactctgtcaccaaggctagagtgcagtgctgtgattataactgactgcagcctcaacctcctgggctcaagagatcctcccactgcagcctccctagtagctgggactacaggtgtgcaccaacacacccagcttattttttattttttgtagaggtgaggtttcaccatgttgcccaggctggccttgaactcttgggctcaaaatatagccttggcctcccaaagtgctatattttacgttttaaagatgtcaataaaaaatctaaaataggccttttgaatgtaggttttgttgaaacagaagaaacgaaaattatttaataaaataaaataggcctggttgcccatttttttaaatatacttaaatgtaaaggatagataagaaagaacaaaagaatgaataatgagtgaaaaatcttttaacctctgcaggcctagatctgaaaaaaaaaaaaatttttttaataaaattaaaataaaattttacaaaatattttaaccactatagttttgagatcttgtggtttcccatccaacatgtaaagaggttggaagttgtactcttatcctcaccaaaaaaaaagaacaaactgaaaatcaacagctcttcttagatccatcaaagaatgaagacacgggacagaccactgcccccaaaaccagaacagacaaatacagagaatcacagattactgagtagaagccgcagctagagccagcaactggtaggaacacttcaagggcgattgactaattgctagagactgagaatgagactcgtttaaaacattaagaactcctggaggcccagccttagagtacctatcaagttctcagggtcaaaagctgaggggaaaatgcccttgtgtttctgtgtgtgtagagggaagagagtaaacattttaaaaaacaaacaaacaaacttccagagttactgctctccttaacaaaggcctgtcctcaagggaaactattttaccaacacctaaccaagctgggttttaccagagtctaactgacatgagagaagtgaaatacccaactccagccccctttagcctatctcacctaaggggcaggtgggtggttggggggacaagactaacagttaaaggaccattaaacacttaccctcccctgacgccttgccatcacattaatcagtctgctatataataatagggattatagttgagcaaagctcaggccctatttcagaaggaatctctagtgtttcataatgagaggatgaagaagtcaataacaataaataataaggagtctctagggaaacccaaatactacagaggaaacaaaaataagcattagatgatgttttcgtctctgacatctacagctgcaactaccagcaaaggcagcctaactcatagctagataacctcacactaaatgactacttaccatgttccttttatgcaatacatcatgtacagctttcaacaacaaattacaagccacactaaaaggcaaaacaaacaaaagccacacactctgaatggataaagcaagtagaagaactagactcagttatggcaaagactgtcaaattatagagacagggaatttaaaataactgtgggctaggtgtggtggctcacacctgtaatccagcactttgggatgccaaggcaggcagattgcttgagcccaggggttcgagactgggctcgagaaataacaaaaattagccagacgtgatggcacttgcctgtattctcagctacacaggaggctgaggtgggcctaaagcccaggatatcgaggctgtagtgagccaagatcgcatcactgcacttcagcctggatgacagaccaagaccctgtgttaaataaataaataaagggcaggcgcggtggctcacgcctgtaatcccagcacttgggcaggccaaagtgacctctggcctcacctgaggtaagaagtttgagaccatcctggccagcatggtgaaaccttgtctctactaaaaacacaaaaaaattagctgggtatggtggtatgtgcctgtaatcccagctacttgggaggctgaggcaggagaatcatttgaacccaggagttggaggttgcagtgagcctgtgattaatatgctaagagctctgatggaaaaaatgctagaaataaaaaacactgtaatacaggcatgtccaatcttttggcttccctgggccaaactggaagaagaagaattgtcttgggccacacataaaatacactaacactaatgacagctgatgaactaaaaattaaaaaaaaaaaaaactcatgatgttttaagaaagtttatgaatttgtgttgggccacattcaaagccaccctgggccacatgtggcctgcgggcagtgggttggacaagtggcttgctgtaaataggaatgaagaatgcctttgatgggcttagacctggccaaggaaagaattagtgaccttgaagatatgtcaactgaaactccccaaactgaaaagtgaggagaaaaaagaaaaatacagtttaccttaatgaacattcaggtataaaatgctacactaatggcccccaataattcatgcctccccagtattcataccattattagccccaacccacactgactttggccaaggagacatcagcgaacatgacccaagcagaaccctgatagcccttatactgtgggacttgccctcttggagtgtggccctgagatagcatgtgaaaaaagccaggctattctccttcaggatgaaagaccatgaagaggcaggccagtgcagtcatcccaccaaaccccaaccccaggtaacaccagctgagtgtagctgcatgaataacttagtcaaaaccagcagaaactgcccagtcaacccactgaatcatgagaaataaaatgattctagttctaagccagtaaattttaggttaatttgttacacaacaataattgcaagaaagaatgtagtattctgctttgcttcatgagccaaatataagcaaatttacaaagatggaagtattgacacggataaagacatatgttcgggaagctcaggcatgagtggataggaaagggatagaaacatagagaagcagaaggtgacaatttaagagtttaaaagaatatgcatactgacactcacaactttaataatgtcctctaggaagaaggtacacatgaaagaactgactttgctaaaggaaaaatttaaaggtgtttttgtgttttatgtctattgacagctagtaactgcctctaggtctctccaagttgagtaacatgtatgtaataatagctacctagtctaataaacatttcgtttaaaatcacatgtttcagtaaaaataacctatcttgcaacttgggactaaaaaaactcttctcaccttttgttttaaagtaggtaagcatcttttatccatgtaccagaactaaacagttttgctcccttgtcttttttttttcttcctactaaaaaaaggccccttataagtgaaatgaccattgttttccctctcagagaggtacagatctccaacaaggaaaattaagtgcactaagtcataagtcaagctttcccatttagctcatttttacaacattgttcactttggaacctgagggattttttttttaatccagaggatgacagctaaaacataattgcacataacctcagaaaagtttaccaccctaatacaactcaaaaggaacacctaccattaaattggaactccacaagcaataacacctaatgcagtttggttttatgggagctgtgtggatttcctttattgtatccctttgcattatttttcacatgcatttgcaatggctttttaccattccttcattagaggcttttgtgaattaaggttagaaaagcagttaacaaaatcaaactactcagttcttcaaaaaattaaacacagagttagcatatgactcaaaattccactcctaggtatattcccaagagaacagaaaacatgtccacataaaacttgtacatgaatgtccatagcagcattattcataatcccccagaaagtggaaacagacgaaatgcccatgaactgatgaatgggtaaaccacagatatggtatattcatacagtggaatattattcagtcacaaaaacatgaaacgtgcaacaatatgatgaaccatactaaactattctaagcgaatacagccagacacaaaaggccacatattgtccaacttcatttatatgaaaggtccagaataggcaacttcatagaggtagaaaggacagtagtggttaccaggggctggagggaggaagaaatgggaactaagtgctcttgggtgtggggttttttttgtggtaatgaaaatattctggaattggtgtcagttgcacagccttgtcagtgtactaaaaaccactgaattgtacactgtaaactggtgggttttgtggtatgtgaattatataccaatttaacacaaaagaagaaacataaaaactactcacattctaaatgtataactgggaagtaggctgacaagagcttgaaccagggttccaatttcttcatttattccaaaaaagaaattagaagaaccttcattaaaaactgtttatggggctgggtgtggtggctaaagcctgtaatcccagcactttagaaggctgaggcaggtggatcactgaggttgggagttcaagaccagcttggccaacatggcaaaaccctgcctctactaaaaatacaaaaattagctgggcatggtggcacacacttctaatcccagctacttgggaggctaaggcaggagcatcgcttaaacccaggaagtggaggttgcagtgagccaagatagcgccactgcactgctttgtagtttacaaagcactttttttgtattttttttttcttattatactttaagttttagggtacatgtgcacaatgtgcaggttagttacgtatgtatacatgtgacatgctgatgcgctgcacccactaactcgtcatctagcattaggtatatctcccaatgctatccctcccccctcccccctccccccaccccacaacagtccccagagtatgatgtttcccttcctctgtccatgtgttctcattgttcaattcccacctatgagtgagaatatgcggtgtttggttttttgttcttgcaatagtttactgagaatgatgatttccaatttcatccatgtccctacaaaggacatgaactcatcattttttatgactgcatagtattccatggtgtatatgtgccacattttcttaatccagtctatcattgttggacatttgggttggttccaagtctttgctatagtgaataatgccgcaataaacatacgtgcacatgtgtctttatagtagcatgatttatagtcctttgggtatatacccagtaatgggacggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatagccagtgatgatgagcattttttcatgtgttttttggctgcataaatgtcttcttttgagaagtgtctgttcatgtccttcgcccactttttgatgtggttgtttgtttttttcttgtaaatttgtttgagttcattgtagattctggatattagccctttgtcagatgagtaggttgcgaagattttctcccattttgtaggttgcctgttcactctgatggtagtttcttttgctgtgcagaagctctttggtttaattagatcccatttgtcaattttggcttttgttgccattgcttttggtgttttagacaggaagtgcttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctaaatatggctagccagttttcccagcaccatttattaaatagggaatcctttccccattgcttgtttttctcaggtttgtcaaagatgagatagttgtagatatgcggcattatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcgggctcttttttgtttccatatgaacgttaaagtagttttttccaattctgtgaagaaagtcattggtagcttgatggggatggcattgaatctgtaaattaccttgggcagtatggccattttcacaatatttattcttcctacccatgagcatggaatgttcttccatttgtttgtatcctcttttatttccttgagcagtggtttgtagttctccttgaagaggtccttcacatcccttgtaagttggattcctaggtatttgattctctttgaagcaattgtgaatgggagttcactcatgatttggctctctgtttgtctgttactggtgtataagaatgcttgtgatttttgtacattgattttgtatcctgagactttgctgaagttgcttatcagcttaaggagattttgggctgagacaatgggattttctagatatacagtcatgtcgtctgcaaacagggacaatttgacttcctcttttcctaattgaataccctttatttccttctcctgcctaattgctctggccagaatttccaacactaggttgaaaaggagtggtgagagagggcatccctgtcttgtgcctgttttcaaagggaatgcttccagtttttgcccattcagtatgatattggctgtgggtttgtcatagatagctcttattattttgaaatatgtcccatcaatacctaatttgttgagagtttttagcatgaagggctgttgaattttgtcaaaggccttttctgcatctattgagataatcgtgtggtttttgtctttggttctgtttctatgctggattacatttattgatttgcgtatattgaaccagccttgcatcccagggatgaagcccacttgatcatggtggataagctttttgatgtgttgctggattcggtttgccagtattttattgaggatttttgcatcaatgttcatcaaggatattggtctaaaattctcttttttgcttgtgtctctgcccggctttggcgtcaggatgatgctggcctcataaaatgagttagggaggattccctctttttctgttgattggaatactttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagggtgtatgtgtcgaggaatttatccatttcttctagattttctagtttatttgcatagagatgtttgtagtattctctgatggtagtttgtatttctgtgggatcggtggtgatatcccctttatcattttttattgcatctatttgattcttctctcttttcttctttattagtcttgctagcggtctatcagttttgttgatcttttcagaaaaccagcttctggattcattaattttttgaagggttttttgtgtccctatttccttcagttctgctctgattttagttatttcttaccttctgctagcttttgaatgtgtttgctcttgcttttctagttcttttaattgtgatgttagggtgtcaattttggatctttcctgctctcttgtgggcatttagtgctataaatttccctctacacactgctttgaatgtgtcccagagattctggtatgttgtgtctttgttctcattggtttcaaagaacatctttatttctgccttcatttcattatgtacccagtagtcattcaggagcaggttgttcagtttccatgtagttgagcggttttgagtgagattcttaatcctgagttctagtttgattgcactttgtctgagagacagtttgttataatttctgttcttttacatttacttccaagtatgtagtcaattttggaataggtgtggtgtggtgctgaaaaaatgtatattctgttgatttggggtggagagttctgtagctgtctattaggtccgcttggtgcagagctgagttcaattcctgggtatccttttgactttctgtctcgctgatctgtctaatgttgacagtggggtgttaaagtctcccattactaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggttttctgaatatagcacactgatgggtcttgactctttatccaatttgccagtctgtgtcttttaattggagcatttagtccatttacatttaaagttaatattgttatgtgtgaatttggtcctgtcattatgatgttagctggttattttgctcattagttgacgcagtttcttcctagtctcgatggtctttacattttggcatgattttgcagcggctggtaccagttgttcctttccatgtttagcgcttccttcaggagctcttttagggcaggcctggtggtgacaaaatctctcagcatttgcttgtctggaaagtattttatttctccttcacttatgaagcttagtttggctggatatgaaattctgggttgaaaattcttttctttaagaatgttgaatattggcccccactctcttctggcttgtagcgtttctgccgagagatctgctgttagtctgatgggcttccctttgtgggtaacccgacctttctctctggctgcccttaacattttttccttcatttccactttggtgaatctgacaattatgtgtcctggagttgctcttctcgaggagtatctttgtggcgttctctgtatttcctgaacctgaatgttggccttccttgctagactggggaagttctcctggataatatcctgcagaatgttttccaacttggttccattctccccgtcactttcaggtacaccagtcacacgtagatttggtcttttcacatattcccatatttcttggaggctttgctcatttctttttattcttttttctctaaacttcccttctcgcttcatttcatctttcattgctgataccctttcttccagttgatcgcatcggctcctgaggcttctgcattcttcacctagttctcgagccttggttttcagctccatcagctcctttaagcacttctctgtattggttattgtagttatacattcttctaaatttttttcaaagttttcaacttctttgcctttggtttgaatgtcctcctgtagctcagagtaatttgatcgtctgaagccttcttctctcagctcgtcaaagtcattctccgtccagctttgttccgttgctagtgaggaactgcgttcctttggaggaggagaggcgctctgctttttagagtttccagtttttctgctctgttttttccccatctttgtggttttatcttcttttggtctttgatgatggtgatgtacagatgggtttttggtgtggatgtcctttctgtttgttagttttccttctaacagacaggaccctcagctgcaggtctgttggagtacccggccgtgcgaggtgtcagtctgcccctgctgggcggtgcctcccagttaggctgcctgggggtcaggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctcctggagctgtggtgggctccacccagttcgagcttccaggctgctttgtttacctaagcaagcctgggcaatggtgggcacccctcccccagcctcgctgccgccttgcagtttgatctcagactgctgtgctggcaatcagcgagactccgtgggcgtaggaccctccaagccaggtgcgagccagatgcgggatataatctcttgtgcgccgttttttaagcccgtcggaaaagcgcggtattcgggtgggagtgacccgattttccaggtgccgtctgtcacccctttctttgactaggaaagggaactccctgaccccttgcgcttcccgagtgaggcaatggctcgccctgcttccgctcgcgcacggtgtgcgcacccactgacctgcacccaccgtctggcactccctagtgagatgaacccggtacctcagatggaaatgcagaaatcacccgtcttctgcgttgctcacgctgggagctgtagaccggagcttttcctattcggccatcttggctcctcccacctacaaagcagttttataaaacattagaagttaagtactattaattatctggtaatttcctcaccgaatccatgcagtagatgatactgtttgctatagttattctaattctacaaatgaggaaacattccattatattttcgtttttgtacctttaagcatctccaggtcaaggtttgtctctctttcatctgtgtaaaaggcatacagtgtacattcactaaatgtttagatgaatgaatacacaaactaaggctcaagggggtcaagggattactaaagatcaaataaatcagtgttaaagtacatacttttggcattcaaatcccatgtgtttcccataataccatattttctttttttttttttgagagccacctaagtaataacagttgtctctttaatttttgattcccatcgtctactagacatctcatattttatccaaaatggcaaatctctaatgtatgctcccattgctgccagaatgagcatcccttaatacatatttgcccattttattcccctacttaaaattcttctgaatttccctgtttttttgttttttttttttttaattgatcattcttggatgtttctcgcagagggggatttgacagggtcataggacaatagtggagggaaggtcagcagataaacaagtgaacaaaggtatctggttttcctaggcagaggaccctgtggccttccgcagtgtttgtgtccctgggtacttgagattagggagtggtgatgactcttaaggagcctgctgccttcaagcatctgtttaacaaagcacatcttgcaccgcccttaatccatttaacctgagtggacacagcacatgtttcagagagcacagggttgggggtaaggtcatagatcaacaggatcccaaggcagaataatttttcttagtacagaacaaaatgaaaagtctcccatgtctacctctttctacacagacacagcaaacatccgatttctcaatcttttccccacctttccccctttactattccacaaaaccgccattgtcatcatggcccattctcaatgagctgttgggtacacctcccagatggggtggtggccgggcagaggggctcctcacttcccagtaggggcggccgggcagaggcgcccctcacctccctcctggacggggcggctggccgggcgggggggctgacccccccccacctccctgccagacggggaggctggccgggtgggggggctgacccccccacctccctcccggacggggcggctggccgggcgggggggctgaccccccccacctccctcccggacggggcggctggccgggcgggggggctgacccccccatctccctgccggacggggtggctggccgggcggggggctgacccccccacctccctcccggacggggcggctgccaggcggagacgctcctcacttcccagacagagacgctcctcacttcccagacggggtggctgccgggcggaggggctcctcacttctcagacggggcggctgccgggcagagggtctcctcacttctcagatggggcggccgggcagaggcgctcctcacatcccagatggggcggtggggcagcggcgctccccacatctcagacgatgggcggccgggcagagacgctcctcacttcctagatgggatggcagcctggaagaggcgctcgtgacttcctagatggtatggcggccgggcagagacgctcctcactttccagactgggcagccaggcagaggggcttctcacatcccagatgatgggcggccgggcagagacgctcctcacttcctagacaggatggcagccgggcagagacgctcctcactttccagactgggcagccaggcagaggggctcctcacatcccagacgatgggcggccaggcagagacgctcctcacttcccagacggggtggcggccgggcagaggctgcaatctcggcactttgggacgccaaggcaggcggctgggaggtggaggttgtagcgagctgagatcatgccactgcaccccagcctgggcaccattgagcactgagtgaacgagactccgtctgcaatcccggcacctcgggaggccgaggctggcggatcactcacggttaggagctggagaccagcctggccaacacagcgaaaccccatctccaccaaaaaaatacgaaaaacagtcaggcgtggcggcgcgtgcctgcaattgcaggcactcagcaggctgaggcaggagaatcaggcagggagattgcagtgagccgagatggcagcagtacagtccagctttggctcggcatcagagggagaccgtggaaagagagggagagggagaccgtggggagagggggagggggagggagagggagagggcaataataccatattttcaagtctcctgtgttccctacacgtttgttcaagcccattaggtaagctgatatcatgttgttattcaaagcccaaatagatgtcttccacgtaatcactgacatggcatatcataagacttcaaggaaaactaaaacaactgcacaaatttatttactcccaaaccttcagtttattatagcagacatctactaagtgcctactgtgtgccagccactatgctgtattccccgggaatagagcgtgaaaatgaataattacctagactggaagtatctaagcacctcttttaatgaaacttctttctgtctaccacatatttcatcacttcatcctatcagctatctataaactgagttcagatataattcaaaatatgccaaaggagtaacagtcagtcagtggattcctttattcacaatcataactcaactttcaggaaaagaggacaaccgtcgttttaagaagttttctataaacagtgatgatcctaacttccaaaaatctaagaactcagcatttgagcatggagcctcacaaattccccatatactattcacttagggtaatttaagatctttctttctggagccacattctagagatcctagtaccaccacatacttttaaaaggtattaaccacttctctcatggattatggctttccgtgaagacagcttatttctttttttttaaataaaaacaactttatgaaggtatattttacatatcaaaaaattattcatcttaagtgtacaattcaatgatttttagtgactttactcagtacaaccattactgtaaatcagctctagaacatttcaatcccctcacaataaaatccctcttgatcaatttttttatatactttaagttctagggtacatgtgcacaacatgcaggtttgttacatatgtatacatgtgccatgttggtgtgctgcatagtattccatggtgtatatgtgccacattttcttaatccaatctatcattgatggacatttgggttggttccaagtctttgctattgtgaataatgccgcaataaacatatgtgcgcatgtgtctttatagcagcatgatttataattctttgggtatatacccagtaatgggatggctgggtcaaatggtatttctagttctagatccttgaggaattgccacactgtcttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgtataaatgtcttcttttgagaagtgtctgttcatatcctttgcccactttttgatggggttgtttgattttttcttgtaaatttgtttaagttcattgtagattctggatattagccctttgtcagatgggtagattgtaaaaattttctcccattctgtaggttgcctgttcactctgatggtagtttcttttgctgtgaagaagctctttagtttaattagatcccatttgtcaattttggcttttgttgccattgcttttggtgttttagacatgaagtccttgcccatagctatgtcctgaatggtattgcctaggttttcttctagggtttttatggttttaggtctaacatttaagtctttaatccatcttgaattaatttttgtataaggtgtaaggaagggatgcagtttcagctttctacatatgtctagccagttttcccagcaccatttattaaatagggaatcctttccccatttcttgtttttgtcaggtttgtcaaagatcagatagttgtagatgtgtggtattatttcttgtctttatgctgagcactaagtaggactgtttaaaaaccaggagcatttatacagtgacactaaaataacacaggtcttggatttataattttgtcacaaaatccactcacattggaaactagattttcccaaagtccaagtaaaatggtgtgccttagttgaacaggccaggagaagattttaccatcaggcagagcccagctgctatgttcttttttctatgtgggtaaccatccatttaattaaagtcagtgaattttaaaacagaaaaataagaggataagctgtatgatttaacaagtgtcttaaatgtcaggtgactatagcctaaaacatctccaaattttaaaattaaatgttaatatctttattctcagtcataatatcttttggcgtctttttacattcaaaatctattttgtccttttttgttttcacttctgaattctgggtgtcaaattatgatattgtacaattaagtttatcctgttaacaataaatagtcccttagcaattactgtactctatatataggaattagctagctaaatacttcagcaattaatttaaatgttaaaaatcatcactgcagtaatacatttcatcacttgctttctttggccaatattctagcctagttgataatttttatttaaaaggtggtccctgggattttactggaaattagtataacaaccatgatcttctgttatccagaatattcagggcattgggttctcagatcaaaacaaatatttaaataagaagtcattaaaatcactttatattttttaattgatatcttatagaattacaatatgtatatgcggcatttaacatacatattcttttctaaaagtttacatgtcagttgtttgatacatggaacaccttttttgtacatatttaaacatatcaaggaaatagtcacattatcagagtagaccataaactccaatttaattgctagccttttttctggctagaccatctgatttgatatactttatatcaaatactatacactttataatgagtctcatcacattaaataacacaaattattaccccaagttggcatttagaaacaagggagtatgataattgtatagccgggaagattttaatagatatatcagcctggtgatgtggctcacacctgtaatcccagctactcaggaggctgaggtgggaggatcacttgtagctcagagctcgaaaccagcttgggcaagacagtgagaccccttcccttaaaaattttaaaaaataaaaataaattagccagatatgatgtcatgtgcctatactcccagctactctggaggatgaggccagaggatcacttgagcctaggagttcaaggctgcagtaagctatggtgtgatcataggcactccagcctgggtcacagagcaaggccccatctctgtttaaaaaaaaaaaaaaaaaagaagaagaagatgtatgagaaaccctcttagcaatgcaattagactagcagcaaaggaaagcaagtgatagtgtattttttaattgttaattttatcacttatcaaaaaaggcttgaaccattgactttaatagaatactgattactctgataattttgggatgagaaaacaaacatatcaatacttggaacacagtctctttctccatcccatcctgctaccagaaagaagaataacctatcagtcacctaatgggcaaagaacacattgattaggaaatagctgtcacttatagttgaaagactcaaggcagatgtgacaatataacaaatgtatgattctcttaggcagctagaaaattagaaacaggccattaaaatgtacatgctagttagtaagaggaaatgccactggccaaatcatttgtaggttagagtccctatgtaatgacatatgtttaatattaaagctatctgtgaatatatttttctttcagagtcttcgcttcactcttcttaacttctgccattcctgttattatccagcttgccgttctccaaattacatatcttcctcacaaaaaaaaaattgtcttttatctgattctcttactcatattttcttatttaaaaatgtaatttaacagtcacaccaggtggaacaaaaacatggtgtttctcttagaattcccctgtgagtaatgagaacagtcctgaaattttcactctgccaagtgtaaccctttgaactatctggaatgagccagagaacttcagcttagtagtgtaggtcacaggctagtccatagccacagtgtctttttcatattcttaccctgcagggatataactggattaaactcttcctgagcaaattggcgtccctcattaaagatcaacaagagtaaccaggctcattccccagagaactgcatcaacagcccaactttaggtctacaataggaacctcccaaagctcaaggtgtgctcagtgagcttagacacaccaatgaagcacaccctggacttgtaaacattagccgggcacagtggtacacacctgtactcccagctactcaggaggctgaggcagaagaatcccttgagttctaggctgtggtgatctacagtcacatctgtgactaaccactgcactcctacctgagccacatagcaagactgcatcacaaaaaattgccacaaaagtcaaaacatgccatggtagctggaacctttgactgggtatacaatgttcccgattcccagaacatgtatcataagaccccacaaataggatagagaggcaaggagtaataggagcaactggcattggagaggttgctccttgtcattagaagtccttttcatagagcagtaagacaaatactgcacttctttttcttctgaagacaaaatcttggatgatgataaaggctaaagggcatgggatttggaattaggctgctgaaattaaatcccagccctatgtaatgaaataatattaaagctatctgtgaatatatttttctttcagagtcttagcttcacttttcttgtttatttaattaaaattaaaataatttaaatttaaattattaaataatttatgtattaatataattaatttaattaaaattaaagttttaaattttcttaaatttcctcatgataaagataataatattatctaccctcatacaattattgttaagaatagttgaaatagtacacaagaagtacttgccacagattctggcacattataatcattcaaaacctgtcaaatcttttattatttcttacagaaaatattctaatttttatcctttattctcttttggtgttctttgtctccattttaattaatgtcagtatagtattgcttcagataccatgattatcagataagatgacagactgtttcagatattgttactgtcagtttgagattaacaacttcttggaacaattttctcttcgagttacacaaaatattgattatctgaatgtgtccttttatcttatatcttcttttcatcgagatatcatttttccttgactcagggcagtgccagtagagttgtaggtattaccgttagatgaaaattccttgtggtttaaaacctttcagagaggccgggcgcggtggctcatgcctgtaatcccagcactttgggaggcagaggcgggtggatcacctgaggtcaggaattcgagaccagcctggccaacatggtgaaaccctgtctctactaaaaatacaaaattagccggacatggtggtgtacgcctctaattcctgctactcaggaggctgaggcaggagaattgcttgaacgtgggaggcggaggctgcactgagccgagatcgtaccactgcactccagcctgggcaagacagagcaagactctatctaaaaaaaacataaaaacctttcagagaaatagaattcagtgttatgttgactcagagaaaaacacatacacgcgcacacacactcatgttcacataccaagaaaggtaagttttcagtgacttttttcttcagctagtgggtcttcctcttcctacctgttatatcagcgtgtatgtattatttaagttctatttttgacaaatagatgtcagagctagagtattctagcgctagaatctaatacttcatatctagtatttgtagacagcaaagttggcttcaatatcttgcctaaaaatagaatgcatgggaattattacaatgtaatatatctcctatactgcattgttaattaattcaggatcctaaattacaacataacctgaatgacattaatcaaagttgcatgtcagtgtagtattctcatggagaataagaacaaagcaaccttgaaaactttttttgtttgtttttgttttttgttttgttttgttttttgagacagttttgctcttgttgtccaggctggaatgcagtggcacaatctcagctcactacaacctccacctccctggttcaagtgattctcctgcctcagcctcccaagtagctgggactacaggcacgtgccaccatgcccagctaattttgtatttttagtagaggtggcgttccaccatgttggtcaggctggtctcgaactcctgacctcaagtgatccacccacctcagcctcccaaagtgctgggattataggcgtgagccactgcgcccagcgaaaacttattttttaaaaattacataaataacatgtacttgaagtatattggaaaatcagactataatgcaagcctggacaaaagcacacaggcatttgaatctggtggttggagtgtctgatatcacaaatgcctttaatgtatttattataaaatattaaaaacttatcacagatacttttggtagacaatcgtgatgtgctaacatttatgtggtataaattgatatagtattttttgttgtctaataccatatttcaactgaaatatgttacaagtgttaggtctgacacatttggaggattaaattttctttcaattatttattaatttaacaaaaatatattgagtggctaatatatgctaggcctgttctagggtcttagaatacagaagtgaataaaacagactcaaatctcagccctcatagagattgcattctagtgggggaagacagacaataggcatactaagtaagttatttaatactatctagtgttaggcagtgttaacgtactgtgggtgggaggaagagggaataaagcagagtaaaagggattgggattgctgggcaagagggtctttgattgtatgtaggattatcagagcaagcctctctgagaacatatcatttgaacaaggatttgaaggaggtaagggagttagacatgtagttatctttggaaggctattccaggcaaagaagaaagccagtgcaaaggccctaatatataagcactcctagattttccaaggaacagtgaagaggccagtaagttgcagcagaatgaaagagggaggttacagagtagaaaatgaagacacagttaaatgggaagtggagagtgtacactaagtaggacataggacaagactgtaatctgagtgaaactgcagactagaaggaacaacagttaaagcaatgagaccaactagaagctattaaaatacttcagtttaggaacatacctatttggggtaaataataagaataattcaggcaaaagttggtggtggcttggaccaaggtggtagcagtggaaatagaaattagtgtctagagtttgtatatattttaaattgtggatatttattcaatttcttggcagattgaatatagggtataagaaaaagagaggcctgtaactataactatagggttactggcatgactaagtggaaagttggaatggccataactgagatggagagcaggtagggggaataaaatcagggattatggggggttttttggttgttgttttgttttgaaatggtgtctcactctgttggccaggctagagtgcagtggcacgatcatggctcactgcaacctgcgcctcccaggttcaagcgattttcctgccacagcctcccgagtagttgggactacaggcatgcgccaccacgcctggctaatttttttgtaccttttagtagagacagggttttgccgtgttggcctggctggtctcaaactcctgacctcaggtgatccacccgcctcagcctcccaaaatgctgggattacaggtgtgagccaccacacccaggcctggggattatgttttgaatatattaacttggtaatatgtgttagacatgaaaatattgatgtttagcatttagtttgatatgagagcctagagttcagagactggcagtctatgctggaattatacatttgggagtgttggggactaacctaagtcaagttaattatatataagtcttaggttcttttggcaataactgtagccattaaagaatgtaacagttaccaaacattggtaactactttccttactgccagtaaacataaaagaaaatctctaaccaaattctgtgcaaataaagacattaatgaaataaacattcattagcaagcagatacaaaactattcatatattttatatactctctgagtatttaggtaatccagccactactttgcatgaatggttaacttaaggaagataagacatatatcacaaaactaaacaatatcttgagataactaaaaacaaaacacaaacaaaaccaaacatattggatgaagcaaaagcagtactcagagggactttatggctgtaaatgcaatgttaaaaaaaaacaacgatctcaaatcagcaacctaattttataccataaggaacttgaaaagaagaccagactaaactcaaagccagcaggaggatggaaataataaagatttcagcagagataaatgaaatagagaaaaataatcatcatagaaatcaaaagttggttctttgaaaagatcaacaaaattgacaatctattagctagactgagtgtttaaaaaaaaagggaaaaggcaaataactaaaatcagaaatgaacaatgggactttgctgctgaccttatagaagttaaaaggattgataatactataaacaactgcatatcaacaaattagacaatctaggccaggcacagtggctcacacctgtaatcccaacactttgagaggccaaagcatgaagaatgcttgaggccaggagtttgagatcagcctaggcaacacagtgagtccttgtctctacaaaaaaattagccatgtgtggtggcatgcacccgtagtcctagctactcaggaggcttaagcccaggagttcaaggctgcagtgagccatgattgtgccactgcactccagcctgtgtggtagagcaagaccctgtctcaaaaaaaaaaaaaaaaaaaaggcacagtggctcatgcttgtaatcccagcactttgggaggctgaggtaggcagatcacctgaggtcaggagtttgagactagcctggccaacatgacgaagcaccacctctactaaaaatacaaaaattagctgggtgtggtggtgtatgcctataatcccagctacttgggaggctgaggaggagaaccacttgaacccaggaggcagaggttgcagtgagctgacatcataccactgcattccagcctgggtgacagagtgagtctccatctcaaaaaaaaaaaaaaaaagataatctagatgaatcaaagatgtgcctgtaatcccagcactttgggaggctgaggcaggcgcagatcacctaaggtcaggagtttgagatcggcctggccaacatggtgaaaccctgtctctactaaaaatacaaaaattagctgggtgtggtgatgcatgcctgtaatcccagctacttgggagactgagacaggagaatcacttgaacacaggaggtaaaggttgcagtgagccaagatcacaccattgcactccagcctggacaacagagcaagactcttgtctcaaaaaaaaaaaaaagtgttccctagaaacacacacaatacaaaactgacccaagaggaaatagacaatgtcaacctacctgtaacaagtaaagagattgaatcagtaattgaaaacctcctgaaaaagaaaactcagggaccagatggctgcactgatgaaattctaccaacaatttcatgaaaggagaatttcatcacttttactgaaactcttacaaaaactagaaaagcaaatactccctaacacattctgtgagaccagcattactctcataccaaacccagacaaagatactacaagaaagctacagaccagtatcccatatgaatattgatacaaaaatcttcaacaaaatactaccaagcaaatccagcagcacattaaaagtatttatactttatgaccaaatgggacttgtcccaggaatgcaaggattgttcaacttaagacagtcaatcaatgtaatacatggcattaatagatctaagggaaaaataatatatggtcatttcaatagatactaaaaaaaatttgacaaaactcaacatccttttataattaaaacactcagcaaactaggaatagaagggaacttccttaacatcacaaagggcatttataagaaaaatcacagctaatatcatcctgtatgatgaaaagctgaaagcatttcttctaagatcaggaagaagatgaggatgcccactttcactcctgctattcacctttttactggaattcctacacttagcaattcggccagaaaaagaaataaaaatcttctaaattaggaacatgcaaaatgatttctatttgcaggtgacatgattctgtatacagaaaatatcatataactcacagaaaaaaatactgcagctaattaacaaattcagcaaagttatagggaacaagatcaacacccaaaaatcagttgtttccatataccagcaaagaaatttttaaaaaagaaaaaaaaaatagttcagtttgcaacatttagaagagtaaaacacctaggaatatatttaaccaaaaaattgaaagatttatccactgaaaactaaaaaacattgctgagagaaattaaagaaaatctaataaatggaaagacatcccatattcatggattggaaaactttaagatagcaatattccccaaaacaatctacagattcaagtggtctgtttgcagaaataaaaagccaaccttcaaattgatacggaactgtaaggggcctcaaaaagccaaaacaatattgaaaaacaaaagcaaagctgagaggacttacactttccaaattcaaaagttactacaaagctacagtaatcaacaagcatagtgctggcaaaaagacagacatataaaccaatggaatagaattgagagcccataaataaatccaaatatctatggcaaattaatttttgacaggagtaccacaaccattcaatggagaaagaagagtaccttcaacaaatcatactagaacatttgtataatgacatgtaaaaaaaaatgaagtgggactccatataaaataattaactcatatataataattaactcatggatcaaggacctcaatgtaaggggtaagattgcaaaattcttagaagcaaacatagaagtagatctgcatttcctcagatttgacaatggattgttagatttgacaccaaaagcactagtaacaaaatttaaaaatagattagattctgcaaaaatgtaaagcttttttgcattaaaaaacattttcagccaggtgcagtggctcatgcctgtaatcccagaactttgggaggccacagcataaggcttgcttgagcccaggaatttgagaccagcatgggcaatatagtgagaccttgtctctagaaaaaaaaaaaaaaaaaaaaaaacttttaattagccagaggcagtggcacaggcctgtgctcccaagctacttgggaagctgagctgggatcactggagcccaggagatcgaggctgcaatgagccatgattgtgccgctgcactccagcctgggtgacagagcaagagcctgtctcaaaagaaaagtcttttttcttttcaacaaactgaaaagggagaaaatatttgcaaatcttatctctgataaagttctagtatccagactataaaaagaatgtttacaattcaacaacaaaaaaaagcccaattataaaattgacaaaggactagacatttctccaaagaattccaaagtagccaataagcacagaaaaagatgtcctacataattggtcatgaaggaaatgcaagtcaaaaccagactgagttaccacttcagaaccactaagatggttttaatttaaaagactgaaaatgacatgtcagcaaggctgtgaaaaataggaaccctcatacattgctggtgggaatgtaaaatggtgcagctgctgtgaaaaacaatatggcagttcctcaaaaaattaaacctagaatcaccatatgatccagaatttctaatatatactcaaaagaacggaaagcagggtctcaaagaggtatttgtacatccatattcatagcagcaataatagccaaatagttcataatagccaaaaggtactaaacaacccaaatggccatcaacagctggatggataaacaaatcaaagtgtatacataaaatggaatattatttttccataaaaagagatgaagtacttttcatgcgcgtccgtgtaaagagaccaccaaacacgctttgtgtgagcaataaagcttttaatcacctgggtgcaggcaggctgagtctgaaaagagagtcagcaaagggagataagggtggggccgttttataagctttgggtaggtaaaggaaaattacagtcaagggggtttgttctctggcgggcaggagtgggggtcgcaaggtgctcagtgggggaggtttttgagccaggaaaaggactttcacaaggtaatgtcatcacttaaggcaaggaccggccatttttacttcttttgtggtggaatatcaccagttaaggcaaggaccggccatttacacttcttttgtggtggaatgtcatcagttaaggcagggcagggcatattcactacttttgtgattcttccgttacttcaggccatctgggcgtatatgtgcaagttacaggggatgcagtggcttggcttgggctcagaggcctgacagtactgatacttactataacttatatgacccttgaaaacattatgctaagtgaaagaagccagacacagttggtcacatgtatggtaccttctatatgaggtatctagagtagacaaatccatagagaatgaaagcagattagaggttactgggggagtacagggtgttgttatagggtgatgaaaaagtttgcaaacaagagagaattgatagttgcacaacattgcaaatacactaaaggccatttgattctacactctaaagtagttaattgtatgctatgtgaatttcagctcaattagaaaataagaatggactgaaatggatgctttcattgaaagctaatggaaatgtaaagtgatgcaaccctctccttaggaaacaaggtttctatattcaagaataagttctaaacttactactctttgatccagtattctgtatctaggaatgaaagaaactaatttgggtgcaaactaatttgggtgcaaactaaagcattctttttttaatagtgaaggattaggaaaattcctttacctccaacaatatggaattaatttttaaataagatataggcaggaaaattatatttttgtaatgtctgtgtagataccactttagaaaaataattttagaagtatacataataatacatgtcttttacgctgtttcctttggctttctcttaatgggattttggtgtttccatcatttttctctctgcttatttatttttcaagaattttcatgatgactaaatactcataaataatactgagtgaaaataatactaaactatgctaaaatgtgtttatttatgcatgcacttgccttggagaaaaaaagtatgtgactaaaagtatgctaaaatgtaataatgattatctcttcattttaagttgttggataattttacttagattattctccttatacttttaagcttgcttattgcataggcaattttaatagtataaacaggaaaacagaagcctagtttgatgtcatgtagacaaaataagtcttttaacataaggggttgtggagaccaaggttttatcatgaagatgaagtctccaggtagcaggcttcagtgacagtagattataaatgcttcttctcagacttaaagagtctgttctatcagtcttaagggctttgtattgatgttaatgctggtcagctgtgcctgaattccaaaagaaaggagcatataatgaggcatatctgaccctcacttccggtcatggcctgaactactttttcaggttaacttttgaatgcctgaggggagggtccatcagttagagttttatttttggtttacttctgttaagtcagtctttgctagtagtgtcatgaaatcagcttgtgtttaattttgggtttgtttgtttgtttgtttttgagacagggtcttactctatctcccaggctggagtgcagtggtacaatcacagctcactacagcctcaacctccctgggctcaggtgattctcccaggtcaactcccaggtaactgggactacaggcacatgccaccatgcctggctaatttttgtattttttgtagaggtggggcttcaccacattgcccaggctggtctgaaaagtcctgagctcaagcaatccacctgccttggcctcccagagtgctgggatgacaggcataaatggcctgcttttaatttttaattcaactctgtaagaataaattttatcttaataaagatagctaacattattatttactatgtgagatactctacttttaaacattatctttcaatcagctcaattccacaaggtggactaattctgcagcccatgctgttcactatactgttttccagtttcatacacattgttaatgcctatccttaaattcatgttccttttcattataccttactgtttccaacttaagaactatataaataatcaggtaaatatactttccagtgattgcatatttttggataacattagtgatgtttagcagagtccccttgaatattaaaatatttatatattaattaactttgtcatttaaatgttaagtttaagcatgtagaaaaatacctagaaaatacatatattgtataaaagtgaattacaatagggaaagattgactattggaatggcagtgtgaggaccacatgaacttgctctcccagagcccccaaaaagaacaacaacaaaaatactggccaaccatataatatccaccatttcagaactctggaaattaaccaaagccacagaatggactgagtattgtctattctaaggaaaactactgatccttgataagacaccgaatctatggcatttttatcttggagcaattcccatcctgccccccttctcaactgagtagtgcagtagccatggaaagccagcggcttcacagccaatggatatgactgacctccttggagctgcatgaaaatctccatccctattactatcaacattttgtctgaactagcagctccctggaaaatcttcattctcagcatcttggctatttcatttgactagggcattaccaaaaacaacagtaatctgctggcaacatctcagctacctaagcatgtgattaaaggtggaggaaacaagatcctgatcaaaatataagaggaattcttagaaaactggaaaacatacgcagctttgaaaagctacaacatatttttggggatctagaagactttgcaaattcctagaaaggaaaacacctcattcaaataatcagctcccttctgcttcaccatgaagccctgcgtaagcaggaaatgaaaactaaggctgtcattttctgaactttgaaggcatgccttcacacacaaatcactttgacaaagggtgggagatgtacaggcaagagatttagggaaatcttacaacaaatcactggctgaccactaaataatactgacccaggtatgccaagtaggaagccagatgtagaataaaaactttaaaaataaaaattaaaaagaccctggggcaactgctgcagggaatacagaatccacagaattcactacatgaaaaaaaaaaaaaagtcactaaacaaataaacagtaacaaaacaacaaacccttgggtggggttaagcgataccagagttatcaatattatcttaaaagtccagttttcaacaaaaattataagacatacaaagaaacaggaaagtaggctaatacacatctctttaaaaaaataaaaagacaacagaaaatgtgcctacagggccagatgctttacttaattggtgtgtgtgtgtgtgtatgtgtgtgtgtgtgtgtgtgtgtgtgtgtgtgtgtgtgtagttgagcttctttcacgtgtttattgaccattttcatggctaataactattagtcatttgggaaatgcaagtaaaaaccataatgagataccacttcacaaccatgagcatggctataatacaaaagacacaacaaaaagtgttattgaggatgtggaaaaatttgaaccattatccattgctggtgggaacataaaatggtgcaggtactttggaaacagttcgatagttcctaatgatgttaaacacttagctacataatcaaaagaaaggaaaacaagagtgaatacaaaaataaacctgtatatgaatgttcacagcagtattttcatagtaaccaaaaatggaaatgactgaaatgtccatcaattaatgaaattaattaatgaaacaaaatgtatatataacaaagtggagtattatttggcaagtaacagtaataaagtatggaaacatgctaccatatagatgaaccttgaaaacatgctaagtgaaagaagccagtcacaaaagaccacattgtatgattgcatttatatgaaatcttcagaataggcaaatctattgagtcagaaagcagattagtgattacatacagctggaagtgtgcaggttggaaacagacatggcttctcatgtgtatggagtttctttctcaagtgataaaaatgttctaagattagattgtggtgatggctgaacaattctttgaatatactcaaaaccacttaactgtacactttaaacgggtgatgtgtatggtatgtgaattatatctcagtaacgctgttttctttaaaaagtgaatcattggctgagcacggtgggtcacgcctgtaatcccagcattttgagagcccgaggcagggggatcacttgagcccaggagttcaaggccgggcaacatagtaagaccccgtctccacaaatatttaaaaattagccgagcctggtggcacatgcctgtggtctcagctacttgggaggctcggaaggaggatagcttgagcctgagaggtcaaggctcagtgcagtgctactgcactgcagcctaggtggcagagtgagaccatgtctcaaaaaaagaaaaaagtgaatcattaatattaatgacctgtatctttcatttcacattttgaaacgtgatacattccagtacctaaatttttaacattttatcattttaatatttgatgggagcaatgtttccagagatgtttttaatttttttttaattgaataactctagctggccaactcagccaatccgcacatttagctctccaactaccatacaacgtgcttggtttaggtcggagcgcaaattttcttgaccatctctacgttggtattccccgtccatctggagaaaaagtgagtaaaaattcattttgtttacaattaatctatgttttaatattcactatttaagtatttaaattaaataatttgaacctaattgaatttgaattcaaataaaccaaatatttttattccctttaaagaataaagaaaaatttattggtagtgacctaagcttatcttacttagagcacatcatgattttaagataccgtgtagtttttccctctcctctcccataaacgtcacctatccctctatcctgctttttcatcctaacatttttcaccacctaacgtgtacataaatattttagtaacataaataatattattatacatatgtgtattatttatataatatgtaaaatcatattattttacttgctttgtttattgtcagtctcaatttgaattttagctccaagcagcatttgtacatagccctttgaacagtgcctgctacgtaagtgtctaataaatatttgttgaatgaatgaattcataaaacacaaatataatctttcccaaaaagatgagaaaattttccaacagatggcacaaaagccttatttttggcttaatattggtaaacatagcttaatccatacctagaatttgaatttctcaaagtagctagatttttcattatttatttagaataataattgtgttttttaaatgtgctgaatgttaaatgttcttaaattcttcttccagtctatacgaaaacaagagtggactgcaatcattccaaattcccagctaattgtcattccataccctcacaatgtccctcgaaggtaatgtacttgcttgaaccgatttggtaaagacactgctaactctgaattatacatacagtgatgtcttttaagctctctcatattcctgctgtgttcccatgagtgcccatcccttaatttgcttacggcaaactttaaatgactaaacatacttacataaaaggtcccagacatttttcatgaagaacaaattcaatcctattagaaaaacaggaggttaactaattagggatttatatgtattctgcttaaataaactgctcttcagtttactagttataaattcaaactttcaggatactaaatctttgtataaagcactaatcttttaaataaattatttgagaagtagtatatatcccacagtggttgggcacaaattttggagttaaatagatgtaggctaaaatgattcagctccattgctggctgactgcaagagtaggagccagtcctttgtcctctccaagactcactttctgcatctgagggtgaaatatacttaacacagtgccaagcatgtggtaagcgaatggtaggtatttttatccttattaacagaatacattcatttcataatacagcatttaactttaaatccttaaattttattcatttttatttaaattcctagattgattctattccttttaaattaggcgataaaagtattcactaacatttaaatttcatagggaaaaatatgctagacaaatatcaatatgagaaaataaccaaagagaaatggtgaatttatctatgaatatgtaaccagtggggtcccctgcttgttacattccctctgaaaataccagcttcatcattctttattaaacatctcgatcgaatgtattgattgccaaaaccagcttatgccacttcatgacctgactctgtgcatctctattcagtgaagtcacactgaaatcagttatggtaggagaatctactccatgaaaattggcaagtaccataaacaaggcttcccgaacccctctctacctcagagccagtttaccagcataccagcagatgcattttatggtaaattaatgggcttcagaaccaaactgcttaagaaaataaactttatcacagccttatgcttggaataagatgacatcattgaaacagttatagtcctggttcagattttttttaatgagcctgtattgtatgtttgtgttagttttctatagatgaaatttacagtaaaactagaaaatctggaccatgagtaggaaactatataaagtacggtacttctatacagctcagtagcatgattttttttcactgccacggacatagaacagtctcttaagatggagtggtaagcaaaaaacaataacaacaacaacaaacaaaagaagcaacagcaaaatgtagaagagtatgtataataagcagccattgtgatttaaaaagaagccatctatacatacatgttcatacatgtataaaatatctctgaaaggatatgcaggaaactggtaagagtgactgcctctgaggagaaaactgaggattgacttttgtctttttttttttttttttttaccaaaacacttacattcctgatttgttaaaaatctattttaaaagtagaactaccaaaaacatctcataaaagaactgttttcttaagtatgagtataacactaagagtagctttcaactaattaacagtatttgttttcttaaggtttacttactcttctgaatttccagaaaattataccatagcttttttccgtaatctcaacatttttcatgtttctcttactctttccaaagaaatgttcttttcaaatttatgtacataataaaaaccaaattgattttagtttttgaggtgtattttgaggttattgactagaagctaacttatggatcaataaattttaattatcccagaataaatcaatagctacttgctatttaccagaacagtcttacctttattaaacttttaaaataaaaatatagccattacctatttctaggaagaacaaaaagttatgtgtatataacaaccttcacacttggtgatacagtccttagttttaggctttcagggtgtgcaaatgctatattacatggactgttttagaaggaaagaactagttctgtttactaaagacctctagtctgtatattgccattaacagtgagggactaaagatgattttgtaagtgatctgaacctaaaagtcattgtagtaatgtaaacactccaacatgatataaaaattatagaagttttgcacaagccatcaacatttatgttttacttggtcacattatatatgtgacacaggtcaaaaataagatgatacagaaggcttctaggatcatgtgactaccttgctttagagttcaggttttcaaattaagcaggtaaatcaagatgtaaaaaagatgtctatgattatccaaagtacccttggatatgtttacctaaaaataattctcataggatcaaacttggaaaatgaaaaatattgaaatatctcatcaaaaattctatttcagttgtctaggtaaaatataaactgcagaatcatcaatattctcagcactatctgatttttaattgtttttgttttatttataatgaatggactgatgaatgaatggtttaatgaatacattgactgtttaattaataagctattttgctttggggtctcaatataactttgttatttttaaataaaatttgtaattttaatttgttctgtttttatctacagttggagtgccaaactgtatcttacaccaagtaatattgttctgcttactgctatagctctcatcggtgtctgtgttttcatcttggcaataattggcattttacattggcaggaaaaggtttgttcatttaaaggaagcattaattttggttaatttattctagtaatacatacattgctctttaaaaacactatatttattttaaacttttttcatatgactagaatttcatcatttttcaagttctgttcaaagcatcattttattgatgataatttcttttatccctggaagttactaatgtctcctatcaattcatacaaatcacaagagatgtctactttaaaagtttgatgcagtacggtagtaataaagtgatcaaccggaaatcaaaaggcatttagaaacaatttcataatgacctgaaaaataataatgattttaaaaaatgaacgtgtgttcagtatgtactgataaagccatggacattctttggctaggattatcagctatctctttgaaaagaattagagtgaaaagaggttaaattattttcttgaggtttaggtggaaggtaacaactgaagcaataaacagccaggcatggtggctcatgcctgtaatcccagcactttgggaggccaaggtggacagattgctggagctcaggagtttgagaccatcctgggcaacatgatgaaaccccgtctctacagaatacacaaaaattagccaggcaccatgatgcaagcctgtaatctcagctactcaggaggctgaggtcggagaatcacctgagcccagaaagttgagggtacagtgagctgcgattgtaccacttcactccagcctgggcaaaaggagtgagaccctgtctcaaaaaaagaaaaaagccataaacatctttttcatctatcaagtattctttgcattaaactgatttctgttctttagtataatactctaaataataattgaaaacaaaactcccaaatatgtaaaagatttttatgcaaagaaaaaagaggctatcactgtaaattagcagtttagatatatgtgaaaaagctagtttctatttatatatgggttccaatcaatgccctcaaaaaagggctgctttgtggccccaaagaaaggtgtttttctttttttgcacctacactctggattgacatgccatcataatcattttttgctagaattaccgtgtttgttcttttaacatatgaaaaagaacatattagttgttctataaatgctcataggcttgtcacttttaaaaaatcactcctttacatatcaaaaacagtaacatgaagttacatattcaattaaccttaagattgcaacttaagagtaagatcaaggacaaccatacatacttggtccagaagtatcagaatatcatctgaaagattccacagttcttgacctgtgaagcaaaggaaatgaatttcattaattcctcagtagatctgattacagcataaacattgcgtgcttataacaataattatgcagtggccaaaaatgaaagttttaagtacaagtatatatttgactatatatatactgtatctcctgtggcactgtggtatctcaaagaggtagaacctctttaaccacttttttacttaagcaggctggctccttctaccattttctcaatgcaggctttccccagtgtctgcccctggccctcttctttcaacactttccctgccaatttcatctaaaatcatggcttcagatatccccagctctcatctctaaaggtccttccccatttccaactgtcaccatgatagctcaacctagatgacttacagcacctcaaaaccagcattctaaagcttcatctctcttacttaacctacaagatttcatcacttgcctatggactctgcctctgtaagaagttctacagctgactccacttctacattcctactgcactgccccttcttacatcctacttggtctctttctttccgttctctcccctttccattctctcccctttccattccatttagcacactgctgccagtgattcattctgtttagccttcatcatgtcactcccctgctgaaaaagctctagtgaatatccattgccttttatgtataaaatccttggcctggcctgcatatgacttccatgtgactccacagtcgtattttttaccagttgctttcacatatccgtgctccttccagccttctcatgattgatcatgttgtaaccccagcttggagtgaataccactctccccatttccatactttcaaatgctttccctgtcttttcaaagctttccctttcctcacccggatctagaagtagtctcttagacttggtaacatttttcactttttatcttgaactacagttatacaatatgttttgcatttgtctttttggagaacaagatacaaaacggaggtttttttaatattaaaatagcaaacacagtattggtattgggagtattagaagcaaagggccaatgaatatctgctaaattgacaagttaatgaaaaaataattagtacattagtactctgtcacccaggctggagtgcagtggtgcaatcttgactcaccgcaacttccgctcctgggttcaagcgattctcctgccttagcctcccaagaagctgtgattacaggtgcccaccaccacactcagctaatttttgtatttttttggtagagacggggtttcaccatgttggccaggctggtctcgaattcctcacctcaagttatctgccctccttggcctcccaaaatgctgggattacaggcatgagccaccaccacacccagccattagatttgtttattaacatcattgttaaaaatgacagaaaaatgcaatcattgattcatccttatagaatctaatacttattcctattttcaagtagataataaatgataagaagctaagtatttaaggaccctaagtatttaatgtgccttaagtattcaagtatttattgttttttaatcaattagatcattaattataaaatagctactataaactacaaaaatactaggactgttgaattaggaaatcatatctattatctgctaattgctggagacttttaaaaatgaatcactgtgtatttcagaaatgagtcttttcataacatctttctaccatttataaacgagtctaaaattctttttcagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataatt

SEQ ID NO: 38661 - DNA, 5043 bp, Homo sapiens
aaaaagcagcagaacctggaagtccacggggagcttggatgccaaagggaggacggctgggtcctctggagaggactactcactggcatatttctgaggtatctgtagaataaccacagcctcagatactggggactttacagtcccacagaaccgtcctcccaggaagctgaatccagcaagaacaatggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactacgtttcctctgaagaatgccgaagacttagatgtaggccaaaacaatattgagaactatataatcagccccaactcctattttcgggtcctcacccgcaaacgcagtgatggcaggaaatacccagagctggtgctggacaaagcgctggaccgagaggaagaagctgagctcaggttaacactcacagcactggatggtggctctccgcccagatctggcactgctcaggtctacatcgaagtcctggatgtcaacgataatgcccctgaatttgagcagcctttctatagagtgcagatctctgaggacagtccggtaggcttcctggttgtgaaggtctctgccacggatgtagacacaggagtcaacggagagatttcctattcacttttccaagcttcagaagagattggcaaaacctttaagatcaatcccttgacaggagaaattgaactaaaaaaacaactcgatttcgaaaaacttcagtcctatgaagtcaatattgaggcaagagatgctggaaccttttctggaaaatgcaccgttctgattcaagtgatagatgtgaacgaccatgccccagaagttaccatgtctgcatttaccagcccaatacctgagaacgcgcctgaaactgtggttgcacttttcagtgtttcagatcttgattcaggagaaaatgggaaaattagttgctccattcaggaggatctacccttcctcctgaaatccgcggaaaacttttacaccctactaacggagagaccactagacagagaaagcagagcggaatacaacatcactatcactgtcactgacttggggacccctatgctgataacacagctcaatatgaccgtgctgatcgccgatgtcaatgacaacgctcccgccttcacccaaacctcctacaccctgttcgtccgcgagaacaacagccccgccctgcacatccgcagcgtcagcgctacagacagagactcaggcaccaacgcccaggtcacctactcgctgctgccgccccaggacccgcacctgcccctcacatccctggtctccatcaacgcggacaacggccacctgttcgccctcaggtctctggactacgaggccctgcaggggttccagttccgcgtgggcgcttcagaccacggctccccggcgctgagcagcgaggcgctggtgcgcgtggtggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccgacccaggcccaggccgacttgctcaccgtctacctggtggtggcgttggcctcggtgtcttcgctcttcctcttttcggtgctcctgttcgtggcggtgcggctgtgtaggaggagcagggcggcctcggtgggtcgctgcttggtgcccgagggcccccttccagggcatcttgtggacatgagcggcaccaggaccctatcccagagctaccagtatgaggtgtgtctggcaggaggctcagggaccaatgagttcaagttcctgaagccgattatccccaacttccctccccagtgccctgggaaagaaatacaaggaaattctaccttccccaataactttgggttcaatattcagtgaccatagttgacttttacattccataggtattttattttgtggcatttccatgccaatgtttatttcccccaatttgtgtgtatgtaatattgtacggatttactcttgatttttctcatgttctttctccctttgttttaaagtgaacatttacctttattcctggttcttaaaaggtgacaattcattctttaacccagatggtcttaatttgtaattaatttgcctccctaaagagcaataccaaatcacatttttttcatgcccctatctttagctgaacttcacccactattatgcttatggtaaaattaaatagagcaatttggaagtgattccaattttccagcatttcttcatttgattctctttttttagtcttaaaataatgactcctattcagacatatcatttttcttttttgtaaatccagtgcgtttttagttaacctttaaatatgctttttgctttcaaaaataaaccagaaaacctatatcctatgatacaactctaagtgttatcacttgattcgaaagggtcagaagaccagttttttagtatcctttcctcattcatcctggagaggattgtgcaggcacattaatattgtgaccaatcacagaatctgggaatatgaagctataattttttaattaatgtcacaaagctctagtgcaatctagttgaatgcagatgcctgtgcccaaataataattcatatagcataaattggagttgtgtgttaatgtgtaaaaatttttgcctgtactatcatataatttaatgtatatacaccagaaactatttttcaaactttttttactgcaaccaatagttaagattatattttacatattttgaaacacacaagcttaatagaaataaatgcttgtgaacaatgcttagtctttttatgacataatttgaaattacctatatatttcattctattcaattttcaaatgtggtcatgatccactaaatttatttcatggtatactagtgggtagtaacccaaagtttgaaaaccacttttctcagacatataaaagcataccagatgttgaacattgatagtatcaaaagatagtcccttagggttctaattttaaaaaaattttcaaagcattgtaggggagtagctttgtctcatgttaaatcactcttacctttaaggatctgacacactatgtaagaaaaagacttcaaggttggaggaggagattttccatgacttttatcaaagtctacagtctatgttgtgggagaaaaatgtagaataacaaaatgagtaaaagtatagaggcaaaacaagcatgtgtatgagagagagagagaaagcatggaaaagaggaaattcatggggatgagcaaaatgactacttccagtgccacagactagactcagttgcttctcttatgttattttttgagacaaggtcctgttctgtcacccaggctggagtgcagtggtgtgatctccactcactgtgatctccactcactgcaacctccacctcctgggctcaagtgatcctcccacctcagcctccctagtacccaggactacaggcccaggccaccacacccactaatttttgcatatttagtagagacgaggtttcatcatattgcccagactggtctcgaattcctgagctcaagcagtctgcctgcctcagcctcccaaagtgctatgattacaggtatgagcacctggcctcaactacttcttgaagatattttaaaactttatcttaacattgtagagggactgggtattagtcagttgataatgccaagaagtgcaatctcttttaatagcatatctaagacaacctaatgtttatacttctgactcagatttcactactggttctgttgagctttgtcaactgagtaattattcttttcttttttctttctttgtttatgttttagagacagggtcttagtcacctaggctggagtgcagtggtgcaatcatagctcactgaagccttgacctcctgggctcaagcaatcctcctgacgcagcatcccaagtagccgggaccacaggcacatgccaccccccacagctatttttgtttgtttgtttgttttttgttttgttttgtttttgaggcagagtctcactctgtcacccaggctggagtgcagtggcgcgatctcggctcactgcaagctccgcctcctgggttcccgccattctcctgcctcagtctcccgagtagcacccccagctattttaaaaaaaatttttgtagagatgggttctcatcatgtcgcccaggctgttgaacttctggcctccaaaggtgggagttattctagcagcttccctgtgatcttctcatatctactggtggagtgggaaagagtagttcaaacaactcagacagaaaatctcgctggtgcaacagtggagagaagggccaagtacttgtcctgttact

SEQ ID NO: 38662 - DNA, 25862 bp, Homo sapiens; identical to SEQ ID NO: 37554

SEQ ID NO: 38663 - DNA, 3707 bp, Homo sapiens
ggagtacagctctttcctttccgtctggcggcagccatcaggtaggctgcgttgaggatctttgctcttccatccgcctttgatcgtcttcctcttcagccatccaggtccggggaccctgcgtcctcggagataggtctccctcctgtgcggccagagtttggtcaggatgcgggacagcaaaggggtggagaggcggcccccggggcgggttgagcgaagatgtgatggcggcgcgaattcgagctgggcccggatcctggaggaggcgtggggctgacgaatggggcgcccgggacaaggcagcctaaagtgaggctgctggttgggtggggtagatgcattttcctcgagagttaatcctcggtggccgcagcagtaccttgtcctgtgatgtcagcggcatctcctttcaggtcctccttggggacgccgcctgccgcagccacccgcccccttggtgctcagttctggttctgttaattcgccccaccaaaacgtgccgagcaccgctctgtgctggggttgcggaagtgactgaacgcggctccgtgggcgcagtggtgggggttgggctagctgtccccggcagttggtgcagagccattttcattcccggcggtttccttgtttttgttggggaactaagatggacggatacagtcgtcttattgtacttaaagcggatgatatttaatacacagtttgatttcacaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggtacgtgatcgactgcgtggatgcttggataaaattatattcgagaaaagttggaaaccagctgttaggaagacactgctgcctcagtgtctttcttcgcatagggctttggcagaaaaaagctagcaacactggtcagttactgtatgcactgttgtctaaagtggcaagtgtgtcaaaggttacaaatctgaatgagttcagactaaagcaaaataaacagtgtgcctccctgtgtgagtagcctaaggtgcattgaaaaagactgggatgtgttttatttttttctattagatagcattaacttactgttgaagtatttttggtggagtattagtgacaagccattgagtcttaagccttacggcttcctataaaatcactaatttcgtgtgtgtttgtgtgtaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggtaaatggttttgagtagcagttatattgaatactgcctggggatggtgggagagagagattaagcaacttttctgattgtacttaggtgagctgtctcgtatataaaacagggtttgtgatttttactaatcttggtgaagagtaattgcttgaaagacttgtctttgttacaaatgcgtgtgtatatactggaagtacttgtggaacctaagctttaaagcggcaagaatatgcagaagagaccaaatgtggcctgcacagcctaaaatatatactaaatatttttaaagctaaacgttgctgagctctcagttgtatggaaaaagataaggtccccaaaccctaaattttgttacccagatattaacatattcctgccctagtcaggaatggagtattaagagggaatgatgtgtttcagtctatgtgtgttgttttagcaagtctacattatctcattacacttgtgatagtctagggagaaatgcttagtaaataacttgagtagtaaaagactcttgtctggtggtgaactagagttgagaattaaaattctttctgacttgctgctataggcaatgtgggagattgaccttgggccttttttcctattctaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgccatggcttcatggcattcagtgattagtggtaatggtaaacactggtgtgttttgaagttgaatgtgcgataaaattattagccttaagattggtaagctagcaatgaatgctagggtgggaagctggtgagccagtggccattagataaatacctttcaagtgtgagcttagacgtcaaccctaaaatacttaaccgtaatgctaattgtgatcattatgaatcccttcagtcacattagggggaaagtagttggctataagtacgtcattcttagtccagtcagtcttaaaaacatcttgggttacccactctgtccactcccataggctacagaaaaagtcacaagcgcatggtttccaaccatatgtgttttctgcagttatttctcttgttctggccaaacaaccctaaaaatccttaccattccacaaagttggaccatcacttgtgcacccactttgactatgagtataccaccacattgcatttctgtttgcaccatgtcttccaggagactagactactgttgtccagggtcaatttgagtgtaaagaaaatgtagacaaggaattgcccaattttaaattctgactttgctgacttaatttaaatgctcgttctgaaccaattttctcctatcttctctaggggtttcaaaagactcagttaattgatttccaggaagtactcatagcaagttcataaaagttcttgagacctaaatttcttcacaaaaaaagaaaagatcttaagtcatacattttaattgtgtagaggttgttcaactgaaggaataaatgtctattaaact

SEQ ID NO: 38664 - DNA, 7499 bp, Homo sapiens
tcgcaacgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggtgaagtggaaggggtgcgggcgggcgagctggggagaccgtgatggggcgggagacggtctcccaccagtgcggattggtcgccatggtctcaggctccgcaggggttggccactttttgcgtcacgctgggtgagcttcaacacgacatgctgctttggcgctggttagttgggtcgtttgtcactcagtactgtactcttcctgattggccaataggcctaccgctcaaaccttggacgctgtgctataattggccgagcatggacgtggggcgggtggttggaaagacggtgaatggaaaggggatggctggtggtcttgggtgtgatgtgtgttattggtttgtagaggtaagtgacccagcaaccgggctggggcccgcagcctcaatccgcaaagataggggtcgaggtaaagacgtttaaaaaaaaaccagtattgggggaggggagaagtgtagttattataatggctagtttaaggcggcaactttctcaagagacctattttagtagctaaggatggtctattgctcaccttcagtgaggacccagcaatattgaagagggctagagttccaaacagaatcatggtaattaaacttggaaaagacgccgacagggtcgtgagaaagacacttctctcttcccctagacttccaaggcagggacttagtgcacctgcgattccgtgatggaaacactaacgccaaataaaccccttattggggtttgtatttgacttttaaaatttagtactgggttcaggtactcattaaatacacttggtgttatatctatgcgtaatttccaagagaaaggaatataattccactaaaaagagtcatacgttgacttcatatcttttcaaaaagtcactaaagggcagcagggaccacaaaaaaaaaaaaaagagattgactacagtagtgagagtccctgcaccaccagggtaggtattgatttttttgatgaaaactggtgggtaaatactagtgagcctactgtatctttgttttcctgaggttaaaaacagtatcattttcctctctgtttatcagcttgctaccataatatttgtggaaatgttgaagcaaggctgtgccattactcaggtggagatctttggagaaggccacatagctagccgcctccacagggagacctaacaggtggcttagaccttgaataaagaaggaactgctttgtcgtgtagcaattttaaaaaagaaagaaaaaaataaggaggaaacatttagcaaactattttttgttgttgtagagacggggtttcaacatattgcccaggcgggtagtgaattcatgagctcaagtgatgcacctgcctcagcctcccaaagtgctgggattacaggcatgagtcactgctcccagccccaaactattttttttttaatttctcatgtgacatgtaggatagcctagggaaccctgctactcatcctctatcaccagaagccctgcttttttctctttgtctttcttagcatttgtgctgagtgatatggcccactctgtgattaaagtattgtgtttagtattacctttagcccaatacgcacaggtccctggctggttccttgggtgaagtgtgagaagcagcttgtctttttctctcacaatagtcatcttgagctttagggattttaacaaaggtctagctttaacagcagagtagagatagcgtatttacaagtgggtggatttccaggagaagttgatagtatagttgttatcagatgtgagaagctgttgtttctcagtctttaattttatttggctcatttgttttctccaggacacgcaggagaaagaaggtattctgcctgagagagctgaagaggcaaagctaaaggccaaatacccaagcctaggacaaaagcctggaggctccgacttcctcatgaagagactccagaaaggggtatggggcatagtctcttaccctctttctttggagctaaaggaggttcttcgaatgaagtctgtagaggttctactggatccttttctggaggttttgttgttgaacagaagtagaggcgaatttgaaatttgaaaagagcaagtcaaattaatgtaaatccctgatgtggtatcaattccctcctgatttcccatgtaggaaattaaggcctaaattggagcatttgggtgtgtggggaaatgagggaaagatgttagaaactgaaatgcagactgcccccaggcatttgcctgtttgaatgttggaggttttaggattgtgcactttttaagcattagagataaattttgggatgcatcatttcagaagaagatcaaaccatctctcctacagaaataaatcctcaacttgaaatgaatcagtttcttcatacccttgaagtgagcaccagccattaattatactcctgcagcaaatgtatttttcttgttcagagtggtcctccttaccaagagagagtctactttcatagccatgtagctcctgatcagatttttagttcccaaaggtacctaaagctgactgagggattatattatcgttttttaaaaaaaaaatttggccaggcgcagtggctcacgcctgtaatcccagcactttgggaggccgaggcgggcggagcacgaggtcaggagatcgagaccatagtgaaaccccgtctctattaataatacaaacacttagccgggtgtggtggcgggcgcctgtagtcccagctactcgggaggctgaagcaggagaatggcgtgaacccgggaggcggagcttgcagtgagccgagatcgtgccactgcactccagcctgggcaacatagcgaggctccatctcaaaaaaaaatttttttattttccttactctcctctgcaatgactgtaggattataaatcattacattggagtgtgcttctctgtgcggatgaaatggtgggtgaaacatccctgtggaggatcccagttattgagtcttagtcacagatgataatgtgatgctgatttgcatttaccttgctggaggcaaggcaggcgtgggcaggctgtcacagtcatggaacatgtgtgggagctgtgagagtcagaaggaaaatacattatcctcatgaacaggcccagtttctattcctggtctgggagaataatcattttgaggttgttggcttgtggttgatctcctggtggctaggatagccccatatttatccttctctatatcttattcatttctgtttctccagttccaggctattgccctgtacccagtaaggtcctcagttaccctttatgaataagtgattttggtggaacgatcctctactgagtggagtacaaaggatggcaggggctatcccttgactccaaaactatatactctagctgggaaattgcttatgtacctgaaaaagtcagaacacactggggagaagacataagtacatgtaattaatgttaaactgtgtatgcatgaggttaatcaaggaagacttcttgaaagatccgagtgtgcatgagggtttataatggatgtgagatgtgagtctccttgtttttgaggaaggccagagtcctcactcacctaaacctccctcttatctcttagcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgtccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaat

SEQ ID NO: 38665 - DNA, 7499 bp, Homo sapiens; identical to SEQ ID NO: 38664

SEQ ID NO: 38666 - DNA, 93596 bp, Homo sapiens
gccccgcgcctgaggggcagtaaaagtcgccaggtccggctccatttctggcacaaaacttgcagcaccgaggggttgtggagagcccttgcaggggaagagggcagggtcatcccgagaaccaacgggcacgtatagcccggcgaacgcccaagccggtcaccgcccccggtcacgtgtcgccagcctccgcggccgcgcgccgctctcagcaccgttcccgccccacccggcccggcagtcggcccgcgcctcccccggcgctactgccacctcgcgctcggaggcgtcacagaacgtgctcttctctcccctcccccctcccgctctccccctcctccccctcccgctccaagattcgccgccgccgccgccgcagccgcaggagtagccgccgccggagccgcgcgcagccatggccgagaaccccagcttggagaaccaccgcatcaagagcttcaagaacaagggccgcgatgtggaagtgagtgtgcttccgcggtctgggcccgcctggccgcgccggcccggcgacgcggggaggggcggggggccggcgccgggctggttctcgtcggcttgtggtcggccggagttggccgccgcctcccgtcaccgcggccccgggctgggcggagcgggcggcgagacgccggccgggctgcagtcaccccccggagctgccggcgcggcgaccgggaaatgccggcgttttcggccccgtcacgcgggcgcggcctggtgtcggcgaggaggggatgtggagctgaggcggggtccgcgggccagggccgcccggatgaacggggatgctgccgcccgggccctccgaccgcacagccgagggggcggccgctgcttgcgcccgccaccggtgcaaccttccgtccggtgcagccccctctgcgcctcccgcgcggctcacatggagcctcggctctgccggtccgggctcctaccttctgcgagccgggcccaggcgggcggtggcggcccgcagaggggggtggggaccagccgggtaactgacttgtttgagggtgatcgatgggggagggtaggatgcgccaggaccattttcttatattccagtgctcgtctttggactagtcgtgccgagctgttgcagctcatactcctgcaactgctggcatttggagcgagctgaaggtggacaatagtttgccatctattgtgttcaggcttcggaaaagaggttgctccgacctccgctcataggacttgttttcttagcctttcttggagtggggtgtgcatagggtgataatttctttgacacgttttactaaaataaattggatacacaggttcataattctcttacatacctcttgctccaagctagtagaatttccaagtggttgcaaaactaaacattcatcgcggtcactcagttagttgctactcagcatgttgccattgtctcattaaggtgacattagcaggtactatttgcaaactcggcttattgaggcagcgctagaggtctctctgcagctactgaaaacagtaagtataatgcacaaacttcactgggaccgtgacctttggatttgttagggggaaaatggttttaaggccgcagccttctttgctaatactaggcgacatgatttgcagttttgtaatttttgataagctagtgtgattaagaggtgtgttttatcctgtcttaaggaaggttgtggggtaaatataccattcagtgttctattttgtagagaaacagacaaactcaggccgtttttcagagctacaaaattaaatactagtaggaaagaacctagggagatatccgtggaattcccatttaaatgagtcaaataaagatcatatattctttcctggtcatggttaaataccctttgtaagaaatacatctaagcgaaagtaaaacttgggaataggaacaagaaattttggaactgcctcctgttattggtccacttgatgacaagtgttaattttgaacttttcccattaggaatttttcttgaagcctatcctgttccaaataaaaatttattgaaaaatactcattgtttgtacagaaaaaccagtaacattcttctctcggatattggtacaggtttttgtttcattgtttacctctattgtgttctggtagctcagtgatacttagtaaggactcctgcacataataggtacacaacaaatatttgctgataagaatgtaacccgtgacttttagatgcatgaaaaagagcatggttgctaagccattcagcctggtattggtcacaacattacatttctcgggattctatagtgtaactaaaacatgaaatagacattcaaatggtagttctaatgtggcagacactgttacgagcttcatgataccttatttaatctgtgtaacaagtatatgaagtgtggcattatccccactttacatgagtaaagtattttttgagacggagtcttgctcctttacccaagttggagtgctcaggcactcatagctcagctgcaagctcaaacttctaggttcaaggaatcttcccaccatggcctcccaagtagctgggactacaggcggacaccaccacacctggctaattttttaatcttttttagagacggggtctcgctttgttgcccaagcttgtcttgaactcctgggctccagtgattctcccgcctcggccttccaaagtgttcgaactacagatgctagtcgtcacacccagctggaactttagataaaaaacctcagtgtgcttatgtagcctgtgcatgtcactcagtggatatgggtattatttattcactaattgtctattgggtatctatcaatgttaggtcttggggataaggaataagatgcagtctgtacttcagggagtttacagtccagtgggggtgataattacaatgcagaacaacaattgttacagtatagtattccgaaaatgcatgccaaaaaaactacttggaggtgagcagaaagggaagatactctggttgatttctaatggatgaatgggagtgagctgattgtgaaggatgaaagaaaggtggccaggcaaagggcgggagaaggctggtggaagaaaggggcattccagactagagggagcagtaattgaagagtcctgagagaaatgtaggagagagagagactaaagggtaaactggggtcaaatctgatgaagggcctttattggggatttaggcatatctaagagtagataaccatgcttagtcttgtccattagaaacagtacaacttagctctgtaactgagtagttgtggttatcaggctgttccaaaacagtgagatgcactttgataagctatgatgcctattttttcacatataggatagacaaaaactaaaacatgttataaattatagaagcagctgatacacaagatgttaggtgcaagaataagatccatacttgttaaagaaaataaaaggatagagttatgccaggggatttgagtagagagagggttgaggaagaaaatttctttgtcattcaatcgagagagactttaagagatctttggagaggaaaaaaaaaatgaggttagtgaatcttataggaaatatgtaccaaacttaaaaggggcatgttaactggtgaataaatatccaggtaaaaaagaagagtgattatattaaagagaggagacttccaggtggcctgtgttgatgcaagaatatcttgtggcaaagagttgcttggaagctttttcttaatagggagatgtgaaggaatttattccagagcaaagaggagatgtaacatgattagagcaatggaaagggtgacagggcagtaatacctagaattcattttggagaaatagcgctgttgtctgatctgcaaagaagagttttccaaaaaattgagactgggaatggctacaacctggaatgaggatttgatgatgctgttcttcctccctcttcctcctccttcaaattctctttataaagatcactgaagagaaagggagtaaaggttattctgaggtttataaatggaggaagggagggagtaattatcatcactgatagaaatttggagcttgggtaggggatgcattttgtagcaaaaactaggaagtacatattgaaagggaaacatttccttttatttgttctggaatgtgctttttttttttaaaaaaaaaaaaaaaaaaaaagagggtctggctctgtcgccaagggtggagtgcagtggcccaatctcggctcactataaccttcgcctcctcccaggctcaagccgtccttccatctcagcctcttgagtagctgggactacaggcacatgccaccacacctggctaatttttgtgttttttgtagagacggggttttgccatgttgcccaggctggtttcaaactgctagctcaagttatcctcctgccttggcctctaaaagtgttgggattaggggcatgagtcaccatgcccggtcctggaatgtgcattttaatgctagaccttttcatgtaaggcattgattcttaaaaacttttcctgttttcaaagataacttatagaaaagtgtgcaaaacagaaatgttctgtttaatgaataattacaaaacaaatgctcaggtaactgcaatccaggtcaactcattttcttgctgctgtatacctcaagggtgtgacattttcattagtaacagtaattaattattttaaaaaccttaacatttattgtttacagtatatcagtgctaagtactttatatagattatctatttaatcttcacaacagtcctatatcaagtaagtactattattatccccatttactgctgaggcaacttgaggcctacaacccttaagtaagtggccttaagtcttccatcgggtgttaagtggcaaagcctggacttacaatatatcaaagctttatgctaagcggctgggcgcaatggctaacgcctgtaatcccagcactttgggaggccgaggcaggtggatcacccgaggtcaggagttcgagaccagcctggccaacatggtgaaaccccgtctctactaaaaatacaaaaattagccgggcatggtggcgcgtgcctgtagtcccagctacacgggaggctgaggcaggagaatggcgtgaacccgggaggcggagcttgcagtgagtcaagatcgcaccactgcactccagcctgggcgacagagcgaaactccgtctcaaaaaaaaaaaaaaaatacaaaaattagccggtcctggtggctcatgcctgtaatcccagctacaagggaggctgaggcgagagaatcacttgaaccggggaggcagaggttacaatgagctgtggtcatgccactgcactcaagtctgggcgacagagtgaaactctgtctcaaaaacaaacaaataaagcttgatgctaaagctagaactcttgcttactgtgctgtactccaccgaagggagtctaagacttgacatgtacaaaccacgcctgaaagttagtgaatggggaaaatattgaagaaatatcgactatatcacagaaattgctatttctatactttaaaaccttgcaaatttttgatgaactttactattagatttatttgcctttttatctttttactcttgcaaagtttccttcttatcagcaaggagccagttggttggttttaccaaaaaatgataatccgtatctttgggcttaacacttaagctttatgctttagtttctgataccagggctaatatatattttctcacctgcaaaattcagttagctctaccagacttgcttctgtctctggaacctccagtgctaagtggcactatctgattgtccaagtttaagattctatccttgactcccttctcttcccctccttcacccttctttgtattagttatctgaagaaccctcatgtttgtacctgttaccaaccttacttcctctgcccctagtttagacccttatctttgttgcctgaacaagtataatagtgtacctagctcttctgtgttcagtatcttctctccccagtgtatcttgtggattgatctttctcatatctttctgtgttactttcctgtttatgatccttcccattgacttcaggataaaagtccttagcatgccacacatagttgtaagaccttaccttttttacctcaccttgcacttttccttatatctcctttgtgccagctgtgataaagtactggagatgcttgagtaaccagtagtttcttcttcatgcctttgtatatgctgttctgtgtgccttcttttgactatctgttgagttggggttcactctggcaacctatctcttcagtgagactccttcatatatctctggaacaccaagattacaattctgccacaccatgtcattctagttaaaaaccaaaaacaaaaaaaaactttaaaagttctccatgagcctttcctgacttacagtatacttggtactatcagtccctattcttttcctcctctctagtgttttcctaggtgaattttccttcacctatttgggataaattgctgtgatgtacaacaaattctgtgtttgtatagctattaaagtatttgggctctgttgagaagctcagtgagaatagataccttggatgtaacttgaaacatgaaacttaatgagaagagagactagatgatatacctgaaaaaagtctacatttgggaatgaaaggttcagtattattctaagacattaattttcttttggtgttgactccatggcattgatactgttgcctagccctccttgaacagcctgttctcctataatgtatttctgtaacatgaactcgctcatacttgaatggttaataaaaaaatgttaaggcaaagttcatattggttcatatgtgatttttagtatcacattaatgtttagcactcttaaataacaacagttgaacataaagtacagaaacagttgaacggatcaagcccaggagtatgcatattggccatgcacccatgttctgcctcttggctctgtttaaccatatgcagtgtctaaaggtgcttaacgaccatccatcctgtgcatttccctcttcttcctaagtttggagagtgtaaagtgtttcaggaatctatatgccatatagcaaacaaactttttttttttcatgaattcactaatggggcatatactgcttcctggttctcttggagtactctttttcagtcagctttggtaagtcttcttcctaccctttgaatgtagtaggcatggcttgggattctgtctacgattcttttatctgtagactgtttttcttgctcatatcagcaactcccttggctttaatcatcatttcaatgtgcggggacttaaatttcataaaatcatctgctggaaattattcacatgagcatctttttagcttctcaagctcaaagtgtttaaagccatgttctgcctttgttttttcttttttctgtttatggcatcatcaccctcactgtgacctgaatttgaaacttgagaggcttcttggacttctcctcttccacattcagtcagatgccagttatgtagctcgaatctctgtgctgtctctggattttggccctgcctctatattctgctgcctccagcctactttaggccttattacctgtcaccttcctgtttaaaaactatctccaaagtggttttcttcctttagtttatgagatttttcagtgagcctgatgcctgattatttctccagattcagccttcctcccccacccccttaagccctagcaacactgaacttcttatatgcttatacataatctggaatcccgcctgcccctcctcgccagtgctatttctattctcagggccatcttgctgactggaatatccttctctgcctcctgttgcctggctaattcctaccacttttaaatactcaactctgggtaggtaccattctttgctcctggaagaagtctgagtgtatctttctcgttgcaattatgataatgtattttaattagattttatttttcctactagattgtgagctttttgagggcacagactatgtatcttcattgcctaccacttagtacagtggctagaaccaagcaagcactaaaatattccttgaataaatacatcgtaggcaccgcagacacaataatttttcccatgtgtatttttgaactgaaatgtttactcttttagtgccttttcctactgcttcccaaatcaactccaagctttttattatgacaggtaaagttctgggagattaaggtatatacatagtgaatgaattagtgattaaggctaatttgtatggctaagtaacattctattgtatgtatataccacattttgtttacccattcatctatagatgaatacttggattgtttccaactttagtctgttgtctcccaaccatttaaaaatgccactaatttgttcgggtcagttttcttttattaaattgcactatatgaaattgcttttttccaggtttgtaacaacagccaagtattggcaatttcatatttagcctaatagactgtcctaattactgggtttgtctgtttccttctggtggtgcttaactggttcctcttatttgtttttttaccacccttcagattttttgtaatctggaagtttttttaaaaaaaaatttttaaacattatttttgagacagaatcttgctgttacctgggctggagtgcagtgacacgatcatggctcaagcgatcctcctgcctcagcgtcttgagtagctaggactacaggtgcacactaccatgtccagcttatttactttttgtagcgatggggtcttgctgtgttgcccaggctggtcttgaactcctgtcctcaagcagtcctccctcctcaatctcccaaaatgctgggattatagccatgagccactgagcccagtctaaactggaagtttgatttaaagtcttgattagcttcaagttaagcttctattaatttatttaaacttcagttggtggtagtgtgtaccttagaatatatctcagtaatgataataagaatgatcgtagggttcaggtgataaagaacaaatagtttaatgccatcaatgtgaaagttacttaacagtttgtgaagtgaattttagttatttgggggaaatgggacatgaaattgatgacatttcaagaagtggaaaaaaaagtaacttcttggtatccagtaaaggagttacaaagtgtatatctagaacttctaacttcagagtcagtaggattttctttctatgactgacaccactcctcagttgaccttttgtttagttagcatacggtttggctgtacagctggccctttgtaacctgtggattcgtagggctgactgtactgtgccattttatagaagagatttgagcatctgcagattttagtatcttcgggggagggagcatctggagccaacccccccgaggatacagagggaggactgtattctcattttcaagtggaggtgaaggaatattaaaagtataaggaggatgtagctatcctttcttgcagttttgctgttaagaaaaattttcttacagcatagccaacatcagcagttaaaatatggtaaaataaatcatgactatatttacttggaattaatcattcttggttttctgggttagggaggttgtatacatactagattttactttattttgacacttgccttaaatagaatataatttagttgttttcttggttcttgagaatcaccattatgcatatggatattgggttttgcttttacataagtgatgccttcaggttgttaaattaacagaattttcttcttgatttttacgcttgtggagtttttgctcttcttaatttttttggcttgtccttcccttgcttttggtctatcagctttcttttgatactgtcagcatatttacttgtggtagcccctatgtttctttttatttgatgctttacatattctagtgacttgggaaacagatttattaaacatttatttagctttttttttttctttgagacagggtcttgctctgtcacccaggctggagtacagtggcacaatcacggctcactgcatccttaacttcccaggctcgagtgatcctctcaagtagctggacaggtgcacgccaccacgcccagctaatttttttattttttgtagagacagggtttcgccgtgttgtccaagctggtctcaaactcttaggctcaagtgattcacctacctcagcctcccaaagtgctgggattacaggcatgagccaccgcgcgcagcctatttagtattttctacatgctatgtagacatcattaggtgccaaagattataaatatgaaaatattccctgatctaaggaagttcagtttagtgggagagactgatacttaagcatatggctagtgtacagtgtggtaagttctatgatacaggtagataatttgtaaagtactataagagtatagaaaaagtgtgattgtacctggggaaattagtaaggttacacagaaggtcatacttgaggtaggtcttgaaggatgagtttgccaactcagaaagaaaaatagtatgaataacagtgactgtgtcatggagtctaaaggcttggcatgtttaagctgcagctgatatgaggggcattgtatccattccccctgcttttggaaacaaccttctgatttggcctttggaagctacttttctgccattggctatcttatggtgggatttttaatgtaggtgctcctgcctctgattaattaatgtgcctcacatttttctggctaacacaaattaggctaatttgtccctggcatttaaatcttgagtgagctgatactgagacctaattgattcatcttgacagaagtactgtgaaggtaaccatccgttaattcctgccggctagatatgtgggagttgctttcgtaggcttgattcttcagctttgtcttggttttgtgaattactctatacattctaccaataaattcactcttccctttatttcttcttaaatttacccaagtcagttgctgttgtttgcaacataactctaaggtgatcaactgtcttggtttgcctggaactgaggtagttcccagtatacaggactttcagtgttcaaacagagaaagtcctggacaaaccttaacaagttgattgctctaattgaaacagtttgggcataaaaataatgagttctcgggatccaagtgttgttcagatgaaaatattcagtatgcagctgaaaacagtgcagaactagcttgcttcagttatgtcactcagcagctattcgaattctttactgagtgtgagggataaaacaatgaaaataatgataaccagtaattgttgagcacttaactatgtgtaaggcactgtgtttataagaataaccttaaataatcctcacaaagtttacattatacagaggaagaaaatgagttcttcatttcttcattttcttcttaatttgttaagaacatacagttaggaaggggcagaactggcactgagtcccagatttccaactttaaaactccatgcccttaatagccattttcctactctacctcagggttcctgctcaaggaatgtatagactagtaggcagattatgtgaaagcaagtaaatatttcctgtaatggaagtgtgtacctagtggagcgggcacatggggaaagaatcacctgagttggcctgggtaagtcactgaaggcttcatggaggtgattgtgcctgagctgaaagtagaaaaatgtgtaggtatttatggtaaatcttgggcaagcctggaagtaagagatagtgtgatagattctggggaactaaagtaacagtatttctggctggacgcggtggccttacacctgtaatcccagcactttgggaggttgaggcaggtggatcacctgaggtcaggagtttgagaccagcctggccaacatggtgaaacgctgtctctactaaaaatacaataattagccgggtgtggtggcgtgcacctgtagtcccagctgcttcagaggctgaggcaggagaatcgcttgaacctgggaggcagaggttgcagtgagccgagattgcaccactgcactccagcctgggcaatggagtgagactccatcttaaaaaaaaaaaaaaaaaaagaaatatttttcaatattcaggtgtggagtaatttgaaatttgggtaggacagacaagagccagattgtgaaaaaccttttcgctggggaacattttaaacagtgaaatagatttgtgcatttagaagcattgctttggttataccataggggatggattggtgaagatgagaagagagtttgggagtaacagaaaaccctcaaggtctcagatggggagtttgggagtaacagaaaaccctcaaggtctcagatgggtggcctgactatagtgttggcactgagattgaaaagcagaaaaagttattaggactaatcttttggcatattttaccttatagaatagaggttggcaagttttttgtaaagagccataatattttttaaaagcctaaatattagggctttgagggccattctgcttgtattgcagctattcacctgtgtcttgagcgcaaaagcagccatagactgtaggcaaacaaatgagtgtggttgtattctaataaagctttatttatgaaatcagttgggggtctagattttgctcacaggcccttctaggctagcgtatccagtggtgaagattaatagctcaagcaatggctagagtaagatgataatataggtgagggattgtagggataagaaggaaagaggagcaggggaggaaagaaccctgaggaaccaaatcatattaggagaagaggtgaaaatggtactgagggagtctgtaggaagcttagcaggaaaatggtgtataagaacttagggaggagagtttcctgaaggaggggcagtaattgcagtatcaaatgctacagagaggagaggcatgatgagaccttacaataagccattcattgtatttgctctttgggggccagtgagaagggaaaactgagggtggtggaggctggaagctagatcatgatgagctaaggagtgagttggagttgagctatttagactagttagagctttgatttaaatatttggtagtcatgggaaggaggaatcacaggttagcttgaggaagacgtagggtggaaagaaggctgttcgtttgttttttatttgttaagaagggtggtgttgactaggctaaactgaagaagccagagcaaaagagacctgaggacttggttagaaaaggaacaaacgactgagcctagatagagtaagtagggagttgttggggaagggaataagaaatataagagatgtgtgagatgtggagagatcttgaagcagcctcaggtggaaaggacttgaagtacaggcagaaatgaggatgggctgcattaggggtagggaaactggaacaaattatacttagtggcctctattttctttgacaacgttaactatagagaatgaagggtctaagaggtaatacttgaaggaaaggtgtttcagggtaagcaaaataggatttatataggaatgaaggcccagctgaggtaagtactgtactagattgttattttggtaacagtaatgaacaattttcagttaattatataagatttagctatgaatgcattctggattttagttagaattgttaaaccaaattcaaagtgtggaagtcattcagttgaattgttaaaaaaaaaaaatggaactagcaggaacgttggaatttaatgagtccaactcctttttcacagatgtgaaaatttaaggcgtagaaaaataatgaatgttgtccactcatctagttggtaaccaggttttctgatttcagaaaatcaaaaatcacttgtttttaattatgtgttttatcataacacacttaacaaaaattctggctgggcacagtggctcacacctgtaatcccagcactttggaagacagaggagggaggattgcttgagactaggagttcaagaccagcctaggcaatacagtgagacctcatctctacacaaaatttaaaaagtaggcaagcatggtggttcacaaccgtagtcccagcttgggaggctgaggtgggaggatctctttagtccatgaggtggaggccacagtgagctgagattgtactgtctcagaaaaaacaacaacaaaaaaacaaaagctctcttttataaaactttcaaacatatgtaaaagtagagagaataatatattgaactcccatgtggcattttaaaacaattataatttatggtcgtttgtgtaatttatatcttgttaaaagaaagtccttagtcaaattaaagagttcaactgagcaaagaatgattcgtgaatagggcagcctcctgagccacagtatgttcagagagactccagcacagccaggtggtggaagaagatgtatagacagaggtacagaaacagtcagattggttacagctcggcatttgccttatttgaacatggtttgaacagttggccccttttaactggccaaaacttggtgattggcacaaaagtaggttacagtctgtttacacctccatttagatacatttatagttcactatgtacagagaaacctttagactgaacttcaaatatgtaaggagactgctttagactaaacttgatttaacaatctctacccacttctactcttccctgcattattttgaagcgtcatctatcagtattatgtttcatctgccaaaattttaacatgtatgcctaaaaggtaagacatatggtagtttcagtgttttttctccttttaaaacataaaccacaatatgggttaatgtggattatgtgggctaagcaggttgatgtgggttaatgtgggttatgtgggctaagcaggttgatgtggttaatttttaacttccaaagatgtttataagttattatgagtagactttttggaataaaggtttcctcatattgcagtattttggaaagtgattttactaaaaaataatacgggccaggcatgtggctcatgcccgtaatctcagcactttgagaggcctaggtgggaggactgcttgaagccaggagttctagaccagcctgggcaacaaagtgagaccctacctctacaaaaaatacaaaaaaaaaaaaaaatcatctgggtgcattgtcgtgtgcctgtagtccaagctccttgggaggctgaggcacaaggattgtttgacctgaggaggtcaaggcttcaccaagcactgcactactgcactccagcccacgtgacagagtgagaccctgtctcaaataaagaaaaaaataaatagtgtaacaactgtttatgtggcatttatataatattaggtattataagtaatctagagatgattttaaaatatgtgggaggagtgcataggttatatgcaaatactatgccattttatataaagggacttatgcatccttggattttggtattaggaggtcctggaacctgtatactttctttgcatttcctgtttcagaaacacaaaaggggtacagatccaactcttcagcatatctttgtggtgtttacagagggtgttaagacagatactgttgttatttttctttatgcaaaatgataataatagggactgaaaggtagaaagctgaatagagtatggaggaaggtagctgaacaggcattgaaataattagagggattggatattgcatgtgcattcctcaacatttgaatcagcaggaaaaaaggaattcagtagactgagaaggatgatcatgttggctaagtattgggctacagattgtagagatgcatatatgggtggtagagaaaaagtagaaaccagcttttatacagtgttaacctcagctagcagagagcaatggactatacagttagtatctttttataaatttgaactgactgtaaatttgaaactacttccatgactatatgtatcttggttttgaaataatatatacttgggaatgcttattgaggtgctttttttgtctttttagattatgcataaataaattttagttaacttcagcatctggtattttaaacaagggtcagaaaaacatcagaaatggatagaagcatttttcaataaatattttgggaatgatccttgtataacttaatttgtgtactaattcatattaagtattcacttatagttatttttctatttattctacttactagtagttaaaaattaactattttttaaagggaaggggaagatgaaaataaaaattgtgattctaaataaaatcttagcattcagatagattcacagatattacagagaaaatttataagctgataattcctagttaggattatcatactatttaatgataaaatgcgtatttactcctgtataataagaataaattctcttggctggaatccttcaatagatgtgaaaataatttaaaatgcttcctcactgctcttgggcaatttaaagttactgtcagggactatggctggtaacaacagtgtggttttcagttatctgttgagttctggaaaccttgtttttgcttggaagaaagaattgatacttggatgttaaagttctgtaggggtacagcctggcgtggtagctcatgcatataatcccagcactttgggaggctgaggtgggtggatctcttgaggccaggagttcgagaccagcctggtcaacatggcgaaactcttgtctctactaacaatacaaaaataaaaaataaaaaagttcgataggggctggatatttgcttttgttttctaaattttgtggatgtggggctagtgcaaacaaacatttttgtgtatcctgttgaactcttgaaactggaaaatttgggatatttgagaggcttggaactaaataaatccaatttcggaatacagagggagaaagtacatgggctattgtagtacaaaaagcattgtcactgaatatgacccaccccaagtccgattgaacaaacaggttgtacaaactcttttttcaatattgtggagcaagaaggaaataaaaatgaatgaaacaagatccttctattcaagggacatatttaataaggtaaataatagctaaaggcaactataaaacagaacaggatagtttagtaagagtaaaggaagtttgggaacacagagaaaagataggtgtgaattacagccttagagatttgcgagggcttcttggtggggatgaactgggccttgaatgtttcatggtttgatgaagatgtataagttagaaaagcagaaacaaatattttttaaagctggtttgtttgtgacagtgtacagccatatggatgaacttctccctagtttgtcacagtgacccagggtattagcatgagagcctgtttggtcagtgtttcccatgtggtgtgctgccctaggggtggccacccggggatttgggtggtggagcctatgtagccttgtccttttatctcagtatgctgtataaatattttctgtgcatgccatgatatgaaagtggttgggaagcactattttaacttactaaatatttctctcctggtaataaattctttagtatattgcttagtgtttgtcaaaaatagctagaatatattcttttttcttttttcttttttttttttttttttttttttgagacagagtctcactctgtcgtctgagtgcactcactctggagtgcaatggcatgatctccgctcactgcaacctccgcctcccagttcaagggatgctcctgcctcagcctcccaaggagctgggattacaggtgtgtgccaccataagtggcaaatttttgtatttttagtagaggcagggtttcaccaggttggtcaggctagtcttgaactgttgacctcaggtaatccacctgccttggcctcccaagtgctgggattacaggcatgagccaccatgcctggccgaatattttcataatgagaacacattcctaattagttgtattagttaccagtgcaggagtcttctgataacgttagacatagctccatgcagcagttagggggcatagccaggtttatcaccttcattctaagtttttgtatttgtgaatgtgatgacattatgtgaggacatgatatgcttgtggtcatggctaaactttaaatataatttaaccaacatatccctccctatgcttttcttttgttttggtaacatagtaaatattggacctatttctgagagaactgtatagtgtttacagcagtgcaggtattagggaggaagggatgttgggcagatctgcttagggtaaagatagccttgagaggaggtccagagctctcttgtctaaaaggcagagaagggagaatgagcaaaagagaaatctaaaagttctgaatttataaaccagaggaaaccaggcagctggacatccaggcctaggtgttataggagacccctagttatgactgctgccaggtgttgaattcggggtataactgtagattgttggggctgtggctcatgtggctttaattaatctttttctctttttaaagaatccattaatttattgaagtggagaaattggagtctctgctgacttgtatcaagaaaaagaactaagacctggtgtggtgggtcacacctgtaatcctagcactttgggaggctgaggcagggggatcacttgagcgcaggagtttgagactagcctgggcaatatggcagaaccccatcccttaaaaaaaaaaaaattagcctgggtttagtggcacacacctgtggtcccagctacttgggaggttgaggtgggaggatcacctgagcctgggaggttgaggctgcagcgagccatgatcacactactgcattccagactgggtgacagagcaagagctgtctcaaaaagatgactatgaatgggatagtattggtgctatagactttcagaatatggttacttcttcctttcttttttcttttggtgaggtaggagttatctggtgcctagagttgttttagggaccttcagaaaatatataacaccttcctgctcttgttcagttcttctgcctagtagacttcagcagtgtgagtttggttttataactactgtaaagtcatttttacatgaactgctcaccacttagtcctaattatcattggaacataaaatggacaaaacattaaaataggtgtcatgtaaatgttattgtaaattttatttatttataacactcttgaaggtttattagtttttgactgcttacaattttttttaattacagggaatatttatcagccgccccaagtgttgataagcaacacagatccaagtgcataatatggtattaataggataaaaaattaggacattggtaattatatcatcgaaaaaatctttgaggcagattaatttagaaaggacttcaaataatttaagtacttctcagaataattaacattaaaaaattacagaagtaatacacatcagtatttagcttgatgagttttgacaaatgattacctccttgtaaccaccattgcaatcaaaatgtaaatatttctgtcttcccaaaagttcctccatatccctttgcagtaaccccttcctgtccctaacccttaggcaaatattaatctgctttctttcattgatcagcttgccttttccagaatttcgtttaaatgtgatgacaatacatactccttttgtgtctgatttttttaaaacttaatattaacattaatattttgtgtacctaaagttcattcttcttaattgctgactcatattcattatatgaatataccacaacagtaggccatttacctaccgttggccatttgagttgttactagtttttggcaattgtaagtaagactgctatgaatatttgtttataaagctatgtgtatgtcttttggatcagtacaagtctatgtgtttctctgttgtatcaatacctaggaacagagtggctgggtcatataagtgtgtatttaactgtctttatttattttgagacagagtcttgcttttgtcacccaggctgaagtgcaatggcatgatctcagctcattgcagcctctgcctcttgggttcaagcaattctcctgcctcagcctcctgagtagctgggattacagacgtgcgccaccatgccctgctaattttggtatttttagtagagatggggtttcaccacgttggccaggctggtctggaactcctgacctcaggtgatccacctgcctcagcctcccaaagtgatgggattacaggtgtgagccactgtgcccagcccaacagtatttagaaactttgaaattcttttccaaggtggttgtcctattttacattcaccaacagtgcgagaattctaattgttccacatgctcaccaatactttgttttgccagtcttttaaattttcattattttaccaagtgtgtagagatgtcttattatggttttattttgcattcttcacattctcttgatgaagagcatctgaaaaatccacagcttatgtcatattaatggtgtaaatgtaaagctttccccctaagatcaggaataagacaaccgtattcattgttgttcttcctattcagtattgtaccagattttctagccaacacaattaggcaagaaaacaagatgaaagataaccaggttggaaaataagaattaaaactctttatttgcaaatgatatgatcttctggatagaaaattctaaagaactcacttaaaaactattagagctaataaatgatttcaacaaggttgcaggatacaagatcagtatacaaaatcaattgtattttagtataccagcaatgggcaatctaaaattaaaacaggccaggtgtggtggcctatacatgcctatacttcccaaaatttaggaggctgagacaggtgggttgcctgagcccaggaattcaagaccagcctgggcaacatggctagatcccgtcactacaaaaaaaataccaaaattagctaggtctgatggtgtgtacctgtagtcccagctactctagaggctaaggtgggaggatcacttgagcttgggaagtcaagaccacagtgaactgtaattgtgttactatgatgagcagtagagcctccagcctgggtgagactaaataagcaacagagtgagaccctgtctcaaaaataaataaaatcaaaaatttaaaaagctgggtgtggtagcatatgcctgtagtcccagctacttgggtgcagaggagggagccttgagctggagaggttgaggctgcagtgaatggtgattgcgccactggcactccagcgggggtgacagagtgagaccccgtcttaaaaaacaaaataacaattttgttacaacagcattacaaagaataaaatgctcaggaataaattcagcaaaagtgtaagacttattttctttatcaggaattcattgtttactgaaagtttaagacttgtatgctgaaaactacaacttcattgaaagaaagatctaagtaaatggaaatatatttcatgttcatggattggaagagttaatgttaagctgcagtaatctccaaatgaactaagagattcaatgcaatttcccataaaatccaagctgacttgccttttttctttttttctattcttttcttttggcttctttttctcttcctcttcttttttttttttttttgaaatatcaacaagttgattctgaaatttgtatggaattgcaaaggaccctgaataaccaaagcaaaacttgaaaaataagaactaagttgaaggactcatatttatatttagcaatttcagaatttacagaacaagcaaacctatagtaattaagactgtgtgatactggcataaggatagacatatggaccaatggaatagaattgagagtccagaaagaaactttcacatttaccagttatattttcgggggttttttcttttcttttttttttttttttttggtaggtgggtaggtcaattgattttcagcaagggtggcaaaacagtattacaaggaaggaatagtttttttttttcaacaaatggaacaaatgactatccacatacaagagaatactggagccttacacagtatgcaaaaaccaactcaaagttgattaaagatatacatgtaaaaactaaaatgtgtaaacttctcagaagaaaacatctgtgtagatctttgtaaccttggcactggtttcatagtaccaccttaaaagcacaagtgacaagaggaaatataggtaaattggactttatcaaaattaaaatattttgtacttcaaaatacgccatcaaggaagtagaaaagtggccaggcatagtggctcgctcacacctgtaatcccagcactttgggaggccaaggtgggagaatcacctgagcctaggatttcgagaccagcctaaacagtgtagtgagacctcgtctttataaagaatttaaaaatttgcctggtgtggtggtgcacatctgtagtccaagctgcttgggaggctgaggtgggaggatcactggtgcccaggaggttgaggctgcagcaagtggtaatcatgcctacctgggcatcagagtgagaccctgtctccaaaaaaaaaaaaaaaaaaaaaaagcagcccacaaatgggaggaaaaaattgcacatcatacatccattaaaggtactacttaacatccagaatttgtaaagaactacagctgaacaatacaaagacagtctagtttaaaaaggggcaaggacttggacagttccctgaaggaggcatacaaatgaccaacaaacacatgaaaagatgcttaatgttattagtcattagggaagtgcaaatcaaaagcaagagatatcatttcacgtacactaaaatggctaaaatcaaacaaataatagcattgggaaggataagtagaaattggaattctaatacgcttctggtaggatgtgcagcaactttagaaaatagcagttcgagatgttaatcatagagttcccatatcacctagcaattttattcttaggtatgtgtccaaaagatgaaaaacacgtacatgaatgcttgttatagcattatcataatatccccaaagtggaaacaacccaaatgtccttgaatggaagaataggtagataaaatggggtatgtccatacagtagaatattattcagcaataaaaaggagtaaagtatttatacatgctacagcatggatgaatctcaaaaacatgctaagtgaagaagccagacatgaaagtccacatattatatgattccatttgtatgaaatgtccaggcaatcaaatccattgatacagaaagtagattagtgattgccaggggttgtgggaaggagcatggggaacaaatgctaaagggtatgtgatttctttttgtggtgatgagaatgttctaaaattaggtagtggtgatggttatacaactctgtactagaaaccacggaacttatccttttaggataaattttatggcgtgggcattatatctgaataaagctgctactaaaataaaaaggaaaaatacacctaatagtagcataaattacctagttaagtcattttcagaatggagtttatgtagtaaaagtaacgtggcattctggcttctagtaatggtgcaatactgtagagttaccttcctatagataacaatgataatatctggacaaaatacattaatttttctttaaaggtactggagagtgatcaaaagcagacaaactggaggagagcctattcttaaaacataactatcttgtgaaattcatgagttggtgggtttttgtctgagggtgctctgtaatcctcctgctacttggtgaagaataccacaaccttatttgcatgaaatgtaaggatacagagttctgggctaacagaacagcaagaaacttagtgggtaaatcctggaagagaggcagctacaaagaaagtgagtccaaaaaaattcgcatataagatctgtccaaattcttggcagtttttaaatactatgcatgcagtggtggcatgtgtagtacatgtatgtgtggcacacaagttgggttcttgacatttagtaggtagaacattaactctgaatagattgttttaagttaaagtcacagttgtgatccctagtgagaaatctcaaaattaaaagatgaacctaaatgccaggagaggaatatctaatggaatgctaaaaaaaaaaaaaaaaaaaaaaaaaaaaattgattaacccaaatgaagacaggccggcaggaagagaaataaaaaacaaacgagatgatcaaaaacaaaaataccataatgaaatgcctgatttcaacaatatcagtcattatgatacatttaaattgactaaagcatcccgattaaaaggcagagattgtcagactggattaagaagcaagacccaactgcatactgtccattttaaatacattttgcactatgtagtgcattttggctacagtgcatattggcttctatgtagcagctttttttttttttttttttgagacagagtctcgcactgttgcccaggctggagtgcagtggcgcgatcttggctcactgcagcttcagcctcccaggttcaagcgattttcctgcctcaccctcctgagtagctgggattacaggcacctgccaccacgcccggctaattttttgtatttttagtagagacggggtttcattatgttgggcaggctgatctcaaactccagaccttgtgatatgcctgctttggcctcccaaagtgctgggattgtgtagcagcattttaaatacaaagacacagtttgaaagtagaaagatgaaaaaatataatagtgatatgtacattttggactatgtaaggtaggtttgttgttggtactcacattgtaacttagtaataaagcacaagttttaatgaatgctttatataggtatactttactttgtacagtaaacaagtcatattttgtagatgttcagtaaggacttgttatggaaggtactttcactgtactgtcccagagatagattgtgatatcctcgtttcctaagtggggactctggggttcagagaggttaagtaataggttcaggatcacatagctagttagtgacagagccactcttatggtctttccattgtgtagctcttgtggctttaatacctaagaaggtacataggaatagatttttttgcaatttgagtcacattttttaaagcagctttaaactgtacacaatttgatactctttcacacacgtacatacactgatgaaaccatcaccacaatcaagataatgaaaatataatttgtaatagttctttttattctaatttaattgatattattctttttttcttcttttttttttttttattgagacagagtcttggctctgtcgccaggctggagtgcagtggcgtgatctcggctcactgcaacctccacctcctgggttcaagcaattctgcctcagcctcctgagtagctgcgactacaggcgcctgccaccacgcctggctagtttttgtgtttttagtagagacggggtttcaccatgttggccaggctggtctcgaactcctgacctcaagtgatccgcccacctcggcctcccaaaatgctgggattacaggcgtgagccactgcacaggcctaattgatattattcttgtattaaattatttcatggtattgctctaaaattttaaactcttaggacataatgtcctgtgtttagtcctaaacctatactttcagtcagaacttaaaattataaaaaaaaaaaaaaaaatcctaacttgattacctctgtgaagaggaaaaaaaaaaaaaaaggaatcccatttcagttatttgtaaagtgaaaaatctcactcccttcttaattttttaaaaaaattctagttgatatcttgtaatattaacgcagtggaattttctgtctgcagtggagtaggaataggcttttttggaagggtaaaacaagctttaatttttgatgttaggtttattaataaacttctccaccccctgctatatttttttaatctgtaactggcagaccagtggaactggatagagaaggaagtttgaagtttccgatttattcttaatttcacatactagaaaagactttttagatcaaaataatgcttgtcttccagagaggatgccattcaaatagcaaatttaatataatttctgctatttagattctaagttatttgatttttagttactcttatagagaggctaaatgtttcaaattttggatggtctcactagcacaggaagagaacaggttcataatccaaaattataaaacacaggaagaaatatatcacagataatacagacaccaaaaacgtcagtcttatgtctcctaagaaattcagcaatagaggtaatcagagaaagactgtaaaataaatatttttaagatgattgaatcattttaagaaggacctaaaaacattaagaagtactacaaaaataaacttgctagaaatgaaaaataaatcattgatgttaaaacctcaatggacaggaaaagtaatggcatttaatattggaaatggagattacaacctgtagacagaaaagggaaacaaacattgatgactgcctgcttcgtgacacgagctgcttttattaatgtttattttatttaattcttggaactactttttgaggtagttgaatatcccacttttagagagtgctgttatctacagataaggtgaaaacagtaaattaagtaagaccagtgaggaaaatgatgaactcagttttgaatgtcttaaggaacatgtggggttttctagggagtgatccaggagatactttagttcaggagagagatccgggcttaaaattttaagctgcttaaattcccaaggttatgggacttgcagaacacaccaaaatctgtttacttagaaatacagcagtttacttaaaggatgctagctaaagggagctataattggaggggtgattgacgtctgacatctgacattttatgtcagcattttcaaatctatagagacaaaaagtagataaatggttttgtaagactgagatggggagcttggtagaatggtaagtgtctgctaaaggataaaaggtttctttatgtagtgatgaaaatataggccaggcgcggtggctcatgcctgtaacccagcactttgggaggcatagatgggaggatcacttgagcccaggagtttgagaccagcttgggcaatatagtgagacctcctctcagaaaatatgataaaattgattgtgttaatagttttataactcagtgaaatacactaaaaaccattgaattgtatgtatactttaggtgaattgttggtaagtgaattatatctcaaagctgttatgacaaaaaaggtaatggttccacattgctgtattgattaatcataacctagaatatatacaggtgagcaaaataataaatagtacgttttagatgccagatacaaatatttttctgtatttaaagattaactagattttcccttacatgtattctatttataacattgaaaagttacatattactgcccaattcagaattcatcaggaaacaaatctggattatccagagttattaatacttaattgataattgaagccatggagatatatatgataacctagaaagggtttgtagagtaactagatgaataggcaaaaccttgggaagagcaacatggatggatgaaggaggaagaccaaagaggaggaaaaccaggaatgtggtgttatggaagtcaaggagatgagaatgaatgaagtgttctcccgcaaaggtaccatgtaattaaggattgtgttccatgaatagaaggttgctgataatgttggcaagagcagagccaatggaattttggatggagtggactaaataagtagaagtgaagacagtctagactactttttcaaaaattttggcaaaagagaacaggaactagttaaaagaaaatgtagattgagaaaggttcttttttttttttttaagtgaaagacatggtcatgctcatgatatgggaaatagaatacttgaaagatgggagagaggagatggataattgatgaagcaaggggacagttgatgagagaataattagattcagtgcacagctagccacctcttgcactgtcattgtgataggatgaaaggagacagggatcttgggattggggaggagatttggacgtgcacgttaggaagttgagggagttgctactatctgatagtttctgttttctcaataaatatgaggcctggtcttctgctgagaggaaggacgatttggaagggggcttgagcagtagctttttgtgcaaaatctaactaggaaagcctggaaagatttccagacagtaagcattgagagcttaattgaggttagagacctagaatttgttatacctataatggaggttgagtaatttattttttctgttgcacacttagcaactcagcttttggagtgagaattgaaacaacccagagttaacttttcaccagggcaacaggatagaagtacaagagttagagttgatgaagtatgaggactatataagaaggaaacaaaaacagagcgagattctgtctcaaaaaaacaaaacaaaacaaaacaaaacaaacccaacagactaaaaactgacaaactgactctttttttttttttttttttttgagacagggtctctctctgttacccaggctggagtgcagtgggacaatcacagctcaccacagcctcaacctcttgggctcaggcgatccttccatctcagtctcccgaatagctgagactccaggtgcacagcaccacacccagctaatttttaaaaatctttttgtagagatgtctcattatgttgcccagcctgttcttgaactcctgggctgaaacactcctcccacctcagcctcccaaagtgctgggattgctggtgcccaccacctcacccagctaatttttgtagttttagtagatggggtttcaccaagttggccaggctggtcttgaactcctgacctcagatgatctgcccacctaggcctccaaagtgctgggattacaggtgtgaggcactgcacctggccagtttttagtctgttgctttttgaagataatctgtttttctctggctccttctaggatattttcctcctgggaaaagaaatctttttattttcccacttggagtttgttgggtgtcttgaatctgtggtttattgttttttatcaattctggaaaattcttagctattatctcctaacagttgcttctgtccagaggaacccaaacaaacactgttttgtattttttattgtatcctttatgtttcttaccctcttttctatatttgtcatctttggccctcttttatttcataattgacggtttcttctgacctgtcttaaagttcacagaatctcttaaactactttaaatttgctgtaaaacccatctgttcagttcttaattttggttatgtgtctaacttaataattattttttcatatctcagagttctgtttggttcttttcatttttcagatctggtcatttctgatcatttcttctggcttgctgatatattttacttccatttttctgttcctgaaatatttgctgtagttattttatgttgtataacctaagtgttaatttaggtttaactctccaacctggcatcaggggtcaggacttaatttgttcccagtatgaaataggcagctaccttcatagttttcatttcacttaattactttttatgacttccctcttaggttcaacttgaccgacctctcctcttctttttttgttttttaagccagccttggtgtaaactttatttatttatttttttaatttaattttattttttttattgatcattcttgggtgtttctcgcagagggggatttggcagggtcataggacaatagtggagggaaggtcagcagataaacaagtgaacaaaggtctctggttttcctaggcagaggaccctgcggcctaccgcagtgtttgtgtccctgggtacttgagattagggagtggtgatgactcttaacgagcatgcagccttcaagcatctgtttaacaaagcacatcttgcaccgcccttaatccatttaaccctgagtggacacagcacatgtttcagagagcacagggttgggggcaaggtcatagatcaacagcatcccaaggcagaagaatctttcttagtacagaacaaaaatggagtctcctatgtctacttctttctacacagacacagcaacaatctgatttctctatcttttccccacatttcccccttttctattccacaaaaccgccatcatcatcatggcccgttctcgatgagctgttgggtacacttcccagacggagtggtggccgggcagaggggctcctcacttcccagcaggggcggctgggcagaggcaccccccacctcccggacggggcgatggccgggcggaggcgccccccctcctccctccgcgacggggcggctggccgggcgggggctgccctccacctccctcccggacgaggcggctggccgggcgggggctgccccccacctccctcccggacggggaggctggccgggcgggggctgccccccacctccctcccggatggggcgtctgccgggcggagatgctcctgacttcccagacggggcggctgccgggcggaggggctcctcacttcacagacggggcggctgctgggcggaggggctcctcacttctcagatggggcggctgccgggtggaggggctcctcacttctcagacggggtggctgggcagagacgctcctcacctcacagacggagtcgtggctgggcagaggcgctcctcacatcccagacggggcgtctgggcagaggcgctccccacatctcagacgatgggcggccgggcagagatgctcctcgcttcctagacgggatggcagccgggaagaggcgctcctcacttcccagactgggcagccgggcagaggggctcctcacatcccagacgatgggcggccaggcagagacgctcctcacttcccagacggggtggcggctgggcagaggctgcaatctcggcactttgggaggccaaggcaggcggctgggaggtggaggttgtagctagccgagatcatgccactgcactccagcctgggcaacattgagcactgagtgaacgagactccgtctgcaatcctggcacctcgggaggccgaggctggcagatcactcgcggttaggagctggagaccagcccggccaacacagcgaaaccccgtctccaccaaaaaaatacgaaaaccagtcaggcgtggcggtgtgcgcctgcaatcgcaggcactcggcaggctgaggcgggagaatcaggcagggaggttgcagtgagccgagatggcagcagtacagtccagcttcggctcgccattagagggagaccgtggggagagggagagggagactgtggggagagggagagggagaccgtggggagagggagagggagagggaccctcttctctactacttatatgacatcagcactgcattaaaaaatatttttttctgttaatagccaggatccagttgttgtagaacaggtgacctcccaaagtatgacgtctttcagaagtaacatatactgtttttgtcctacttttttgttattaagaatatgtatgttatttaaaatataggaattctttttaaaaacacgataccattatcacacttgccaacgtgatcatggggggaaagggcagcagtgctggtgcaagtcctggaatccgaagaccatagaatctggagttctgacagcaagaattactcttgcctcctctttttgttccatctgggccccagcttattgaatgctgcccacccacattgagagtgaaacttcccctatcagtctactaactcaaatgccagtctcttcaggaaataccctcacaggcactgggacagcccagtcattctaatcaaatgcctgaccgcccgggttttcctttcagcagaagagggacgagctcagtgctgtctgaaccactgaggataattaatgctttcaccagctatctgggtatcccttaatccagtcaggttgacacctggaatcaactattacaaggtccacacattgcgattgattgattgatgtgaactcaaagtctcctttttaatttatggtctcttaatctcaccatctttgtcttttttatgcactttattgttggagaaactgggttcatggaggttctcataatctgaattttgcttttttttttttttttttgagatgggatctcactctgtcacccaggctggagtgcagtggtgtgatcttggctcactgcaacctctgcctcctgggctcaagcagtcctcccacctcagtctcctgggtagttggaatcacaggcatgtaccaccattcctggctgagttgttttttgtatttttggtagagatgggatttcatcatgttgcccaggctggtcttgaactcctgagctcaagcagtcttcttggattgctgggtttacaggcatgagccaccgtgcccggctggattttacatcttatcatgtcacttgacatgtgtattggccctctgtatttcctgtaaattcaaagttgaagctggaggctttatcagattcagatgatttgggggaattgggaacatgactgcatcatatgtgatggttttctcttccatcagaaaggcacgtagtgtctggctgtctctttctgttatgttgacatcaccactgaggaacattgtctaagtctgttatttactaggatttgtaaaatggtgataatctatcactccttctttaagctagaccagggatccccaaccctggaccactaccagtccgtggcccattaggaactgggctgcacagtaggaggtaggcagcaggcaagcaagtgaagcttcatctgtatttacagctgctcctcattgcttgtattaccacccgagctccacttcctgtcagatcagcagctgcatttgattctcaaaggagcacaaaccctgctgtgaactgtgcatgcgagtgatctaggtgcatgttccttatgagaatctaatgcctgatgatctgtcaccatctcccatcatccccagatgggacctctagttgcaggaaaacaagctcaggcctcccattgattctacattatggtgagttgtgtaattatttcatattacaatataataataatggaaataaagtgcacaataaatgtcatgcacttgaatcatcctgaaaccactccttctacttcctagtccatggaaaaattgtcttctgtgaaactagtccctggtgccaaaaagtttgggaacagctgagctagactacatctattaagagaaaccttcctctcatttattaattggttagattaccccatgataaaatttgtttagaaacagtaaaataaatgcttgattcttttcctttatcagttttcaaaataatgaggtagttcattatcatccttcagtgatgacaatttagttgtttgggtttttatttccatttcctggatttacagattgaaatctatgtgtgtttgaattcattgtcttattgataattgataataattgtattgtctttgaacatttggagcctcttcatgttagctcttgagtagtttttacaagactctagtctcgtaaatatctttgatatttggtatgttaagatattgcaggcttaccttgtaccttttctgcccattagttggaatgaaccagttctgtttgctattggtggtatttttgagagtattgtctatgcactcactgatttggtcactgtttctaggcgttggagatacacatctccaagtagacatcttggggtggatagatataggattaaaacaaaattttgtgtgtgtgtgtatgtatataaacatatgtgtgtgtgtatatttatatgtatacatatttatatgcatatttatatacatacatacacacataaacacacacatataatgcatatattgatattccaattcaaattcaggactatgggattttactaaacaacttctatcatatatccgtctttctcctaggccaaacttcctgtttttttctgacaccaggaataatagaatatgacatttttactcatttgctttattccacatagacacataacagtctcagaataacaacaccagcagcgctgcacccagtaatagggttaccgagaacagtttggagttttcctggtagttctctttagggttaactggagatgcagggttaaattgctgtgttgaaaagttacacaggatagtgtgattatgctaccaaatggatacacgtttaggttcatttctttatttttagggattgcttttcttgttaaatttgattttgtcatattcatacgcagtttattttcatggttttaaagtcaagtcctagtttccttgtcatcacctatatatttatgtgtaaaataatcattgtatgtgatctgttttattttttgttttagtatacttttggcctctagtttgtggttttgtttttgttttctttagtcctctctttcttagttattttctattgattccccatcatgtacattattgaaattagttgtgaccttctcttttccttccccctcagcatctgatgtatatcctttaaaatttttattaaaaactgacctttattttgaggtgattgtagattgacatgcagttgtaaaatataacacagagatcctgtttatcctttctccagtttccccagtggtaacatcttgcaagatgctcgtacagtatttatgttcatccaagtcattgtttgtatcagcagtttgtttcttttaattgctatatggtgttccatggtatggatgtaccacagtttaagcgtgaaggatacctgggttgtttccaggttgtagctattaagaataaagctgttgtaaacatttgcgtacaggttgtgtgtgtgtgtgtgtgtgtagatgagttttcatttatctcatataaatgtccaatgtgtagttgctgggtcctgtggttgttacatgtgtactttaagaaatggccaaaggtgctgtcattttacattcccacaagcaatgtatgaaaactctccatactcaccagcatttgaaagtatcacaattttaaattttagatgtataataagatttcatggtggttttaatttgcatttccctaatggctaatagtattgaacatcttttcatgtgcttatttgccatgtgtatatcctcttccatgaaatattttttcatttcttttgcccattttctagttccattggttggttggttacctgttgagctttgagaggttttttgtttttgttttttaattctagatactagtcctttcttggatatgtggttgcaaattttttttttttagtctctagcttctctttttatcttctttacatgggtgttcaaagagcaaaatagttttttattttgatgaggtctagtttaccaactatttctgttatggatcatgctttttacggtcaagtttaagaactctttgcctagccccagatcccaaagaattatctcctgtggtttttcctaaaagtttatagtttcacatttattttgaattaaattttttttaaggtgtgaggcttaagtcagggttaatatttttgtctgtcaatatctatctggtccagcactgtttgctgaaaagtctattgatgtcctccatttaattgcttttgcacctttgtaaaaaatcagttggatatatttgtgtaggcttatattgggttctctgttcttttcaatgtgtatattcttccactgatatcacacaatgtttattactgtaactatgtaatatatcttgaaattggctagattgattccttccacttcgtttttcattttcagaattgttttaactattctacttactttgcctttccgtataaattttagaataattctgtatctgcaaaatatattgctgggattttgataggaattgcattaaacctgtatatcagtatgaggagaatcaacatctttaccaagttgagtctaccaatctatgaacacaatatgcccctccattttttctcttttttaagctagaaacaggatcttgctctgtcactgaggctggagtgcagtggtgtaatcatagttcactgcagccttgaactcctggacacaagcggtcctcctgcctcagcctcccaagtaactaggacaataaacacttgcctccatacctggctaatttttaaattttctgtagaagctgagtctcgctatgtatggtcttgacctcctgggctcaagcagtcctccctccttggcctcccaaagcactgggattacttgagccatcatccagcattgtttgtttgttttgaggcagggtctatctctgtcgctgtggctggagtgcagtggcacagtctccacttactgcagcctccgtctcccgagctcaagagatcctgctacctcaccctccccagtagctgagactacaggcatataccacgatgcccagctaaatttttttttgcttttttttgtagagatgaggttttgccattttgcccaggctaatctcaaattccttggctcaagcaatccacctgcctcggcctcccgaagtgctgggattacagatgtgagccaccacacccggctgttgtttgtatttttaatttcagtgtctatgtgttcattgctagtatatagaaatataattgatttttatgttgtattctgtgacattgttgaactcacttaatagatctggaaagtttttggtatattccttggaatttttaaatcatcttttctgcaaataattgattgttttctttattttattttttattttgagatggagtctccctctgtcgccaggctggagtgcagtggcacgatctcggctcactgcaacctccgcctcctgggttcaagcgattcctctgcctcagcctcccgagtagctgggactacaggtgtgcaccaccacgcccagctaattgtgtttttagttgagatggggtttcactatgttgaccagatggtcttgatctcttgacctcgtgatccgccctcctcagtctcccaaagtgctgggattacaggagtgagccacagcacctggctgggattattttctttcttttgcatctatatgccttttactttattttcttgccttattttactggctggaacttcttatactatgttgaataatagtggtgagagtggacaccattttcttgttctcaatctagggaaacatagtattcagacttttcaccactagaatgttaactctaggcttttatttttctgagtgtttttactataaatggatgttgaattttgtcatttttttctgcattgaataatataatcattgatttgtcttcattagtctattagtatggtttatattgattgattttcaaatacagaaccagccttgtatcactagaatgaagcctgctagtatagtgacttctagttggtaacattttgataaggatttttgtatctgcagtcattgagaatattggcctgcagtttctttttcttcttttttttttaatgctgtcttttctggttttgttattcaggtaattttgtaattagcttcataaagtgaattgagaagtgtacccatctgttttttgtagagattatataaaattggtgttagttcttctttaggcatttggaagaattctctagttaaaccatccaaaccctgaagggaagttttaaaattacaaatataatcatcttaatagttaacagcgttattcaaattaggtatttcatattgagtgaggtgtgatagttcttgctttttgagtcattggtccatttcatctaaattgtcaaatttgtgtgtgtagagttgtttgtagttttcccttgttcttttgatgtctgcaaagtctgtagtgatagtacctttttcatttctaatattataactctgcattttctctttttttttggccagtctgctgatttttttttttttttgaaagaactagcttttcattaattttctctactttttgttttcaatttcattgatttctgtttattccttctgcttgttttgggtttgttttgctttttatgttgtagggtgtcgaagctgggagttttgattattggtttgagactttctctctttcttaatgtttgcattaggtgctttaaatttctctctcagcactgctttaacctcttttctgctctacttcagcatctgatgtgatgcaatttccttttctcaccagttaatagttaataaggcaatcaatacacttagttgtttttttgtttttattcttcttgagatggagtcttgttctgtcacccaggctggagtgcagtgacgtgatctcagttcattgcagcctccacctcccaggttcaagcaattctctgcctcagcctccgggaatagctgggattggattacaggtgcaaccaccacacccggctattttttgtatttttagtagagatgaggcttcaccctgttggccaagctggtcttgaactcctggcctcaaatgctccacccgcctcagtttcccaaattgctgggattacaggcgagagccactgcacctggcccacttactcagtatttcatatgcatgttttgtcttcctttcaattttgtgtctacattgtcagggcatgtagcagttaaatactgtattttttcccttataacagtggtccccaacctttatggcaccaggggccagttttgtggaagacagtttttccatgaatggcgggtcggggaggatggtttcgggttgaaactgttgcaccacagatcatcaggcattagttagattctcataaggagcacacaacctagatccctcacgtgctcagttcacaacaaggtttgtgtttctatgagaatctaatgccaaccgtgatctgacaggaaatggagctgaggccataatgctcacctcctgctgctgtgcagcctggctcctaacaggctatatggactggcaccagttcacggcccagggattgggcctaccttataaggactatttaatcttagttctacaggtaaataaattcattgctcacggtcaccttttatcagtgtctctccagttattttggttgtgtggtgaccattctctattagattcttcagaaagtgctcatataaacagtagtccttgagttgtgtttataacagttgttttgccacttgtatactttaaatttagtggttctgactggatataaagtccttgattcacattttcaatattttttgcctaatgtccagatgcaattttctcttcttttctttttggaagtccgttagtttcacttgtatatttctcagtgttggtttttctggatggattccccaggtacttgggtgtactttcagtatttcagttcaagtcttctaatttcaggaagttttttttgatttatagttttaagtatttgctctatttcattgcttcggttttcttatttgaggagtctttattatatgaatttaaaatctaagtgcctttattgtcacttccttctgataattttctttttttttttttttttttttttttttgagacagagtctcgctctgtcacccaggctggagtgcaatggcgcaatctcggctcaccgcaagctccacctcccgggttcatgccattctcctgcctcagcctcccgagtagctgggactacaggcgcccgccaccatgcccggctaatttttgtatttttagtagagatggggtttcactgtgttagccaggatggtctcgatctcctgacctcatgatccgcccgcctcggcctcccaaagtgctgggattacagacgtaagccaccgtgcccagcccttctgataattttcaccttcatttctgattacagtttttttctttacatattctgtttctcttaagcattatctgttgtttactggctcttaagattgctcttggctaggttcctttctgaaataattttttgctttatttctaattcttttttgattgctaggacctcatttctgagtttttctaattctgattgataatgttatttcacattttctatcattttctaggatagtttttatcacttttgtgtatatgtcttttcagtaggctttcaatagcaacactctgtttcctattctctcatttcttacagcatgggcttcaacgccaatcctttcctgtccattttttgatagattttcctgaacttttaagagcaagaagtgggtcagagtagcctttctagtttcaccactcaagatctttttcttctgttgtttgttacaagatgattttttttttaagggggtggcattggcatcctattttctgaggtctggctctgttcattgtaggacattgtccaggaagaggattttagttctttgattttgtgtctagctccatcatacttaacaatgttgatgtgtgcaaaagatcccttccatttgcaactgttctcaagttgcctttccaaagtctctagtcattcatgatttgggagttctcttgttctcagggtcttcaatcgccccataacttctgcccttccattttcttctgcatatatgcatatgaatcctgtagctggtgatttaaccagaccctgcttgtatttgagaattcgttagaatactttgtctcccaaccttgtaggtgtcgtttgtttgcttgttttggggacagggtctctatcacccaggctggagtgtagtggtatgatcatggctcactgcagccttgacctcctgggctgaagccatcttcctgcctcagcctcctgaagagctgggaccacaggtgcacgccaccacacctggctaatttttaatttttttgtagagacaggtctcactgtgttgcacaggctggtctcaaatttctgggctcaagcaatcctcccgcctcggcctcccaaagttctgggattacaagcatgagccactgtgcctggccctcttgtaggttttgtctgtggagtttaagtttggctattctgatgacattttttgtgtggggcaggggatgccaagagatgaaaaaaatcattgacacattttattcaagagaaagatgacacagattttgcattttaaaaagaacccccccggctgcattgtggaaaattgattcagtgcatggaaggagactagttaggctattttagtagtccagattagatgatggtggcttactcttagatagtggccgtggagctgggaggtttgaatcctgttctggttgacttgtttgatttcagaggattgaaagtgagtagacagggatagtcttccaggattggtctcttgaaactatttggatggttgtacagtttcctaacattaggagtattgacaggagaggagatgtgggggatctttttggtgagggtgttaggaagggaacaagtatattagttttaagcatactgagtttgaagcctttaaaccatctctcttccagcccttaacacacatatgcacatattttaattcttttgggagcttttttctgtccctctgattatatctcctcttgatacagatcttaacatttactttcctatctcaagcttaacacttttttttttcgagacagaatctcactctgttgcccaggctggaatgcagtggcccactcgtggctcatggcaacctccgcctcccaggttcaagcaattcttgtgcctcagcctactgagtagctgggattacaggcgtgcgccaccatgcccagctaattttgatatttttagtagagatggggtttcaccatgttggccaggctggtcttgaactcctgacctcaggtgatctgcctgccttggcctcccaaagttctgggattacaggcatgagccactgtgcccggccagcttaacacatttttatcactcattattactctcatttccactagaccaggtgctggcaaaccttttttttttttccaaggcagggtttcactctgttacctaggctgaaatgcagtggcaccatcatggctccttgcacccttgacttcctgtgcttaagcaatcctccatctcagctcccccaagtagctggaactgtaggtgcacacatgagcacaatgagatactacctctacaaaaaatgaaaaatcagctgagcatggctgtgctcaagtgatcctcccgcctcgacctccgaaagtgttgggattacaggcgtgagccactgcacctagtctgctaacttttccttaaaaggacaaatagtaaatattttagcatttgagggcaaagaggcaaaaataagagcatgatgtaggtacttaatatcatttataatgtaaccacttaaaaaatgtaaaaaccattcctgttgggacctacagaaacagatagcctgccagatttgatacacaggttatagtttgccgatccctgtgctagactgtgaattctgtacttgcttcccggttggcaaatgtattgcccaatgtattttaaatgtattgagtaaatttttgttgaatgggtgaatgacttatagattaggagcttaagagacagagtggactaaaaatagatacttgggagtggtcatgaagcagtaattgcagacatgagggtagatgagatcacttgggaagaatataagggagaatataagggagtccatctttttctgtaatttaaacaaagagcatagtaagtcatgactaactcagaggtacttaggtatggtagtcagtacctcctcttcttaactgacctaagtgagtttggccatttacatttatatgattctttcgggtgaataagtggtctttaattattagagataggtgagggtaacagatactttcgcctttgaagttttgctactagtgagttatatacacaaatcttagaattatgctgcatatataaatatgtattagtaagcagtcacaaaagtcatatggttcgtttcatgggtatagtacttttagactggagattaccaccttgtaagaaaacttcaaccctaagcagataccacaatgttctgactaggattaggtgatacagttctctaagaagggatggaacacaggatcaagggggtttctagacacagaaacttctctgaagttgtgctgtagggcctgccggattcttagaccccaaacaagtaagaatcgaggtgcctgtatttctagtcaattcgtatatcttgaataactgttctactttagcagtaaaaatctatttccaactttccttatgcagagtatcaaaccagtgtctataaattgagatgttcatattcgaagcacttactacctgggagctaactcctgtttaggggtgtttaaaacattaaattaatcacctcttaagtgtggtttcctaatttagtgtggttcttcagaatttaactcactaattctgtctatacagaaatatcttagtgtgaattaagatgatagagcagaaaatcatattttggagcagatatgctgcctggatctttttgttatgcatcatcttttaataattcataaatagttaagtgttgcaaatattgcaatgaaaatatttttcttttcagttataggaaaaattgaagtaaatattcatttaggtaaaatttttaacagtggtagagttctaatcttccagtgaataaagatagcttatagagttgtcaaataacacttcattaatgttggtatttgaagattgttcaacatttgtcatttttatgaacttatgcgtaagacattctctgtattaatagtactaaagtcacaatatagaaacatactaaatatagaattaaattcaaggttctttctagtgtcgaaccttatcagggataatagtttttatcagtatataattccatcacatgaaatgaatatgactaatttgaattttgtttggcagttttgtttctatttaatatatatctgtatttaagtttaagtttatatctagattatttcagtatagttagcaaactttataatttggattttatgagattttttttcttaagaagatcactgtggtttaagaaagagatatcacaagaattattaaataaaatatagcacactgaaccttggcagtatattaaaataataatataccatgatcatatagcctttattccaataatataaagatgtaaccatgcttatatgtgtaataaaagaatccattatatcagtatgttagaggggagatatatattatttcagtgtttccccataaggcatgcctgatagatcctcttaaactcagaaggataccttaccttttgatacaaaacatctatctcaaacttatttttattttcatgtttttaaggccatggcaatgaatttactttttaaaaatatgaatcattagagatataattcattgattgcagacatcagaaaccatccctggctgacttaagcaaaaccataatttattggaagaatgtaaggtagttcataagatgagtagagaaatggaagaactgggaattgagcaagtcaaggatataggcattatttactaccttgtccaaaattcttcctttggaatttaatgtgcctttttttccctttctccttaagattcagagttatagaggagataattctgatagtgtagttgagtcttgtgacctacttaagctaggagagagtgagccactttaggtctcattaagactacaggatgggaaggatgtaattccccaaagatgactgggtacagttagggcagggaaatgggtcctaggcagccaagtcccaccttccacaaaattaaccaacagatatccagtaaatacagaatttggctttttaactaattgtagctcatcatttaaagtataagatgtatcagtcattgagattataaatttcttcttatttatttattttttgagacagagtctcgctctgtcactcaagctaaagtgcagtggcatgatctcagctcacttcaacctccgtctcccaggttcaagcgattcttgagcgtcagcctccaggagtagctgggagtacaggggcgtgctactgcacccagctaattttggtatttttagtagagatggggttttgccatgttggccaggctgatctcgaactcctggccccaagtgatcctccagccttctaaagtgctgggattacaggtgtgagccactgcacccagccaatattaaatgacttctaactcaaatacctgagtttttttttttcttcttcttcttttttttgagatgcagtctcgctctgtcgcccaggcctggagtgcactggcgccacctcggcttgctgcatccccccgcctcccgggttcaagcagttctcctgcctcagtctcccatgtagctgagattacaggtgcctgccaccaagcccggctaattttttttgtatttttagtagagactaggtttcgccatgttggccaagctggttttgaactcctgacctcaagtgatctgcccgcctcggcctcccaaagtgctaggattataggcatgagccactgcacccagctgagatctttatatactagcagtgtccgtattttgatacatctgtaatctttgtttttcttttctagacaatgcgaagacatagaaatgaagtgacagtggaactgcggaaggtaaggttgatttacatttaaagaaaagtaattagatttttctgatgttaaaattctgtgtatcttgaataatgaaaatactgtggcaaattagtggtcatccctaaaaccacacatcactggatactttatcatggtacttattcataatagctttcatttactgagggtactaggccctgtgtgaagcactttaccatcactgaaattctcataacatctgatgaagttagatacattttctttgacatcctctttctgtgggcttcctctccctttgcttatgtaaaagttacacatccttgttaaagatactttacagaagtaaataaaagtagaaaagtagaaaaaccttgtgttttcccaactgaaagcaactgctattaaaatttattgtattttcttccattatttttggaggattttagagttaccttcatcagattgtgttttcttttttctctttctttttttgagacagcgtttcactctgtccaggttggagtgaagtggtgtgatcttggctcactgcagccttgacctcccgggctcaagtgatcctcccacctcagctggctgagtagctatgaatgcaggcacaccaccacacccagctgtgaatacaggcacaccaccacacccagctaatttttgtttattttttgtagagactaggtctcactatgttgcccaggctggccttgaattcctggactcaaacaatcgtccttctgttgggattacgggcgtgagctgccatgcctggcccaaattgtgttttcatgtgaacacattttatttgaaacaaatatttaaattgctaatccagaaaataatagtgaattctctttctttacacgtttcttttttttttttttttttttctgatgcagagtctcgctctgtcgcccaagctggagtgcagtactgtgatctcgactcactgcaacctccgcctcccgggttcatgccattcttctgcctcagcctcccaagtagctgggactacaggcgtccaccacctcgtccggctaattttttgtatttttagtagagatggggtttcaccgtgttagccaggatggtctcgatctcctgacctcgtgatctgcccgcctcagcctcccaaagtgctgggattacaggcgtgagccaccgtgcccggcctatacatatatcttttaaaaaataaatttaaaacttatttcagatctttggtgtttgtcttaggttagacttttcctcatgtaattcactcctaaaactccttcctatattgaattaccatcttgggctgggtgcggtggctcatgccgtcattccagcactttgggaggccaaggtggacagatcacctgaggtcaagagttcgagaccagcctggccaacatggtgaaaccctgtctactaaaaatacaaaaattagttgggtgtggtggcacacacctgtagttccagctactcgggaggctgaggctggagaattgcttgaaccctggaggcaggggctgcagtgagccagggtcacgccactacactccagcctaggtgacagagcgagactctgtctcaaaaaaaaaaaaaaattaccgtcttgaaacttttcagttgtagggagaaggaaggaggtcttgattctgaaagtacacattttcttagagtcactagaaatagacttgtgcatttattatttaagaattattttaaatacacactttgtttcatacacgggctaggtagctcttcaaatctgtagttttacaacaatattgccagaagctcattttaactacattcataaggtcttcatcagaaatgcatttagttattcaaccaagcattaccatttgagcaattgtctcatggaggtgaacactagataaataatcacataaccaaatatatccttacaaattgtggatgatgctatggaggaaaaatagccatgaaagttaacagagtgaggttttttttaaaattgggcattcaaaggtgacttgtctgaagaaataacatttaagctgaaacctgaaggataaattgaaattagcttattttttctaagtgtttaaataaccatattttgaatttttgcaaatcagtgtcatgctcattggtatagtatatagttcctgacatccattctcctgtaccctttccccgccccctttttaaaagtaaattttgaaaatacttgctaagagttgtagtatatatttactaaatttcaaaaaattcacctgaggtcaagagttcgagaccatcctggccaacatggtgaatccctgtctctactaaaaatacaaaaattagttgggtgtggtggcacgcacctgtagttccagctactcacaacatagaatattttctatgtaattagtccagtagctccaaaattaggaaattaacaaggaagatcatttttttgtttcaatcatcaatggattaacaactaatgatagaattattttgtctattatctattaatcatcaatcattttgtatattaataaacattagcataataaacattaacataagcataaaaatacttgctaattcccattccctgtcaactcctttatggacacaacaatactttggtaatcatatttgcaagttctttcagatctttgggtcatttagaccagagaaatgagctaagccttagcttaataaagtaaggtgttttttccagtcttaacactttaaactttttttctttttcacattttgttgacatacaccatacatacaaaaagtccacacgtcgtaagtatccagcttgatgaatatttgtaatgtgaacacatttgtgtaaccaccagctcctggatcaaaaaagagaataccccagggcctctttctaggtattggttatccccaaaggtaaccattattctgatttctaacagattattttgcatatttagaactctatataggtagaatagtgtgcgtccttttttgtctggattttcattcaccaaatgaagattactttctttaatagatgcaatagaagtaaaattggaattaagtaattagtaattattgccatctgttaacattacaccatctgccaccagatatgggcccttacttttccttaacttttcacgcttgcaattcaactttaaaacttttgtattagttcagaagcctcctcttgtttaatcattttagcccttctaatgtgcttataaatctaagctactaatttatatattatatttggttacttgatcctcctcctgttgttgtgctgccttctctaatttatagaactaaaaattcttgcatgtcacagcatatctttttaaatattcaccttagttgccttagagacccctttcttttttttttttttggctaacattatttcctttccagttactaaggttcaatttctgaaaatacttgtagtaggaccaaaaatgaaattaactaaagaaatctcaagcaatttcttatttcaagtttaagaattccccaagtaagcagtagaaagcaaacttttcctgaaacaacgcctgaagtttattcagacaaaacttaattgattttgatgtgattttacagagatgtggagagctcttcaagagaagattcttccactctttatggtcagagtatctgtccctgattccaggccttgctctctctattgctccattgaggagagaatcacattgtttttatttagtgacattgagattcttgaaaacaaaagagagctagtccccagagtttcactgagaaattaaactagtggatatcatctgtcaattgtaactcactttactccatgggattttgctttgaatatttcattttcccttagattgtaagcttctaaagtgcagataataaccacattcactatccatctacatccctccaccccagcctcccaaataactcctaagtctctttcttagcccatctcaaaatgcctaatcacattgtggctatgtagtcgattaagtgctgatattcacgaattaaatttaattatgatctctaaaaatatgcacttatatttaagtcatgtattgaagttttaagacaaatacttcagatataggccgtgctactcaaaagtcctgatctgtgacaagttagggagcttgtgccaaaatgtaaaagaaggcactgcttccttcaagagagtctttctgacagaagtaaattgaaagatatcccatgttcacggatttggaagaattagtattattaaaatatcagtactacccaaagtgatgtacagattcagtgcaatctctatcaaacctctaatgtcatttttcacagaaatagaaaaaaaaaaactaaaatttatatgaaaccacagaagaccccaaatagccaaagcaatcttaaaagaatgaacccagaagcatcacactacctgatatgaaaatctactgcaaagccataataatcaaaacagcatgatagagacataaaaacacacacacagaacagtggaacagaaaagtttgctttctacggcttacttggggaatgcttaaatttgaaataagaaattacttgagatttctttagttaatttcatttttggtcctactacaagtattttcagaaatcgaaccatagtaactggaaaggaaataatgttatacagaaaaaaagaaaggggtgtctaaggcaactaaggtgaatatttgaaaagatatgctctgacacgcaagaatttatttcaccagaaataaatccacaaatttgtagttggttgatttttgacaaaggtgccaagaacatgccacaggaaaggacagtcttttcaataaatggtcttggaaaaactggctatctacatgcagatgaatgagaccaggcccttatttcacaccatatacaaaaatcaactcaaaatagattaaaatgcaaacataagatgtgaaactgtaaaactactggaagaaaacacaggggaaaatctccatgatactggtctgggcaatgttttcctggatatgaccccaaaaacacagccaacaaaacaaaaatagacagatgcaattatatcaaatttaaaaggttctgcacagcaaaagagactattaataaagagagaacctatagaaaatatttgcaaaccatacatctgataaggggttatatataatgaactcaatagcaagaaaactaacaattaaaaaatgggcaaggattgggcacggtggctcacgcctataatcccagcactttgggaggccgaggcgggcggatcacaaggtcaggaaatcaagaccatcctgggtaacacgggtgaaaccccatctctaccaaaaatacaaaaaattagctgggcgtggtggcatttgcctgtagtcccagctactcgggaggctgaggcaggagaatggcgtgaacctgggaggcggagtttgcagtgagccgagatcacgccactgcactccagcctgggtgacagaacaagactccatctcaaaaaaaaaaaaaaagggcaaaagagcagaataaacattctcaaaacatagaactggctaataggtatactaaaaattgttcaacattactaatcagagaaataaaattaaaactactgtgagatatcatcttacacctgttagaataaccattatcaaaaagatgaaagataacgcatgttggtgaggatgtggagaaaaggaaactcttgtacactcttggtcagaatgtaaattagtatagacattatagaaagcagtatggggaagttcctaaaaatagaactaccatgtgatcaagcaatcccactactgtgtatatatccaaaggaaaaatgaagccagtatgttgaagagatacctgcactcccatgtttattgcatcacaatacccgagataaggaatcagcccaaatgtccaccagtagacaaatagaaaaagaaaatgtggtatgtatacatagtggaatactttttagccttaaaagaaagaaaccctctcttttgcaacaacgtggatgaacttggaggacattacattaccagaaataagccaggcaaacaaggcaagtatcacatgctctcacttatgcatggagtctaaaaaagctagactcatgtaggatggtggttaccaggggctggggccaggggtggggggtacagggatttggggagatattgattcaaagtataaaaaatttcagttagataggagggataagttcaagacctttactgtagaacatggtatattggtcagttttcacgttgctgataaagacatacctgaaactgggcaatttacaaaagaaagaggtttattggactcacacttccatgtggctggggaggtctcacaatcatggcagaaggtgaaaggcacatcccatatgacagcagacaagagagcttgtgcaggcaaacttgtttttaaagccatcagatcttgtgacactcattcactatcatgagaacagcgcaggaaagacccacccccataatttaatcacctcccacggcacacgggaattgtgggagttacaattcaagatgagatttgggtgggaatacagccaaaccatatcacatggttatgaactatagttaataacaatgtgttatattcttgaaaaatcactgacagtagattttaagtgttttcaccacacacacaaaaatgaaatgtaaggtaatgcatgtgttaatttttttttttttttctgagatggggtctcattctgtcacccaagttggagtgcagtggcacaatcttggctcgctgcaacttctgcctcccaggctcaagcaattctcctaccctcctgggtagctgagaccacaggtgctcaccagtttgctcagctaattttttgtatttttggtagatacgggatttcgccatgttgcccaggctggtcttgaacttctgagctcaagcaatctgcccgcctcagcctcccaaagttctgggattacaggcatgagccactgcactcagctgtgtttattaactcatagctattattccacagcttatacatatttcagatcatcatgttttactcaatacatatatagaatttttgtcaactttttaaaaataatatgtttaaagcaggtctttctgtctaaataaagagctgaactaaacagtgtgcttagtttcacagttggtttacattctggcacaagctcacctccccacctttttttgttactttagaggcttatcaccctgaaggtaaaagctccttatcttgtagcagaactgtaacaaacagtttgagaattattaactagtgtaaggatcacacttcaaataacagatactgatccgtcaaaattgaggatgacagatgacatctgtttattaataggtactgtttacctggcctctgactcctttcgtgtgaattgttttttcttttacctccttgctctctttcttcccaatttagagaggcttttatgcatcaacacttaaacacacatctgtacctcttttttttcatcacattgtagacagagttatgtaggaattaagtaacttgcatagtcacaagctaataaatggcagagctcttaccattatgctataatgcctctcaaaatacatgtgtgttggttgaataatgcttcgtgggttgagaatgagcccaaaacctgttacttatattttcaacttttggcacattatattaaatttgacctaatcttttcttgatgattggtcagtcaggccataggcccttattttcagtagatttggaggtgaggcaagtttaagatcctacataaagaaaaaatccacccaagtgccccacttgcttgataagatccagtacttgtttagttaattgtttgaaagatcttttaaaaatactctaaattcccccatattaataagccaaaaaagaaaaatatgatcatatcagttactcatttctgataaaaggaatagaaaggaattgcctcatcttggtaaagagcaccacaaaaacctcacagctaacatcacacttaatggtgaaagactaaatgctttcccctgagattcagaagcaaggtgaggaagtccatcataactgctcttattcagtataatgctggaagttctagccagtgccatataaggcaagaaaaagaaatgaaaggtatgtagtttgtaaaggaagaactaaaactgtccgtatttgcagataatgtgattatctatgtagaacatcccaaggaatctatcagaaagctcctggaactaacaggtgagtttagcaaggtcacagaataaagaaatcagtcgcatttatatatgctgaacatgcagaaaccaaaattaaaaacaatacaatttttagacaattcaaagaaaataaaatacttcagtatatattaacaaacatgtacaggatttatacagtgaatattacaaaatgctggtgaaagacatgaaacaagacaagtaaatggagagatgtatactgtgttcttggattggaagcctcaacgtaataatgacattgattctccctaaattgatctgttggtttaatgcatttcctattgaaattcaaccaagatattttgtggacatagatagacatttaaaaatgtgtatggaaagacacagtctctagaatagctaaaacaatcttgacaagaaaaaaggggaaattacttcacgcaatatgaaagcttatagtatatagccatagtaatcaatactgtgtgttattggtagaaggaaagacatagaccatggaacagaaaatataacccagaaatacacctgcacaaatacctccagctgatttttagcagttacaaaaccaattcaatggagggaaggacagctttttcaaaaatgatgagcctaaacttcacaccttatgcaaaaatacaaaatggattatagaattaaatgtaaagcacaaagctataaaagttttaggaaaaaacatagagaattttctggatctggagacaaagagctatatttggccacgaaagcctaatccataaaagaaacaattgataaattggacctgattaaattaaaaattttgctgtgtgagagcccatatgaaaagatagaaaagacaagttagatattggaagaaaatatctgttaaaccacgtattcagtaaaagactagtatccagcacatacaatgaactctcagaactcagcagtaagagccaggtgcagtggcataacacctgtattcccagctactcaggaggctgaggcaaaaacaactcttgagcccgggagttggaggctgcagtatgctatgatgttgcctatggacagtcactgcactctagcctgggcaacatagtgagacccctggctcttacacacacacacacacacacacacacacacacacacacacacacacacacagacacacacacttaatagtaagaaaaaacaaaacagtctaatttaaaaagatgtgaagagtcatttcattgaaaggaggacatacagatattaaataagcacatgaaaagatgttcagcatcgttagctattagggaaatagagattaaagccacaactacacatctatcagaacagctaaaataaacagtagtgacaacaccaaatgctggcgaagatgtggagaaactgatcactcatgttagtggtggaaatgtaaaatggtacagtcactccggaaaacagtttgtcagttttttgtctaaacatgcaacctctgtataacccagtgcttacaatcctggacattgatctcagagaaaggaagatttgtattcatatgaaatctgtacatgcatgtctatatagcaactttattttttaatagccaaaacttagaaacaacacagatggcctttaatgggtaaatagacatactgtaatatgtctacagtatatctatatgatgaaatactatttggcaataaaaatgaacaattatataagcaacaattgttgatacaagcaacaatttatataaatctccagacaattatactgagcctataattctgtcataaaaaggttatataccatacgatcccatttatataaaatttttgaaatgataaaattttagaaatggaagacaggttagtagttgccaagggttatatacggtgtcagatgagaaggagttgattttgcttataaaaggaggaatgcatcttgtgtttttggaagtgtttaccatcttgactgtggtggtagataacatgaatctatacaggtgataaaattgtatgggatgtaatacacacacacacatgcaaatacatgtaaaacgagaagtctgaataaaataagtggattgtatcaatgtcagtatcccagttgtgatactgtactatagttttgcaaagtgttacctttggggtaacctgggcaaagcatacaagggatctctccatattcttataactgcatgtgaatatacaattatctcaataaaaatttcagttaccaaaaaaagtctaagttagtatcgaaaaaagcagctatttgataagatgaattaaatgatcctgcagggaaaaaagaaacatgcattagattgtcagttcttaacatgattcatgaaccagtagtgttattttaaaaaatttgttttaatcaaagcataacacactgaacagagtgcccaaaacataaatataacttataaaacttgtgggtgaatatccatgtagtcacccagcagtaatatcatttcataaatgttaatattgaggggaattttcattgagtatattttcctacctcattaaaagcatttagatgcaaccagggttggactatttcttaaaaaacaaaacaaaacccaaggaactaaaacctaaactagatgaagatttaaagtgagggtattattggataaaaacagatttaattacttatttcaagcttgaaagggggctgataaataatgtaattatccttttcataagatttaaaagaattggcatcaaacttgctccacaagtttaggtatagaattgcaagccagtttttcaaggtggaaagaggaatttgggaatgaaaaggaagtactttatatagagtttaataacatacagaacttactaactcaaacaatatattaagttgggttataagaaatcgcccatagttaactgctttgacctacaaagcagttcatgtggttcaacctagtaaaaaacagaagatccaaaagggctaggtagatacatgcatacgtggataatagattaataatggatttttaaaggaatttaagaaatccatttaatccatatgtgtgtttaaggattggttgggtgttgaaattaggtaagttcccataacccctgagctgctttctcacctgacaaaagaaaagtataccctttacggatgctgaatttattgtagtgcagttttcaggagggtaaaaatctctaggtatcaactgaagggacagtttaagttactggttttaatgattaatctgaccattagaaacctgcccagtgattatttttccttggcttgtacatatttttgttaagagtaaagtatggggcgggcgcggtggctcacgactgtaaccctaccacttttggaggctgaggtgggcggatcacctgaggtcaggagttcgagaccagcctgaccaacatggagaaaccccgtctctactaaaaatacaaaattagccgggtatggaggcgcatgcctgtaatcccagctattcaggaggctgaggcaggagaatcacttgaacccgggaggtggaggttgcagtgagctgagatcgcaccattgcactgcagcctgggcaacaagagcaaaaactccatctaaaaaataaaaaataagtaaatatggttcttgtgccatagatattttggtctatgttaggatgttttcaatttaaatgcaggggttgttacccaatgtttgataaaagaaataatttacaaagaagctataatagctctaaactagtatatgcctaatagaatgtctctctctctctctctctctatctatctctctctctatatatatatatatatgtgtgtgtatatatatatatataaagtcaaaatttgcaaaattagaaggggaaattcatcaaagatataatcattgtgggagattttcttagtaatgaataaacacaagaagagatagaaaatttgaataatttaattcacaaattttaactaatagacacatgtaaaaccacatatgtgtttggaaactggttttatgatagaataagatgtagtttccaaactctgcgctgaggtaacatggggctccacagtgacctgaaagggtctttgggatatttcagttttgagagaaatacagtgacatctttcagacaccacagaactattagatctcgaggtagtccacagtttaaacacttaaataacactacattcctttctacaattattttatctaagagtgaaataattttttcttttagtttatttgtttttcttttctttttcccaaatgactactttggcgtacactgtggactgagaaagtttgggaacttctggtataaagcagatgtcagctaatttcagtgtattgtacatacatgttctctgacttcaatgtaattaaattagaaatcactgaataagacagttacaaaaacctcatagttgtgaacgttttaaagtatgtctgaatatattgaatatattgagtataaaagaaatcttaatggattctaggaatacctaaaaatgaacagtaggaaaactattatatgtcagaacctgtagaatacagttaaagtggtaattcaggagacaaatttatagcaagtagagagaaggaacaacaacaaaataccaggaattttagaagtcttattaatttaaatacagcataaatttaaaaacatgagtgcatcatctagttttttgcttcataatacaccactccaaactatgtagcttaaaacaatagccattttattgagctaacaattttgtgggttggcagagtgggttttctggcacaggccagttcaactgttttctgcaggcttcccttactgtctctggtcagctgacagggttggttggtgactagatgatctaacatggtctcaggtaacttggctgggacttgtttgttgtccacacagtcttattctccatggctcagtgttcacaaggtgatttcaggaaaaaagttgcaaaagagaacctgtccctgatgtgtaagcacttttcaagtctgtttgcttaatgtcccattgccaaagcaagtcacacagccatgcctacagtcagtgcgggactggatatgggaaggggaattactgccatttttgcaaacaatctacaatttaagtatgagcaaacttacgcaaataggcaaggcgcagtggctcacgcttgtaatcccagcactttgggaggccgcggcaagcggatcacttgaggccaggagtttgagatcagcctggccaacacggcaaaaacacatctctactaaaaatataaaaattagccaggtgtggtggcgcacgactgtaatcccagctactcaggagtttgaggcacgagaatcacctgaacccaggaagcagaggttggaagtgagctgagattgtgccactgcactccagactgggtgacagagcaagactcttgtctccaaaaaaaaaaaaaaaaaaaaacaccacagtgggtgcttaatgaagtgtgtgtgtgtaaaagccagccaggaaattttgttaccgaagccagaatgtgacccttgtcattggtttgcagtatgcacatttaattcatattatccttatgtgttcagtatttgtttcataattgcctaataaagttgaagtagttttaatggatttttcattaacagtagtccttatgacttcttaagcatttattggttgcctttcagaacaaaagagatgaacacttattgaaaaagagaaatgttccccaagaagaaagtctagaagattcagatgttgatgctgattttaaagcagtaagttaccatgttttaatagtgattttaaaataatttttatagtaactgtgagaacttcatttttaatataagaccaactttataatgataatgaaagtatattaactcaggtacactgtttaatgaatgtaattttgttaataaactctgctgaactattttttttttctttttaagcaaaatgtaaccctagaagctatattgcaggtatgttactaaattaatactctcgttttgaagtattttgaaattgattttttttttttcatttctgaaatttacatttggtattgcagaatgccacaagtgataacccagtggtccaattgagtgctgtccaggcagcaaggtaaatactaatttgtctagagagagaattatgtcattcctcagttgtgttacctggtagtctagaagttaatatgttgttatttcttttcacagtttgaaaattatagcaattaatttctcatatttattttcctagaaaactgttatccagtgacagaaatccaccgattgatgacttaataaaatctgggattttaccaattctagtcaaatgtctagaaagggatgataagtaagtatggattttactccctattcagtttttttcagttaacttaaaagtttggattattacttaaccagtgagttcagtttggttttgtacttatgatgtttttcaatcgtcatatattttaatttaattttcttattctgtgatcatatttagcagacccagagtgcttctcgttttcatttctgaaggatgtgtatgttttctaggaaatttttatctcctgtttattgcctgttttaacttatctcaaatatttatagtctttattaggattttttattactaatattttaaaacaacccaaataatgtttgagtcactctttgcttatgagcctatatatagattaacctcatgactaagtcaacatggatggtttccagaactaagtggctctttcttaccctgggaatcttccagctgattactgatcctctgtgttgtctttaacagaacttcatccatgataagttgtccaatgtcagactttttgtttgctgcaaattaagaataaggggacaggttatatttacccaggagagaaggagtaaaactccactggatatcttttgaggaactggccctatttccatttttgtttagtgatatctcagtgctgtgccttaaactttgttaatttggattaactggggagaatataagtttgaactccaaaacatattaaaacaaatgctttttttttgcatttaagagcatctagactgaaacttgggatattttgctaaatgttgtccaaggaattttcagttggctagataagaatagtggtatataaatgttgccactaagggtttttagtatttaaaaataccatttgctttcgttgtgtgccacaacctctcccactttccacccccaggcctgtaacactttttaaaatactatcatgtttgttttctgtaacagtgttacttaagtaaaggtaagttttattttagctgttgaaaaaataaattctggctggacgcagtggctcacgcctgtaatcccagcactttgggaggccgaggtaggtggatcgcttgagtccaggagttcgagagcagcctgggcaacatggtaacatcccagctctacaaaaaaaaaaaaaaaaaaaacacgaaaattagccaggcatggtggcacatgcctatagtcccagctacttgggaggctgaggtaggaggatcgtttgagcctggaatgtggaggttgtcctgagccaatatcatgccattgcactccagcctgggtaacagagcaagaccctgactcaaaaaataaattcggctgggtgcagtggctcacacctgtagtctcagcactttgggaggctgaggcaggtgggtcatgaggtcaggagatcgagaccatcctggctaacgtggtgaaaccctgtctctattaaaaaatattaaaaaaaatcagccgggcgtggtggcaggcgcatgtagtcccagctacttgggaggctgaggcaggagaatggtgtgaacctgggaggcggaggttgcggtgagccgagatcgcaccactgcactccagcctgggcgacagagcaagactccgtctcaaaataaatgaataaataggggggaggggggagggatagcattaggagatatacctaatgctgaatgacgagttaatgggtgcagcacaccagcatggcacatgtatacatatgtaactaacctgcacattgtgcacatgtaccctaaaacttaaagtataataataataaaaataaaataaaataaataaataaataagttctattctacttctacctttaggaccctccagttgttcttttttttttttttttttttttttttttttttttttgagacagagtctcgctctgttgcccagggtagagtgcagtggtgcaatcttggctcactgcaatgtctgcctcccgggttcaagcgattctcatgcctcagcctctttgagtagctgggattacaggtgtggctaatttttgtatttttagtatagatggggtttcaccatgttggccaggctggtcttgaactcttgacatcaggtgatcctcctgccttagcctcccaaagtgcagacattacaggcatgagccactgggcccggcctagggccccttgtttgtggccaacttctcttcttctttttttccttttctttccagtcttttatatgtagactcatttgtgtgtctgtgtctatgaaacataacatataatacagaaaaatatgctaaaatatatacagcttaatgaataattatgaaactcagacctctgtaaccaccacccaaagcaaaaacagaaaattttccgtgatttggatctgactttatggatttgtcatgggaagttgtgttataatgtaaaaggccatatactttggagccagattgactgtggttcaaatccagggtttgctgttgataaaaatccacgtggcttttgaacctcagctatctcatctataaaaattaggtgatggtaaggaatggaaataatacatacaaagcactctacacaatgtcaaacttatgataaatgtccatttattttttatttttatttatttatttttttgagaccgagtctcgctctgttgcccaggctggagtgcagtggcacaatcttggctcactgcaagctccgcttcctgggttcacgccattctcctgcctcagcctcccgagtagctggggctacaggcgcctgccaccacgcccagctaatttttttatttctagtagagatggggtttcaccattcacaggatggtctcgatctcctgaccttgtgatccacccacctcggcctctcaaagtgctgggattacaggcgtgagccaccgcactcggccataaatgtccatttgttattgcactcgttttttctatatcttttctcatttttttttatttttccacatgacatcttgaaagactttctttggctttataattttattttttacatttatccattttctcatttaagtcccccattcccagtattttgccaaaccacctaaccagcttaataactttctccttccagtctgaggcaacatatactgtcttactgtttttgatcttactgttttttttacttcttccctgcctctgatataccatcttatttcctgccttctgctagaattcatcatatacaggggaaattttaaaagtttgtggaaaagtggaatcaaaagacaataaaatatatgaaagataataaatatataaacttgatttctcaacataagctccatcaaggtcaagacacttttgtaagtgatactaccagccattgtctatccctaaagaactgagggtcctgggaatttaaccatgtcagcgcagtctttttcatgatattaactgaagaaaactagatgccctttacaggttgtttttttaagattaggaaacaaaaagaagtcacaagatggccaaatcagaactgtaaggtggatacctaatgatttcctattgattctcttgcaaaattgctcttgtttgatgagcagaatgaacagaaacattgtggtggagaaagactctctggtaaagctctctcaggcttttttctgctaaagctttggctgactttctcaaaacactctcataataagcaggtgttatcattctttggccctctagaaggtcaacaagaataataccttgagcatccccaaaaactttttagtcattacctttcctcctgaccagtccacttttgcttcgattgtactttgtctttaggatcatactgggaaagccatgtttcatctccttttacaattccttgaagaaatacttcaggatcttgatccctctggtttaaaattttcattggaagctctgctgttgtctacggcttatctgggcacaatggttttgacacctatcaaggggaaagtttgctcaactttaatttttcagtcataattttgtaagctgaaccaatcaagatgtctggtattggttattgtttctgctgttaatcagcaatcatcttctgttagggcacgaccaagattaatcttttcctcagatattgttgttgattgtttgccgctgtggatttcatcttcaacatcgacttgtcctttttttttttttttttgagacagagtctcgctctgtcgcccaggctggagtgcagtggcacgatatcagctcactgcaagctccgcctcctgggttcacaccattctcctgcctcagcctcccgagtagctgggtctacaggtgcctgccaccacgcccggctgactttttgtatttttaatagagatggggtttcaccgtgttagccaggatggtctcgatctccttacctcgtgatccgcctgcctcagcctcctaaagtgctgggattacaggcgtgagccaccatgcccggccgacttgtcccttcttaaaaggagttaaccatttgtaaaccgctgatttctttgggggcattttccccgtaaagttttaagtacatcagtgagttcaccattatttcacccaagcttcaccataaatttgatgtttgtttttgctttaattttagcaggattcatgttgctcttctaggggctcttttcagattgatgacttaccccttacccctcttagtgcctcaaactagatcatgttcagacgtgtatagaaagttagtatgagtttattttggtgcaaaaaaattgaaatccatggagtttttttcataatacacatttttaatgagttttttaaagtcccctcatagttcttctctgctacttcattttctcatatgttccatctttttaacctgtatatcactatttgctatatctctgacatctattctccttaaaaccttttgttcttggatctcttcaaccttttttctcttttttctttcttttttttttttttttgagatggaatctctctctgtcgcccaggctggagtgcagtggtgcaatctcagctcaccacaacctccgcctcctgggttcaagggattctcctgcctcagcctcccgagcagctgggattataggcacgcaccatcatgtccagctaatttttgtatttttagtagagagggggttttgccatgttggccaggctggtttcaaactcccgacctcaggtgatccatctgccttggcctcccaaagtgctggggttacaggtgtgaaccaccttgcccggacttctttaaccttttgatactaacaaccttgcttgctctcttccctgtttataggcttttcttcaaactccctaacctttgtctaatcttaatttttgctgactaaatccccccaatccttggtattccacttaagggaatttgtactctttcagctatcctaacttaatatctatcatttccttttaacaggtctttcctttatgtcttttttgtgacagggtttcactctgtcacccaggctggagtgcagtgacacaatcacagctcattgaatcctcaaactcctaggctcaagcaatccccccatcccacccccgcccagcatcccaagtagctgggactacaggtgtgtaccaccacatctggctgatttttttattttttgtaaaaatggggtctcaccgtgttgcccaggctggtttcgaactttttggctcaagcgatctgcctgcctcagcctcccaaagtgctgggactacaggtgtaagccccaacatgtcttttaataggtctctcctatatcagcctttaaccttttttagccattctgcataccattgatttgaacattattttctttcctccctttttcaatgccccatccttagcatatctgtagaatacactcctcactcccatcctgaaacacacacacacatgcacaaacaccctgttacttgcttcttagttagtttcagctctcttgatctaatccttgtcgttcctacacatcatgatccttccatgcatgatacctgttttatttcccactgtcactgcctttctttttaaatccatctttgaaaagctagttcagttgtcactttctttgtgaggtcttccattactattcgaaaatataatgatcttgttttttcaacaaaattatacagccttgtaatatccctagtatgtaaagcagatggtgtaatggagacagatggggttctagctttaagaccagcctagagcgtgtgatagtggttaaagtgagatgatgagggcctcaactagcacttgatattaggggtgattatataaatgtaagaaatgtttaagaggtaaaatcgacatgatatattgattagatgtgtctgtggagaggaagtcgaagtcaagggaaataatgactggctaaatgttgtaataccagtggacataaagaagcaggttcatagtgactggctttgggagccaaagagattttttaagtagagatggctgctgggtgcagtggctcatgcctataatcccagcactttgggaagccgaggtgggcagatcacctgaagtcaggggttcaggaccagcctggccaacatagtgaaaccctatctctactaaaagtacaaaaatgagccaggtgtggtgatgtgcacctgtaatcccagctacttgggaggtggagacgagaatcacttgaaccccagaggcagagattgcaatgagtcaagatggcgccactgcactcccgcctgggtgatggagggagactccatctcaaaaaaaaaaaaaaagtagggttggctagcaggcaattggattataacaaggtgaaattcaaggacaaggcaaagaatagccatatcttatcagtcttaagattcattaatttaagtggtagttatgtgtctaaaaagatgtgttattgtttttttacagtccttcattacagtttgaagctgcttgggcattaactaacatagcatcaggaacttctgcacagactcaagctgttgtgcagtctagtaagtaaattccttactgtctgaactttttgtgttttaatgatggcaaggaagtagagttttgtaataaagaaattttatcttgtaacattttttaaatgatgacttttataagttacttttgatgaccgatatctttttcatagccgtcattaatttatcatgaaaaatttttaattgtggttattaaaagaagagtagagttttatcttttggagtagacatcatgctgtgataacaggattttaaattccgtttctgatatcttcaagatgctgaatggcttctgccttttagcttatgacatattttaaattttactttcctcaagatgggctaataattattgttaaatgacactgacacaagctctttagaaaagtactagatatcaccacgtacgttattatagtatgggacacttagctaattttaggtgtggtaatcaaggtgattttaagtagcatgtgatatggcagtaagttacattgaatcatgtattgagaatactattctcaccagacccacaggtggctcatgcctctaatcccagcactttgggaggctaaggcaagcagatcacttgagttcaggagttcaagaacagcctaggtgacatgacaaaatcgtgtctctacaaaatatttaaaaattagcattgcatggtggcgcatgcctatagtcgcacctactcaggagacagaggcgagaggatcgcttgagccagggaggcagaggttgcagtgagccgagactgcacactgcattccagccccggcgacagagtgagaccctatctcaaaaacaaaggctgggtgcagtggctcaagcctgtaatcccagcactttgggaggccgaggcgggtggatcacgaggtcaggagatcaagaccatccttgctaacatggtgaaaccctgtctctactaaaaatacaaaaacaaaattagccgggcatggtggcgggcgcctgtagtcccagctgcttgggaggctgaggcgggagaatggcgtgaacccgggaggcggagcttgcagtgagccgagatcgtgccgctgcactccagcctgggtgacaaagcgagactccacctcaaaaaaaaaaaaaaagttatcatgtgacccagcagttctactcctaggtgaaaccaagagatatgaaaacatattcatacaaacacttgtacataaatattcacagcaatgttattcataactaacccaaatgttcattaaccgaggagtggataaagtgaatgtggtgtatacaatggaatacaattcagcagtaaaaaagaatgaagtaccaatacctgttaccacatggatgaacctgaagaatgttaagtgaagtcagaccccccaaaaaacacagtatgatttcatttgtatgaaatgtccagaataggcaaatctgtaaagacagaaagcagatatttaatggttgcctgccgcttggggaatgtgtggcagaggaacaaatgtggaatgactgccttaagtatgagatttcttttttcttttttcttttcttttttttttttttttaagacggagtctcgctctgtcgccaggctggagtgcagtggcgtgatctcagctcactgcaacttccgtctcctgggttcaagcaattctcctgcctcaccctcccaagtagctgggactacaggcacacaccaccatgtccagctaatttttgtatttttagtagagacggggtttcactatgttggccaggatggtctcaacctcttgacctcgtgatctgcccgcctcgcttcccaaagtgctgagattataggtgtgagccactgtgcccggctgagtatgatattttttttttttgagacagagtcttgctctgtcacccaggctggagtgcagtggcacgatcttggctcactgcaacctccgtctccctggttcaagcagttctctgcctcagcctccaaagtagctgggattacaggcgcccaccaccacgcccggctaatttttatatttttagtagagacagggtttcaccatcttggccaggctggtcttgaactcctgacctggtgatccatctgcctcggcctcccagagtgttaggattacaggcatgagccatcatacccagccaagatttcttttgaggtcctggaaatgttataaaattagattgtggcgatgtcctcacaactctgtataaatatgaaatgtcattgaattacacacttaaatgtaaatttattgtaattatatctccgtaaagttgttaaaactgaattaatttaaattttaagtaaataatacaagtaatacacagatacagcaaaaaaaaaaaaatgaggtagtgcacagttgattgaaatttttaaaaagtgatctagcttatgctggaaatgggtataatgtatacattctgtaaagagtaaggattatgagaaattattttaaagtataagatagacctgatatgagattaatcagttctttggttaatccccgtatcaggaattgagattttgtagactaaagcattacattttaaggttacatgtttggggtaggaactcttttttttttttttttttttttaatggattataggaaggatttcatgctgttgctttcttttagttaatggtatgatagcaacctttagatactgccagttggttacggtacttgactattactaggggaaaatactgaaattgattctttttagggtaaagatatttgccacatttgttcttccagctacaatatgccaggctgtgtatttgatcaatttctttgatctgaaatctgtaaactcttcaacatgttgctagtataaatattagtttttctttattacagatgcagtacctctttttctgagacttcttcgttcaccacatcagaatgtttgtgaacaagcagtatgggctttgggaaacattataggtaagtggtttgaaaggaatcctcttaagaatctaaattaacttttttcctacattggcatagccattacatactatgtttcctctgaatttaatgtgtgttgactctcttcttgcctcataagtactgacttaagatgatgctctttgaaaaggatatacagtttgctgttagcattggtaggttaaatttacgttccccagatcaaaatctggagaaacaacacttgatgcctttgactaatggtgaggaaacatagaacgtcagtgttcccacatgagccattgcatacatttcagactttctcatcctgaatgtaagttttttttaaatataattttcatttctgtaggtgatggtcctcaatgtagagattatgtcatatcactgggagttgtcaaacctcttctgtccttcatcagtccctccatccccatcaccttccttcggaacgtcacatgggtcattgtcaatctctgcaggaataaggatcccccgccgcctatggagacagttcaggaggtaaatgaagaattgtaaaggccagatggtatattttccctatgtttgtacttcaggaattcatatacaggggacaaaataatacatatactgatttcattgcaggtgtgagttttttgtttgtttgtttgtttgataacggagtcttgctctgtcgcccaggctggagtgcagtggcgcgatcttggctcacggcaagctccacttcctgggttcacgccattctcctgcctcagcctcctgagtagctgggactacaggcacccgccaccacgcctggctaatttttttgtatttttagtacagacggggtttcaccatgttagccaggatggtctcgacctcctgacctcgtgatctgcccgcctcggcctcccaaagtgctgggatgacaggcctgagccaccacgcccagccacaggtgtaagattttaaaagtaacgtaccatatttaattactcctatgaaataaaagttgagtgtcttactgtacctgaaagaatgtcagttcatcctaatgcctatttttttgattatctgcataaaaagaaaatataaaaattcagagagaaaaatacaaaaggaaaacaatctcaaagttttattactgtattgcattgttggtttaaagctataaaagggggttgctacaggcaaaactagtatacttacatgcaaatgttcttgaatgagtttgctttaagtccaattgattttttttcttcttcttcttcttttgagacagtcttgttctattgcccaggctggagtgcagtggcatgatctcagctcactgcagcctctgcctcctgggttcaagcgagtctcgtgcctcagcctcctgagtagctgggattacaggccagcgccaccacacccggctagtttttgtatttttagtagagatggggtttcactgtgtaggccaggctggtctcaaactcctgacctgaagtgatctgctcacctcagtatcccaaagtgctgggattacaggtgtgagccactgcccccacggcctaactccaatttattactgacaaaattggagttcttaaaagtgtgacatattttttgttaaatctactaattaaaacaaagtaaaaacttttttatttacatttgatatgtaaatagatccttgtgctttgcattttaaaaaaaaatcctacataacctttattcactgttgactgtgttatctcttttttttttttttttttttgagacagtctcgctctgtttcccaggctggagtgcagtggcacaatctttgcccactgcagcctccacatccggggttcaagcgattctcatgtctcaggcatgtgccaccatgccaggctaatttttgtatttttagtagaaatgggttttcaccatgttggccagctggtcttgaactcctggcatcaagcagtccacccacctcaccctcccaaagtggtgggattacaagcatgagccaccacacttggccaactgtgtatctttataatggacatctttctctagtacctgctactttttgttgctatgcaaaggtattttgtgtgatttcctacaaccccctgctccctttctcccatattttaaaaagagatctctggggcctgaatttaacaagcaaagctttgtactttgtactggttcgaattttcttgactaaaggtgaagttgaaaactttaatttgacttaagtagcttattaagtaaaatcgtatttttacgttaagcaggtaagtgagacaattacggcagttttaagtgtagcttttcttaaatagctgtaactgtatatttgcatctccattttttccacttgacattttatgccataaagaaggttattaaaaacaaatgtttttattttaaggtacattaacttctgccagatttatttggatattttaacttgttaattgaacatatttcagtttaacatttgagatatgtttttggtttttttagattgaatttatcaggttttcattttcctaaaagatattcagacaaatttaacattgtctttctcgccctacaaaccatatttaccgctttttatgtcaaagttgttcatttttacagacatattaattaactaatgttaagtattgtttattttctttcctcagattttgccagctttatgtgtcctcatataccatacagatataaacgtaagttaagaagcagcttaaatgtgggattttgctcttgatgggacagaaagggtttttatgtaagtgtcagcatacattttatcaacttgtcaagtttctacaacgtatttacagttttcagaaataggattaagcttaaattaggtttatagcttaaatctgtaagcagtaacagccagacagcaaaaatgctcacttttgagaaattactgcatatgtagtttatttctgtcattattaagtagtgtttttaaaccttaatatttgtaaagcggtaaaacctcatgaaacaccttactttttaaaaaaaatctcactggttcttacaacagataggctagatattattccccccattttatagaataagaagaaacggactctcagagagagattaaatgacttatctaaagtggaagagctagtaagggtcagagtcaatattcaaattaaagtcttctcataacaggtcttgggtacttgtcacaaaaccatgctgcctttttatgctacagtctttttagatatagtatagaagaatatatagttttaaatgcaaggcatttttaggtgattttttttcattatattcagatttagtgaagcatttactgtcaacgttctggcaagtttgatactatctaggcaatctgaaaattctcctaaatgcagtaaggtaaattgttacttttccatggagtaaaacagtggataaatttcggtgactagtgttgatccagtttcttttattctaactaacatctctttctgatttgttgtatatttgtgtttttgtaatctttatctacatacacataacatgtacatacatatgtgtatatgtgtggcagaattgtgaattgtgtgtaatttatcattgggacaaagaaatacatctttgcttacctttctcacaaggcaatataatttgtatataaaaattgtatcacattactctagctcatttgcagattttaagctctcaggatggaatcttttaaaggtagctaaagtcacttcgtgtttgacacagcctaaaatgtcattaaaatgaagtaaaacatgtttatatgccgtcttatttccaaaatggatataaagtgacttaacaaaagacatataagataatatctgtaaaggaaaaagtaaaatttatacagaagtttagttgttgctgttgaaaggtaagtttagttgtaagctttctgacagcaaagattaaaaggggaataagcaaaatatctgctgtttgcctcaggactttcccccagaacattatagaattaattataggcaaataaaagctttcaccatctgttggttgtgtttatgtgaaagctggggtattaaagtggcagtgtactgtagttacaggtatattagtcaagtttagcaaacactcacaaattattccacttaaagccagaattgtgccatgaattgtacactcagtgataagacataaagagaccatgccttctaagaccttaacattaaagatgtaaaaagagttaaaaggaaagaacttatgtcaagaaattgctgtgctggatctctctgtagactccttttatcttaccagtatccttgtaagataagttttattcttctattttacaaatacagagattgaaactcggtaaagttaaataatctttctaaggtcatgcaatgaatgagagccatacctgagaactgaagccaggtccaaggcctgtgctttttcataccatgatcacatattcagtataatccataggctcacagtgaaaaaaaaaatcataccataagcacataaacataaaacatggtatgaaagccaacaagaaaaaaggtaagatagagcagtgaccaaagtgctttattatggaagcacagataattttgctagcgaagcagaaagcttcgttgacaaagtaacatttgagacgagcattataaggagacagaagtggggacagagtcaaagattatagtgttcatagttaccatttattgagtttaaaatctgccaggcactgttttaagcacttttgctatgttaacccatttaattcttacaaaattcttgtgagattggtactctcattatctccatcatctacaaacgttgtaaaagaagcagaggtacttaagtaatttgtctcatgtcatataactaggatgaataggattttcacaggttgagagaaagtcatttcaagaacacgggggaagatattaagaactcaagaatacatggaggtttaagagaatacatgtagataataacctaatacgttcgctaaggagttaatttgcagagtctttgattcttttttttttttttttcttttttttccgagatggagtcttgctctgtcacccaggctggagtgcagtggcgcgatctaggctcactgcaacctccgcctcccgagttgaaggaattctcctgcctcagcctctccagtagctgggattacagtgcatgccaccactccctgctaattttttatatgagtttttgattctatattaaagagttttaagtttatcttgtaatgactgcagagtcattgtagattttttaaatcgagaaatgatatttgttttatacagataaaattatctgtaacagacaaataacacaaatatggaaggtttgaagtagggaaagtttgactgtaggtagatgtattttgctatcataataggtttagggaagttgatgaaggcatggactattactaaattgcaataataggaatcgttaagggagaaaaaactttgagtgttaggaaataaagtgagtagaacttggaacttgttgttcctcagtggcggtattttccaaaagcaaaagacaatacagattttggattcgtcagtatttaagggattgatgaaaacctgggcattgaatgagatcacctggaggaggctgtatttcggaaggagggctaaaaatgtaacttaggaattcctggcgtttcaggaatggcagcaagggaagaagaaccaacaaaggagtttttaaaagtagtatgatgatggctgggcacggtggctcatatttgtaatcctagcactttggaaggctgaggacagtggatcacttgaggtcaggagttgagaccagcctggccaacatagcaaaaccccgtctctactaaaaatacaaaaattagctgggcatcatgatgcgtgcctgtaatcccagctacttgggaggctggggcaggagaatcgcttgagtcggggaggtggaggttgcaatgaaccgagatcacgccactgcactcccacgtgggcaacagagcgagatgctgtgttaaaaaaaaataattaaataaaattaaagtgtgatagaagcataaaatgtggaacaaatagtggggaaaaaataaggcagagatttaataggttctagatcatatagtcttgtctaaagaactacataccctttttatgtagtagataaggagccagagaataaatggtcaaattttttttttaggttgatagctcaaaggctaatatagatcaaaggcaagaaaatcgcttgagcccaggagttcaagcccagcctaggcaacatactgggacctcatctctaaaaataaaaaattagagactacaagtatttgcagtttcagggtgcctaacacccagctgtagcttatcttctcccagcctttgagatattgtcatggagaccccactgaaaaccattagttgagctcagtctacaatttcattattatattagttagaaaaaaaaatagttttctgctaatagtagtgaccatgtaatggagaaacatcttaaggcatcatgttgttttgcacaggattctgttttgtggacacagtttatttaaacacactattatggataggcatttaggccatttcctgaattttgcaaatgtaaaagtattataccaatgactattgtgtgttttcatattattggaggtatatcttcagggtatattcttagaagcaggattgctgggtcaaagagtaaatgcatttgtaatttcgttgcatactgccaaattccctgctgtaagggttgtgccattttgccttggtatctgggaaggtttgtattcttgttctagtggttgcctttattgtggttgcccttattcttatatcttttcttttttactgttttgatagttttaaatgacatttttcgactcctttatctattatgtagtgtatgcagtatgcattcaaaagtgaaagtgactttctcagtatccttgccaatagagtgtgttgtcacatttaaaatttttgctcatctgataggtgagaaacagtatctcagttttaatttgcattttactttttatgaatgacgttgaacattatttcatttgtttaagggccattttaatttgtatctttgcgaacagactagtcatatttaatgtctgtttttctgtaggatttttggtctttttcttaggttttaagagttctttatatattaaggatattagttctgccatacttaaaatacttccctagtttgtcttttgtctttgactatgatgttttgccatgtgaactttttgtatataatcaaattcatcaattttttttaattgtatctacattttgtctgaactatagatgttttatgttagagaaatatctatacattccttttttgggtgttctatcaaggacactgaaaaaatgtaatgaatttttcagtgtctgtagagaaaattctattattttctccttaaatctattaataaaacttatattaatgatatttttaaaaattgaaccatccttgcattctttgaatcatctcacttgatcattatatgttagtttctcaatgtagtatgtgattctgttaataatattttatttcagatttttacatcagcattcacgtaagtgatattggtttgcagtttagcttttgttcaatttattaggcaataatttacattaattacaaatattaatattaaatttaattatgttaataccattagttaatggtgctataatcatgatgtattaagttttatacttctattgttttattaaagttgaggtgttaatgttatgcttccttcattttctgtactctggaacaatttatatagcatcaagtctgtctgacctttgaagatttgatagtttccctcttaaatcctttggggatttggtacttttttgtggagttagtttcatgataattttctttatttttgatatggaagttggcttgtttaagcactctttctaaagaaggtcagtttttataaactattgttctagtaaattattcattgcatctatgtttacttgcattaaagtgtgcagggtagttttttgttctaatttattattttaagggttattttatcatttctgattttgtgtatttgtgccccctccctgctcttttctaattaagttaggtaggactttttcttagttgtttttttgtttgttttttgtttttttcagagaaccagggtttcagtttattagttagatctatgatttttctattctttatctcattacttttgtatttttcattgactcatcataatcacccaaaatccgtagtttacactgttgttcactcactcttgctgttgtgcattctatgggttcagacaaatttgtataaatttttaaggctatgaattttcctttaatcactgttttaaataaatgtcatagattctgatgtgtggcatttttgttttaactttttagaaattttgttgagtttaggccaggcgttttggctcatgcctgtaatcccagcactttgggaggctgaggcgggtggatcacctgaggtcaggagtttgagaccagcctggccaacatggtgaaaccccatttctactaaaaacacaaaaattagctgactgtgatggcacgcgcctgtaatcccagctacatggggcactgaggcaggagaatcacttgaacttaggaggcagagattgcagagagccaagattgtgctactacaccccagccggggtgacagagtgagactctgtctcaaaaagaaaagaaaaatagaaattttgttgttgggtttttctgttttgtgtgtgtgtgtgtgtgtgtgtgtgtgtgtgtgtgtgtgtttcacctaagagctgtttaatataaggctattaaatttctatatagaaaagcctttttggttttcattttattaatgtataagttttttgccttgtgataggcttataatgtttctgacttaggtaatttattgatgttttctttgaacctaatatgatatttgtacatgtgcaagttgtagttgccattatcagggtataaagttcaatatatattcataagagttatacctttattttttgcctatttgacttccctcatatgacagtagtatgttaaaacctcctattattagtatgtttttacatatatttgtgtgtgtgtgtgtgtgtgtgtttattctctgctttaaaacagtgattgcagggctatttggttaatagatgtttataactgttgtattttcatgataaattgtgggatttaactttgtaaagtatccttttttctttgtaattctttttagattaaattctactggtcgtcttttaacagggttacaacctcagctttctttttatcatttacttggcatacttttgctcatccctttatttttagcctttccaaattctttgttttatgtgtgtctcttgtatacagcgtggaattgggttttgttttgagagccagggccaatttgaaaatctttttttttttttaataggttagttaggcccattcacataggttgatagattgatttgaactgtcattttgtgaaataatgtccctgtgtttttttttttctctgctaagcatacttttgtctttctcaattttcttttggtatttggggaagtttgtatttttgttctagtggttacctttattcttacacctttttaatgctctcttactatctgttttgacagttttaaatgatatatttttttacttctgtctcttacctgtgcaatgatgcatgagcttattctattttctcttcttgcctcaacctcccattttttaatctgattctagacttatctattttgccaaatttggaacatatttcttcatatttttttcagctccgcctttccttgtagggtctctgaagacacaaatattagatctattgttattgtgctggaagttcctgagagttaatttctgtttaatctttttttttttctgttattcagtttggatgatttctattgatgtatctttgggttcatttatttttttttcccccttctatcatgtcgggtttttttgctgagaattcccactttaaatttgtttcaaatgtgttcataattgttcaccagtgcatttttatgatagttactttaaaatcttatcaagtccttgtcagataattccaatatgtgtgtcatctcaatattggcatctgttgactgtcttttctcttttgagaatttcctggatcttggtatgaagggttattttccattgtagcctacacatattggtgttatgctttgagacccctgtttctaggtaaatctagttactgttactgccagggtgggcagtagccagactttgttctcagacccagcatctgcagacacctccagcagggaggcctcctcacttccagagtgggaaatgggctggtaggtgggctcagctcttaggcccagcttctgtcctctcttttacacagtcttgaggcaagaggtccagacaaaagctagaatttaattttttctcctcttacagataatggaaatttttagtgttctctgactcttagtaatgctgaaggggtgtgggttatatgtgtagttctattttatttattcatctatatccttttttgaagggtatgtgaattcaggtgcctgctattattttagggcaaaaagatgtgatgtcttcaatttggatgacctaataggaaacatcttgattttgcataagctacaaccagtgcttatattcctctgtgacgacaccaagcaatgccacatacaagatctttgaccttgaatgaatcaccagatcgctaagcctgttttcttctatgtagttgcaaagttaggataggcctagggcatggtttatactccaggtttatacttcagttggggacacatttcaggagattttcaaacagttttttccccagatgaagttaaagtgccaagtcatttcttttattggtttactttagtagcctgaaaaattgtattgctaaatatgttggaaaaccagtagagtaaatagatgacctttctgttctcttctgaacttgaaacagtatggtgtgttggcctcattcttgtaaatagtgtttttctgtgggattattaggtagctaatttgtgagggcagggagaattacttttctgcctgtttttaaattcatctgtctgatacataaatgcagaagttggaatagaagttttcccagacttctgtgtctcattttctgtgaagaatgatctgaggtaggcactgaaagaaagataaggtactttctacttaatagattaatcagctaagcagatatttttgccactaagctaaaacttgaaatttggttactttttctgtcactactcctgaggtgtgttgaacaagtaaagcattcaaacaaatatgtaaaatggtttttcttttgtgtttcctgtagattcttgtagacactgtttgggctctgtcatacttgacagatggaggtaatgaacagatacagatggttattgattcaggagttgtgccctttcttgtgccccttctgagccatcaggaagtcaaagttcaagtaagtatttttaaatttttcttatttgtatacagttgtgtttgctataaccagttaacttgtacagctaggctttaattctatctgtaagtgcttatcttccacatttcttctgctagtccctgagcctgattttgttgatttccaaatctttatctcacccagtttctttgctgagttccacacttgtatagccaattgttcttgaccctttatacatatcatctaagaactccttcaagctttccgtggttaactagacagaaatgaaacgatcatctcccacaaacctgctcttcttccttgtctaccttcagtgaacagcatggcctaagctagaaattttgattcctccttgcaattcccattccattacaaaatcatttcaattcttcttatataggttcaaatctgtctctccttatctatctagaacaacagatttagttcaagactctatctttcccccaaataattgcaataacctaattgcatttcttctttctctctcccactctaattaggggtaggcacttattagatctgttcatcctgctttaccaaagtgactttctaggtggaagtgtgtgcccattccaggcgtttattaaaatattatatatatttttgagatggagtcttgttctgtcgcccaagctggagtatggtggcgcgatctctgctcaccgcagcctctgcctctcaggttcaagtgattctcctgcctcagccttcagagtagctgggattacaggcatgcaccatcacaccagctaatttttgtatttctagtagagatggagtttcactatgttgcccaggctggtcttaaactcctgacctcaggtgatcccccccgcctcggcctcccaaaatgctgggattataggcatgagccaccatgcccagccttaagaaactggacttcttctaaaattttaatttccttttattttttgaatctttttccaaccaattttcacacaatttttttttttcataaagtttcagtttttcacaagagactatttaaaattcagaatagctctcagactgcttggtgctttgtgaaaggatgaaataagtgttatttatgccttgcatttttactttttctcaggattatgaaaaatatagaattagtcttataagcaaataaatttatagaaaacattttatccccaccctagacagcagccctcagagcagttggcaacatagtgactggcaccgacgagcagacccaggttgttctcaattgtgatgtcctgtcacacttcccaaatctcttatcacacccaaaagagaagataaataaggtaaggcatataatgtcctcattatgctatttctttctgtgtctcatttttaactgtctccttgtttctattgctacttgtatgtttttcttaaaagccactgcagcgaagatgagaattattttaaatcacctctgcaaatgtttttcttcaacttttttttttttttttttgagacagagtctgtctgttgcctaggctggagtgcagtggcacgatctcggctcactgcaacctctgcctcctgggttcaagcgattctcctgcctcagcctcccgagaagctgggactacaggtgcccgccaccacgcccagctaatttttgtatttttagtagagatggggtttcaccatattggccaggctggtctcgaactcctgaccttgtgatccgcctgcttcagccccacaaagtgctgagattacaggcgtgagccaccgcgcccagcctttttcaacttttaatcgcttctggtaggtgctgccctggtcatcacagagtaaaaaacatttttagactacctgtgtttctatttaagtagactgagcatagcaacaatcattaaattagtagccgcttgaaagtgcagacaaaatctgccatttgaatgggctggtatttttttaaacaaaccgatcataaaaattttgatctcccagcaaaattagtttggacccaaagacgaggtgcctaaattcaaggatcataaaaaattactctttttaagatttcaagcttcatagacaagtttattattaattgtgtaatatgtacttactagtatgtaataagtcttcatgcctggcttatttcatctagcatgttttcaaggttcattcattttgcagcatgtgtcagaactttattctttctatggctgaataaatattccattgtatgtatacaccacattttgtttttacattcttctgttgatggacacttcggttgtttccaccttttcactattacgaagaatgctgcagtgaacattggcatacaaatacctatttgagttcccgctttcaatttctttggatatataactgcaagtagaattgctcgatcatatgttaattctgggtttagctttttgaggaaccaccaaaccgttttccattgcagctgcactgttttacattcccaccagcagtgttactagaattctaatttctccacatcctagccaacgtttattttctgttaaaaaaaattactgacaatcctagtagatgtgaagtggtgtctcattgtggtttaaatttacgtttagttggccaggcatggtggctcatgcctgtaatcccagcactttgggaggccgaggcgggcagatcacgaggtcaggagattgagaccatcctggctaacacagtgaaaccccgtctctactaaaattacaaaaaattagccgggtgtggtagcagacgcctgtagtcccaactactcaggaggctgaggcaggagaatggcatgaacccaggaggtggagtttgcagtgagccaagtttgtgccactgcactccagcctgggcgacagagcaagactctgtctcaaaaaaaaaaaaaaaggaaaaaagaaaaagaaataaatttacatttagtttactaaagttttatctgcctaatatactaccatcacccaaacccagcagaactgatcatttcttcttcgtcatcataactatatttgtatagttgcttgagtataatttgactgttgggttcttatagaaaagtatggtgtcaaaaaacacattttatagatacatttgttccagtgaagacaaagaagccagagactttcagactctgggccagttacttttactaaagaaatttttaacaatataggtgatttttttttttttagctaaatgaatatattccataattggaaacaactgagaagtgaggaagctgggcagaagtcagcagagaaaggttccggcctgtgatgtagtatgcttttaagtgagggtatcgtggggggtagaggaaaatttcatagaaatgccatctcaacttcagcaagcaattagttacttcaaaaattttttgccttgaaaatttgttacttgcattttgagactatcataggaccctggaagtagaagttaccaacttgattttcttccctcagcatttctgtttgaaactttttaaatctacaaaaaatgtgcaagaatagtatagtgaacacccatgtactctaaacacagattcagcaattattaacaacttaccacagttggatggcaaaacaaattcatttgtggaagaggaagatacacatgtgatactaacctgtaaacagctcacagacgtgtttatgacttataaatcccttagttttagaatatttatgttatatagacccatgctagactagttagatggttaatttttatggaatacttgaatgactatatcttgtgagtaaatattttttaaaattaaaaaagaaatcacctttattagaagtagtttttaagtagttttagaaattcagttgtatagtggctgggcgcggtggctcatgcctgtaatctcagcactttgggaggcctaggcgggtggatcacgaggtcaggagatcgagaccatcctggctaacacggtgaaaccccgtctctactaaaaatagaagaaaattagctgggcgtggtgacaggtgcctgtagtcccagctactcgggagactgaggcaggagaatggcgtgaacccgggaggcggagcttgcagtgagccgagatcacgccactgcactccaacctgggcgacagagcaagactccgtctcaaaaaaaaaaagaaaagaaaaaagaaattcagttgtatatttatttctgtcttttagaggaagctaatgcacagacatgtaagctccatgaataaagatttctgttttgttcatttctataaaatcaccatttcctagaataatgcctagcttatagtaggcctatatattaatgaatggataaatgccaggttattggagcccaaatataattaatggaaatttccttataacttgtttaaaatggaagattttgtatacctaatcactttttaggtgcagtctctttaacgtaattcaggtgattttgttattgtctatataaaatatattagaaagacattaaaggtattatttttcaaataaaggtgccctatattttgttcaattataggaagcagtgtggttcctttccaacataacagcaggcaaccagcaacaagttcaagctgtaatagatgctggattaattcctatgataattcatcagcttgctaaggttggtcatattatgagttcaccgtgtctgttaatctgttaataaccaagactttttggataaagagtccattttatgatctcatttttaaccttcagggggactttggaacacaaaaagaagctgcttgggcaatcagcaacttaacaataagtggcagaaaagatcaggtgagtttgaaaacctgtaactgtcatgattgttaatactggaaagcatgctgctctcttatgtttcgtagttgctgactgtattgtgttctttttggggaaaagataattattattattttaagagatggagtctcactatgttgcccaggctagagtgcagttgctattcacaggcatgaccataacgcactacagcctccaactcctgggctcaagatagcctcctgcctcagccttccatgtagcacgacaccctactgggaaatagataattatataaataaaaatatttcttctcttttgttgtctaggttgagtaccttgtacagcagaatgtaataccaccgttctgtaatttactgtcagtgaaagattctcaagtggttcaggtggttctagatggtctaaaaaacattctgataatggccggtgatgaagcaagcacaatagctgaaataatagaggaatgtggaggtaagagtggattgatggaagaagagtatttgagcactggaactctgaaacataagttctttaaagtcaacttactagacagaaaattactaggatacgttgtttttaaatgatcacagtatgttgcttttctttattcactatatttgcattccaagaggattttccagaagacagtagtccatactttgcaaaatcaggttgtgaaagtcactgtatagccttctagagattgacaacatagcttttttttttttttttggagacagaatcttgctctgtcgcccaggctggagtgcagtggcacaatctcagctcattgcaacctctgcctcccgagttcaagcaattctcacacctcagcctcccaggtagccgggattacaggcgcacaccaccacacccagtggatttttgtgtttttaatagagacgaggtttcaccatgttggccaggctggtctcgaactcctgacctcaagtgatccacctgcctcagcgtcccaaagtgctgggattacaggcatgagccactgcgcctggcctgacattgcattttaggaaacactaatacttctcttgaagtcacagtgcatgacagcaaatttaagagcccttacaacactacataaattttaaagctttatttaatccagcatttcttaaacttcttaacaatgaaacactttttttgtgtgttattaccatgtaattctgtggaccccactttaggaaatattatttcatatagttggaaaaggttactgacttctgagtcacctagatattttgtttcaatcttgtaatgattcttaggatttccacaactacatcctgaagttattactgtggcagttactttgaaattttaatgagaaataattgtgatttgacatactgtattattctttaatgacatgtgaaacatatgttaaaattctgtttttaaatgtacatgttcaatatgtactaacatgtttaaaccttaaattagtttatcataatgtcatgttttagattttacatttcattgactactttatatgaatattctattgtttatttatttatttattttaagagaaaacaaatgcagtagtaccgtagaatattcagactgggaggatttctttctttctatttatttatttatttatttatttatttatttatttatttatttattttttatttatttattttttttttgagacagagtttcgctcttgttgcccaggctggagtgtaatggctcaccgcaacctccgtctcccgggtttaagcaattctcctacctcagcctccctagtagctgggattataggcatgcaccaccacgcccggctaaatttttgtatttttagtagaggcagggtttctccgtgttggtcaggctggtcttaaactcccaacctcgggtgatctgcccgcctcggcttcccaaagtgctgggattacaggcgtgagccactgcacccagccgggagggtttcttgagaagaaattatcccacagattttaaggagtcttgtccaaggtgacagaagtaggttgtgatagaagcaaagttaaaatccagatcttcttactattaagataattaaaaattgtagtcaggttcataacacagtaagtttgagcaacttagagaattactactcttcagctttttatcaatatagttacttttgtctataggagtaataggatacatattaatattttataattgtataaagcactttggcaacgatttcccccattcttttggtttattagtatataagaaaaaattgcaactattttaaaataaccttcaaaaagacatttcaaggaagaatattaaggtgtgaaattgataaacatgtatatgatgtgtggagtaaatatattggaaatataaatgaaggcattctatgatatctgttctggaaatattttctcccaggttcattgtggctataggacataagacctctattcattttttaaagaaagtttttcaaaatttaaatctttatatcttttataccaattataaggttctaaaaactcattttgtggttatataaaggtaataacatttggaaaacaaagagaaagatacaaattactttatgaggcagtaagattaataagattggccgggtgcagtggctcactcctgtaatcccagcactttgggaggccaaggcgggcgaatcacgaggtcaggagttcgagaccagcctggccaacatggtgaaaccccgtctctactaaaaacacaaaaaattagctgggcatagtggtgggcacctgtaatcccagctacttgggaggctgaggcaggagacacttgaacccaggaggtggaggttgcagtgagccgagacgtgccactgcactccagccctggctacagagtgagactccgtctcaaaaaaaaaaaaaaaaaagaaagaaagaaaaaatgcccaggcgcagtggctcacgcctgtaatcccagcactttgggaggccgaggtgggcagatcacgaggtcaggagatcaagatcatcctggctaacatagtgaaaccccgtctctgctaaaaatagaaaaacttagccgggtgtggtggcgggcgcctgtagtcccagctacttgggaggcttaggcgggagaatggcatgaacccaggaggcggagcttgcagtgagccgagatcacacctctgcactctgcactccagcctgggtgacagagcgagactccgtctcaaaaaaaaaatagattagtaaatttatattaaagcactgtgggggagttggttctagtactgtcacaaacttgccatataacttgaaataagtctctttacatatttatgccacagcttccctctgtcaaatggattgtttgggtgtttttttagactgtctgcctcagggatccgggtacctcaagggcttctaagaaggaaaaaattagtgggattctggtcctccaactagaagcagccccgtgttttgtctgttttttagacaaaccactatcttagatgggggagcagtgtgttctgagttccttaggatttctccatgattaaaatgagtgtggttttgattagtatctccttatcaattaaccagttattttgattattttatttttaccaggtttggagaaaattgaagttttacagcaacatgaaaatgaagacatatataaattagcatttgaaatcatagatcagtatttctctggtgatgatgtaagtagatattaaaatagcgtgtatcttcatgtaaatgaaaacctatacatgatgtaaatttactaagagttttccttttattattaggatgacataagtttgtactgtatttctattagacattccatcagtcactttctcttaaatactttgaaacttcattataaggtaaagttgtaaaaacagttcttgtttcatttctaatctattaactaggaagaaatagtaattatataagtgatatatgttcagataggttaaataaatctaggtcccagatacagaaacttaacaatgcagtttcgaaacgtgttaaattttaaattgttaaatttcttaataaaattattgatttactcgaatatttttagttggttaaagcattcacatagaattatttgctaagaggtaaaaagtcaattccacttacatcataatgtatagtatcataacctaataaggatttttttcttgttttttacagattgatgaagatccctgcctcattcctgaagcaacacaaggaggtacctacaattttgatccaacagccaaccttcaaacaaaagaatttaatttttaaattcagttgagtgcagcatctttcccacattcaatatgaagcaccaccagatggctaccaaatgataagaacaacagcaacaaaaggctccaaaacacacatgcctctttgttttgatgcttctaaagcaagccatgtctcagtcactttgcagttgccaaaagtcactatcacatggactgtaaatgcatatgcatgatttcctaaactgttttagaactctccttaacaatctcaactaccctatttttccctgttccctggtgccacaggctgacaactgcagtctccagtttagaataaatattccatagtggtgacatgtcagctgcccactgatactcctttggaaaatggtgcgctgtggatcaagacactttggtatgatgcatatacaagttggaagactaaagaggtgcagtgtgatctgagcctccatcattgtcctccacaaacatattttcatattctttatgtggaagaatagattttaaagtacaagccaaatgattttcattggtggaactgacacaaaaaaagtaacttaaaaacaagaaacttggttattgaataaacagataagtttaaaaaaaaaaaaaaactacttcatctaccagtaattgatgtgtttattatctgcctcagaagccagggttggaggaagaactttagatatggatattaatgcttttgccattatacctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattggatatggttgatttatattgggtttaaactgtggagctttcatgtttactgtaatttagtcttaaaatattttttacttagtaaccagtgcttttgataatgtggttggcaacaaaccagcaactatttagaagtgtcataagagttcattctttgagtattgggaaagttaattcagatcctactcaaaaagcatcttcacatattaaaagattcagacagggatctgtgtagaggagtaatttgcagttatttaacataaacctgatttgcagtgatctctaagtaattctgcaaaatccggtattactatgtcaagttattgcttttggtaaattgtctgacccagttattaatgaaagaatatggatttaaaaatttttaaactaaataatttgtgctgtcacagaaatggtattgttgctcttgtttactgggtataatttcccaatgcattgatgtgaagggatagaaaatctaaactaatttagttatccattggggggtgtatttactgtgatgaagatgagacagatgccatcagagctttgtgaatcagctggggtgttttcactgataaacaacacatagcaggtgtgcattcattacaaatatatgtatctgccaaggtggagccactttaaagagtgagttttgtcttgtatctaaagtggatacaagcgtatgtttaaactgcaagatttttacttgctagagaatctgttttaatatagtggtttggcctctgattatttataggttttataaattttagaatcaatttctctttaaggtggctcagatttttcaactcttgtgcacataaaattgagttgaagttcattgtgcctttttttctttatccaaattttgagttaaagcttcatatggtaactgcatcctgttcggacactatagtctaaatttttgaaactgtgtggtgttcgctaaaagtaggaataacaacgtaaaagctaattaaggtcacaaacttcggtgaaacccttaaaagtccaaatcttcttgatattgtgaaccgtaccccttccagtttagtttcttctggactttccttacttaactgacagttaccttttaaaatttgcacacattatgattaaaattgggcctctactgtgatgattcctatttcctctcatgttttaaagtgcaaactaacatttaagtgaacattagcatcaagtagtgcagacacttgtatgcatttccttgattcaatttgtgaccttaccagttttgaattggaattgcaccatttcgtagataaaggaaactaagtatattgctgcacttttaagttttcaaaacagtgtttaaaaattgcattgttatttttttttaaactcagtttaaaaagactaaaacgttctttcaaaagaggcatctaaatgtgttcctaattttgtatatgggcttaggttttgtaaccaataaaaaaagctgctatcaaatatg
